United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 11

SEQ ID NO: 30676 - DNA, 1689 bp, Triticum aestivum
  Clone ID: PAT_TA_30676
cacgggactccctaatttggtaggatttttagagttccagaagtttgcattaattacagattgctacagattgttctgtttttgacaaattctgttttacgtgtgttgtttgcttattttgatgaatctatggctagtaaaatagtttataatacatagagaagttggaatacagtaggtttaacaccaatataaataaagaaggagttcattacagtaccttaagtagttctttgttttctttctctaacggagctcacaagatttctattgagtttttgttgtgaagttttcaagttttgggtgaattctttttggtggattatgaaacaaagagtggcaagagcctaagcttggggatgcccatggcacccccaagataatccaaggacaccaaaaagtcaaagcttggggatgccccggaaggcatcccctctttcgtccacttccatcggtaatttacttggagctatatttttattcaccacatgatatgtgttttacttggagcgtcttgtattatttgtgtcgttgcatgttagtctaccacaatcatccttgttgtacacaccttttgagagagccatacatgatttggaacttgttagaatactctatgtgcttcacttatatcttttgagctagatagttttgctctagtgcttcacttatatcttttagagcacggcggtggctttattttgtagaaattgttgatctctcatgcttcacttatattattttgagagtcttttagaacagtatggtattttctatggttataaaattggtcctaatgatgggcatccaagttgggtataatagaaactatcataggaagtgaattggatgctatgatcaatttgatacttgataattgttttgagatatagaggtggtgatattagagtcatgctaattgggtaattgtgaatttaaagaatacttgtgttgaagttggcaagtcccgtagcatgcacgtatggtaaaagttgtgtgacaaatttgttgcatgaggttctcttttgattgtcttccttatgagtggtagtcggggacgagcgatggtcttttcctaccaatctatccctccaggggcatgcatagtagtactttgcttcgagggctaagtagacttctgcaataagtatattagttctttacgactaatgtgggtccatggatatacacacactcatccttccatttagctagcctctattatgccgcgcaactttcaccggtatcatgcacccattatttaccttcctcaaaacagccaccatacctacctattatggcatttccatagtcattccgagatatattgtcatgcaactttccaccgttccgttattatgacacgctccatcattgtcatattgctttgcatgatcatgtagttgacatcgtatttgtggcaaagccaccgttcataattctttcatacatgtcactcatgcatcattgcatatcccggtacaccgccggaggcattcatatagagtcatattttgttctaagtatcgagttgtaatttttgagttgtaagtaaataaaagtgtgatgatcatcattattagagcattgtcccagtgaggaaaggatgatggagactatgattcccccacaagtcgggatgagactccggacggaaaaaaagagaaaggccaaaaaaagagaaggccc

SEQ ID NO: 30677 - DNA, 983 bp, Triticum aestivum
  Clone ID: PAT_TA_30677
gcgaacgcgccaaggggctgccgtggaaggagcaccggcggcaggagcgcgataggagccagagagaggaggatgcccgcacgttggccgggatggcagaggccatcccggagagcaacgttgggttcaagatgttgaagcagatgggatacgacccggcagcccgcggcgccggcgccgagccggtcggaatcgagatccgccgctctcgggccggactcggggcggagccagatgcttctgtggcgccgctgccgcagccatcggaacccaagacgcgggaggaggaagaaagggagagaaagcggcaggaggagatggtggtggtagctgaggtcgaggaagagcacgcaatggaagggacggaggttggtgtgggacttccgcaaggctgaggcggcgctcgcgcactgagagaacagggaggtggagccaccggcccccgatggggaggagaaggagaagggagaagatgaagaggaagaggtgatcactgaagagggtttacaaaccatattggataagctgcgtgttcaacaccactattgcctttactgtggatgcaagtttgaatcagcaggagcactggcaaatgaatgccctgggcctaatgaagatgatcactgatccactctgtcaatggtgactagggcactgtccttcccgctacaggtgatgattctatgagcaatgcaatctgtattcagtaatgattggcattaccgcattggattcttcacatactggattacaaacttgctgtttcgttttgcctctatcatgcagattatggtaaatgtgacatttgggatattcttgattagttgactgtgtacggttaaccttagtccttgacacaatcactggttcatagccaactggagaaactgagctccagcatgttagtggaaacaatatattcttaactactattatgtgtattagttttctgtatcaaatgtctcagcatgagaaaaaaaaaa

SEQ ID NO: 30678 - DNA, 1357 bp, Triticum aestivum
  unsure (1)..(1357): unsure at all n locations
  Clone ID: PAT_TA_30678
agaaattttttcacgcctttaatgtattcgggagtgtgtctgttaccgaacattcatgtcggttcatctctgcgtacatcataaatagataagtgaccaaattaatagaagttcatcatcacattaaaaccaaagtgcatacatagttctcatctaacaacatatagctctccagagcatctaattaattaaaccatacattgaaactatgtaaaacatttcaatgcgaaaacaaatgcgatcataatcgcaaccaaggtaacaattgatccaacggcataatgataccaagcctcggtatgaatggcatattttctaatctttctaatcttcaagcgcattgcatccatcttgatcttgtgatcatcgacgacatccgcaacatgcaactccaatatcatcttctcctcctcaatttttttttttatttttaccttcaacaaattgttttcttcttcaactaaatttaacctctcgacaatagggtcggttggcatttccgattcacatacctccacatccgaatcatagacaggacgagggccgacgggggcggataccaaaaccatcgcacacggtggtgccggcgatgagatcggcgcgggtgatcgacggcggtgaagacggggacggggcgtgacggaccgctaaacctagacaaatctcgaggaaaatggagctttgaggtcgagctccgagaggagaaagcttaactagtgtggctcgggcatttcaccgaacacctcatgtgcataggaggtgagctagagcaccacaaagccctcccctcgccgaccagagaaaaacatagcactggagtgctctgctcgcgggcgaggggtatatataggcacctcattggtcccggttcgtggcatgaaccgggactaaaaggcagcctgtggtcccggttcaagccaccaaccgggaccaatggtggtgggccaggagcaaggcccattggtcccggttcgtcccaccaaccgggaccaaaggggcatgacaaaccgggaccaatgcctccacgaggcccggcagcccctgggctcatgaaccaagacagatggccatggggtcccggtctggactgaaccgggactaatgggcaccgangcttggacaaacctgttttctnctantgagatacttcgacatcaacaangatggggcttgcaacaattaataactccattggnggttaangatcaacaacgttggatttccctttcaacaacaantttttgaacccntncccttgcnanttaacctttnngnaattcccntttggcntanaattgggaatgttcnaanccccatggttccncttaaannccagggtncggtaangncaatttct

SEQ ID NO: 30679 - DNA, 1376 bp, Triticum aestivum
  Clone ID: PAT_TA_30679
atctcaccctcttgcgccgccatcatcgtttttgttcgcgcccgagcggctgcccgccatggccatcgtcgtagccgcggccagcacgctcgctgtcgcctgagaagaggtgcaggaggacggacgtactcctctacttcgtctacaccaccggatcgacgccgtagaactccaacgccgctgcccgcttcatcttcatcctcggacgccgtcggacctcctcgtcaaattcgccgccgtctgcagctcctaaccttccaccggcctttcttgtgccccgcgaccctgagaccgatgtcggtgcccctgtgatcgactacatagacgacccctccttcttgtctgagcaaccagatgttggagcccaggatccagacgccaccgtcgacgacgactcctactgcaccaagggtgcctagtactacgtgcaggacgccgacaacgaccaggagtagttaggaggatcccaggcaggaagcctgcgcctctttcaatctgtatcccagtttgtgctagtcatcttaaggcaaacttgtttaacttatgtctgtactcagataagattgcttccgctgactcatctatgatcgagcacttgtattcgagccctcgaggcccctggcttgtattataatgcttgtatgacttattttatttgtaaagttatgttatgatattttcccgtgagtccctgatcttgatcgtacatatttatgtgtatgattggtgtacggtcgaatcggggtcgtcacatagacgcacgctgggcaagtggcagccgattcggcgggatcctcggaacgtgcgtgcaggtatttgttgctaatcaatgtacgtgcgcgcggggtgcctacacgtgcaggtacatgtcgatctggagcacggcgttgttggtggtggcgttgtacgtattcgtccgaagcaggccgtatccagcagcccctcggaaggcgccggtgccgccgacaaccggcagctccctgacggtgtcgaggatggcgtccctggcgaacacggcgacggtgctgccgttgtgcttccccgccgtgaagagcatgttggcgctgagcagcagcgcggcgtccgtgctgcgacgcgaagaggtagaacccctgcgccctcccgatgaccggcgacgccgcgccgggcccctcggtgagagcgtcgtcgatggtgtacatgtcgccgaagcggttggtggggtcgttgggcagcggcgtcaggcccctgacgacgcgcaccgccgtggccgcgctcggcgccaccgccgtcacgatgtcgtgcatgtagaagcggaggtgcgtcgtggctggagccaccgcggcgacgagcgccagagaggccagtgccatcagctgcacgctgtggtggatggc

SEQ ID NO: 30680 - DNA, 2098 bp, Triticum aestivum
  Clone ID: PAT_TA_30680
caaggagaagggaactgacggctgccagggaaagaaactaggcgaaactctggatgctcgatcaaacacttgatgtctaatgaagcatggtgtagtagcaagctagcaactgaattttttacataccatggatttctttctacctctatttgatgctcggtggtgctggtcagaaggacagattggttttatggtggcggcctcggctactcccggtgcttgctaaagagcagggccagcaataggcctttagaatacatgcaagcaaatttatctccaggtgacttattaagatgcatatggtacttttcagccatggcaaatgcacaggtgtagctgcatcttgatgagaggatcgatgatttattatggtagacatggaactaagatttggtaaaaaaaaatatgatgatatgataggtgatttatgatgtgctattttagataacgatactaagtttttattccatagatgacatttggttgttctgcattttttatcttttgcaaagatagatgttataagagataaacatcatatacaggttaactctttgtgtgcctattagcatgccttgctgccaagtggaagtagtttatataatgctcataaatagagcttccctgtgggaaggatgaggcacactcattgatactttggttttatataagataggagcatgtcatgctatgcgaaaatctgtttgaagatctaatttcttatttttctattttgtcggttagaaaaccagtgaaggggagccttggcgcagtggtaaagctgctgccttgtgaccaagaggtcacgggttcaagtcctggaaacagcctcttgcagaaatgtagggaaaggctgcgtacaatagacccaaagtggtcggacccttccccggaccctgcgcaagcgggagctacatgcaccgggctgcccatttttttgaactctttaacccaggctaatcctgattgcaaagttattgtaattccttcttaggattgataggttgttctctaagaaaccacagtcgaagtcaagaaacgacatcaaaaagaccgacgaaattattgaagacacagaagaacaagagctatttgtcgaacgcattcggctagaaaaaattgagctaagcataaaaaacctgatgagtaagatgacaattcaagaacctacatttgataggatgattgtagtgtacaggcaggctggcatgaaggctaagcctagtcgtggaatatttgtaaagcatttcaaaaatattccaatggctgatatggaaattgttctgccagagaagaagaatcccactttaacaccaatggattgggtcaagtttcttatttctgctgttataggtttggtcactcttgttggttctcttgaaatgccgaaggctgatgtatgggttgtcattgcaatcatgtctggggtgattggctattgtgctaagatctacttcacgtttcagcaaaatatgacactatatcagaatttgattacaaaatcaatgtatgacaaacaacttgatagtgggaaaggaacacttctacacttatgtgatgatgtgatacagcaagaagttaaggaggtcataatttcttactatattttaatggagcaagggaaggcaactatacaagatcttgatttgcattgtgaggagctaattaaagaggagtttggcgccgagtgcaattttgatgttcacgatgctgtaaagaagttagagaagcttggcatcgttcatcgggattcgattggcagaatcttatgtgctccgttaaagcgtgccaacgaaatcataggcaccacgactgaagaaatggtgatgcgagcacaacagaaccctgcttcttaactgtcgcctcaaaggaaatgtatttctctgtataaaagcacaagccagaactcagaaggcatctgctcatcctcaaggaacacgttgctttcaatgtaccatctgtacgcaatatcttagattctattttccgacattggcgagttctattgagtgtaactaagggtgccttgtttaggtccaaaatctggacatgttacttgtaaataataatcatatatgtaatgaaccaatagttcccc

SEQ ID NO: 30681 - DNA, 1885 bp, Triticum aestivum
  unsure (1)..(1885): unsure at all n locations
  Clone ID: PAT_TA_30681
tatctttcggaatagtttatcgtttgctctagtgcttcacttatatcttttagagcacggtggtggttctattttatagaaataattaatctctcatgcttcacttatatcattttgagagtcttttagaacagcatgataatttactttggttataaattttaaaagctaagagaaattggatgcttgatagttgttttgagatataaaggtggtaatattagaggtgtgctagttgagtaattgtgaaattgatgaatacttgtgttgaagttggcaagtcccgtagcatgcacgtatggtaaacgttgtgtgacaaatttgaagcatggggtgttctttgagtgctttccttatgagtggcggtcgggggcgagcgatggtcttttcctaccaatctaaacccctaggagcatgcgcgtagtgcttagttttttatgacttatacatttttgcaataagtatatgagttctttatgactaatgttgagtccatggattatacgcactctcacccttccatcattgctagcctcttcagtaccatgcattgccctttctcaacttgggatttggtgcaaacttctccggtgcatccaaaccccgtgataatcatacactcttcacacataaacctccttatatcttcctcaaaacagccaccatacctacctattatggcatttcgatagccattccgagatatattgccatgcaactttccaccattccgtttatcatcatgacacacatcatcattgtcatatttgccttgcatgatcatgtagttgacatcgtatttgtggcaaagccaccatgcataatttatcatacatgtcactcttgattcattgcccatcccggtaaaccgccggaggcattcacatagagtcatattttgttctagttttgagttgtaattcatgagttgtaaataaatagaagtgtgatgatcatcattattagagcattgtccccaaataaataaataaaaaagaaaggccaaaaataagaaaaaaaagctaaagaaaaaaaagaaaaaaatgcgaaataaaaagaaaggccaaaaaatgaaaggccaaaaaaaggaaaaaaggaaaataaaaagggggcaatgttactatccttttccacacttgtgcttcaaagtagcaccatgttcttcatatagaaagccttttatgttgtcactttcatatactagtgggaatttttcattatagaacttggcttgtatattcctacgacgggcttcctcaaatgccctaggtcttcgtgagcaagcaagttggatgcacacccactagtttcttttgttgagcattcatatatttatagctctagtgcatctgttgcatggcaatccctactccccatgttgacatcaattgatggacatctccatagctcattgattatcctcgtcaatgtgagactttctccttttttgtcttctccacacaacctccataatcatattctattccacccatagtgctatatccatggctcacgctcatgtattgcgtgaaagttgaaaaagtttgagattatttaagtacgaaacaattgcttggcttgtcatcggggttgtagaattcgggaacatttttgtgtgacgaaaatgaagcatagcctaactatatgattttgtagggatgaacttctttagccatgttattttgaagaagacatgattgcttttaataatatccttgaagtattacatttcctaagtcaatatgaactttatttgaacaattggtctgaacatcaagccacaataaagaaatacattgagaaatatgttangnacatccacgtcaaaatccgttttaacattaccacccaaggggggccgggtaccaatcgccctaantgagtc

SEQ ID NO: 30682 - DNA, 1098 bp, Triticum aestivum
  Clone ID: PAT_TA_30682
gcgagtcccccgcacctacacaaaacaaataaatcctcgcaaccaacgcgataaggggttgtcaatccctacacggtcacttacgagagttagatctgatagatatgataagataatatttttggtatttttatgataaagatgcaaggtaaaataaaaggcaaagaaaatagctaagtgttggaagattaatatgatgagaatagacccgggggccataggcttcactagtggcttctctcaagagcataagtatttctacggtgggtgaacaaattactgttgagcaattgacagaattgagcatagttatgagaatatctaggtatgatcatgtatataggcatcacgtccgagacaagtagaccgactcctgcctgcatctactactattactccactcatcgaccgctatccagcatgcatctagagtattaagttaaaaacagagtaacgccttaagcaagatgacatgatgtagagagataaattcatgcaatatgaaataaaccccatcttgttatcctcgatggcaacgatacaatacgtgccttgctgcccctactgtcactgggtaaggacaccgcaagattgaacccaaagctaagcacttctcccattgcaagaaagatcaatctagtaggccaaaccaaaccaataattcgaagagacttgcaaagataacttaatcatacataaaagaattcagagcagattcaaatatttctcagagataaacttgatcataaacccacaattcatcggatcttgaaaaacacaccgcaaaaagagttacatcgaatagatctcctagaagaggaaggagaacatggtattgagatccacaaatagagaagaagccatctagctaataactatggacccgaaagcctgaggtaaactactcacaactcatcggaagggctatggtgttgatgtaaaagccctccgtgattgattccccctccgacggagtgccggcgaaggctcaagatgggatctcgcggatgcaaaaggttacggcggtggaaatagttattcgtggtcgcttctgatgttctcggggtacgtggatacatataggaggaagaagtaggt

SEQ ID NO: 30683 - DNA, 1866 bp, Triticum aestivum
  Clone ID: PAT_TA_30683
tcaatatggttgttcaaccgacaacaatttgctgcatgcattcagcaattcacctactggaaacggaatgagccctatcggaatgtgcccttcaatgatgtcaaatgctctgaagattgcaccaattgggaaggacaacaactggtctaaatatgatcaagtattctcaaacagcaaccagtccctcggcgcagcgtttcagcactcacagtcataccaagatcgcaaaagtgaccatatgagctcgagtcctgggacattaacagggcctgagtttctgtggggcagcccaaagccttatccggagcattcccagtcctcatcaatgtggcgtccaccaccagttggtcatgcaatgtcatctagtagccgccctcagggtcagggcttcctgtatggtagtcgccaggcttcattgttcggatctttggatcaaaaccgtcatcatgttgggtctgccccttcaggagctccgtttgagagccacttcggatttttgcctgaatcgcccgagacatcgtttatgaatcaagttaggtttgcaaatatggggaacattggcggtgctaaccgaaacgggggaagcctcatgctgaacatggcttctcgtgcttccttgaatcctgtttccgctctaagtggaagcctgacagataataactctactaacttcagaccagtaccgtcgccaaggcttgggcaaccaccattctttgggaacaccacatatcaaggacctggttattatggacttgacagctcctccattgagcgtggtcgtaaccgccgagttgacagcagcgcgttccaggcagatagcaagaagcagtatcagcttgatttggacaagatccgtaaaggagaggatactcggacaacattgatgataaaaaacattccaaacaagtacacatccaagatgcttttggctgcaattgatgagctccacaaaggaacatatgacttcttctacctgccaattgatttcaagaacaaatgcaatgttggttatgcgttcattaacatgatatcccctgtgcacattgtatctttctaccaggctttcaatgggaagaagtgggagaaatttaacagcgagaaagtagcatcattggcgtatggtaggatccagggaaggaatgcactaatctcacatttccagaattcaagtttgatgaacgaggacaagagatgccgccccattctttttcattccaacgggccagagactggaaatcaggaaccatttcccaatgggatatgcatccacatgcctctggatggtggggcaggctccagcaaggagcccctcggctttgaagaggacgacaatcccagcgagatcaagatatccggggagaaatccatggtggggagtttgtagattatataaccaacgaagaggctcggagtcgccgccgcggagtctaactgtcttgtgacgaaaggcggtgtccacccccaaactgtataaaagtgaggaagattggtttagtagtgcaggaattatggcgtggcgtggcatggcgcatctaccggtttttgtcgcagcggatgtcgcccccctgaagcagcggctttgaatcgcagtcgggagtttgctaggtccccccctcttttgaccccccgaactctgtacagatagatgtggggagttgatgatgactggatgatgatgcttttggtttggttttctgtaaagaacaccaattgtacagtcggatggatacttgtgctagttctgcatgcttttattttctgtatggttgaaactcaactcaagacaggtctaatcgggtgatgccagtgtggaaatatgaatccccgcattgtgcaaaaaaaaaaaaaaaaaaaaaaaaaaaaaaa

SEQ ID NO: 30684 - DNA, 1478 bp, Triticum aestivum
  unsure (1)..(1478): unsure at all n locations
  Clone ID: PAT_TA_30684
cagtaagtataacacccatagaaataaggaattagttcattacagtaccttgaagtggtcttttgttttcttttgctaacggagctcacgagttttctactttaagttttgtgttgtgaagttttcaagttttgggtaaagatttgatggattatggaacaaggagtggaaagagcctaaccttggggatgcccctggaacccgcaagataatctaaggacacctataagctaaagcttggggatgccccggaatgaatcccctctttcgtcttcgttcatcggtaactttacttggagctatatttttattcaccacatgatatgtgttttgcttggagcgtcatgtcattttattttcccttgcttgctgtttgaataaaataccaagatctgaaattcttaaatgttagagagtcttcatatggttgcataattattcgactactcattgatcttcacttatatctttcggagtagtgtgttattgctctagtgcttcacttatatattttagagcatggtggtagttttattttgaacaaatagatgaactctcatgattcacttagattattttgagaatcttaaatagcatggtaatttgcttaaaatcctaatatgctaggtattcaagaataataaaattctcttaagagtgtgttgaatactatgagaaatttgatacttgataattgttttgagatatggagatggtgatattagagtcatgctagtcgttaattgtgaatttgagagatacttgtgttgaggtttgtgattcccataacatgcacgtatggtgaaccgttatgtgatgaagtcggagcatgatttatttattgattgccttccttatgagtggcggtcggggacgagcaatggtcttttcctaccaatctatccccctaggagcatgcgcgtagtactttgtttcgataactaatagatttttgcaataagtatgtgagttctttatgactaatgttgagtccatggattatacgcactctcacccttccacctttgctagcctctctaataccgtgcacctttcgccggtatcatacacccaccatataccttcctcaaaacagccaccatacctacctattatggcatttccatagccattccgagatatattgccatgcaactttccaccgttccgtttattatgacacactttatcattgtcatattgcttgcatgatcatgtagttgacattgtatttgtggcaaagccaccgttcataattctttcatacatgtcactcatgcatcattgcacatcccggtacgccgccgggaggcattcacatagagcatattttgttccaaagtatcgagtgtaatggttgagttttaagaaaaataaaagtgtgatgatcacattattaaagcatgtcccaattgaggaaaggatgatgggagactagatccccaaaaatcnggatgaacccngncaaaaaaaaaaaa

SEQ ID NO: 30685 - DNA, 644 bp, Triticum aestivum
  Clone ID: PAT_TA_30685
ggggaatacttccaatatcaacacacaacgaaggcaacaactgtagtacgtacgtaagtgtagcttagcctcctcctgtactgcatgccatggcgatgctgaagaagaacacgagctccctgagcttcgtcatggtcgccctcatggtggtcatggctgccacccttctctactcatgcgacgcccgcaaagtgaaggataagcccaccgctttccccgtggcggggaagtgcttctcgaggtttttcgcgaactgcaccgagccgcggtgcaagaagttctgcgtccagccactccccggagccgtctgtatcgacaaaaaccattgttgctgccctattgcttagttataagcgccgctgaagcagtcaggctaagaaatactagttaaaggtggcaataagtaatattcgtacacttccaaatatatactacccctgtttctaaatataaggcttttttgcagttcaattcagttgaactgcaaaaacgtcttatttttgaacaaaggtagtatatgctaatgttgtttctatttatgaactgtcgaccccaaagatttatgtattgaattaattgtataattatgtcaccacaacaatgtgcttgtgatcaagattaattacttccatttggtttgagat

SEQ ID NO: 30686 - DNA, 1560 bp, Triticum aestivum
  Clone ID: PAT_TA_30686
ggtcgacccacgcgtccgctcagtagcagcctctgaccccaacggactctcagccgcctcctgctctgcacaccgagaaaatggcggcggcggcggcggcggtgcgctgtgctgagcagctggttgagagggagatgagcgggcgcgacgcctcccacgacgccgcccacgcgctccgcgtccgggacctcgcgctctccctcgccgccgagcagggcgtctcctcccccgaccgcctcctcatcgtggaactggctgctctcctgcacgacatcggtgattacaagtacaccaaggataatgtggaggatatgagcattgtcaaaaggtttcttgaagaggtagggttggaggagggacagagggaggaaatagtggccattattacagggatgggattcaaaaatgaggtttcaaataagcttaatgcggagcccactcttgagtttgcaatcgtgcaagatgcagatcgtctggatgcaattggtgcgattggtgttgcaagatgttttacatatggagggagcaagaacagtgcattacatgatcctaacgtacttccacgggataatttgtcaaaggagaagtatatgtccaaggaggagaaacaaacatcaattaatcatttccacgagaaactttttaagttgaaggacatgatgaagacccgaggctgggaaaaagagagcagagaaaaggcacaagttcatggaaaattttgtggctgaattctatgaagagtggagtggcagggcttgaagttgaccaaccagaccgtgggctgggagggcaaggcatgaagttggccaaccaatgttcaccaacttacatcgataaaaagccatggattaccatctggttttacatcactgttcaggttcccatgaaactttccccaaaacgcaagagctctgaatataatgaataaatgacaagactctttaccaagatatttcagagtccctggatgttgcctatgtttttcttttctgattaaaactctgaaagattgctctttggtaatataagcagttctatctgattgagagcacatttatttaaaaagatctcatcatatcttgcaggtgttttatattcaaataataaaaaaaaaaaaaaaaacgcgagactagttctctctcgtgccgaattcggcactgctgatcatgttttgctcgtggaagaggcttagtcaacgggtctgctacattcagatccgtatgtactttacaattttctatgtctccatccttgacatattcactaatggagttgaagcgtcgcttgatgtttttggttttcttgtgaaacctgggatccttagcaatggcaattgctccagtcttgtgacaaaagattgtcattggacccaatgcactgggtactacccctaggtcggatatgaactccttcatccagactccttcatgtgttgcttttgaagcaactacgtactccgcttcacacgtagatcccgccacgccgctctgcttagaactgcaccaactgacagctccaccatttaatataaacatgtatctagtttgcgagttctcgtgc

SEQ ID NO: 30687 - DNA, 1893 bp, Triticum aestivum
  Clone ID: PAT_TA_30687
gaggataaactatgatgatagttgatttgattctgctaaaaaaacagaaactttgcacgcacaaatataattttgttaaatcacaggaacgcgattttgtgttgattcattttgctgataatcaataaacaaattttccagaacttcctattttggtaggatttttagagttccagaagtttgcgttagttacagattgctacagactgttctgtttttaacagagtctgtttttcaagtgttgtttgcttatttcgatgcatctacggctagtaaaatagtttataaaccatagagaagttggattaaagtaggtttaacaccaaaataaataaagaattagttcattacagtaccttatgtggtggttttgctttctttcactaatggagcttatgagatttcctgttgagttttctgttgtgaagttttcaagttttgggtaaagatttgatgcactatggaataaggagtggcaagagcctaagcttggggattcccatggcacccgaagatattcaagagtacacaaaagcctaagcttggagatgcccccggaaggcatcccctctttcgtcttcgttcattggtaactttacttggagctatatttttattcgccacatgatatgtgttttgcttggagcgtcgtgtatgatattagtatttgctctttagttttccacaatcatccttgctgtacacaccttttgggagaatcccacttgattggaatttattagaatactatatgtgcttcacttatatcttttgagctagatagtttttgctctagtgcttcacttatatcttttagagcacggcggtggcttaattttgtagaaattgctagtctctcatacttcacttatattattttgacagtctcttagaacagcatgctatttgctatggttataaaattggtgctagaatggtaggcatccaagttgggtataataaaaactatcataggaagtgaattggatgctatgatcaatttgatacttgataattgttctgagatatggaggtagtgatattagagtcatgctagttgggtgattatgaattagtataaatacttgtgttaaagtttgtgtttcccgtagcatgcacgtatggtgaaccattatgtgacgaagtcagagcatgatttattctttgattgtcttccttatgaatggcggtcggggacgagcgatggtcttttcctaccaatctacccccctaggagcatgcgtgtagtactttgtttcgatagctaataattttttgcaacaagtatgtgagttctttatgactaatgttgagtccacggattatacgcactctcacccttccacaactactagcctctctagtaccacacaactttcgccggtgcactacacccaccatataccttcctcaaaaaatccaccatacctacctattatggtatttccatagccattccgagatatatttccatgcaactttccaccgttctgttattatgacacgctccatcattgtcatactgctagcatgatcatgtagttgacatcgtatttgtggcaaagccaccattcataattctttcatacatgtcactcttgattcattgcatatcccggtacaccgccggaggcattcacatagagtcatattttgttctaagtatcgagttgtaattcttgagttgtaagtaaataaaagtgtgatgatcatcattattattgcattgtcccagtgaggaaaggatgatggagactatgattcccccacaagtcgggatgagactccggacgaaaataaataaataaaagaggacaaagaagcccaaaaaaggccataaaaagagaaaggcccaaaaaaaaaaaacaaaacaaaaaaaaaaaagcgggcgct

SEQ ID NO: 30688 - DNA, 1488 bp, Triticum aestivum
  unsure (1)..(1488): unsure at all n locations
  Clone ID: PAT_TA_30688
tgtgcttcacttatatcatttgaagtttggattgcctgtttctctttacatagacaaccgccatttgtagaatgctcttttgcttcacttatatttgttagagcacgggcatatcttttgtaaactctcttgcttcacttatatctatttagagagatgacaggaactggtcattcacatggttagtcataaaatcctacttaaacttgtagatcgctggatatgatatgtttgattccttgcaatagttttgcgatataaagatggtgatattagagtcatgctagtagattaattgtgaaattgagaaatacttgtgttgaagtttgcaagtcctgtagcatgcacgtatggtgaaccgttatgtaacgaagtcggagcatgatttatttattgattgtcatccttatgagtggcggtcggggatgggcaatggtcttttcctaccaatctattcccctaggggcatgcgtagtagtactttgcttcgagggctaataaatttttgcaataagtatatgagttctttatgactaatgtgagtccatggattatacgcacacttaccatttcgcaattttctagcctctacggtaccgtccattgccctttctcaccttgagacgtggtgcaaacttcgccggtgcatccaaaccccgtgatatgatacgctctatcacacataagcctcattatatcttcctcaaaacatccaccatacctacctatcatggcatttccatagccattccgagatatattgccatgcaacttccatcatcatcatatacatgacttgagcatttattgtcatattgctttgcatgatcgtaagatagctagcatgatgttttcatggcttgtccgtttttttgatgtcattgctacgctagatcattgcacatcccgggtacaccgccggaagcattcatatagagtcatatctttgttctagtatcgagttgtaatattgagttgtaagtaaataaaagtgtgatgatcatcattatagagcattgccccatgaaaaaaagaagaaaaaagaaaaaaaagaaaaaaaaaaggaaaggccaaagaagcctaaataaaaaagggggccaaagaagcccacccaaaaaaaagaaaaagaaaaaantaaaangaaaagggtcaacgttactatcctttttccacacttgtgcttcanagtagcaccatgttcttcatacaaggagtctcttatgttgtcactttcatatactagggggaatttttcattatagancttgggcttgtatattccaacgatgggcttccctcaaatgccctaggtcttcgtgagcaaagcaagttggatgcacacccacttantttcagtttgagctttcatacacttatngctctaggtgcatctgttgcatggcaaatccctactccctttgcattgacaatcaaattgncgggcaatctccaatagcccgttgattaacccgcggtccgatgtgacga

SEQ ID NO: 30689 - DNA, 1662 bp, Triticum aestivum
  unsure (1)..(1662): unsure at all n locations
  Clone ID: PAT_TA_30689
ttaatcaccacatgatatgtgttttgcttggagcgtcatttttttttgctttctgtttgaataaaataccaagatctgaaattcttaaatgttagagagtcttcatatagttgcataattattcgactactcattgatcttcacttatatctttcggagtagtttgttgttgctctagtgcttcacttacatctttttagagcacggcggtggttttatcttacagaaatagatgaactatcatgtgtcacttatattattttgagagtcctaaacagcatggtaatttgctttggttatgaatttagtcctaatatgatgggcatccaagagggatataataaaaactttcatataaagtgcattgaatactatgagaagtttgatacttgatgattgttttgagatatggagatagtgatactaaagttgtgctagttgagtaattgtgaaattgagaaatacttgtgttgaagtttgcaagtcccgtagcatgcacgtatggtaaccgttgtgtaacaaatttgaaacatggggtgttcttttgattgccttccttatgagtggaggtcagggatcgcgggatggttaactcctaccaatctatccccctaggagcatgcgcgtagtgccgaggtttttgatgacttgtagatttttgcaataagtatgtgagttctttatgactaatgttgagtccatggattatatgcactctcacccttccatccttgctagcctcttcggtaacgtgcattaccctttctcaccttgagagttggtgcaaactttgccggtgcatccaaaccccgtgatatgatacgctctatcacacataaacctccttatatcttcctcaaaacagtcaccatacctacctatttatggcatttccatagctattccgagatatatttccatgcaactttccaccgttccgttcatcatcatcatgacatacattacttttgtcatattgccattgcatgatcatgtagttgacatcgtatttgtggtaaagccactacgcataatttttatacatgtcactcttgattcattgcaccatcccggtacaccgccggaggcattcatatagagtcacatcttgttctagtttcgagttgtaattcatgagttgtaatcaataaaagtgtgatgatcatcattattagagcattgtccccccaaaaaaaggccaaaaagaaaaaaaggccaaagaaaaaaaagaaaaaaaaggaaggccaaaagaaaaaaaaaggccaaagaaaaaaaatagaagggaaaaataaataaataaaaagggggcaatgttactatctcttttccaaacttgtgcttcaaagtagcaccatgttcttcatatagagagtctcatatgttgtcattttcatatactagtgggaatttttccttatagaacttggcttgtatattcctacgatgggcttcctcaaaatgccctangtcttcgtgagcaagcaagttggatgcacacccactagttttcctttggttgagccttcatacattttatagcctccnagtggcatcccgtttgcatggcaatnccctactcctcaangttgacatcaattnatgggcatccncatagcctggttgattanccnccgcnaatggtagactttnccctttttggct

SEQ ID NO: 30690 - DNA, 1601 bp, Triticum aestivum
  Clone ID: PAT_TA_30690
cgtccgctcacaacaagcagcaagcgcttgatgggaacatgtttattaactatatcggcaggaagtgctgtgaccttggcattcagatgaacaagacagcatgctttgtgcatctatcggcaatgtcagtgctatcagatccacaccagttgtacgaggagctgaacaaagctaagcaggctgcggtgaagaagaaccagaagctgcagctcctcttctgcccgatgtctgaacagcatcctgggtacaagacactgaagctgatctgcgagacacagctggggatccaaacccagtgtttcttgagccacctcgcaaacaaaactcagggccaggaccagtacatgtccaaccttgctctcaagatcaacagcaagctcgggggcatcaacgtccagctccaggacaagctcccactggacaacggtgttccttacatgttcatcggcgcggacgtgaaccacccgtcacccgggaatgtggaaagcccgtcgatagcagctgtggttgcgtccatgaataggggcgccaccaagtacgtgcctagaatccgcgcccagccgcaccgctgtgaggtgatcaagaacctcggcgagattgtccaagagctcatcggtgtctttgagaagaaggccgccgcgaagcctcagaggatcatttacttccgtgatggcgtgagtgatggacagttcgagatggtccttaacgaggagcttgcagacatggagaaggtgatcaaggtgaagggctactcgccgacgatcaccgtgattgtggccaagaagcggcaccacacgcggctgttccccaaggagcacaacgagccgctgcagacgaagaatggcaatgtgctccctggcacggtggtggacaccagaattgtcgaccctgtgacgtacgacttctacctgtgcagccacaatgggctgatagggaccagccggccgacgcactactacaacctgatggacgaacacggctacgggtcggacgacttgcagaggctggtgtacaacctctgcttcgtgttcgcgcgctgcaccaagcccgtatcactggcgacgcccgtctactacgctgacctggcggcataccgtggcaggctctactatgagggcatgctggcgtcccagccccaggtgcgcagctcgtcgtcctcggcctcctccgcagcggcgggtgcttctgacttcagcaacttcccgatgctgcacgtggatcttcaggacaacatgttcttcatctgacgctggcgtttcacccggtgttgcttagggtcttggtcgggtagaacatatatacaaactatttcgtattgtctgaacttggtccggtagaacatataccccaaactgcttggtatggtctgaactttgaacttgaaatgtgttgctagttgtgtcattgtccgtgtgcttcaggtctgtgtttttaactatagcttgtgttggttgcctgaccttggcttgactgtatctttggagattctgatgatgaaattccatgaagttgtaacaactttcgattcatttcatcatctcataaatctcaacggtgggaatttgcttgtcacttgatatggatggtgtaattatttgctc

SEQ ID NO: 30691 - DNA, 2016 bp, Triticum aestivum
  unsure (1)..(2016): unsure at all n locations
  Clone ID: PAT_TA_30691
gggattattacagactgttctgttttagagagattctgtttttgatgcatagtttgcttgttttgatgaaactatcgattcatatcagtgaattaagccatgaaaaatttatattacagtagacacaatgcaaaaacaaaatatgaattggttttcaatagtacttagagtagtgatttgcttcattatactaacggatcttaccgagttttttgttgaagttttgtgtggatgaagtgttcgataatcgagaatgtcttgatgtgagaagaaggaagagaggcaagagctcaagcttggggatgcccgaggcaccccaagtaaatattcaaggagactcaagcgtctaagcttggggatgcctcggaaggcatcccctctttcttcaacaagtatcagtatgttttcgtattcgtttcgttcatgcaatatgtgcaagtcttggagcgtcttttgcatttagttttcacttttcttttatgcaccgtgctggtatgagatagtccttggttgatttatagaatgctcattgcacttcacttaaatcttttgagtgtggctttatagaatgcttcatgtgcttcacttatatcatttgaagtctggattgtctgtttctctttccatagaaaactgccatttgtagaatgctcttttgcttcacttatatttgttagagcgtgggcatatcttttgtagaaataattaaactctcttgcttcacttatatctatttagagagttgccaggaattggtcattcacatggttagtcataaaatcctacataaaacttgtagatcactgaatatgatatgtttgattccttgcaatagttttgcgatataaagatggtgatattagagtcatgctagtgggtagttgtggattgtagaaatacttgtgtagaagtttgtgattcccgtagcatgcacgtatggtgaaccgttatgtaacgaagttggagcatgaggtatttattgattgtcttccttatgagtggcggccggggacgagcgatggtcttttcctaccaatccatccccctaggagcatgtgcgtagtacttcgtttcgataactaatagatttttgcaataagtatgtgagttctttgtgactaatgttaagtccatggattatactcactctcacccttccaccattgctagcctctctaataccgcgcacctttcgccggtatcatacacccaccatataccttcctcaaaacagccaccatgcctacctattatggcatttccatagccattccgagatatattgccatgcaacttaccaccgttccgtttactatgacacgctccatcattgtcatattgctttgcatgatcatgtagttgacaccgtatttgtggcaaagccaccgttcataattctttcatacatgtcactcttgattcattgcatatcccggtacaccgccggaggcatccacatagagtcatattttgttctaagtattgagttgtaattcttgagttgtaagtaaataaaagtgtgatgatcatcattagtagagcattgtcccaagtgaggaaatgagatggagactatgattcccccacaagtcgggatgagactccagactaaataaaaaaggagaggccataaaaaaagagaaaatgccaaaaaagaagggaccatgctactatccttttaccacacttgtgcttcaaagtagcaccatgatcttcatgatagagatctcctaagatatcactttcatatactagtgggaattttcaatatagaactgtcctgtatatccaatgatgggttcctcaaaatgcctaggtctantgacaagtaattgntgacaccacttagtccttgntgacttcanaacttataacncaatgnancgttgcatggaatcctaccaccaaatganncataanggatcccanaccgtgaacnccantnatgtaannacntcctttgntccaaacacattcatcaanaggttatcaggggcncccagtcngggaataaat

SEQ ID NO: 30692 - DNA, 1254 bp, Triticum aestivum
  unsure (1)..(1254): unsure at all n locations
  Clone ID: PAT_TA_30692
gttcctccctggcctcactcccgctctcatccactccccccctctcccaggcgatcccctctccagtttcgccccactcccgaacgcctccgttgccgctgttgccgtcgacctcgcggncatcatcgccccccacgccgagctgggaggtccggcggaaccgctgtcgtctacttcgtcttcctcgcccacgaggtcaagccgggagcccccacatcgaccggatcgaggtcatcttcaacctccgccccgctgcttgccgtcttcgattcggcctcatcggaacctccccgagcccgctttgctcacctacaggctcgataccccgagaccgatgttgatgtccctgtgatcgactacatcgacgacgaccctccttcttgtctgagcaaccaagcaaggccccccccctttgatcatcccgatatcgcccatcctatactatcatgcttgcattagattttgctactgtatttgattgctcctattatgatgcatagcctgctttttgtacctgcttattgttacctacctgcttatcctaacttgcttagtataggttggttagtgatccatcagtgacccccaatgagggagtcctggactagggggtgtccggatagccgaactatcatcatcggccggactccaagactatgaagatacaagattgaagacttcgtcccgtgtccggatgggactttccttggcgtggaaggcaagcttgggcgatacggatatgtagatctcctaccattgtaaccgactctgtgtaaccctagccctctccggtgtctatataaaccgaagggttgtagtccataggacaacgatcacaacatacaatcataccataggctagcttctagggtttagcctctctgatctcgtggtagatctactcttgtactacccatatcatcaatattaatcaagcaggacgtagggttttacctccatcaagagggcccgaacctgggtaaaacatcgtgtcccctgcctcctgttaccatccggcctagacgcacagttcgggaccccctacccgagatccgccggttttgacaccgacagtgaccatgttcttgagcttgcatgtcaaatatatatggttccaagtagttctaatgcttgatatatgctctaggcacttgtatgagtagttgctatcaatcttattgaagttggttcactttgtttgaagtttttaaaaatttagattgtttcagaaataatgaagagacttttgagggg

SEQ ID NO: 30693 - DNA, 1349 bp, Triticum aestivum
  Clone ID: PAT_TA_30693
caccgggttttctgttgaagttttgtgtggatggagtgtttgatcgaggaggtctcaatatgaggaaaaggaagagaggcaagagctcaagcttggggatgcccaaggaaccgcaagtaaatattcaaggagactcaagcatctaagcttggggatgccacggaaggcatcccatctttcttcaacaagtatcggtatgttttcggattcgtttcgttcatgcgatatgtgcaatcttggagcgtctttttcatttagttttcacttttcttttatgcaccatgctggtatgatatagtcgatggttgctttatagaatgctctttgcacttcacttatatcttttgagtatggctttatagaatgcttcatgtgcttcacttatatcatttgaagtttggattgcctgtttctcttcacatagaaaaccgccatttgtagaatgctctattgcttcacttatatttgttagagcgtgggcatatcttttgtagaaagaattaaactctcttgcttcacttatatctatttagagagatgacaggaactggtcattcacatggttagtcataaaatcctacataaacttgtagatcactgaatatgatatgtttcattccttgcaatagttttgcgatataaatatggtgatattagagtcatgctagcgggtagttgtggattactagaaatacttgtgttgatgtttgtgattcccataacatgcacgtatggtgaatcgttatgtaacgaagtcgaagcatcatttaattattgattgtcttccttatgagtggcggtcggggacgagcgatggtcttttcctaccaatctatccccctaggggcatgcgtgtagtacttcgtttcgataactaatagatttttgcaataagtatatgagttctttatgactaatgttgagttcatggattatacacactctcacccttccaccattgttagcctctcttgtgccgcgcaacttttgccggtaccatacacccactatataccttcctcaaaacagccaccatacctacctattatggcatttccatagccattccgagatatattgccatgaaactttccaccgttccgtttatcatcatcatgacatcctttacttttgtcatattgccattgcatgatcatgtagttgacatcatatttgtggcaaagccaccatgcattatttttgatacatgtcactcttgattcattgcaccatcccggtacaccgccggaggcattcatatagagtcatatcctgttctagtttcgagtggtaattcatatgttgtaaccaataaaacccccatgatcatcattcctagagcatttttc

SEQ ID NO: 30694 - DNA, 716 bp, Triticum aestivum
  Clone ID: PAT_TA_30694
atcgcactctcgctcgcgtccagatccaccttgccgtgcgcccgcatcaccatggccgacctcacccgcacacccacttagctccccgctgtacctgctttctccagaagaacaaccgccgactacctcgtctactggagccacctgttggagttgaagctctctgcatcaaccacgacgatgtcttcttcatcctcgtcaccgaccgctgccctgctgttgattcccctatctccgaacctccccagagccacccggggcctccgtcgagctcgccaccggccctccccatgactacgagaccgacgttgctgctgcccagttcgactacggagttgacgacccctccttcttgccaagagcaaccagtcgttgaagcccaaggagacggacgccactgtcgacgaagactcctactaccactagaggtgcctactactacatgcaggccgctgacgatgaccaggagtagttaggaggatcccatgcaggaggcctgcgcctctttcgatctgtatcccagtttgtgctagccatcttaaggcaacttgtttaacttatgtctgtactcagatattgttgattccgctgactcgtttatcttcgagcacttgtattagagccctcaaggcccttggcttgtaatatgatgcttgtatgacttattttactttttagagttgtgttgtgatatcttccaaaaaaaaaaaaaaaaa

SEQ ID NO: 30695 - DNA, 1991 bp, Triticum aestivum
  Clone ID: PAT_TA_30695
tccggggccacgggcttcaggcaaatgggacgacaaaaagatgaagatccaaccctgggtgcatgatgcggcttgaagctacgtcattatttccccaaagaggaagggatgatgcagcatagcggcggtaggtatttccctcagatatgaaaccaaggttatcgaaccagtaggagaaccaagcaacacaacgtaaacagcccctgctcacagataacaaatccttgcaacccgacgtgttaaaggggttgtcaatccctttcggggtacggcacctcaagataggcaaacaaacgtgagataaattgtagttgattgatagatcgaacgccaaataaaataaataagggaaaattgcagcaaggtattttagggttttttggattaatagatctaaaaataaatgcaagagaaatgtagatcgcaaaggcaaataatatgagaaagaagacccgggggccataggtttcactagtggcttctctcaagatagcataactattacggtgggtgaacaaattactgttgggaaattgatagaaaagcacgtagttatgatgatatctaaggcaatgatcatgaatataggcatcacgtccaagattagtagaccgactcctgcctgcatctactactattactccacacatcgaccgctatccagcatgcatctagagtattaagttcataagaacggagtaacgcaataagaacgatgacatgatgtagaaaagataaactcaagcaatatgatataaaccccatctttttatccttaatagcaacaatacaatacgtgttggttccccttctgtcactgggatagagcatcgcaagattgaacccaaagctaagcacttctcccattgcaagaaaaaccaatctagttggccaaaccaaatcgatagttccaagagacttgcaaagatatcaaatcatgcatataagaattcagagaggattcaaataatattcatagataagctgatcataaatccacaattcatcagatctcgacaaacacatcgcaaaagagtattacatcgaatagatctccaagaacatcaagaagaactttgtattgagaaccaaagagagagaagaagccatctagccaataactatggacccgaaggtctgtgataaactactcacacatcatcggagaggctatggtgttgatgtagaagccccccgtgattgattccccctccggcagggtgccggaaaaggcccgaagatgggatctcacgggtacagaaggttgcggcggtggaaaagtggtttcgtggctccccctgatgtttttagggtataagagtatatataggcgaacgaagtacgtcggtggagctccgtggggcccacgagggttgggagggcacgccctaggggggtgggcgcgcccccctacctcgtggctccctcgtttctttcctgacatgcactccaagtccatcaggttgctttccttccaaaaataagctccgtgaagtttcaggtcaattggagtccgtttggttttccttttctgcgatactctaaaacaaggaaaaaacagaaactggcactgggctctaggttaataggttagttccaaaaataatataaaagtggataataaagcccaatattgtccaaaacagtagataatatagcatggagcaatcaaaaattatagatacgttggagacatatcacctcccgctgccttgccggtccggcgccgaccctccccccccctaaccaccgctagataggccattccctcgccggaaaagagagagggttccgccgcggcatcatccaccccgttcctgggcgagctttccggcgctccggccgtgcagggcgggttaccgacggctgcgcgcctaccacgcccgctaggtgttcggtgatttgtctgctcggcgatggactcggacgacgaggaggcgttcgcggcgctgctggaggaggaaggcgatgccgaaacccgggatgaagac

SEQ ID NO: 30696 - DNA, 1784 bp, Triticum aestivum
  Clone ID: PAT_TA_30696
atccagccaaggggatagaagaagttgagggagactcccggcagcacgacggcgtggtggtggagcttgcagttctccggcagggcttcgccaagcactactgaggaggaggtggagttggagagggggagggttgcgctaggggcaaggggtgctgctcccatgcgccttccccactatatataggggtggagggggctggtttcttgccctccaagtccattggggcgttggcaaaggtgggagaaaagaaatcccatcgtttcccttccccactgattgttatcccccctttttagggatcttgatcttatccctacgggatatgatcttattccttctaaggggggatcttggtgcgccttgaccaggggtgtggggccttgcccccactacccacgttcatgtgggccccccaagcaagtgggccccactccagaaccttcccggtacaataccgaacattttttggtggccaaaataggacttcccatatataaatctttacctccggaccattctgtaactcctcgtgacgtccgggatctcatccgggactccgaacaacattcggtaaccgcatactaatatctctacaaccctagcgtcaccgaaccttaagtgtgtagaccctacgggttcgggagacatgcagacatgaccgagacgactctccggtcaataaccaacagcgggatctggatacccatgttggctcccacatgttccacgatgatctcatcggatgaaccacgatgtcgaggattcaatcaatcccgtatacaattccctttgtcaatcggtacgttacttgcccgagattcgatcatcggtatcccaataccttgttcaatctccgttaccggcaagtcactttactcgtaccataatgcatgatcccgtgatcaactccttgatcacattgtgcacattatgatgatgtcctacagagtgggcccagagatacctctccgtcacacggagtgacaaatcccagtctcgattcgtgccaacccaacagacactttcggagatacccgtagtgcacctttatagccacccagttatgttgtgacgtttggcacacccaaagcactcctacggtatccgggagttgcacaatctcatggtctaaggaaatgatacttgacattagaaaagctttagcatgcgaactacacgatcttgtgctaggcttaggattgggtcttgtccatcacatcattctcctaatgatgtgatcccgttatcaatgacatccaatgtccatggtcaggaaaccgtaaccatctattgatcaacgagctagtcaactagaggcttactagggacatggtgttgtctatgtatccacacatgtatctgagtttcctatcaatacaattctagcatggataataaacgattatcatgaacaaggaaatataataataatcaatttattattgcctctagggcatatttccaacagtacccttgttgcccttgtcctggttgttgtcattgtcctggttgttgcccttgtcctggctgctgcagagaagttgggtagtacccttgttgcccttgtcctggttgttgcccttgtcctggttgttgcccttgttctggttgttgcccttgtcctatttgttgctcttgtcctagttgttgccctttttctggttgttgcccttgtcctattttttgcacttgtcctggttgttgcccttgtcctgggtgctgtggagaagttgggtagtaccccttgttgccattgtcctatctgttgcccttgtcctggc

SEQ ID NO: 30697 - DNA, 2541 bp, Triticum aestivum
  unsure (1)..(2541): unsure at all n locations
  Clone ID: PAT_TA_30697
taacattaaacccactatcttcgatttcaaggaatttaattatgataattgttctttagtagattgtatttccttgttgcaatctgtgttgaattctcctcatgcttatagtcaaaataaagcttttaccaaacatattgttgatgccttgatgcaatcttatgatgaaaaacttaatttggaagcttctatacctagaaaacttaatgatgagtgggaacctactatagagattaaaattaaaggacatgagtgttttgctttgtgtgatttgggtgctagtgtttccacgattccgaaaactttatgtgatattctaggtttccatgatcttgatgattgctctttaaatttgcaccttgcggattccaccattaaaaagtcaatgggaaggatcaatgatgttctcattgttgcaaatagaaatttggtgcccgtagattttatcgttcttggtatagattgcaatctttcttgccctattattcttggtagacctttccttagaacgattggcgcaattattgatatgaaggaagggaatattagattccaatttccattaaagaaaggcatggagcactttccaagaaagaaagtcaaattaccttatgaatctatcatgcgtgctacttatgaatttaatgccgaagatggcactcgttagatctatctttgtttttatgcctagctaggggcgttaaatgatagcgctagttgggaggtaacccaattttctttatgttttttgttttggctcctgtttagtaataaatctagcatctaccttctggttagatgtgtttttatcttttaattagtgtttgttccaagtagaacctataggataacctacgatgatagttgatttgattctgctgaaaaacagaaactttagctttcacgagattagctgccattttttactggagagtgcttttgcgttgattatttttgcttctgatgaataaacaaattttccaggacttcctgttttggnagaattttttggangttccagaagtttgcgttagctacagattactacagactgttctgtttttcttgtgttgtttgcttattttgatgaatctatggctagtaaaatagtttataatccatagaggttggaatacattaggtttaacacccatataaataaataatgagttcattacagtaccttgaagtggtcttttgttttctttcgctaacggagctcacgagttttctactttaagttttgtgttgtgaagttttcaagttttgggtaaagattcgatggactatggaataaggagtggcaagagcctaagcttggggattcccaaggcaccccaaggtaatattcaaggacaaccaagagcctaagcttgggtatgccccggaaggcatcccctctttcgtcttcgttcatcggtaactttacttggagctatatttttattcaccacatgatatgtgttttgcttggagcgtcacgtcattttattttgttttgattgctgtttggaaccaattccaagatataaatttattaaatgggagagtcttcacatagttgcataattgttcgattactcattgatctccacttatatcttttggagtagtttgttgtttgctctagtgcttcacttatatccttttagagcatggtggtagttttatttttaagaaatagatgaactcccatgtttcacatagattattttgagagtcattaatagcatggtaattcgcttaatgttaatatacttggtattcaaggtatgtgaaactttcttttgagtgcgttgaatactaagataagtttgatgcttgataattgttttgagatatggaggtgataatattagagtcatgctagttgagtagttgtgaatttaaagaatacttgtgttgaagtttgtgatttcctgtagcatgcacgtatggtgaaccgttatgtgatgacgtgggagcatgatttatttattgattgtcttccttatgagtggcggtcggggacgagcgatggtcttttcctaccaatctatccccctaggagcatgcgtgtacacttcgttttgatgattaatacattttcacaataagtacatgagttatttatgactaatgttgagtccatggattatacacactctcaccctccaccattgctagcctcccgtgtaccacttaactttcgccagtaacatacacccaccatatactttcctcaaaacggccaccatacctacctattatggcatttccatagccattccgagatatattgccatgcaactttccaccgtttcatttatgacacgcttcatcattgtcatattgccttgcatgatcatgtagttgacatcgtatttgtggcaaagccaccatgcataatttatcatacatgtcactcttgattcattgcccatcccggtacaccgccggaggcatttagatagagtcatattttgttctagtatcgagttgtaatcattgagttgtaaataaatagaagtgtgatgatcatcattaacagagcattgtccc

SEQ ID NO: 30698 - DNA, 1585 bp, Triticum aestivum
  Clone ID: PAT_TA_30698
gcaacggtcggattttgagtatcaattccttaggctatcatgttcctcactgtgtaggaaatccgcactgcgatttctaactccttagtcagaacagattcctcagagaccagagaacttcgtctctgtcactgaagaatatgactgaactgtatgagatttccaatggcttcactcgaagggattggtaggtgtaggattttgagttgagcataacatggaaatttttccttagtatttccttgaccccctttaacagtacggtgtttcctatgactcaagaaagagaaaatgaaaactacgaaaacataagtcttcacgcttcatgttcctcgaatgaataccaagtcttcaaggtcacaccaatttcttcactttcaaagtcttcagaaagtcttcagaaatccaaagtcttcagtcgaagaacttcatttttaggggttgactttctctataaatatcaaactcctcatagacttatagacctgtgtacactcacaaacgcattagtcccttaacctataagccttcaatacaccaaaaccactaaggggcactagatgcacttacatcggtcatatcgtagcggtgcttaggcgaagccctgcgtcggtagaacatcatcatcgtcaccacgccggcgtgctgacggaactctccctcaaagcttggctggatcggagttcgagggacgtcatcgagctgaacgtgtgctgaactcggaggtgccgtacgttcggtacttggatcggtcggatcgtgaagacgtacgactacatcaaccgcgttgtgctaacgcttccgctttcggtctacaagggtatgtagacagcactctcccctctcgttgctatacatcacctatgatctcgcgtgtgcgtaggaaatcttttgaaattactacgaaacccaacagagctttcatacacttatagctctagtgcatccgttgcatggcaatccctacttactcacatggatatctattgatgggcatctccatagcccgttgatacacctagttgatgtgagactatcttctcctttttgtctttcccacaccccccattccaatcccgcggccatggcggccgggagcatgcgacgtcgggcccaattcgccctatagcgagtcccttattaattttcatcacgaaaacagccacccgccttttactcctttctcatcttctttttttttctctgcgttcggcgctggtgtgtctgtctttcccctctatctgttgatcatgatggggctgttgttccgctactcacgtttttgccgtttctgctctttctctgttttttttgtttgtgctgattggtcgctgcactttctcctggctcctctcatgctctctcagtcaccgacccattctatccacccaccacacatctctcatatcactctactatcctctctatcttctccgccagcctatctgtttttcttctctctttatctttttttgttcgcctcccgcgtgcgcagtcagtcgtgtttttcttcatttcatctatttctgttctctcctttacctctcactatttcactattcgttctctgtttatttttctacta

SEQ ID NO: 30699 - DNA, 1731 bp, Triticum aestivum
  Clone ID: PAT_TA_30699
ctaatttgtcagaatttttggagttacagaagtattcaaaatctccagattgctacagactgttctgtttttgacatattctgttcttcgtgtgttgtttgcttattttgatgaatctatgagtagtatcgggcggtatgaaccatagagaagttggaatacagtaggtttaacaccaatattaataaagaatgatttcattacagtaccttaaagtggtggtttattttcttatactaacggagctcatgagattttttgttgaagttttgtgttgtgaagttttcaagttttttggtaaagatttgacggattttggaataaggattggcaagagcctaagcttggggatgcccaaggcaccccaaggaaaaattcaaggcaaccaaaagcttggggatgccccggaaggcatcccctctttcgtcttcgtctatcggtaactttacttggagctatatttttattcaccacatgatatgtgttttgcttggagcgtcttgtatgatttgagtctttgctttttagttgtcacaatcatcctcgctgtacacaccttttgagagaagcctatttgattcagaatttgctagaatactctatgtgcttcacttatatcttttgagctaaataattttgctctagtgcttcacttatatcttttagagcacggtggtggttttattttatagaaattattgatctctcatgcttcacttatattattttgagagtcctttagaacagcatggtaatttgcttgggttataaaattagtcctaatatgatgaacatccaagatggatataataaaaactatcatataaagtgcattgaatactaagagaagtttgatacttgataattgttttgagatatgaagatggtgatattagagtcatgctagttgagtagttgtgaatttgagaaatacttgttctaaagtttgtgattcccgtagcatgcacgtatggtgaaccgttatgtgatgaagtcggagcatgatttatttattgattgtcttccttatgagtggcggtcggggacgagcgatggtcttttcctaccaatctatccccctaggagcatgcgcgtagtactttgtttcgataactaatagttttttgcaataagtatgtgagttctttatggctaatgttgattccatggattatacgcactctcaccttccaccattgctagcctctctaacaccgcgcacctttcgccggtatcaatcacccaccatataccttcctcaaaacagccaccatacctacctattatggcatttccatagccattccgagatatattgccatgcaacttaccaccattccgtttattatgacacgctccatcattgtcatattgctttgcatgatcatgtagttgacttcatatttgtggcaaacccaccttcataattctttcatacatgtcactcttgattcattgcatatcccggtacaccgccggaggcattcacataaagtcatattttgttttaagtattgagttgtaattgttgagttgtaaatcaataaaagtgtgatgatcttcattattagagcattgtccgaagtgaggaaaggatgatggagactatgatttccccacaagtcgggatgagacttcggactttatgaaaaataaaagaggccaaagaagcccaaataaaaaaagaggccaaagaagcccaccgaaaaaaaaaaaagtaaaaaggaaaaa

SEQ ID NO: 30700 - DNA, 929 bp, Triticum aestivum
  Clone ID: PAT_TA_30700
gatactgaaactagatttcaattgaccaattgtaagaggaacactaacatatctcgaaactgacaacatctggtgcaacgtccacgtacgattggtagagataaaagggatgcaaaacacacgggcacatgatgatacgatactccggcaggaaacatcccggccggacttggagaaaggaagcgaggaaaagactaggcggtgagctccatgatggcgctgacgatgtcgccgtcgtgcgccttgagggccttgacggccttggcgcgggacacgctggcctgcgtcatgacgaggtcgatgtcgcgggcctcgatgccggtctcgtccaccacctcctcctcgtcggcgggcgccccggcccccgccgccgccgcgtcgggcctcatcgccttgctcaggtcctgcatcctgaactgctgcgcggcctgcgcctgcagctgcgagctcaggtcctcgatcttggcctccccgaagatcacgtacgtctccgacgtcgggctcttgaacacgtccggcttcgacaccacgaacaggatgttcttggctctcttgatggtaatcctgctgacgcccgtgacgggcttcatcccgagcttcatcatggccttgcggctcttcttctcgctccggctctgcttcgacccctcgctcccggccacacccagctcgccgtcttcatcctcgtcgtcctcgtcatcatcctcgtcctcctcctcgtcttcatcaccgtcgccctccttgacgtcctcgacgacgggcgcgccgtcctccgcgggctcctcggccttgacgacctccggtgccgcgtcgccgctctccagctccggctcggtggccaccggcgtctcctcgctgaccatggtgagctgctgcggtgttggtgcagggacgagcgtgctgctggagtgaggataaggagtcggacg

SEQ ID NO: 30701 - DNA, 988 bp, Triticum aestivum
  Clone ID: PAT_TA_30701
ttcgagcggccgcccgggcaggtacattgccagaggcattcatatagagtcatactttgtcataggtatcgagttgtaatttttatttcttttgagtcataagtaaatagaagtgtgatgatcatcattattcattttcagagcaatgccccagtgaggaaaggatgatggagactaggattcccccacaagtcgggatgagactccggatagtgagagaaaaaaatataaaaaaataaaaagaaaaagaaaaaaagaaaaagaaaaaagaaaaagaaaaaaaataaacaaatagagtaggggcattgttagtatcctatactacacttgtgcttcaaagtagcaccatgtttttcatatgggagagtctccctatgttgtcattttcatatactagtgggaattttcaatataggattagatgcacacccacttagtttctttttgagctttcatacatttatagctctagtgcatccgttgcatggcaatccctactcactcacattgatatatattgatgggcatctccatagcccgttgatacgcctagttgatgtgagaatatcttctcctttttgtcttctccacaatcaccattctattccacctatagtgctatatccatggctcacgctcatgtattgcgtgaagattgaaaaagtttgagaacatcaaaagtatgaaacaattgcttggcttgtcatcggggttgtgcatgatttgaatactttgtgtgatgaagatagagcatagccagactatatgattttgtagggatagctttctttgtccatgttattttgagaagacatgattgctttgttagtatgcttgaagtattattgtttttatgtcaatattaaacatttgttttgaatcttatggatctgaatattcttgccacaatagagaaaattacattgataaatatcttaggtagcattcaacatcaaaaattctgtttttatcatttacctacttgagg

SEQ ID NO: 30702 - DNA, 1251 bp, Triticum aestivum
  Clone ID: PAT_TA_30702
cgtggaagtttattttgtgcctttggtagcttattttgttgttctatttgttgggcacacgaaggggagccttgacgcagtggtaaagctgctgccttgtgaccaagaggtcacgggttaaggaaagactgtacaatagacccaaagtggtcggacccttcccgagaccctacgcaagcgggagctacatgcaccgggctgcccttatttgttgggcacacattgttcatggagtaggtgttttcagatttgcaagtacagcgaccgtacatttttatcagcacaatgatggatggtctacttgggagatgtgagtttgctggtgtcgctggacggagtccccgctcaccagttcgtggaacacctccaccttcacaggcggcacccgcatgccgtacgagttcatcgactgcgacgcttgtttgaactgctgcgctagctgggcttgggcgctctggtttccagacatgcccagatgctgctgaagctgctgttgctggtggtggtggtgctgctggagctgttgctgctggtggtggtggtgctgctggagttgttgctgctgctgctgctgttgctggtggtgttgttgaagctgcaatacgtgctgttgctggagctgcttctgttgctgctgctgcagtagctgctggtgcctcagctgctgcatctgttgttgttgttgtctggtgagagatccgtacgggctattgatttgtgaatccatggtgttctcgagcttcacgtttaccagggcctgttgggcttgaaggagattattttgattttgtacttgtgcatcttgatgaactgggtggctagcccactctactccccatctttttaatctccattaagggtcccaatgttacttgcaaaaacgttgcgctttaagatccagggatgaggtgcagggatggccaagatgtcaatctcctcttcgaggtgtccagatccggtgtgcttgaggtcgatccggtactgaaccagggactgtggtgctcaactgggggtcaccgaccgctgctcccggcagcaggacggagcaactaggggtcaccggacgctgctcccggcggcaggacggagcacggggcggagcaactgggtcgggtggagggaaggggaaggtgaggaataggacatgggagaggagaagaacgaaggaagagggatcagcggaggagggaaggctcgccggtggcggcgaatcggagcgccatggtatgtgcgggattggggccctcgtgc

SEQ ID NO: 30703 - DNA, 1014 bp, Triticum aestivum
  unsure (1)..(1014): unsure at all n locations
  Clone ID: PAT_TA_30703
gcgagcgtggtgggtaagttggtgcancccctgcaggggaagaaaacatctatcgatagcctgtcctatgataacggacacttggagttgtatcccgatcgatacaactagaactggatacttgagatgagaactggatggtgatgaaggatttgattgtgatgataactggatagtatggctctgggattgctttctcgcagggagtcgagaaaggatctctggccgaggttgataacactactactactttactttatgctactctgtactcttctatatgctgcaagatggtggtttccagaagatgctagtcttcgatagtttaggcctcccccttctcttctggcatttctgcagtttaagtccacatatacagcccatttttatttgatacagatgcatacttagtttagatctgatgtaagtcttgcgagtactttggatgagtactcacggttgctttgctacctagtctttttccccatacccgattgttgcgaccagatatcggatcccaggagccagacaacacctctgatgactactgctaccatgagggtgcctactactacatgatggccgctgacaatctggagtagttaggaggctcccaggcaggaggccttgccttttcaatcgttgttgcttttgtgctagtcttcttaaggcaaacttgtctaacttatgtctgtactcagatattgttgctttcactgactcttgtgtattcgagcttatgtattcgagcccttgaggcccctggcttgtaatataaagcttgtattattttaatttgtgtctagagttgtgttgtgatatcttcccgtgagtccctgatcttgatcgtacacatttgcgtgtatgattagtgtacgattgaatcgggggcgtcacatgggactacaatgcctaaatgattgactctagtggaagtgggagactgttggggatanatcaatcatgacatgatgatatttccctatgtattcatgagttatccatattgtccat

SEQ ID NO: 30704 - DNA, 1698 bp, Triticum aestivum
  Clone ID: PAT_TA_30704
tcaccagtcaccacaccccgcgcggccgcagcgccgctcagactcaggctcagctccgccgccgaagcgccacgcgcagccatggccggctccgagcagcgcgtcgtcgccgtcatcatggtcggcggccccaccaaagggacgcggttccggccgctgtcgctcaacgtgcccaagccgctcttcccgctcgccggccagcccatggtgcaccaccacatctccgcctgccgccgcatccccaacctggcgcagatatacctcatcgggttctacgaggagcgggagttcgcgctctacgtctcctccatctccaacgagctcaggatccctgtcaggtacctgagggaggataagccacgcgggtcagccggagggctctacagcttcagggactacatcatggaggacactccggcacacattgttttgctgaactgtgacgtctgttctagcttccccttgccagacatgctcgaggcccataaaaagtatggaggcatgggcactttgctagtcaataaggtatctgcggagtcagccaaccaatttggcgagctagtagctgatcctgaaacaaatgaactgttacactatacggaaaaaccagagacttttgtgagtgatctcataaattgtggagtctatatatttacaccaaagatattaattgctatcgaggatgtcctaaaacagaagaaagacagagctaatttgcgccgtgtatccagctttgaagctcttcaatcagcaacgaaggcaattccggcagattatgttaggttagatcaagatatcttatctcctctagcaggaaagaaggaactttacacataccagacacttgatttttgggaacagatcaagaccccagggatgtctttgagatgctctgggcctatatctctcccagttccgccatacctctcctcatcttttagcctctggagatggcaaaaagggtgccactattgtaggtgacgtgtacatccatccatctgcgaaggtgcatctaactgcaaagattggtcccaatgtttcgatatcagcaaatgcacgcattggagcaggtgccaggcttatcagttgcatcattctggatgatgtcgaaattatggagaatgcagttgtcatacattcaatagtagggtggaagtcaacagtagggaaatggtcacgtgtacagggtgaaggggaccacaatgccaaacttggtatcaccattcttggtgaagccgttgatgttgaagatgaagtagttgtaactaacagtatcgtgctcccaaataaaactctcaatgccaagtgtgcaaagatgagatcatcctataatattccttgcacaacaacatatctttatttaatcccggaataaggtctacaacccaaatatgtaattttctttccttttccttggcgcagtggtaaagctgttgccttgtgaccatgaggtcacgggttcaagtcctggaaacagcctcttacagaaatgtaggaaaaggctgcgtactatagacccaaagtggtcggacccttccccggaccctgcacaagcgggagctacatgcaccgggctgcccccttttcttctttaccccccttatgtatgcttgcattagattggggtcgttagtctgtacaaggcatgtgatgtgatatggtgtaattttgtttagcattctggcatcaagttgactg

SEQ ID NO: 30705 - DNA, 663 bp, Triticum aestivum
  Clone ID: PAT_TA_30705
gccggccaggcctgggactcctatatcaaacacaacgaaggcaacaactgtagtacgtaggtacgtaagtgtagctagcctcctcctgtactgcacgccatggcgctgctgaagaagaacacgagctccctgagcttcgtcgtggccaccctcatggtggtcatggctgccacccttctcctctcctcgtgcgacgcccgcaaagtgaaggataagcccaccgctttcctcgtggcggggaagtgcttctcgaggtttttcccgaactgcaccgagcagcggtgcaagaagttctgcgtccagccacttcccggagccgtctgcatcgacaaaacccactgttgctgccctattgcttaattataagcgccgctgaagcaatcgggctaagaaatagtactagttaaagatggcaataagcaatattcgtacacttccaaatatatactacctctttctaaatataaggcattttgcagttcaattcggttgaactgcaaaaacgtcttatatttaagaataaaggtagtatatgttaatgttgtttctagttatgaactgtcgacccaaagatttatgtattgaattaattgtataattatatcaccacaaccagggccgtctccaggaatttggggccccagtgcgaaaagaaaaaaaaaa

SEQ ID NO: 30706 - DNA, 1902 bp, Triticum aestivum
  unsure (1)..(1902): unsure at all n locations
  Clone ID: PAT_TA_30706
ggcgagaaaaattctagcctgcaaattactgctgaaggaagcagcaaagtggttccaactcctgtagaatatacaaccagtgaaatcattgatggcaagccggttaatactgttgaagggctcaaggtttatgaagggttggtaaatgtgactgagataaacaagattgtttctttagttaatgaaacaaaagcttcttctcgtcgaggagggttcgaaggtaattatgtagcctctaaagttatttgtttctgtgcctatgtgcatcacctgtgtgtgtagtgtgttagcgtaactgtgtgcacttttgccacattgaattctgaatttatatctaaattgcatactgtcagaatattgccgaacatctagggaaatgccacagcttagcagagtctattacccttggctagttggccatttgtcctagtctgtctttatctaatttttggggtactgtgattcaactattttattggactttgctgttaattttgcttggtgcaaaaagtgggccagactgttattgttggtaaaagaccactgaagggtcatggaagcgtaattattcagctgggagttcctatcattgaaggccctcttgaagatgaaaatcaaagagagacaacaagggtggagcctgttcctgggttgctgcatgacctgtttgatcgcttctttcggcagggaattgtaccttttaagccagactattgtgttgtcgacttctactatgaggaggaatattcccatcctcagcaacctccctcttggtatggtaggccactttgtaccctctgcctgacagagtgtgatatggtgtttggccgagttatttttggagaacgaggcgataacagaggccctttgaagctctctctctctacagggtctcttgtagttttgcaagggagaagtgctgatgtagccaagcgagctattcctgctacacgtaagcagcgaatccttctaacttttgggaagtctgtggcaagaaaagttgcaccatcggaaagtgcttcacggcctaccgccccgttaacacctccttctatgccctggggtccaccatcaaggccagctaatgtgaggccacattctccaagtccgcagcactttggatacaccccgaccagcagcgtacttccagcaccaacaactggacctcatcacatccctccgtctgatggaatgcagccactctttgtagcacctgctcctgttgctgccgcagccatacctttcccagcagctgttcccttgccaaatgcaacggcagcttggatgccagaagctgccccaaggcctgccccacctcgattccctgttccaggcacaggcgtcttccttcctcctggatcagctcaccagctgccccatcagatgatacaagcttcccaagctcatgcggaacctaactccccaagaggctcagcagcttatgtgcataacaagggtactgtcatggaggtggctaatggtagtgcttctccaaagagctcaggaacaacaaaaagggccgatacaaccgaggcaaaaccagagtgcaatgggagctctagttctgtgggtgaggagcagcagaacggtggtatgaagaatgctgggctcagcaaggttgagccaagtgccgctaaatagaagggaggtatagtacatagagaacagaaacatgagacgaggaaacctcaattttccaggtcatggttgcgggcaactctcctatccttgacaagcacaagtaccttgatgccgtcgacttgtcgtgagaatgaatgaaaaccgtcttaagttttgtagccgatcgatctgtagcaaaactggatatatcatgctgctttaacttatcacctgcttgctacaactatgggtagtatgggnctaagcatgtnacaacatgtt

SEQ ID NO: 30707 - DNA, 597 bp, Triticum aestivum
  Clone ID: PAT_TA_30707
gctatatcaacacacaaagaaggcaagaactgtagtaagtacgtacgtaggtgtagcacctcatcttgtactgcacaccatggcgataatgaagaagaacacgagctccctgagcttcgtcgtggccgccctcatcgtggtcatggctgccacccttctcctctcctcgtgcgacgcccgcaaagagaaggataagcccaccgcttcccccgtgtcggggaagtgcttctcgaggtttttcccaaactgcaccgagcagcgatgcaagaagttctgcgtccagccactccccggagccgtctgcatcgacaaaacccactgttgctgccctattgcttagttataagcgtcgttgaagcgatcgggctaagaaatagtactggttaaagatggcaacaagcaatatttgtacacttcgaaatatatactacctctgtttctaaatatatggcattttttgcagtcagttgaactacaaaaacgtctaatatttaagaacaaggtagtatatgttaatgttgtttctagttatgaactgttgacccaaagatttatgtattgaattaattgtataattatatcaccacaaaaaaaaaa

SEQ ID NO: 30708 - DNA, 1604 bp, Triticum aestivum
  unsure (1)..(1604): unsure at all n locations
  Clone ID: PAT_TA_30708
attattattaggccttatgtttgctgtgtggaaaaaaaatctaatgaaaattttctagtaggtcaacatacaaacgatatcaatttttgttaagttcattaacaaatattcattcaaagaaatgaaaactagctcccagctacatagaagtacactattcagctgactttgcattgatcatcgattcactgccaagaatctccaacaaacaagttccataactcaacgagctgctagggccaaaaccaggtccagatcagaggtcagctttcttgacaagctttgtatagataatgcgaccatcccttgaagaattgctctcggcaagagcaatttgaaccatgtccttcacatccctgttggataaaaatttccccaagttgtgaaggatgcaccttaaatcatccacctttatataaccaactctgttttggtcgaagtacctaaaagcctgcaacaggtccttatcaaccacatcatgtttcgctgaatctcctttctgtgatccagatatctttccctccttaccaacagatttctcttcaacttctttcaaatctcctttctctgctacagactgcttgtcctcttctgttttttccaatttaagattctccgttgtcctctttccatcatcttctgcggttacctcttctggcttggtttctctttcatttgagttatcctcattctgtgcttctgccggctcttcagcagtggcatcatccatgtcctcgtcgccctcatattctacttcatcgggatcttcttcatattcaggatcttcttcctccattttctcatcagctttaggttcatcacaggcagctgctgactgatctgcgtcaatcttttcctcaccctctttcatcatttcatcctgggcagcatgatctgtactcatcttctcgtcatcctcttttaccagttgctcatgggaagctgatgaattatcaccaattatcttttctccaccctcttttattgtttcatcatttttacctgggttacctgaggtacttccagttacattttcatcagttgtctttagtcgcttctccaaggatattgtgtcttccttctttagatcttcctctctttggcgcttacgttgattcctcctcacaacatactgcctgtaaagtttctcaagaaaagacaggatcacacaacccattctgtattgaagcatttcgctgaaagactcagcaaacaaagaaagctcaaatacagactcctctgtatcattggcggtgtagtccaggaggccatccaatgaaagggatgttgaccggagtttatattctttgctctttttggcctggagaatgaatcctgggtgtttaggaggttcatcagacttcttcttttctttggtgtcaatgggcgactttttctttgagtccatcttctggtctttatcctttgtttcgttgtcatccattttcttgacactcttcccggctgtttcatcattttttggatctttctgttccacaacttcctgctggttaaccttatctgtatttgccttttgatcatcagtcattatgtctccctttatctccagctcctgttctttcttctgatnngaggtatcttca

SEQ ID NO: 30709 - DNA, 1474 bp, Triticum aestivum
  unsure (1)..(1474): unsure at all n locations
  Clone ID: PAT_TA_30709
aatcacttagagctcattattatgatgtattaccgagtgggcccagagatacctctccgtcatacggagtgacaaatcccagtcccgatccgtgtcaacccaacagacactttcggagatacctgtagtatacctttatagtcacccagttatgttgtgacatttggcacccccaaagcactcctaagcatccgggagttacacaatctcatggtctaaggaaatgatacttgacattggaaaagctctagcaaacaaactacacgatcttgtgctatgcttaagattgggtcttgtccatcacatcattctcccaatgatgtgatcccgttatcaatgacatccaatgtccatagtcaagaaaacatgaccatctattgatcaacgagctagtcaactagaggcttactagggacatgttggtgtctattattcacacatgtattacaatttccggataacacaattatagcatgaataaagataattatcatgaacaaggaaatataataataatgcttttattattgcctctagggcatatttccaacagtctcccacttgcactagagtcaccaatctagttacattgtgatgaatcgaacacccatagagttctggtgttgatcatgttttgctcgcgagagaggtttagtcagcggatctgcgacattcagatccgtgtgcactttgcaaatttctatgtctccatcttgaacattttcacggatggagttgaaacgacgcttgatgtgcctggtcttcttgtgaaacctgggctccttcgcgagggcaatagctccagtgttgtcacagaagagtttgatcggccccgacgcattgggtatgactcctaggtcggtgatgaactccttcacccaaatcgcttcatgcgctgcctccgaggctgccatgtactccgcttcacatgtagatcccgtcacgacgctctgcttgcaactgcaccagcttactgccccaccattcaaaatatacacgtatccggtttgtgacttagagtcatccagatctgtgtcgaagcttgcatcaacgtaaccccttacgatgagctctttgtcacctccatatacgaagaaacatatccttaagccttttcaaggtatttcaaggatgttccttggaccgctgtccaagtggatccacccctgggatacttttggggtacctcccctggctaaacttaataagctaagggacacatcaagtcctgggtacacanattggcatacatgataagacctatggctggaagcatanggaaancctttcattttcctccccnaccttccgcaagtgggcnggcattgganccttacccatcctcacaccttggttnntacaagncaagaccttccttggcttgatcattttgacttccttcaacttnntcaaggaatgtcttgtgnaaanccnattaacnctggtcaacccaaaaannttaaagcnaaaaaaa

SEQ ID NO: 30710 - DNA, 4408 bp, Triticum aestivum
  Clone ID: PAT_TA_30710
gtgtggactaaaagtagtagatgcagaaaggagtcggtctacttgtcacggacaatacacatgatcatgcctagatattctcagaattattcacttttctatcaattgctcgagggtaatttgttcaccctccgtaatacttatgctatcttgagagaagccactagtgaaacctatggccccgggtccattctccatcatacaagtttccaatctattttattttgcaatttttactttcaatttatatcataaaaataccaaaaatacttatcttattattatcatctctatcagatctcactcttgcaagtggccgtgaagggattgacaacccctttatcgcgttggttgcgaggttcttatttgtttgtgtaggtgcgtgggacttttgaggagcctcctactggattgataccctggttctcaaaactgagggaaatacttacgctacacttgctgcattaccctctcctattcgcggaaaaccaatggtagctccagacgtagcaagaaggatctctggcgccgttgtcggggaggtcttcgctcaagtcaagacataccaggtacccatcacaaacccatctctctcgcatttacattatttacctctcgttttcctctcccccacttcactcttgccgttttattcgccctctctttcccaatctcctcctctctttttgcttgccgtttttatgtttgcttgtgtgttggattacttgttgccatggcgcaagataataccaaattgtgtgatttctcgaataccgataataatgatttccttagtactccgattgctcctcttaataatgatgagtcttttgaaatcaatgaccgctgtgctgaatcttgtgatgaaagatcaatttgccggcctttctacgtgaagatgccgctacttatctaaacaattttgttgacttgtgtgatatgcaaaagaaaaaagatgtcgataatgatatcgttaaattgaagctatttcctttttcacttagagatcgtgctaaaacttggttttcgtctttgcctaaaaatagtattgattcatggaacaagtgcaaagatgcttttatctctaagtattttcctcccgctaagatcatctctcttagaaacgatattatgaactttaaacaacctgatcatgaacatgttgcacaagcttgggagaggatgaaattaatgatacgtaattgccctactcatggtttgaatttgtggatgattatacaaaaattttatgccggattgaattttgcttctagaaatcttttagattcggctgcgggaggcacttttatggaaatcactttaggagatgctactaaactcctagataatattatggttaattattctcaatggcacactgcaagatctactaataaaaaagtgcatgcgatagaagaaattaatgtgttgagtggaaagatggatgaacttatgaaattatttgctactaagagtgtttcttctgatcctactgatatgcctttgtctactttgattgagaataataatgaatctatggatgtgaattttgttggtaggaataattttggtaacaacgcttacagaggaaattttaatcctaggccttatcctagtaatccttctaataattatgggaattcctacaacaactcttatggaaattataataagatgccctctgaatttgagactagtgttaaagagtttatgaattcacaaaagaattttaatgctttgcttgaagagaaattgcttaaagttgatgatttgtctaggaacgttgatagaatttctcttgaaattgattctttaaagcttaaatctattcctcctaagcatgatatcaacgagtctctcaaagccatgagaatttccattgacaagtgcaaagaaagaactgctaggatgcgtgctaagaaagatgcctttatgaaagcgtgttcttctagttcctatgaaaataatgatgaagatctaaaagttattgatgtgtcccctattaaatctttgttttgcaatatgaatcttgataatgatcggactgaatatgatccatctttacctagaaggcgttctaagaattcagaatttattggtcctgatgctaaatttgataaaagtgggattgaagaaattaaaaccctagatgttgctaaacccactatctcggatttcaaggaatttgattatgataatttttctttagaaggttgtatttccttgttgcaatccgttgttaattctcctcatgcttatagtcaaaataaagcttttaccaaacatattgttggtgccttgatgcaatcttatgatgaaaaacttaatttggaagtttctatacctagaaaacttaatgatgagtgggaacctactataaagattagaattaaagatcatgagtgttttgctttgtgtgatttgggtgctagtgtttccacgatgccgaaaactttatgtgatattctaggtttccatgatcttgatgattgctctttaaatttgcaccttgcggattccatcattaaaaagccaatgggaaggatcaattatgttctcattgttgcaaatagaaatttggtgcccgtagattttatcgttcttgatatagattgcaatctttcttgccctattattcttggtagacctttccttagaatgataagtgcgattattgatatgaaggaagggaatattagattccaatttccattaaggaaatgcatggagaactttccaagaaagaaaattaaattgccttattaatctatcatgcaagctacttatgaattgggtgccaaagatggcactacttagatctatccttgcttttatgcctagctaggagcgttaaacgatagtgctagttgggaggcaacccaattttatttgtgtttttttgtttttgtttctgtttagtaataaatcttgcgtctaccttctgtttagatgtgtttttatgttttaattagtgtttgtgccaagtagaacctataggataacctatggtgatagttaatttgattctgcggaaaaacagaaactttgcgcgcacgaaaataattttgttaattcacacaaacgagctttttcgttgattcttttttctgtagatcaatagacaaattgctcaggatttcctattttggtaggatttttacagttccataagcattcaagagttacagattgctgcaggctgttctgtttttgacagattctgtttttcatgtgttgtttgcttattctgatgcatttatggctagtatgtagggtatgaaccatagagaagttggaatacagtaggtttaacaccaatataaataaataatgagttcattacagtaccttatgtggtggtttttctttcttgcaccaatggagcttatgagatttcctgttgagttttgtgttgtaaagttttcaagttttgggtaaagatttgatggactatggaataaggagtggcaagagcctaagattggggatgcccatagcaccccaagatattcaaggataaccaaaacctaagcttggggattccccggaaggcatcccctctttcgtcttcgtctatcggtaactttacttggagctatatttttattcgccacatgatatgtgttttgcttggagcgtcttgtatgatattggtctttgatttttagtttaccacaatcatccttgatgtacacacctttttggagaaacccacatgattggaatttattagaatactctatgtgcttcacttatatcttttgagctagatagtcttggctctagtgcttcacttatactttttagagcatgacagtgattttattttatagaaattgttgaactctcatgcttcacttatattattttgagagtctttaaatagcatggtgataacccacaagtgtaggggatcgtttgtagccttcttcgataaataagggtgtcgaacccaatgaggagctaaaggtagaacaaatattccctcaagttctatcgaccactgatacagctctacgcacgcttagcgttagctttacctataacaagtatgaaactagaagtactttgtaggtgttgctggataggtttgcaagaatataaagagcacgtaaataaaaactaggggctgtttagataaagacacaactaagttcgttttagtagagagctttttgtcacgaggaagttatttgtccctaggcaatcgataactagaccgataatcactattgcaattttttttgagggagaggcataagctaacatactttctcttctcggatcatatgcacttatgattggaactctagcaagcatccgcaactactaaagatcattaaggtaaaacccaaccatagcattaaagcatcaagttctctttatcccatacgcaacaatcccctta

SEQ ID NO: 30711 - DNA, 3505 bp, Triticum aestivum
  unsure (1)..(3505): unsure at all n locations
  Clone ID: PAT_TA_30711
ggcgttaaacgatagcgctagttgggaggcaacccaattttctttatgttttttttgtttttgctcctgtttagtaataaatcttgcatctaccttctgtttatatgtgtttttatcttttaattactgtttgtgccaagtagaacctataggataagctacgatgatagttgatttgattctgctaaaaaacagaaactttgcacgcacgaatataatttttttaaatcacaggaacgtgattttgcattgattctttttgctgctgttcaataaacaaattgtccaggacctcctatttttctaggatttttagagtttcaaaagtttgcgttagttacagattgctacagactgttctgtttttgacagattctgtttttcgtgtgttgtttgcttatttcaatgcatctatggctaataaactaatttataaacgataaggaagttggaatacagtaggtttaacacagaaataaataaataatgagttcattgcagtaccttatgtggtggttttgttttctttcactaacggagcttataagatttcctgttgagttttgtgttgtgaagttttcaagttttgggtaaagcttttatggactatggaataaagggtggcaagagcctaagcttggggatgcccatggcaccccaatatattcaagagtagtcaaaagcctaagcttggggatgccccgggatagaatcccctctttcgtcttcgttcattggtaactttacttggagctatatttttattcgccacatgatatgtgttttgctaggagcatcttgtatgatattagtatttgctttttagtttaacacaatcatcctttctatacacacctttttggagaagcccgcttgattgaaatttattagaatactctatgtgcttcacttatatcttttgagctagataatttttgctctactgcttcacttatatcttttagagcatggcggtggcttaattttgtagaaattgctactctctcatgcttcacttatattattttgagagtctcttagaacatcatggtatttgctatggttataaaattggtcctagaatgatgggcatccaagttgggtataataaaaactatcatagaaagtgaattggatgctatgaccaatttgatacttgataattgttttgagatatggggatggtgatattaaagtcatgctagatgggtgataaagaatttaaataatacttgtgttgaagtttgtgattcccgtagcatgcacgtatggtgaaccgctttgtgatgaagttggagcacaattttatttactgattgtcttccttatgagtgacggtcggggacgagcgatggtattttcctaccaatctatccccctaggagcatgcacgtagtactttgtttcgatgactaatagaattttgcaataagtatgtgagttctttatgactaatgttgagtccatggattatacgcactctcacctttccgccattgctagcctctcttgtaccgcgcaactttttccggtaccataaacccaccacatatccttcctcaaaacagcctcaaaacaaccaccatacctacctatcatggcatttccatagccattccgagatatattgccatgcaactttccaccgttccttttatcatgacatgttcatcattgtcatattgctttgcatgatcatgtagttgacatcgtatttgtggcaaaaccaccgttcataatttttcatacatgtcactcttgattcattgcctatcccggtataccgccggaggcattcatatagagtcatattttgttctagtatcgagttgtaatcattgagttgtaagtaaataaaagtgtgatgatcgtcattattaaagcattgtcccaaaaaaagaagaaaggccaaaaaaagaaggggccaaataaaaaagaaaggccaaataaaaaagggaaaggccaaataaaaaataaaaaaataaatataagggaaaatgctactatccttttacaacacttgtgcttcaaagtagcaccataatcttcatgatagagagtctcttgttttgtcacttccataaactagtgggaatttttcattatagaacttggcttgtatattccaacaatgggcctcctcaaatgccataggtcttcgtgagcaagcaagttggatgcacacccacttagtttcagtttgagctttcatacacttatagatcttagtgcatccgttgcgtggcaatccctactcgtatatgaaagtgacaacataagagactctctatatgaagagcatggtgctactttgaagcacaagtgtggtaaaaggatagtaacattgcccctttttcttttctttttttctcttttttttccttttctttttttgggtaggcttctttggcccccttttttatttaggcttctttggcctctctttttcttattttttttttatttttttcttggggaaatgctctaataatgatgatcatcacacttttatttacttacaactcaatattacaacttgatactagaacaaagatatgactctatatgaatgcctccggcggtgtaccgggatgtgcaatgatctagcatagcaattacatcaaaaaacggacaagccatgaaaacatcatgctagctatcttacgatcatgcaaagcaatatgaaaataaatgctcaagtcatgtatatgatgatgatggaagttgcatggcaatatatctcggaatggctatggaaatgccatgataggtaggtatggtggctgttttgaggaagatataatgaggcttatgtgtgacagagcgtatcatatcacgaggtttggatgcaccggcgaagtttgcaccaactctcaatgtgagaaagggcaatgcacggtaccgaagaggctagcaatgatggaagggtgagagtgcgtataatccatggactcaacattagtcatagagaactcacatacttattgcaaaaatctattagtcatcgaaacaaagtactacgcgcatgctcctagggggatagattggtaggaaaaaaaccatcgctcgtccccgaccgccactcataaggaagacaatcaaataacacctcatgtttcaaatttgttacacaacgtttaccatacgtgcatgctacgggacttgcaaacttcaacacaagtatttctcaatttcacaattactcaactagcacaactttaatattactatctccatatctcaaaacaatcatcaagtatcaaacttctcttagtattcaacgcactcataagaaagtttttactaatcttgaatacctagcatattaggattatttaagcaaattacaaggctgtttaagacnctcaaaataatataagtgaagcatgagagtcatctatttctacaaattaaacaacaccgtgctctaaaaagtataagtggagcactaganaacaacaaactannctgaaagtataatngaaatcaatgagtattgataata

SEQ ID NO: 30712 - DNA, 2067 bp, Triticum aestivum
  unsure (1)..(2067): unsure at all n locations
  Clone ID: PAT_TA_30712
aggggctgcgccccctctagggtttccacccccaagggctggcggccagccctacatcccatctaggggggcgaccaaggggaggagaggggggcgccactagggtgggccttaaggcccatctggacctagggtttgccccctcccactctcccatgcgccttgggccttggtggggggcgcaccagcccacccggggctggtcccctcccacacttggcccacgcagccttctggggctggtcgccccacttggtggacccccgggaccctcccggtggtccaggtacattaccgatatcacccgaaacttttccggtgaccaaaacaagacttcccatatataaatctttacctccggaccattccggacctcctcttgacgtccgggatctcatacgggactccgagcaactttcgggttaccgcatactaatatctctataaccctagcgtcaccgaaccttaagtgtgtagaccctacgggttcgggagacatgcagacatgaccgagatgactctccggtcaataaccaatagcgggatctagatacccatgttggctcccacatgttccacgatgatctcatcggatgaaccacgatgtcaaggacttaatcaatccctatacaattccctttgtctatcggtacgacacttgcccgagattcgatcgtcggtatcccgataccttgttcaatctccgttaccggcaagtctctttgctcgttccataacacatcatcccgtgactaactacttagtcacattgagctcattatgatgaggcattaccgagtgggcccagagatacctttccgtttacacggagtggacaaatcccagtctcgattcgtgccaacccaacagacacttttggagatacctgtagtgcacctttatagccacccagttacgttgtgacgtttgggcacacccaaagcattcctacggtatctgggagttgcacaatctcatggtctaaggaaatgatacttgacattagaaaagctcttagcaaacgaactacacgatctttgtgctaggcttaggattgggtcttgtccatcacatcattctcctaatgatgtgatcccgttatcaacgacatccaatgtccatggtcaggaaaccgtaaccatctattgatcaacgagctagtcaactagaggcttactagggacatggtgttgtctatgtatccacacatgtatctgagtttccaatcaatacaattctagcatggataataaacgattatcatgaacaaggaaatataataataaccaatttattattgcctcaagggcatatttccaacagtctcccactttccactaagagccaatatcctattcacatcgccatgtggattaacactggataggccacatccccatgtgaccaacatccaaagagtttactaagtgnccactaaactattcacatcaccatgtgatttagactcaatgagttctggggtttgatcatgttttccttgtgagagaagttttagtcaacgggtctgcagtattcagatccgtatgtacttcacaattctctatgtcatattgtaaatggtgcttccaagttccacttgaagctattccaaatggttgctccactatacgtatccggtttgccactcagagtcattcggataggtgttaaagcttgcatcgacgtaaccctttacgccgaacctttatcacctccataatccgagaaacatgtccttatttactcccaaggacaatttgaccgttgtccaatgatccatccctaaattattcctgtacccttggactgaccaatggcaagnacacttacggtgcggtacacagcatacatactacanacctantctgaaccatanggacacttctccttctctctcttcggcgtggncactttaatctaactcaatacttacacnaagnaagaatcctcttgacgatcatctgacactnaagatatgtaaggaagtccaatnaaagacattacgtttgttaacccaaatctgtccaagtcaanagttantcagttcataaaccnttaanacagttg

SEQ ID NO: 30713 - DNA, 1129 bp, Triticum aestivum
  Clone ID: PAT_TA_30713
ttaaccctcactaaagggaacaaaagctggagctccaccgcggtggcggccgctctagaactagtggatcccccgggctgcaggaattcggcacgaggaaaaacacaccagagctcacctctcccctcgcttcctcgcgaaaatgtcgactgaggtggctgcggctgacatcccggtgcctcaggtggaggtagccgccgacgccgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagaccgccgccaagtccccggccaagaaggccgccgcgaagcccaaggccaaggccccagccaaggccaaggccgtcgcgaagcccaaggcggcggcgaagccgaaggcggctgccaagcccaaggccaaggctgccgccaagaaggcgcctgctgctgcgaccccgaagaagcctgttgcccggaagccgcccaccaagagggcgacgccggtgaagaaggccgctccggccaagaagcccgcggccaagaaggccaagaagtagaggccgcttgacggacctagatgccctggcggtagtattgagtagcctaattctctgttcggtgttgtcggtcaagagcttcttgactgtgtcttgggcggcggtgggctgtaaatctgatctatctgtgccgggggtgtacccttgtcgaggaagagtggtatccatgggaatcagttgtactagtagtagtaaccagtgtaattgagtctttttattatcgcagcaatatccatgagctatttgtcaaaaaaaaaaaaaaaaaaaaaaaaa

SEQ ID NO: 30714 - DNA, 667 bp, Triticum aestivum
  Clone ID: PAT_TA_30714
agctcgtgccgaattcggcacgaggatattttccccactcctatgcccctccctctcttcccccagatccaccgcaactgtggccgtgaacgccggcgcccacgcgcctcaccatgctctacgagcatgtccgctaggtgcggcgccgtcctctgcttcgactccgaccgctggaaccattcaggagcgaccgcgtcctcgggaacgacctcgaccacgccttcctcgccggaggctgcgccgagccgctctgtcaccctcctgcgctactaaactctcacaggccttcttgagccgcccgactacgagaccgacgctgctgccgccccgttcgactacggagttgacgacccctccttcttgccagagcaaccagatgacggatcccaggagccagacgacgccaccgatgactactactacccggaggatgcctactactgcttgaagaccaatgacgatttggagtagttaggaggctcccaggaaggaggccttgccttttcgatcgttgttgcttttgtgctagccttcttaagacaaacttgtttaacttatgtctgtactcagatattgttgcttccgctgactcatctttgatcaagctcttgtattcgagccttcgaggcccctggcttgtaatataaagcttgtattaaaaaaaaaa

SEQ ID NO: 30715 - DNA, 2876 bp, Triticum aestivum
  unsure (1)..(2876): unsure at all n locations
  Clone ID: PAT_TA_30715
tccgaacagcttcgggtaaccacatacatttccccataacaatatagcgtcaccngaccttaagtgtgtagccctacggggttcggggaaccatgtagacgtgaccggagacatctctccggcccaataaccaacagcaggatctggatacccatgttggctcccacatgttccacgatgatctcatcagatgaaccaccatgtcgggtattcaatcaatcacgtatacaattccctttgtccatcggtatgttacttgcccgagattcgatcgtcggtatccccatacctccttgaatctcgttaccggcaagtcactttactccgtactgcaatgcatgatcacgtggaccagacacttagtcacattgagctcattatgatgatgcattaccgagtgggcccagagatacctctccgtcatacggagtaacaaatcccagtctcgatccgtgtcaacccaacagtcactttcagagatacccatagtgtacctttatagtcacccagttacgttgtgacgtttggtacacccaaagcactcctacggtatccgggagttacacgatctcatggtctaaggaaaagatacttgacattggaaaagctctagcaaacgaactacacgatctttgcgctatgcttaggattgggtcttgtccatcacatcattctcctaatgatgtgatcccgttatcaatgacatccaatgtccatagtcaggaaaccatgactatctgttgatcaacgagctagtcaactagaggcttactagggacacattgtggtctatgtattcacacatgtattacgatttccggataacacaattatagcatgaacaatagacaattatcatgaacaaagaaatataataataacaatttattattgcctctagggcatatttccaacaacaatgaatgctcaagtcatgtatatgatgatgatgaaagttgcatggcaatatatctcggagtggctatggaaatgccatgataggtaggtatggtggctgttttgaggaagatatagggaggtttatgtgtgatagagcgtatcgtatcacggggtttggatgcaccggcgaagtttgcaccaactctcaagatgagaaagggcaatgcacggtaccgaagaggctagcaaaggcggaaaggtaaaagtgtgtataatccatggactcaacattagtcaaaagaactcatatacttattgcaaaaatttagaagtcatcaaaaatcaagtactacgcgcatgctcctagggggatagattggtaggaaaagaccatcgctcgtccccgaccgccactcataaggatgcacaagccaggtacacttcatgtttcaaatttgttacacaactttaaccatacgtgcatgctacgggacttgctaacttcaacacaagcattctttgaattcataatcacccaactagcatgactttaatatcactacctccatatctcaaaacaattatcaagtatcaaacttttcttagtattcaacacactcataagaattcttacaaatcttgtatgcttggcatattaggatttttcagcacattaccatgctatttaagactctcaaaataatatgagtgaagcatgagagttaatctatttcttcaaaatagaactaccaccatgctctaaaatatataagtgaagcactagagcaaacgacaaactactccgaaagatataagtgaagatcaatgagtagtcaaataattatgcaactatgtgaagactctctcatttaataatttcagatcttggtattctattcaaacagcaagaaaagcaaaagaaaattaaattaacactccaagcaaaacacatatcatgtggtgaataaaaatatagctccaagtaaagttaccgatagacgaagacgaaagaggggatgccatccggggcatccccaagcttaggctcttggttgtccttaaatattaccatggggtgccttgggcatccccaagcttagactcttgccactcctcattccatagtccatcgaatctttacccaaaacttgaaaacttcacaacacaaaactcaacagaaaactcgtaagctccgttagtataagaaaataaatcaccacttaggtactgctgtgaactcattctttatttgtattggtgtaatatctgctgtattccaacttctctatggtttataaactattttactatccatagatgcatcaaaataagcaaacaacacacgaaagttagaatctgtcaaaaacagaacagtctgtagcaatctgtaactaacgcaaacttctggaactctaaaaatactaccaaaataggcagtcatggaaaatttgtctattgatcagcagcaaaacgaataaacacaaaatcacgtttctgtgatttaaaaaacaaatttcgtgcgcgcaaagtttctgtttttcatcagaatcaaatcaactatcatcataagttatcctataggttctacttggcacaaacactaattaaaacataaaaccacatctaaacagaggctagatgaattatttattactaaacagaatcaaaaagcgagaaacaaaaacaaaagtaaaattgggttgcctcccaacaagcgctatcgtttaacgcccctagctggcataaaatttcaacgatgctcacatgaaagataataattgaaacacaaagagagcatcatgaaacatgtgaaaaacacatctaagtctaacatacttcctatgcataggcatgttataggcaaacaaattatcaaggcaagcaaaaactagcatatgcaaggaagcggaaagaaacaatagctatctcaacataacgagaggtaatttagtgacatgaaaatttcttccaccata

SEQ ID NO: 30716 - DNA, 1220 bp, Triticum aestivum
  Clone ID: PAT_TA_30716
ttttttttttgcacgttaaatagcacggtcgctcatttagagagtttgtccgctcatttacagagtaccacatacaccaaaaatcaactggagcctgaacaaccacgcaaaactacctccctttgagctccagagtggagtccacttctttctactagtgtacaccaaaagtcccttaaaaaatcatcttgcacgtttatgcagctgttctctaccccagttctgcacagaaggttgacgcgccgaaccaatttgaggatgctgtatgttcttcatagctcgcttttgctggactttgcaggcttcttcttccccttccaccaattcttcaccgccttggacaccttgctcacatgccctttcagtttcttgccggtatccttgatctgtttcaccacctgttgcttcaggtctttcttttgcggacccttgtttttcagaatgtttcccaagttcttgggtaagctatcctcgtcttcatcgtcatcttcatcatcctcatcaccttcaacgccaaagttgttcttcatcagatcgtctctggagtacatcttcatgtttggggctcctggcatgccctccattgatctcattatcttctccatctcagcatcctttgagggctttgctgcaaagggttctccagggacccggtcttttggaactggtggtggatctgcagcacatgctttggtaatatctttgcagacaaactttatcagctgatcaactgaaggcttatttgtgtagacaaactcagcaacatcggtatcagcataacccatcacctcctggcatgcacgctcaatggtcttgcattccgagttacagtgcccttcctcatcttggtccacaagctcgagcctgtcgcccttctcgacgatgtcgatccggagcatccagtccgcctcctgcttcttcaggttgcacacattctccgcgatgtcgatgatctcgatctccggcaccttcttggagggcggaagggcttgctgcttggcggcgacctgcgcggagatctcccgcgcgatccgctcgcagacctggcaccggatgtacggcacgtcctcccgcctcgccgccgtcgccggcttcttctgccccgccgcctccgccgcgggcgccaccagcaggaggagcacggccgccagggccacggcgaccaccaccggggcagcgcttcctctcgccatctccgctcgtgccgaattcggcacgag

SEQ ID NO: 30717 - DNA, 1126 bp, Triticum aestivum
  Clone ID: PAT_TA_30717
ggagtaggactcctccaggcgcaccccaaaggggccggccgcacctccccctccctcctttatatacgggggcggggggcaccccatagacacacaagttgatcaacggatcgttccgtatccgtgtgcggtgccccctccaccatattccacctcggtcatatcgtcgcggagtttaggcgaagccctgcgccggtagagcatcatcatagtcaccacgccgtccgtgctaacggaactcatccccgaagctttgctggatcggagcccggggatagtcatcgagctgaacgtgtgctgaactcggaggtgtcgtatgttcggtacttggatcggtcggaccgtgaagacgtacgactacatcaaccgcgttgtcataacgcttccgctttcggtctacaatggtatgtaaaatacacactcctcccctctcgttgctatgccatcaccatgatcttgcgtgtacgtaggaaattttttgaaattactacgttccccaacagtggcatccgagcctaggttttaatgtgtagatgttgcaggcgaagaagagtagcagaggcacattggagacgatctgtagcagcagaaacttccgcgtggatgttgaagaagagtagcggaggaggatccttggggttgagctgcagcgtggtgaagaggacttggtgaagatcagcagcggagggcccggccttggggaggaatcgtggtggccttcacgggaggtcagccgaccacccgaagcagagaaccacctggtgtccggcgccccgcaggagatgccgcagcggcggtcgtcggagttgaagcagaccggcgcgggcgtcgatgttggagcagagcggcacgggcgtaggtgttggagacgagcagcagcagtcggtcaggacggagaagcctcgcagcggaacaccgagaagtcgttggagaggatcaacagctctgtttcttgaggttggggatgaggaagtacagcgggtcgacgtcggcattgaagaggagcagtggattcgatctggttctccttctcgcttccctcgatccccttttctccctcctccaatccggtgttcctttggttcgatctggtggtaggtgagcagcgtggagagcgagagcagtt

SEQ ID NO: 30718 - DNA, 1434 bp, Triticum aestivum
  Clone ID: PAT_TA_30718
atcggtctcaacaaacacaccgcaaaagaagattacatcgaatagatctccacgagggagggggagaacattgtattgagatccaaaaagagagaagaagtcgtatagctaataactatggacccgaaggtctgagataaactacctacacatcatcggagaggctatggtgttgatgtagaagccctctatgatcgatgcccctccagcggagctccggaacaggccccaagatgggatcttacgggtacagaaggttgcggcggtggaattaggtttttggctccgtatctggtagtttgggggtacgtaggtatatatagaaggaagaagtacgtcggtggagcaacatggggcccacgagggtggagggcgcgccgggggggtaggcacgcccccctacctcgtggcttcctggttgatgtcttgatgtagggtccaagtctcccgggtcttattcgttgagaaaatcatgttgccgaaggtttcattccgtttggactccgtttgatattccttttcttcgaaatacttaaataggcaaaaaaacaacaattctgggctgggcctcctgttaataggttagtcccaaaaataatataaaagtggataataaagcccaataatgtccaaaacgggtaataatatagcatggagcaatcaaaaattattggttacgtttggaggagttatccaagtacgagggttcactggttcggctgtggtgtgaggctgccgtcgccgcagggcctggccagcggtgggagtagtatgggggcggtgaggtctccgcggcagcacagccggccacgggaggcaggagcatgcggcacgaacggcgctgctttgggcggctggagcaagaagaccaaaggttgaagaagcactacggccattggatggacatcgtacggtcactggagctagaatcgttcatattgactaagttgacaaagccctccgtctccgtcaacttagtaggcccacaagtcagcctctgaaacggtgcgccccagatgtcagggggaggaatcattttttgggcggccgaagctaagaatatccgagattaaagaagaagcacgacatccgttggatagatatccaacggccactgctgctagaaccgtgtgttgactataataagttgacaaagccttgcatacgcgtcaacttatttttttaggggacgcgtcacttagtaggcccacaagtgtggcagagaacttatagcccatttgcgttttgtaagaatgtacaacccatttttgaattctaatggaatttacaacagcccatttacagtttgttaaaagtacagcccattttctagctaggacaacgattaataatttcaaccaaccgttgaagaccgaattcaataaaatttcccacattttgattggatccgaaatatttttatcccgaaatttc

SEQ ID NO: 30719 - DNA, 2434 bp, Triticum aestivum
  unsure (1)..(2434): unsure at all n locations
  Clone ID: PAT_TA_30719
taaaatacaaggacaaccaaaagcttaagcttggggatgccccggaaggcatcccctctttcgtcttcgtctatcggtaactttacttggggctatatttttattcaccacatgatatgtgttttgcttggagcgtcttgtatgatttgagtctttgctttttagtttatcacaatcatcctcgctgcacacaccttttgagagagacacacgtgattcggaatttgttagaatactctatgtgcttcacttatatcttttgagctatatagtttttgctctagtgattcacttatatcttttagagcaaggtggtggttttattttatagaaattattgatctctcatgcttcacttatattattttgagagtcctaaacaacatggtaatttgctttggttatgaatttagtcctaatatgatgggcatccaagagggatataataaaaactttcatatgaagtgcattgaatactaagagaagtttgatacttgataattgttttgagatatgaagatggtcagtggcggagccaactcaagtttagagccggggcaagatctaagtgctgccaaattacttagtttctacccaaacaaacttccacttcacccaattttctctactagagcttcatggacttgcaccaagggagcccgggcaagtgccccagctcgccaggtgctgtcaccgccactgaagatggtgatattaaagttgtgctagttgagtaattgtgaatttgagaaatacttgtgttgaggtntncgattcccgtaacatgcacgtatggtgaaccgttatgtaacgaagttcgagcatcagatagtttttgattgtcttccttatgagtggcggtcggggacgagcgatggtcttttcctaccaatctatgcccctaggagcatgcgtgtggtactttgtttcaatgactactagatgtttgcaataagtttgtgagttctttatgactaacgttgagtccatggattatacgcactctcagccttccaccattgcgagcctctctagtgcataactttccccggcttcgacaaccgaccatagtaccttcctcaaaacagccaccatacctacctattatggcatttccatagccattccgagatatattgccatgcaactttccaccgttccgtttattatgacacgctccatcattgtcatattgctttacatgatcatgtagttgacatcgtatttgtggcaaagccaccttcataattctttcatacatgtcactcttgattcattgcacatcccggtacaccaccagaggcattcacatagattcatattttgttctaagtatcgagttgtaattcttgagttgtaaataaatagaagtgtgatgatcatcattattcattattagagcattgtcccatgtgaggaaaggatgatggagactatgattcccccacaagtcgggatgagactccggactttatgaaaaataaacgaggccaaagaagcccaaataaaaaaagaggccaaagaagcccaccaaaaagaaagaaagaaaaaaaaaaaagaaaataaaagaaaataaaaaaatgagagaaaaagagagaaggggcaatgttactatcctttttaccacacttgtgcttcaaagtagcaccattatcttcatgatagagagtctcctatgttgtcactttcatatactagtgggcatttttcattatagaacttggcttgtatattaccgatgatgggcttcctcaaaattccataggtcttcgtgagcaagcaagttggatgcacacccacttagttgcttttgttgagctttcatatgtttatagctctagtgcatccgttgcatggcaatccctactccttgcattaacatcaattgatgggcatctccatagcccattgattagcctcgttgatgtgagactttctccttttttgtcttctccacaaaccccccatcattatattctattccacccatagtgctatatccatggctcacgctcatgtattgcgtgaaaattgaaaaaaagatagagattactaaagtatgaaacaatggcttggcttgtcttcggggttgtgcatgatgagagcattcttgtgtgacgaaaatgaagcatgactaaactatattattttgtagggantgaactttctttgggccatgttattttgagaaagacataattgcttttgttagtatgcttaaaagtattataatttaatgtcaatatgaactttttgtctngaatctttcgggtnatgaatattcataccacaattaaggangattacactaaatnatccaagtagnatccggataaaaaatccattttaacattanccgagggggggggccggtccaattcccntaaggagcctataancgcgtcatgggtcgtttaaagccnganggaaaact

SEQ ID NO: 30720 - DNA, 929 bp, Triticum aestivum
  unsure (1)..(929): unsure at all n locations
  Clone ID: PAT_TA_30720
cggccgcgtgggcggacgcgtgggccgcaagattctgtcggtgcagctcaagaagctggtcgcctccggcaagctgaccaaggtcaaggcctcgtacaagctgtcggccgccgcggccaagcccaagccggcggcgaagaagaagcccgcggcgaagaagaaggcgccagccaagaagaccgccaccaagaccaaggccaaggcgcccgccaagaaggccgccgcgaagcccaaggccaaggcgcccgccaagcccaaggccgccgcgaagcccaagcccaaggccgccgcgaagcccaaggccaaggccgccgcgaagcccaaggctgccgccaagcccaagggccgccccgccaaggctgccaagacctcggccaaggacgcgccagggaagaaggcccctgccgccgcggcgcccaagaaggccgccgccaggaagccgcccaccaagagatccacgccggtgaagaaggccgcgcccgccaagaaggctgcgccggcgaagaaggccccggccgccaagaaggccaagaagtagatccttggagggagatcctagggcttggcgatagttttccagtagcagtttttcctgttctgtgctgttagtcgagatgtccgggctgtgtcgggggtgctaggctgtaaatttgaaatctgggttggggtgcactggtgatcctgtgcacccctttgtgtgtgttgtgagaaacggtggcgacgatcgcgttgtagcaagcttatgtatttgtgtaactgaattgggtaattgaatcttcattttagcaacatccttctgaaaaaaaaaaaaaaaaaaaacanaanaataaaaaaaaaaaaaanaaaaaaaaaaaaaaaaaaaaaaaaaaaaaaaaaaaaaaaanaaaaaaatnaaaaaacaaattnnccgaancctnggcngganaaac

SEQ ID NO: 30721 - DNA, 2487 bp, Triticum aestivum
  unsure (1)..(2487): unsure at all n locations
  Clone ID: PAT_TA_30721
tattttgaatttcaaggaatttaattatgataattgatctttaatagattgtatttccttgtcgcaatccgtgttgaattctcctcatgcttatagccaaaataaagcttttactaaacatatcgttgatgctttgatgcaatcttatgaagaaaaacttgaattagaagtttctaccctagaaaactttatgatgagtgggaatccactattaaaattaaaaataaaaatcatgaaggctatgcattgtgtgatttgggtgctagtgtttccacgattccaaaaacattatgcaatgtgctaggtttccgtgaatttgatgattgctctttaaacttgcaccttgcggattccactattaagaaacctatgggaagaattaatgataatcttattgctgaaaataggaattatgtgcccgtagaccttagtgttcctgacatagattgcaatccttcatgtcctattattcttggtagacctttccttagaacgattggtgcaattattgatatgaaggaaggaaatattagattccaatttccattaaggaaaggcatggaatactttcgtagaaaaatattaaattaccttatgaatctatcatgcgggctacttatggattgcctaccaaagatggcaatacctagatctattcttcgcttgttatgcctagctaggggcgttaaacgatagcgcttgttgggaggcaacccaattttattttgtgttttttgctttttgctcctgtttagtaataaataatttgcatctagcctatattttggttgtgttttatgtgtttaattagtgtttgtgccaagtagaacctataggataacctatgatgatagttggtttgattctgctgaaaaacagagactttgcgcgcacgagaaaatattcaataaatcacagaaacgtgcttttgtgttgattatttttgctgctgatcaataaacaaattttccaggactttatattttggtagaatttttagagttcaagaagtttgcgttagttacagattgctacagactgttctgtttttgacagattctgtttttcgtgtgttgtttgcttatttcgatgcatctatggctagtaaattagtttataaaccatagagaacttggaatacagtaggtttaaaaccaaaataaataaataatgagttcattgcagtaccttatgtggtggttttgttttctttcactaacggagcttataagatttcctgttgagttttgtgttgtgaagttttcaagttttgggtaaagcttttatggactatggaataaagagtggcaagagcctaagcttggggatgcccatggcaccccaagatattcaagaatagccaaaatgctaagcttggggatgccccaggaaggcatcccctctttcgtcttcgttcattggtaactttacttggagctatatttttattcgctacatgatatgtgttttgcttggagcgtcgtgtattatattaatctttgctttttagtttaccacaatcatccttgctgaacacaccttttgggagaagcctacttgattaggatttattagaatatgctatgagcttcacttatatcttttgagcttgatagtttttgctctagtgcttcacttatatcttttagagcacggcggtgtcttaattttgtagaaatttctagtctctcattcttcacttatattattttgagagtcttttagaacagcatggtattttctattttcataaagttggtcctagaatgatgagcatccaagttgggtataataaaaactatcataggaagtgaattggatgctatgatcaacttgatacttgataattgttttgagatatggaggtagtgatattaaagtcatgctaattgggtgattatgaatttaaagaatgcttgtgttgaagttagcaagtcccgtagcatgcacgtatggttaaagttgtgtaacaaatttgaagcatgaagtgtacctggcttgtgcatccttatgagtggcggtctgggacgagcgatggtcttttcctaccaatctatccctttaggagcatgcgcgtagtgcttggtttttgatgacttccaaatttttataataagtatatgagttcttttgaccaatgttgagtccatggattatatgcacttttacctttccatcattgctagccttttcggtaccgtgcattgccctttctcactttggagggttggtgcaaacttcgccggtgcaccaaaccccatgatatgataacatctatcacacataactcccttatactcctcaaaaacaccacatacctacctattaagggattccaatagcatcccgagatatatgccaagcacttccaacgtccgtcaacacacaagacatacatacttgtcanatgcatgcagatatgtattgcatcgattatggaaatcatgatcanantttgtangcnnctgatcataacanccgtnacgc

SEQ ID NO: 30722 - DNA, 1271 bp, Triticum aestivum
  Clone ID: PAT_TA_30722
cgcatctctctcacctccggcgaaaacacaccagcgctcccctctcccctcgctttcccgccgcaatgtcgaccgacgccgctgccgccgacatcccggtgcctcaggtggaggcgaccgccgaccccgtcgtggagaccacgactgacgcccccgccggcgacgccaagacgaccaaggcgaccaaggccaaggccgcaaagacccccaaggcgcccaaggtgaagaagccctccgccccgaggaagcccaaggccgcccccgcccacccgacctacgctgagatggtggcggaggcgatcgccgccctgaaggagagaggcgggtcgagcaccgtcgccatcgccaagtacatcgaggacaagcacaaggcgcacctcccggccaacttccgcaagatcctgctgacgcagatcaagaagctcgtcgccgccggcaagctgaccaaggtcaagggctcctacaagctcaccaaggcccccgcagcgcccaagaagcccaagaccaaggcgccagcaaagaagaagcccgcggcgaagaaggcgccggccaagaagcccgccgccaagtccccagccaagaagaagcccgccgccaagcccaaggccaaggcccccgccaagaccaccaaggccgccgccaagcccaaggcggcaacgaagcccaaggccgccgccaagaccaaggctccagccaagaccaccaaggccgccgcgaagcccaagccggccgccaagacgaaggcgcccgccaagcctcggggccgccccgccaaggccgccaagacctccgccaaggacgcgccagggaagaaggcgcccgccgccgccgccacccccaagaaggccgcccccaggaagccgcccaccaagcggtcggcgccggtgaagaaggccgcgcccgccaagaagacccccgccaagaaggccaagaagtagagcctccgtcctccggcaaaccagtttccattagcagttttcccctgttctgtgtcggtggtagtccaggattgtgtgttctagactgtaaatttttacatccgggtcggggtgctctggttcaatccggcgtacccttggaggtgtatctgtgggtgaaacgacgacggcggcggcgagggttcgtccccgagcctccgttttaccgtagcagcttgatttgtcgaggttttttagcgtagcaagatccttgtgatggtgtcgaaaacaaatagtgcattgtttatctaattaattatggttatggtcaaaaaaaaaaaaaaaaaaaaaaaa

SEQ ID NO: 30723 - DNA, 2373 bp, Triticum aestivum
  unsure (1)..(2373): unsure at all n locations
  Clone ID: PAT_TA_30723
ccacgcgtccggttttgaccagtcaacccaggaaatgttgaatgttcaccctgttgactcagcacacccctacccccactgtcagcctctaacgcactgctgggtccattggactgggtgcatctagtattttaggtgtattttcgaattaatattaaatctagaaatttcagaaaatgtttaaaactttgaaaattaatataaaataatccgtaactcggatgaaaatactttgtacatgaaagttgctcagaacgacgagacgaatccgaatacgcagcccgttcgtccgccacgcatccctagcatagcgaacatgcaactttccccctctggttcatctgtccgaaaacgcgaaacactggggatactttcccggatgtttccccccttcgccggtatcacctcctaccgcgttagggcacagctagcaccgctcattgtcatgttatgcatcgtcatgcatttgattgcattatatttattgtgttccccctccgttacttctctccggtagaccccgagaccgacgccgctgctacccagtacgactacggtgttgacgacccctccttcttgtctgagcaaccaggcaagccccccctttgatcaccagatatcgcctactcttctctatactgcttgcattagagtagtgtagcatgttactgctttccgtcaatcctattctgatgcatagcctgacattgttgctacacctgttgataccttacctgcaatcctaaatgcttagtataggatgctagtttatcatcattggccctacattcttgtcagtctgccttgctatactatcgggccgtgatcacttgggaggtgatcacgggtatatactatacatacatacatactatacagatggtgactaaagtcgggtcggctcattgagtacccgcaagtgattcacatgagggggctgaaggtgcaggtggctccatcccggtagaggtgggcctgggttcccgacggcccccgactgttactttgtgggcggagcgacagggcaggttgagaacacctaggttagaggtgggcctggccctggtcggcgtccgcggttactttaaaataacatgcttaacgagatcttggtatttgatctgagtctggccactagcctatacgcactaaccaactacgcgggaacagttatgggcactcgacgtcgtggtatcagccgaagccttcgtgacgttagcgactgagcggcgcgcaccggattggaacgtaagcctgctcttgtattaagggggctaggtctgctttcggccgccctcgcaacgtgcaggtgtgcaatgggtgatgggcccagacccctgcgccataggatttagatcggcgtgctgacctctctgttgtgcctaggtagggctgcgacgtgttgatcttccgaggccgggcatgacctaggaaagtgtgtccggccaaatgggatcgagcgtgttgggttatgtggtgcacccctgcaggaaagttaatctattcgaatagccgtgatcttcggtaacaggatgacttggagttgtaccttgaccttatgacaactagaactggatacttaataaaacacaccctttcaagtgccagatacaacccgatggtcgctctctaacagggcgacgaggagaggatcgccgggtaggattatgctacacgatgctacttggtggacttaccttctgctctcttctacatgctgcaagatggaggtggccagaagcgtagtcttcgatatgactagctatccccctcttattccggcattctgcagttcagtccacatatgatagccttattccatttgataccaatgcatacatatgtagtgtagctccttgcttgcgagtactttggatgagtactcacggtttctttgctcctccttttccccccatcccttctacctggttgtcgcaaccagatgttggagcccaagatccagacgccaccgttgatgacgactactactactcgggaggtgcctactactacgtgcagaccgctgatgacgaccaggagtggtttgggaggatcccaggcaggaggcctgcgcctctttcgatttgtatcccagtttgtgatagccttcttaaggcaacttgtttaactgatgtctgtactcaagatattgttgctttccgctgactcgtctaagatcgacctgttgcattccgagcctcaaggcccttgggttgtaatatgatgcttgtatgactaattaatttgtanagtggtgttgtgantcttcccgtgagacctgatcttgatngtacnattgggtgtatgataagtgtacattgaattgggggcgtcacaaattgggtacaaaacggacgctgtaggaaccccttc

SEQ ID NO: 30724 - DNA, 1268 bp, Triticum aestivum
  Clone ID: PAT_TA_30724
gccggccgggttcgggcaacccaaacggcacgcccaaacccaaagccaagtcgcactcctcctcctatcctcttcctcgccgaggcggcgaccggccagcgccgcagcagcaaccccggccgccgccagctccacctccaccgcccgcgcgtctccgattcggcgaatttggggctgaggaaagaggaggagcgacttctctctgctctggtggttgcaacttcaggacaagatgcacttccttgcatcatttcacggccctgcaggttttgagcttttgtctgtttccctgggatggatgccaagaagttcctgcagatggtcgaagacaagaagaagagactccttgagaagaaggaagccccactgaaatggcagcagaaactggaagcggcaattaaggccactgaagagaaggagaagaagctcaagtcaaaaaagcacaggaggcgaagctattcttcctcagagtctgacagtgaatccgagagcgacagtgatcggaaacacaggaagaggaaggaccgcaaaaggcacaggaaacatggccactctgactctgatggtgccaggaggcgcaagcacaggtcaaagaggaggagcttggactctagtgatgagagcgacagtgatgaatatgatagcgaatctgaagaagagcgcccaaggaagaagcactcgcacaggaggaagcatcaccgacactctccaaggtcagagtctgatgcttcagattacagcagcgatgatgatgagcggagatcaaccaggaaggaccacacaaggagccgcaggcgtcgccaccgatcattagacgatgaatctgaggacaagatcaggtcgaggcataggaagcgtcacagatcaagtgacgaggacaagccatcagattctgacatccataagcgtcacaggagccgctctatgtccttggatgatggtgctgctggtgagccagacaagatgaatgatggtaaggggtctcacaaaagccggcaccaccgccgccatcaccatcaccatcatgatcaccatggcaactctgctgaacccagtgacggggaagcaactcgtgtaagttgttaatgcctcagaacctgattggcgtcatcactgggctctgtgacgggaaggtttgccccagttggctagttgctgaatgaaagcatgtatctttcataatgttactgtctcggctctgctgcgacttctgaagcctgtacttgttgtactgaaaaatttggcgacaccagatgttatttccagca

SEQ ID NO: 30725 - DNA, 3248 bp, Triticum aestivum
  Clone ID: PAT_TA_30725
ttgatcctgctgaaaatcagaaacttttgcacccaataaattagttttggtaatccaaagaaacgtgattttgatatgatgctttttgatatgtactgttacacaagtggtttaggttttcgcaatttatcaggatttgtggagttacagaagtattctagagttacagtttactacagacagttatgtttctgacatattctgcattctatgtgttgtttgcttattttgatgaatccatgagtaatatgggagggtatgaaccatagagaagttggaatacagtaaatatttcacaaatatgaatttagaatgagttcataacagtacctaagtggtgatttattttcttatactaacggagcttacgagttttctgttaagttttgtgttgtgacgttttcaagttttgggtaaggrtktgattgastagggaataaggagtggcaagagcctaatcttggggattcccaaggcacaccaagttaatattcaaggacaaccaaaagcctaagcttggggatgccccggaaggcatcgcctctttcgtcttcgtctatcggtaactttacttgaagctatatttttattcaccacatgagatgtgtttttcttggagtgtattgtatgatttgagtctttgatttttagtttaccacaataatcctcgctgtaaacaccttttgggagagatacacatgaatcggaatttattagaatactctatgtgcttcacttatatcttttgagctaggcaatattgctctagtgcttcactattatctttttagagcacgacagtggttttattttatagaaattgttgatctctcatgcttcacttatattattttgagagtcttctagaacagcatggtaatttgctttggttataaaattagtcctaatataatgggcatccaagataggtataaaattagtcctaattttcatatagagtgcattgaatactatgagaagtttgatacttgattattgttttgagatatgaagatggtaatattagagtcatgctagttgagtaattgtgaatttgagaaatacttgtgttaaagtttgcaagtcccgtagcatgcacgtatggtaaccgttgtgtaacaaatttgaaacatgagttgttctttgattgtcatccttatgagtggcggtcggggacgagcgatggtcttttcctaccaatctacccccctaggagcatgcgcgtagtactttggtttttgatgacttgttgatttttgcaacaagtatatgagttcttcatgactaatgttgagtccatggattatacgcactcttttacccttccaccattgctagcctcccttgtatcgtgcaactttcgccggtaccatatacacccaccatatacctttcctcaaaacagccaccatacctacctattatggcatttccatagccattccgagatatattgccatgcaactttccaccgtttcgttcatatgacacgcatcatcattgtcatattgctttttgcatgatcatgtagttgacatcatatttgtggcaaagccaccatgcataatttttcatacatgtcactcttgattcattgcatatcccggtacaccgccggaggcgttcatatagagtcatatcttgttctagtttcgagttgtaaaaccataaaagtgtgatgatcttcattattagagcattgtcctagtgaggaaaggtgatgaagctatgttccccccacaagtcgggatgagactttggatttacaaaaagaaaaaaaaaagagaaaaaaaagagaaaggcaaaaaaaagagaaggcccaaagaaaagaaaaaaaaagaagaggaaaagaaaaaaatgatgagagaaaaagagaaaaggacaatgctactatctctttttccacacttgtgcttcaaaatagcaccatgatcttcatgttagagagtctcatatgttgtcactttcatataccagtgggaatttttcattatagaacttggcttgtatattccaatgatgggcttcctcaaaagtgccctaggtcttcatgagcaagcaagttggatgcacgcccacttagtttcttttgttgagctttcatacatttatagctctagtgcatcccgttgcatggcaatccctactcactcacattgatatttattgatgggaatctccatagcccattgatacacctagttgttgtgagactatcttctccattttgtcttctccacaatcacaattctattccacctatagtgctatatccatgtctcacgctcatgtatggcatgaagattgaaaaagtttgagaacatcaaaagtatgaaacaattgcatggcttgtcatcgaggttgtgcatgatttaaatattttgtgtgatgaagataaagcatagccagactatatgattttgtagggatgagctttctttggctatgttattttgagaagacataattgcttggttagtatgcttgaagtattattatttttatgtcaatattaaacttttatcttgaatcttttagatctgaacattcacgccacaataaggaaaattacattgaaaattatgttaggtagcattccacatcaaaaattctgtttttatcatttacctactcgaggacgcgcaggaattaagcttggggatgcttgatacgtctctaacgtatctataatttttgattgttccatgctatattactatgtgctttgaatgattatgggctttattatacacttttatattacttttgggactaacctattaaccagaggcccagcccatattgctgttttattgcctgtttcagtatttcgaagaaaaggaatatcaaacggagtccaaacggaatgaaaccttcggcaacgtgatcttctcactgaacgtgatccaggagacttggaccttactccaagaagtttccagggaggtcacgaggttggagggcgcccccctgggcgcgccccatgcctcgtgggcccctcggagctccaccgacgttctccttcctcctatatatacctacgtacccccattagaccaaagagggagccaaaaaacctaattccaccgccgcaacttcctgtatccacgagatcccatcttggggcttgttccggagctctgttggcgagggcatccatcacggagggcttctacatcaacaccatagcccttccgatgaagtgtgagtagtttacttcaaccttcgggtccatagcttgtagctag

SEQ ID NO: 30726 - DNA, 1757 bp, Triticum aestivum
  Clone ID: PAT_TA_30726
tcctagtcaaaataggattcgcggagggggaaaagaggaggagggagccggccacctctcctagtcctaataggactaggggaagggggaggcgcgcagcccatctagggcagccccttctcttttccactaaggcccactatggcccatatagctcccggggggttccggtaaccctcccggtattccggtaaaatcccgatttcacccggaacacttccgatgtccaaacataggcttccaatatatcaatctttacgtctcgaccatttcgagactcctcgtcatgtccgtgatcacatccgggactccgaacaaccttcggtacatcaaaatgcataaactcataatgtaactgtcatcgtaaccttaagcgtgcggaccctacgggtttgagaacaatgtagacatgaccgagacacgtctccggtcaataaccaatagcgggacctggatgcccatattggctcctacatattctacgaagatctttatcggtcagaccgcataacaacatacgttgttccctttgtcatcggtatgttacttgcctgagactcgatcgtcggtatccaatacctagttcaatctcgttaccggcaagtctctttactcgttttgtaatacatcatttcgcaactaactcattagttatcatgcttgcaaggcttatgtgatgtgtattactgagagggcccagagatacctctccgacaatcggagtgacaaatcgtaatcttgatgtatgccaactcaacaagtaccatcaaaacacctgtagagcacctttatgatcacccagttacgttgtgacgtttggtagcacacaaagtgttcctcctgtattcggaagttgcataatctcatagtcataggaacatgtataagtcatgaagaaagcaatagcaacatactaaacgatcgggtgctaagctaatggaatgggtcatctcaatcagatcattcacctaatgatgtgatcccgttaatcaaataacaactctttgttcatggttaggaaacataaccatctttgattaacgagctagtcaagtagaggcatactagtgacactctgtttgtctatgtattcacacatgtattatgtttccggttaatacaattctagcatgaataataaacatttatcatgatataaggaaataaataataactttattattgcctctagggcacatttccttcagcgcgtagtaatttgtttcgataactaatagatttttgtaataagtatgtgagttctttatgactaatgttgagtcccatggattatacgcactctcacgcttccacctttgctagcctctctagtactgcgcaactttcgccgggtaccataaacccgccatataccttcctcaaaacagccaccatacctacctatcatggcatttccatagccattccgagatatatttccatgcaacttccatcatcatcatatacatgagttgagcatcattgtcgtattgctttgcatgatcgtaagatagctagcatgatgttttcatggcttgtccattttttgatgtcattgctacgctaggtcattgcacatcccagtacaccgccggaggcattcatatagagtcatatctttgttctagcatcgagttgtaatattgagttgtaagtgaatagaagtgtgatgatcatcattattagagcattgtcccagtgaggaaaggatgatggagactatgattcccccgcaagtcgggatgagactccggacg

SEQ ID NO: 30727 - DNA, 1007 bp, Triticum aestivum
  Clone ID: PAT_TA_30727
agaagcccgcggccaagaagaaggcgccagccaagaagaccgctaccaagaccaaggccaaggcgccagccaagaagaccgctaccaagaccaaggccaaggcgcccgccaagaagtccgccgccaagcccaaggccaaggccccagccaagaccaaggccgcggcgaagcccaaggcggccgccaagcccaaggccaaggcccccgccaagaccaaggccgcggcgaagcccaaggcagccgccaagcccaagggccgccccgccaaggctgccaagacctcggccaaggacgcgccagggaagaaggcgccggccgccgcggcgcccaagaagcccgccgccaggaagccgcccaccaagagatccacgccggtgaagaaggccgcgcccgccaagaaggccgcgccggcgaagaaggcccccgccgccaagaaggccaagaagtagatccttggaggaagatcctagggcttggcgatagttttccagtagcagttttttctgttctgtgctgttagtcgggatgtccggctgtgtcgacggtgctagactgtaaatttgaaatctgggtttgggtgcagcggatcaccggtgcaccccttggtgtgtgttgtgaggaaacggtgacgacgatcgcgctgtagtaagcttgattacgtccttgccctgactgctgagaacttccttgcaaggcgccttcagactcttgtcttcaaggctggcatggcaaaatccatccaccatgcccgtgtcttgatcaggcaacgccacatcagggttggcaggcagatcgtcaatgtcccgtcgttcatggtgagggttgaatccgagaagcacatcgacttctcactgacaagtccattcggcggaggccctgcaggccgggtgaagagaaagaaccagaagaaggcaagtggtggtggcgatgcaggtggtgacgaggaagaggaatgaggaactagtagctatcaccttatatttatcaaatgttggtgttatgagtac

SEQ ID NO: 30728 - DNA, 3280 bp, Triticum aestivum
  unsure (1)..(3280): unsure at all n locations
  Clone ID: PAT_TA_30728
aattccgggcgacgggaggctccaaccttcccttttcatgcaaatttaatgataatgaaaccttagcttcttatgctaatggtatctatgattactatgatgtggaacaaatagaaaaatttgttgcttttatgtgtgcttatgagattgaatctatgtttaaagcatttgacgattttgattattcggtttatagaccagaaaattttgctatgcttagatattgctatgaaaattatgaatacaattacaatattaatgcatttattgagaaagtctcccctgtccaagaagagactaatattttgcaggaagctatggaagaagaaattgatgaaagagtgagctcattggatgaaaaagatgatgaggagagcgaagaacaaaagtaggaagagcggattagcaacccgtgcccaccttctaatgagagtaaccctccaactcatacattatttaattccccttcgtgcttaccgaaggatgattgctatgatgattgctatgatcccttgaatttgtttgaaatatccctttttgatgatgcttgctatgcttctggccaagatgccaatatgaattatgcttatggagatgaacttgctatagttccttatgttaaacatgaaattgttgctattgcacccatgcatgatagtcctattgtctttttgaattctccaaactacactatatcggagaagtttgtgcttattaaggattatattgatgggttgccttttactactacacatgatggttttgatgaatataatatgtatgtgcttgctgctcctacttgcaattattatgagagaggaactatatctccacctctctatgtttccaatacgataaaattgcaagaaactgtttatactatgcattggcctttactaagtgtgcatgaattgttcttttatgacatgccgatgcataggaagagagttagacttcgttgttgcatgctatatgttactttgtgctcaccactaaatcacaaatcattgttaattaaaattggctttgatataccttgggatccgggtggatctattacttgagcactatatgcctagcttaatggcgttaaagaaagcgctgccagggagacaacccggaagttttagagagtcatttatttctgttgagtgctttcatatagtttaaaaacaaaataaaataaagaggggaacccaaaacttttcaaaaaggaaagtgaaagtgagagagacaatcattgttgaagtgggggagctccttgaactttgttcatgctcacggaaactttgtgaatcttgattacagaaatttttcaacaaaaataattatccccttgtacaattccattgtattgtaaaaataatgtgccaaggttttcctttaggatgtttacatttgcttgatggtttgtacggtgcaggacagaaactttggctgtagtgcacgattttacatttttagctggaacgtcaaatggttctgattctttttgcactgtcttcctatacaattttttttatttttcctaattttggtagaacttattaagtatcagaagtatggtgaatgttcagattgctacagactgttctgtttttgacagattctgtttttgatgcatagtttgcttgttttgatgaatctatcaatttatatcactggattaagccatggaaaagctatattacagtagacacaatgcaaaaacaaaatatgaattagtttgcaacagtacttagattagtgatttgctttattatactaacggatcttactgagtttctgttgaagttttgtgtggatgaagtgtttgatcaaggaggtctccatatgaggaaaaggaagagaggcaagagctcaagcttggggatgcccaaggcaccccaagtaaatattcaaggagactcaagcgtctaagcttggggatgccccggaaggcatcccctctttcttcaacaagtatcggtatgttttcggattcgtttcgttcatgcattatgtgcaagtcttggagcgtcttttgcatttagttttgatttttcttttatgcaccatgctggtatgagatagtccttggttgatttatagaattctcattgcacttcacttaaatcttttgagtgtggctttatagaatgcttcatgtgcttcacttatatcatttgaagttggattgcctgtttctcttcacatagaaacctgccatttgtagaatgctcttttgcttcacttatatttgttagagcgtgggcatatcttttgtagaaataattaaactctcttgcttcacttatatcaatttagagagatgacaggaattggtcattcacatggttagtcataaaatcctacataaacttgtagattgctgaatatgatatgtttgattccttcgaatagttttgcgatataaagatggtgatattagagtcatgctagtgggtggttgtggattgtagagacacttgtgttgaggtttgcaagtcccgtagcatgcacgtatggtaacggttgtgtgacaaatttgaagcatggggtgtttctttgattgtcttccttatgagtggcggtcggggacgagcgatggtcttttcctaccaatctatccccctacgggcatgcgtagtaagtactttgcttagagggctaataaacttttgcaataagtatatcagttctttatgactaatgtgagtccatggattatacgcacttttacctttctgcaattttctagcctcttcggtatcgtgcatttcccttcctcaccttgagagccagtgcgaacttcactggtgcatccaaaccccgtgataggatatgctctatcacccataggccttattataacttcctcaaagcaaccaccatatctacctattatggcctttccatagccattccaagatatactgccatgcaacttccaccacttccgtttgatgacttgagcattcattgtcttattgctttgcatgatcatatagctgacatagtagttgtggctcagccaccgttcatcattttccatacatgttacgctagatcattgcgcatcctgggtacatgccaagaggcattcatatagagtcatattttgttataggtatccgantggtaatttttattccttttggantaataantaaatagaagtggtgatgatcatcattttttaaagcatgccccagttagggagaggatggatgggagactatgatcccccccacaantcnggatgaaccccngacaatntagagaaaaaaagagaaaaatt

SEQ ID NO: 30729 - DNA, 1774 bp, Triticum aestivum
  Clone ID: PAT_TA_30729
tagtctcgcgttttttttttttttttttgcaaaatacgctttaggtataatataatattatatgcctaacttgaatagggtaccgtcagaatcggcactcggttgattcaggtcattcctccggtgaataagttcgagttccaacaattactgaaagtcgctacttatctacaaaatcttccctgcactcaggaaagcaaactactaccaccaccttgttacctatttctagttagggagcctgcagctatcacccccattaccaggcaaattatctcctacctgcgcacgctgtcttcaggctgcgggcaggttcttcttaaccttgtcttccaggaacttcctagtgtcagcgcccttcacgttgaactccatcagaagatcttcaaacagcgtcttgaggttgtcagtgaactgagtgcgcctacccagaggatccaccctcatcacttcttgcttctttggtacactgctgctactgcggctgctgctgctgctgctagacgctccagtgccgtcgtattccgcttcttcctcttcggggacctccgatccgaccatgttaccctctaggtagtgtttgcatgctgccagaatggtgcgtccgcgttcccggaagtggcccggcgacaaggtctccaaagtgctccggaggccttctaagtgaatacagcatagtcctacaggagtgcagaaatgtgttcttgttatactctacagaatgctgttgtccagttgcggtattcgcagagcctgcatatcccggttcattgaagtatggcttctcattcaaaatgagagcctgaatggacacaagcacctgcagcatggttgagtgagctgagttccacttctcgcaaccactaccactccaggtaccaaggaggctaaggcagacttttccacaattatacaagttcggattaagtcgaagccctccagaatggtaatacaccaacggaggctctgaaggataattagaggtaaaatgtgcatcaaagaagaagagaccatcatgatagggtgttcccttagggccaataatcgcagccctaagaagatccattctatcttcagcaacacggacaaagatagaagctggtagatctttctctaaaagtttccagtcatgttgaattctctttgcccattccctgcttgtcttccccactgatttattagcataatggtggtcagagaaattttgaacagtgtagaattgttgaaatgccttatatttccttgtaatttcatcctcaactaactcatctgacgctccatcctgctcgtcattggctgcaagtttctgaagccatggtacagtagcctccacacctggaggcagatctaaatcatcaaatttatcagcaagctgctgattaaagtcagcttcatcaaattcatattcagagtcatcgccgttgtcatcatcacaatcatcatcatcatcatccatatagtaatcctcttcctcattttctgcgtaatcagtatctggtagctctgattcagacatttgcacagaagcacttgtgctggatccaacttggtcgctggaagaaccctcgcatcgctggcgcttctgctgcgatgaactccaagccgcggcgcccgtcgcccagcacgacgagccgccctgctgcggcccgcggcactctgtgtccatggccgccggcgcaggccaggccgggggcgccgcgagaggcgtaggaggcggggtggggtgggagctcgggcggagtgcgcgggtgcgacggaggggaggggaggggag

SEQ ID NO: 30730 - DNA, 2339 bp, Triticum aestivum
  unsure (1)..(2339): unsure at all n locations
  Clone ID: PAT_TA_30730
cggaacacactatactgtttctgacaaattctgttttacgtgtgttgtttgcttattttgatgaatctatggctagtaaaatagtttagaatccatagagaagttggaatacagtaggtttgacaccaatataaataaagaatgagttcattacagtaccttgaagtagtcttttgttttctttctctaacggagctcacgagatttctgttgagttttgtgttgtgaagttttcaagttttgggtgaatttttttgatggattatggaacaaggagtggcaagagcctaagcttggggatgcccatggcacccccaagataatccaaggacaccaaaaagtcaaagcgggatgccccggaaggcatcccctctttcgtccacttccatcggtaatttacttggagctatatttttattcaccacatgatatgtgttttgcttggagcatcatgtattatattaatctttgatttttagtttaccacaatcatccctgctgtacacaccttttgggagaagcccacttgattataatttgctagaatactctatgtgcttcacttatatcttttgagcttgatagattttgctctagtgcttaacttatatcttttagagcatggcggtggctcatttttgtagaaattgctagtcactcatgcttcacttatattattttgaggttattttagaacatcacggtatttgctatggttacaaatttggtcctagaatgatgagcatccaagttgcgtataataaaaactatcacagaaagtgaattggatgctatgatcaatttgatacttgataattgttttgagatatggaggtaatgatattatagtcatgctagttgggtgattatgaatttaaagaatgcttgtgttgaagttggcaagtcccatagcatgcacgtatggtaaaagttgtgtaacaaatttattgcatgaagtgctcttttgattgtgcatccttatgagtggaggtcgggggcgtgcaatggttaactcctaccaacctcccccctaggagaatgcgtagtagtactttgcttcgagggctaataaaacttttgcaataagtatatgagttctttatgactaatgttgagtccatggattatacgcactctcacctttccacctttgctagcctcttcggtaccgtgcattgccctttctcaccttgagagttggtgcaaacttcgccggtgcatccaaaccccgtgatatgatacgctctatcacacataaacctccttatatcttcctcaaaacagacaccatacctaccaattatggcatttccacagccattccgagatatattgccatgcaactttccaccgttccgctcatcatcatcatgacatactttacttttgtcatattgccattgcatgatcatgtagttgacatcgtatttgtggcaaagccaccatgcattatttttcatacatgtcactcttgattcattgcaccatcccggtacaccgccggaggcattcatatagagtcatatcttgttctagtttcgagttgtaatccttatgttgtaatcaatagaagtgtgatgatcaatattattagagcattgcccaaaaaaaagagaaaggccaaaaaaagaaaggcccaaaaaaagagaaaggcccaaaaaaaggggcaatgctactatctctttttccacacttgtgcttcaaagtagcaccttgttcttcatgtagtgagtctcataagttgtcttgttcatactagtgggaatttttcattatagaacttggcttgtatattccaacgatgggcttcctcaaaatgccctaggtcttcatgagcaagcaagttggatgcacacccactagttttcttttgttgagcattcttagctctagtgcatctgttgcatgacaatccctactccttgcattaacatcaattgatgggcatctccatagctcattgattagcctcgttgatgtgagactttctccttttttgtcttctccacacaatccccatcatcatattctataccacccatagtgctatgtccatggctcgcgctcatgtattgcatgaaggttgaaaaagtttgagattatttgagtatgaaacaattgcttggcttgtcatcgggggtatagaagttgggaacatctttgtgtgacgaaaatgaagcatagcctaactatatgattttgtagggatgaactttcttttgccatactattttgagaagacatgattactttgattagtatgcttgaagtattattatttttatgncaatatgaactttngncttgaatctttcggatctgaatattcatatnacaag

SEQ ID NO: 30731 - DNA, 1817 bp, Triticum aestivum
  Clone ID: PAT_TA_30731
cataaaccttagaggagacataaatgtctgtattgttggagatccaagttgtgcaaagtctcagtttttaaaatacactgctggtattgttccgcgatctgtttacacatcagggaagtcctcgtctgctgctggattgacagcaactgttgcgaaagaacctgagaccggtgaattttgtattgaggcaggtgcactcatgttagctgataatggcatctgttgtattgatgaatttgataagatggatattaaggatcaggttgctatacatgaagcaatggagcagcaaaccatcagcataacaaaagctggaatacaagcaactttgaatgcacgaacttcaatactggcagcagcaaatcccacaggaggacggtatgacaagtcaaaaccacttaagtacaatgtggcgctacctccagccattctttcaagatttgatctggtatacatcatgattgatgaacctgatgaaaacactgactaccacattgctcatcacattgtgagagtccatcaaaaacgtgaagaagcactttcccccgcatttagcactgcagaattgaagcgctactttgcttttgcaaagtctttgaaacctcagttgagttctgaagcaaagaaagttctggtcgaatcatatgttgtcctccgtagaggtgacagtactcctggtactagggttgcttacaggatgacagttaggcaactggaggcgctaatcaggctgtcagaagctattgccagaagccatttggaaagaattgttctccctgctcatgtccgcatggcagttaaattactcaaaacatccataataagtgtggaatcaagtgaagttgacctatctgattttcaagatgcacctcttgatcatgatgatgaacagccagtacaaggagatgctactcaacaagatggtccagatgaaccagcagaggtgattaagaagaaattggttattactgaagaacatttccagagagttacacaagctttggtcatgagactgcggcaacacgaagaatcagtcaagaaagacggggatgttctggctggcatgaagcaaggggatctaatcatttggtatgttgagcagcagaatgcccaaggtgcatatagttctacagaagaggtgaaggaggaagtaaagtgcatcaaagccattatagagaggctgatacagagggaaggccatcttgtagtcatagacgaaggaacagcggcagcagaaggtgctgcagcaagggcatcggagcacagaatcctggctgttaacccgaactacgtcattgattgattaaccagctgaggacacagctaactagatccatcatatgtggttgaccaatagagcagacattcaaacggaagacatcctgttgtcatatgctctagaaatgatatgttgtacctgccatccccttcccaaggaagcataagatctctggaattgtatcttccatccaaggttgaaatgtggtaattaatttgccaccagtattggttgcgtattctccaccgtttattggttatgtaaactgcaactctgtaagacaagtatagcttaatttatgtgtttctgaaaaaaaaaaaaaaaaaaaaaaaaaaaaaaaaaaaaaaaaaaaaaaaaaaaaaaaaaaaaaaaaaaaaaaaaaaaaaaaaaaaaaaaacatataaaaaaaaatataaaaggtttattaaataataatttaatatatattaaatttagttaagggggggggggttttttttaggttaaaaaattttttaaaatgattattgtgagggtattttttttttttgggttgaaa

SEQ ID NO: 30732 - DNA, 1246 bp, Triticum aestivum
  Clone ID: PAT_TA_30732
cacaagcaaaggagattgctgggaaaggcgcctcgaccaactcaatctggaccatcagattcatgcgtagctctaggcttcttcttgtaccccacccccacccccacgcgtcgcaccgaacacgccccacttcttctggcacgtgcgctccgcgcacgcgtcttcacgccccgcccgaaaagcgcaacgcgcagatcccctatacgcgataccccaatcgaagaagagaggaaaaagaaagcgagctctgcggcggagccatgtccggggccggggagtaccaggagatggccgcgtcggtgccgccggcgctcaaggccatcacgctcacccacgtccgctaccaccggggcgacagggtcggcctcttcctcgcgtgggtctccctaatccccgtcttcatcagcctcggcggcttcatctcccacttcatgttccgccgcgagctgcagggcatctgcttcgccttggggctcctcgtctcgcaggtcctcaacgagctcatcaagcactccgtcgcgcagtcccgcccggcctcgtgcgagctgctcgagacctgcgactcccacggatggccgtccagccacgcgcagtacaccttcttcttcgccacgtacctctcgctcttcgtgctccggcggtcgccggcgagccgcgtcatggccgccttctcatggcctctcgcgttcctcaccatgctctccagggtgtatctcggctaccacaccgtcccgcaggttttcgcgggagcagtagtcggccttgtatttggtgctatctggtactggttcgccaacaccgttcttgctcaatacttcccaatgattgaggagagcgcaattgggaggtggttttatatcaaggatacttcacatattcaagatgtgctcaagtttgagtatgataatgcaagggcagcaaggaagaaagttgctactgattgaggatatggtggagtccaggagccagatgccacctttgacgactgctgctaccccgagggtgcctactaccacgtgacggacgccgacgaccaagagtagttaggaggctcccaagcaggaggccttgccttttcgatcgtagatgcttttgtgctagccttcttaaggcaaacttgtttaactcatgtctgtgctcagatattgttgcttccgctgactcgtttgttttcaagctgatgtattcgagccctcgaggcccctggcttgtaatataaggcttgtattattttaaaaaggggggg

SEQ ID NO: 30733 - DNA, 1364 bp, Triticum aestivum
  Clone ID: PAT_TA_30733
cctgtgcggcgctcgaggcggccggtcgggaccagctcacacgcatctctctcacctccggcgaaaacacaccagcgcgcccctctcccctcgcttccccgccgcaatgtcgaccgacgccgctgccgccgacatcccggtgcctcaggtggaggcgaccgccgaccccgtcgtggaagaccacggctgacgccgccgccggcgacgcgaaggcgaccaaggctaccaaggccaaggccaaggccgccaagacccccaaggcgaagaagccctccgccccgaggaagcccaaggccacccccgcccacccgacctacgctgagatggtgacggaggcgatcgccgcgctgaaggagaggaacgggtcgagcaccgtcgccatcgccaagtacatcgaggacaagcacaaggcgcacctcccggccaacttccgcaagttcatgctgacgcagatcaagaagctcgtggccgccggcaagctgaccaaggtcaaggcctcctacaagctcaccaaggcccccgcagcgcccaagaagcccaagacgaaggcgcccgccaagaagaagccggcggcgaagaagaaggcgccggccaagaagcccgccgccaagtccccagccaagaagaagcccgccgccaagccgaaggccaaggccccagccaagaccaccaaggccgccgccaagcccaaggccgctgccaaggccaaggctccagccaagaccaccaaggccgccgcgaagcccaagccggccgccaagacgaaggcgcccgccaagcctcggggccgccccgccaaggccgccaagacctccgccaaggacgcgccagggaagaaggcgcccgccgccgccagcacccccaagaaggccgcccccaggaagccgcccaccaagcggtcggcgccggtgaagaaggccacgcccgccaagaaggcccccgccaagaaggccaagaagtagagcgtctctgtcctcccgcaacaagtctcccgtagcagttttcccctgttctgtgtcggtggtagtccaggattctgtgttctagactgtaaattttacatccgggtcggggtgcgctggttcaatccggcgtacccttggaggtgtatctgtgggtgaaacgatgacgacgacgacggcggcggcgagggtttgtcccccggcctccgcattaccgtagcagcttgatttgtcgaggttttttagcgtagcaagatcatgtgatgggtgtcgaaaacaaatagtgcattgtttatctaattaattatgattatgatcaatcgctcttgccctgcaatttttgtgatttttggatttgaaatcgggtgagatttggaatgtgatggaatttgagatttcacc

SEQ ID NO: 30734 - DNA, 1345 bp, Triticum aestivum
  Clone ID: PAT_TA_30734
tcgcttctcgccacgcccaaacccaaagccaagtcgcactcctcctcctcctatcctcttcctcgccgaggcggcgaccggccagcgccgccaccgccaccgcccgcgcatctccgttcaattcggcgaatttggggctgaggaaagaggaggaacgacttttcgctggtggcctgaaattcaggacaagatgcacttccttgcatcatttcacggccctgcaggttttgagcttttgtctgtttcgctgggatggatgccaagaagttcctgcagatggtcgaagacaagaagaagagactcctcgagaagaaggaagcccctctgaaatggcagcagaaactggaagcagcaatcaaggccactgaagaaaaggagaagaagctcaagtcgaaaaagcacaggagacgaagctattcttcctcagaatctgacagtgaatccgagagcgacagtgatcggaaacacaggaagaggaaggaccgcaaaaggcacaaaagacatggccattctgactctgatggtgccaggaggcgcaagcacaggtcaaagaggaggagctcgggctctagcgacgagagcgacagtgatgaatatgatggcgaatctgaagaagagcgccgaaggaagaagcactcgcacaggaggaagcatcgccgacactcttcaaggtcagagtctgacgcctcagattacagcagcgatgatgatgagcgaaggtcaaccaggaaggaccattctaggagccggaggcgtcgccaccggtcctcagacgatgaatctgaggagaagatcaggtcgaggcataggaagcgtcatcacagatcaagtgacgaggacaagccgtcagattctgacaaccataagcgccacaggagccgctctatgtccttggatgatggtgctgctggtgagccagacaagatgaatgatggcaaggggtctcacaaaagccggcaccaccgccgccaccaccatcaccatcatgatcatcgtgcgaactctgctgaacccagagacgggaagcaactcgtgtaagttgttaaaatgcctcagaacctgattggcattttcactggactctgtgacggcaatgtttgcttgccccagttggctagttgctgaatggaagcgatgtatctttcataatgttactgtctccggctctgctgcggattctgaagcctttacttgttctactgaaacgtttggcgacactagatgttatttccagcgtttcctctgttgacatatgtttgcttgctgatttggtggttaaacatgcctgtttcatttgctgcaagttcactattgcattttcgtttaaaaaaaaaaaaaaaaaacc

SEQ ID NO: 30735 - DNA, 1352 bp, Triticum aestivum
  unsure (1)..(1352): unsure at all n locations
  Clone ID: PAT_TA_30735
cttctggatgtgcccctccatgacggaggaggcaatccacttgcctcccgctccggaaatagttggagaaggttgaggtgagatgtgcggacttgggcgctcgaggtcgagttcgcggagatggataagcaaaggaggaagaaggcgtaggtaaaagggtagatctttatcccctnatatgggcagacgaaaccatgcgtccccaccatcctgataaaactcgcttatctcccaagcgccgcaatcaatggcgcggttgggttacccacgttcgtattgatgggaatcccggaataaggggaacacgatctctgcttcgacaagacgtgccaagggaaccgcctcgctaaacgcgctgaggtggtacaataaaaccaattttcgagtaaaggcttggtggtggtgtgatgtcacgccacaaaatacgtcagcaggattgaattgtgtaaatattattctctctaacggtggtatgtggaaattattttgcagagccggacactatccttgtgttcaaaatcttctatgaagtattcagaggaggaacccgccttgcaatgccgaagacaaatctgcgcgccggactcatcgtcattgatgcctggttcaggggctactgagggagtcccggattagggggtgtccggatagccggactatatccattggccggactgttggactatgaagatacaagattgaagacttcgtcccgtgtccgaatgggactctccttggcgtggaaggaaagcttggcaatacggatatgtagatctcctcccattgtaatcgactgtgtgtaaccctagccctctccggtgtctatataaaccggatggctctagtccgcaggacacaacaacaaccattacaatcataccataggctagcttctagggtttagcctctctgatctcgtggtagatcaactcttgtaatactcatatcatcaagatcaatcaagcaggaagtagggtattacctccatagagagggcccgaacctgggtaaacatcgtgtcccttgcctcctgttaccatccggcctagacgcacagttcgggaccccctacccgagatccgccggttttgacaccgacacccacgtcctcctccagcttccctgcagccacgcagacacctcctgcccgaactgtcccgtccgccgcctcccatgcgctgccttccaggaccccggtaggtcacgccatgcgccggagatggagctccgcaggagttcgccgccgccaattgcctcagctctggccagaacgagtcgtccccggcctcctcgtcagaccgtctcccctctgccaagtcctgcgtcgtcgtctaggccccagcggcctagac

SEQ ID NO: 30736 - DNA, 2909 bp, Triticum aestivum
  Clone ID: PAT_TA_30736
ctgaactacgtacttaagtagtcattgtcggtggtaccttaaggtggtggtttgttttcttatactaacggagctcatgagattttctgttgaagttttgtgttgtgaagttttcaagtttttgggtaaagatttgatggattttggctgaacttcgtacttaagtagtcatcgtcggtggtaccttaaggtggtggtttgttttcttatactaacggagctcatgagattttctgttgaagttttgtgttgtgaagttttcaagtttttgggtaaagatttgatggattttggaataaggagtggaaagagcctaatcttggggatgcccaaggtaccccaaggtaaaattcaaggacaaccaaaagcctaagcttggggatgccccggaaggcatcccctctttcgtcttcatccatcaataactttacttgaggctatatttttatttaccacatgatatgtgttttgcttggagcatcttgtatgatttgagtctttgctttttagtttaccacaatcatccttgttgtacacactttttggagagacacacatgaatcggaatttattagaatactctatgtgcttcacttatatcttttgagctagataattttgctctagtgcttcacgtatatctttaagagcacggtggtggttttattttatagaaattattgatctcttatgattaacttatattattttgagagtcttttagaacaacatggtaatttgctttggctataaaattagtcctaatatgttgggtgatacgtctccaacgtatctataatttttgattgctccatgctatattatctaccccttttggatgttcatgggctttattttccacatttatatcatttttgggactaacctactaaccggaggcccagcccatattgctgtttttttgcctatttcagtatttcgaagaaaaggaatatcaaatggagtccaaacggaatgaaaccttcgggaacgtgatttttggaacgaacaagatccggagagcttggagtgcaagtcaagaaacaaccggagcctccacgagataggagggcgcgcccctgtctcgtgggctcctcgggcgtccactgacgtacttcttcctcctatatatacctacgtaccccgaaaacattcatggttccaatgaaacacaatttccaccaccgcgaccttctgtatccgcgagatcccatcttggagccttcgtcggcgatctaccggagggggattcgatcacggagggcttctacatcaacaccatagcctctcctatgatgtgtgagtagtttacctcagaccttcgggtccatagttattagctagatggcttcttctctctttttggatctcaatacaaagttctccccctctcttgtggagatctattcgatgtaaactctttttgcgatgtgtttgtcaagatccgatgaattgtgggtttatgatcaagtttatctatgagaaatatttgaatctcctctgaattcttttatgtatgattgagttatctttgcaagtctcttcgaattatcagtttggtttggcctactagattgatctttcttgccatgtgagaagtgcttagctttgggttcaatcttgcggtgtccttacccagtgacagaaagggttgcaaggcacatattgtattgttgccatcgaggataaaaagatggggtttatatcatattgattgagtttatccctctacatcatgtcatcttgcctaatgcgttactctgttcttatgaacttaatactctagatgcatgctggatagtggtcgatgtgtggagtaatagtagtagatgcagaatcatttcggtctacttgtcgcagacgtgatgcttatgttcataatcattgcctagatattctcagaacaatgcgctcttctatcaattgctcggcaataatttgttcacccaccataatacttgttatcatgagagaagccactagtgaaacctatggccctcgggtctatcttttatcataaaagtttacaatcgattttactttgcaatctttactttcaatctatatcataaaaataccaaaaatatttatcttatcatatctatcagatctcactcttgtaagtgaccgtgaagggattgacaacccctttatcgcgttggttgcgaggttcttatttgtttgtgtaggagaaccaagcaacatatgtaaacggtacctgcacacaaagaacaaatacttgcaactcgacgtgtaagaggggttgtcaatccctctcgggtaaaagattgggtaaatagacagattgggtagatgcaaatagaataacgacaaataaaactcagcgaggtattttttgggtttttgataatatagatctgaaaataaaagatgcaaataaagaaaaaggcaaatagcaatatagatctgcaaatatatgatgggaaaatagacccgggagccgtagatttcactagtggcttctctcaagaaatagcatatgatgggtaaacatattactgttgggcaattgataaaacatcgagtaattatgccgatatccagacaatgatcattatataggcatcatgttcaagattagtagactgactcctgcctgcatctactactattactccacacatcgaccgctatccagcatgcatctagtgtattaagttcatggagaaacggagtaatgcaataagaatgatgacatgatgtacacaagatctatttatgtagagaccccatcttgttatccttaatagcaacgatacatacgtgttggttccccttcggtcactgggatcaagcaccgtaagatcgaacccattacaaagcacctcttcccattgcaagataaatatatcaagttggccaaaataaagagccgggaaaaaagaaga

SEQ ID NO: 30737 - DNA, 2798 bp, Triticum aestivum
  Clone ID: PAT_TA_30737
atgctttatgttttcgtttctgtttagtaataaatttttcatctaccttctgtttagatgtgtttttatgttttaattagtgcttgtgccaagtagaacctataggataacctatggtgatagttaatttgattctgctgaaaaacagaaactttggcgcacgaaattagtttttttaaatcacatatacctgattttgtgttgattctttttgctgctgatcaatagacaaagtttccaggacttcctattttggtaggatttttagagttccagaagtttgcgttagttacagattgctacagactaatctgtttttgacagattctgtttttcgtgtgttgtttgcttattttgatgcatctatggctattattaagtggtatgaaccatagagaactttaaatacagtaggtttaacaccaatataaataaataatgagttcattacagtaacttgtgtggtggttttgctttctttcactaacggagcttatgagatttcctgttgagttttgtgttgtgaagttttcaagttttgggtaaagacttgatggactatggaataaggagtggcaaaagcctgagcttggggatgcccatggcacccgaagatactcaagaacagccaaaagcctaagcttggggatgccccgggaaggcatcccctctttcgtcttcgttcattggtaactttacttggagctatatttttattcgccacacgatatgtgttttgcttggagcgtcgtgtattatattagtatttgctttttagtttaccacaacaatcctttctttacacaccttttgggagaagcctactttattagaaatttattagaatatcctatgtgcttcatttaaaccttttgagcttgatagtttttgctctagtgcttcacttatatcttttagagcacaacggtggcttaattttgtagaaattgctagtctatcatgcttcacttatattattttgagagtcttttagaacagcatggtatttgctatggttataaaattggtcctagaatggtaggcatccaagttgggtataataaaaactatcataggaagtgaattggatgctatgatcaatttgatacttgataattgttttgagatatggaggtagtgatattaaagtcatgctagttgggtgattatgaatttaaagaatgcttgtgttgaagttagcaagtcctgtagcatgcacgtatggttaaagttgtgtaacaaatttgaaacatgaagtgtacctggcttgtgcatccttatgagtggcggtcggggatgagcgatggtcttttcctaccaatatatccccctaggagcatgcgcgtagtacttgatttttgatgacttctaaatttttgcaataagtatatgagttcttttgactaatgttgagtccatggattatacgcacttttacctttccgcctttgctagcctcttcggtaccgtgcattgccctttctcaccttgagagttggtgcaaacttcgccggtgcatccaaaccccgtgatacgatacgctctatcacacataaacctccttatatcttcctcaaaacagccaccatacctacctattatggcatttccatagccattccgagatatattgccatgcaactttccatcgttccatttatcatcatcatgacatacattacttttgtcatattgccattgcatgatcatgtagttgacatcgtatttgtggcaaagccaccttgcattatttttcatacatgtcactcttgattcattgcaccatcccagtacaccgccggaggcattcatatagagtcatatcttgttctagtttcgagttgtaattcatatgttgtaatcaataaaagtgtgatgatcatcgttattagagcattgcccaaaaaaagaaaaaaaagaaaggccaaagaaaaaaagaaaaaaagaaggccaaagaaaaaaaagaaaaaaggaaaaaaagaaaataaataaaaaatggaaaataaataaaaagggcaatgttactatctattttttccacacttgtgcttcaaagtagcaccttgttcttcatgtagtgagtctcatatattgtgcttcaaagtagcaccatgtttttcatatagagagtctcatatgctgtcgctttcatatactaagtggggaatttttcattatagaacctggcttgtatattcctacgatgggcttcctcaaaatgccctaggtctttgtgagcaagcaagttggatgcacacccactagtttcttttgttgagctttcatacctttatagctctagtgcatctgttgcatggcaatccctactcatcattgacatcaattgatgggcatctccatagcccgttgattatcctcgtcaatgtgagactttctccttttttgtcttatccacacaatccccatcatcatattctattccacccatagtgctatatccatggctcacgctcacgtattgcgtgaaagttgaaaaagtttgagattatttaagtacgaaacaattgcttggcttgtcatcgggggtgtataagatgagagcatttttgtgtgacgaaaatgaagcatagcctaactatatgattttgtagggataaactttctttagccatgttattttgagaagacatgattgctttcattagtatgcttgaagtattactatttcttatgtcaatatgaacttttcttttgaaccatttggatctgaacattcatgccacaataaaggaaattacattgagaattatgctaggtagcattccacatcaaaaatt

SEQ ID NO: 30738 - DNA, 2637 bp, Triticum aestivum
  unsure (1)..(2637): unsure at all n locations
  Clone ID: PAT_TA_30738
ggtgtggagggaaccttcaccgcatgaataccttgattacactttgcaataagaggttggatgctctagatctaaaagtctccgagtatgaagggaaatgtaaggaacctcccagatacgagcataactccattaaaaagataaataccaaatattgcaatacctagatctatccttgcttttatgcctagctaggggcgttaaacgatagcgcttgttggaaggcaacccaattttatttttgttttttgctttttgattctatttagtaataaataatttatctatcctctgtttagatgtggttttatgcttttaattagtgtttgtgccaagtagaacctttgggaagacttagggaaagtctttgcgatcatgctgtaaaaaacagaaactttagcgctcacgagatttgctgccattttttattggagagtgatatttagttaattatttttgcagatgattaatagatatattcctcacgtccaaaaatttattttagaatttttggggttccagaattatacgtttgatccagattactacacactgttctgtttttgacagattcgattttctatgtgttgtttgcttattttgatgaatctatgagtagtatcgaagggtatgaaccatggagaagttgtaatacagtaggtctaacaccaatataaataaagaatgagttcattacagtaccttttgtggtggtttttctttctttcactaacggagcttatgagatttcctgttgagttttgtgttgtgaagttttcaagttttgggtaaagatttgatggactatggaacaaggagtggcaaaagcctaagcttggggatgcccatggcaccccaagatattcaagaataaacaaaagcctaagcttggggatgcccggggaaggcatcccctctttcgtcttcgttcattggtaactttacttgaggctatatttttgttcgccacatgatatgtgttttgcttggagtgtattgtatgatattagtctttgctttttagttttccacaatcatccttgttgtacacaccttttgagagagacacgcaggaatcggaatttattagaatactctatgtgcttcacttatatcttttgagctagatagttttgctctagtgcttcacttatatcttttagagcacggtggtgtcttaattttgaagaaattgttgatctctcatgcttcacttatattattttgagagtcttttagaacagcatggtaattttctatggttataaaattggtcctagaatgatgggcatccaagttgggtataataaaaactatcatagaaagtgaattggatgctatgatcaatttgatgcttgataattgttttgagatatggaggtagtgatattaaagtcatgctagttgggtgattatggatttaaagaatgcttgtgttaaagtttgtgattcccgtagcatgcacgtatggtgaaccgctttgcgatgaagttggagcacaattttatttattgattgtcttcattatgagtggcggtcggggacgagcgatggtcttttcctaccaatctatccccctaggagcatgcgcgtagtactttgttttttgatgacttctaaatttttgcaacaagtgcatgagttcttttgattaatgttgagtccatggattatacgcaccctttcacccttccattattgctagcctctcttgtgccgcgcaacttcaccggtaccatacacccaccatatatcttcctcaaaacagccaccatacctacctatcatggcatttccatagccattccgagatatattgccatgcaactttccaccgttccattcatatgacatacattacttttgtcatattgctttttgcatgaacatgtagttgacattgtatttgtggcaaggccaccttcataatttccatacatgtcaatcttgattcattgcatatcccggtacaccgccggaggcattcatatagagtcatatcttgttctagctttgagttgtaattcttgagttgtaaatccataaaagtgtgatgatcttcattaattagagcattgtcctagtgaggaaaggatgatgaagactatgattcccccacaagtcgggatgagacttcggactttacaaaaagaaaaagaaagagaaaaaaaagagaaaggccaaaaagaaaaaaaagaaaggccaaagaaaaaaaaagaaaaaagaaanaaaataaaagaaaaagaaangnaataaatgagagaaaaagagagaagggacaatgctactatatctttttccacacttgtgcttcaaagtagcaccatgatctacttgttttggatgtgatgcctatatacatgatcatgcctagataacgtcataattattcgcttttctatcaactgcttgacagtaatttgttcacccaccgtaatacttatgctctcgagagaagcctctagtgaaacctatggcccctgggtctatctcttaccatatttgttttcaacttacttttatttgcatcttcactttcttgcatctatattataaaataccanaaatatatttatcttatcatactatctttataagatctcactttcgcaagtggccctgaaagggattgacaac

SEQ ID NO: 30739 - DNA, 2664 bp, Triticum aestivum
  unsure (1)..(2664): unsure at all n locations
  Clone ID: PAT_TA_30739
gtatagcaataaataatttatctatcctctgttatgattgagtttttatgttttaattagtgttcgtgccaagtagaaccattgggaagacttggggaaagtcttgttgatcttgctgtaaaaaacagaaactttagcgctcacgagaattgctgccatttttattggagagtgctatttagttagttatttttgcatatgattaatatataaattcctcacgtccagaaatttattttagaacttttggggttccagatcttgcgttagctacagattactacagactgttctgtttttgacagattctgtttttcgtgtgttgtttgcttattttgatgaatctatggctagtaaaatagtttataaaccatagagaagttggaatacagtaagtttaacaccaatataaataaataatgagttcaatacagtaccttgaagtggtgttttgttttctttcgctaacggagctcacgagattttctgttgagttttgtgttgtgaagttttcaagttttgggtaaagatttgatggattatagaacaaggagtggcaagatcctaagcttgaggatgcccatggcaccccaagataatctaaggacaccaaaaatccaaagcttggggatgccccggaaggcatcccctctttcgtcttcgtccatcggtaactttatttggagctatatttttattcaccacatgatatgtgttttgcttggattttcatttcattttattttgtttttctttttgtttgaataaataccaagatcttaaattcttaaatgttagagagtcttcacatagttgcataattattcaactactcattgatcttcacttatatcttttggagtagtttgtcatttgctcttgtgcttcacttatatctttttagagcacggcggtggttttattttgaagaaattgttgaaatctcatgcttcacttatattatttttagagtctttagaacagcatggtaatttgcttgggttataaaattagtcctactatgatgggcattcaagatgggtataataaaaactttcatatatagtacattgaatactatgagaagtttgatacttgatgattgttttgagatatggagatggtgatattagagtcatgctagttgagtagttgtgaatttgagaaatacttgtgttaaagtttttgattcccgtagcatccacgtatggtgaaccgttatgtgatgaagtcggagcatgatttatttattaattgtcttccttatgagtggcggtcggggatgagcgatggtattttcctaccaatctacccccctaggagcatgcatgtagtgctttggtttttgatgacttctagatttttgcaacaagtacatgagttcttttgactaatgttgagtccatggattatacgcaccctttcacccttccatcattgctagactttcttgtgccgcgcaactttcgccggtaccatacacccaccatttaccttcctcaaaacagccaccatacctacctattatggcatttccatagccattccgagatatattgccatgcaactttccaccgttccgttcatatgacacgcattacttttgtcatattgctctttgcatgatcatgtagttgacatcgtatttgtggcagggccaccttcataattttcatacatgtcgctcttgattcattgcatatcccggtacaccgccggaggcattcatatagagtcatatcttgttctagctttgagttgtaaatccataaaagtgtgatgatcttcattaattagagcattgtctcggtgaggaaaggatgatgaaggctatgattcccccacaagtcgggatgagactcccgacgaaaaaaagaggccataaaaaagagaaggcccaaaaaatgagagaaaaagagagaagggacaatgctactatccttttaccacacttgtgcttcaaagtagcaccatgatcttcatgatacagagtctcctatgttatcattttcatatactagttggaaattttcattatagaacatggcttgtatattccaatgatgggcttcctcaaaatgccctaggtcttcgtgagcaagcaagttggatgcacacccacttagtttctttttgagctttcatatacttatagctctagtgcatctgttgcatggcaatccctactcattcacattgatatctattgatgggcatctccataccccattgattagccgcgtcactgtgagactatcttccttttttgacttccccttattaatgtctatcactacattctattccacccctaagtgctatcgccatggcttacgctcatgtattgcgtggaggttgaaaaagctgaagcgcgttaaaaggtatgaaccaattggctcggcttgtcatcngggttgtacatggacaaatactttgggttaagaagatgggagcaagacaagactacatgattttgttagggatagtgtttttaacattttaattttaaaagacatgatgtttgttgnatgcccgatatgatggtctatacaaatatagacatgattgattancntactaaatcncncatgatagtaagataagtangnagganatcactcaaacactttacatactancagggggcggtccatcnctaagatc

SEQ ID NO: 30740 - DNA, 3565 bp, Triticum aestivum
  unsure (1)..(3565): unsure at all n locations
  Clone ID: PAT_TA_30740
aatcctgtagagttttgtgttgtgaagttttcaagttttgggtaaagcttttatggactatggaataaggagtggcaagagcctaagcttggggatgcttatggcaccccaagatattcaaggatagccaaaagcctaagcttggggatgcctcgggaaggcatcccctctttcgtcttcgttcattggtaactttacttggagctatatttttattccccacatgatatgtgtttttcttggagcgtcctgtattatattagtctttgctttttagtttaccacaatcatccttgttgtacacaccttttgggagaaacctatttgattagaatttgctagaatactctatgtgcttcacttatatcttttgagtttgatagtttttgctccnagtgcttcacttatatctattagagcacgacggtgggcttaattttgaagaaatgtttactctcatgcttcacttatattatttttgaganttttttagaacatcatggtatttggctaatggttaataaatttggccccaagaatggatgacacccaattggggtaataataaaaactatcatagaaagtgcataaaacactaggatcaatttgatgcttgataattgttttgagatatagaggtggtaatgttagagtcatgctagtgggtaattatgaaattgagaaatacttgtgttgaagttggcaagtcccatagcatgcacgtatggtaaaagttgtgtgacaaatttgttgcatgaggtgctcttttaattgccttccttatgtgtgaaggtcgggatcgcacgatggttaactcctaccaacccttcccctaggagcatgtgtagtagtactttgcttcgagggcaagtagacttttgcaataagtatatgagttatttatgactaatgtgagtccatggatatacgcacactcatccttccactttgctagcctctattataccgcgcaactttcgccggtatcatgcacccattatttaccttcctcaaaacagtcaccatacctacctattatggcatttccatagccattccgagatatattgccatgcaactttccactgttccgttcatatgacatgcattacttttgtcatattgctctttgtatgatcatgtagttgacattgtatttgtggcaaggccaccttcataatttttcatacatgtcactcttgattcattgcatatcccggtacaccgccggaggcattcatatagagtcatatcttgttctagctttgagttgtaaatccataaaagtgtgatgattttcattattagagcattgtcctcgtgaggaaaggatgatgaaggctatgattcccccacaagtcgggatgagacttcagactttacaaaaagaaacaaaagggaaaaaaaaaaaaaaaaaagaagaaggaccaaaaaaaagaagaaggccaaagaaaaaaaaagaagaaaaaaagaaaaggaaaaaataaaatgagagaaaaagagagaagggacaatgctactatctctttttccacacttgtgcttcaaagtagcaccatgatcttcatgatagagagtctcctatgttatcactttcatatactagtgggaatttttcattatagaacttggcttgtatattccaatgatgggcttcctcaaaatgccctaggtcttcgtgagcaagcaagttggatgcacacccacttagtttcttttgttgagctttcatatatatttatagctctagtgcatccgttgggatggcaatcgcctactcactcacattgatatctattgatgggcatctccatagcccgttgatacgcctagttgatgtgagactatcttctcccactttttgtcctcacaaccaccaccatataccacatatagtgctatgtccatggcttgcgctcatgtattgcgtaagagttgaaaaaaagctgaagcgcgttaaaaagtatgaaacaattgctcagcttgtcatcggggttgtgcatgatgggagtattttgtgtaatgaaaatgaagcatggcctaactatatgattttgtagggataagctttctttggctatgttattttgataagacatgattactttgttagtatgcttgaagtattactatttttatgtcaatattaaacttttatcttgaatcttttggatcttaacattcatgccacaataaagaaaattacattgagaaatatgttaggtagcattccacatcaaaaattctgtttttatcatttacctactcaaggatgagcaggaattaagcttggggatgcttgatacgtcaccaacgtatctataatttttgattgttccatgctattatattatctgttttggatgtttaatgggctttactatacacttttatattatttctgggactaacctattaacgggaggcccagcccagaattgttgtttttttgcctatttcagtgtttcgaagaaacggaatatcaaacggagtccaaacagaataaaatcttcaggaacgtgattttctcatcgaacgtgatccaggagacttggaccctactccaagtaaaaaaagaggcggtcacgagggtgggggcgccccctagggcacgccccctgcctcgtgggcccctcgttgctcctccggcgtacttcttcctcctatatatacacacgtacacccaaacgattagaacaggagccatatatctaattccaccgccgcaactttctatacccacgggatctcatcttggggccttttccggagctccgctagaggggcattgatcatgaagggcctctacatcaactacatggcccctctgatgatgtgtgagtagtttatttcagaccttcggtccatagttattagctagatgtgttcttctctctctttggatctcaatacaaagttctcctcgattctcttggagatctattcgatgtaatctttttttgcggtgtgtttgtcgagatccgatgaattgtgggtttatgatcgagtttatctatgaacaatatttgaatctcctctgaattcttttctgtatgattggttatctttgcaagtctcttcgaattatcagtttggtttggcctactagattgatctttcttgcaatgtgagaagtgcttagctttgggttcaatcttgcggtgctcgatcccagtgacagcaggggaaacgacacgtattgtattgttgccatcgaggataaaaagatggggttttgatcatattgcatgagtttatccctctagatcatgtcatcttacttaaagtgttactctattcttttgaacttaatactctagatgcatgctggatagcggtcgatgtgtggagtaatagtagtagatgcaggcaaaagtcggtctacttgtattgggcgtgatgcctatatacatgatcatacctagatattctcataactatgctcaattctgtcaatagctcaacagtaatttgtttacccaccgtaatacttatgctctcgagagaagccactagtgaaacgtatgccccccgggtctattttccatcattttagtctcccgtc

SEQ ID NO: 30741 - DNA, 1385 bp, Triticum aestivum
  Clone ID: PAT_TA_30741
tctattcccttgctcgaaattaaccctcactaaagggaacaaaagctggagctccaccgcggtggcggccgctctagaactagtggatcccccgggctgcaggaattcggcacgagcgcatctctctcacctccggcgaaaacacaccagcgcgctcctctctcccctcgcttccccgccgcaatgtcgaccgacgccgctgccgccgacatcccggtgcctcaggtggaggcgaccgccgaccccgtcgcggagaccaccgctgccgccgccgccggcgacgcgaagccggccaaggcgaccaaggccaaggccgccaagacccccaaggcgcccaaggcgaagaagccctccgccccgaggaagcccaaggccacccccgcccacccgacctacgctgagatggtgtcggaggcgatcaccacgctgaaggagagaggcgggtcgagcaccgtggccatcggcaagttcatcgaggacaagcacaaggcgcacctcccggccaacttccgcaagatcatgctgacgcagatcaagaagctcgtcgccgccggcaagctgaccaaggtcaaggcctcctacaagctcgccaaggcccccgcagcgcccaagaagcccaagaccaaggcgccagccaagaagaagccggcggcgaagaagaaggccccggccaagaagcccgccgccaagtccccagccaagaagaaggccgccgccaagcccaaggccaaggccccagccaagaccaaggccgccgccaagcccaaggcggcagcgaagcccaaggcagccgccaagaccaaggctccagccaagaccaccaaggccgccgcgaagcccaagccggccgccaaggcgaaggcgcccgccaagccgaggggccgccccgccaaggccgccaagacctccgccaaggacgcgccagggaagaaggcgcccgccgccgccgccacccccaagaaggccgcccccaggaagccgcccaccaagcggtcggcgccggtgaagaaggccacgcccgccaagaaggcccccgccaagaaggccaagaagtagagcgtctccgtcctcccgcaacaagtttccattctcctgttctgtgtcggtggtagtccaggattctgtgttctagactgtaaattttatatccgggttgtgggtgctctggttcattccggcgtacccttggaggtgtatctgtgggtgaaacgatgacgacgacgacggcggcggcgagggctttgtcccccggcctccgcattaccgtagcagcttgatttgtcgaggttttttagcgtagcaagatccttgtggtggtgtcgaaaacaaatagtgcattgtttatctaattaattatgattatgatcaatcgcttcttgccctgc

SEQ ID NO: 30742 - DNA, 1340 bp, Triticum aestivum
  Clone ID: PAT_TA_30742
tcccctgctcgaaattaaccctcactaaagggaacaaaagctggagctccaccgcggtggcggccgctctagaactagtggatcccccgggctgcaggaattcggcacgagctcagctccggcaagcaacaccagcgctctcctctcccctcggttccccgctgcaatgtcgactgacgtggtcgccgatgtcccggcccctgaggtggcggcggccgccgaccccgtcgtggagaccacggcagagcccgccgccggcgacgcgaagccggccaaggagaccaaggccaaggcggccaaggccaagaagccctccgccccgaggaagccccgcgccgcccccgcccacccgacctacgctgagatggtgtcggaggccatcaccgccctgaaggagcggacggggtcgagcccgtacgccatcgccaagttcgtcgaggacaagcacaaggcgcacctcccggccaacttccgtaagatcctgtcggtgcagctcaagaagctggtcgcctccggcaaggctgaccaaggtcaaggcctcctacaagcctgtctgcccgccgcggccaagcccaagcccggcggccaagaagaagcccgcggccaagaagaaggcgccagccaagaagaccgctaccaagaccaaggccaaggcgcccagccaagaagaccgctaccaagaccaaggccaaggcgcccgccaagaaatccgccgccaagcccaaggccaaggccccagcgaaaaccaaggccgccgcgaagcccaaggctgccgccaagcccaaggccaaggcccccgccaagaccaaggccgccgcgaagcccaaggctgccgccaagcccaaggcccgcccagccaaggctgccaagacctcggccaaggacgcgccagggaagaaggcgcccgccgccgcggcgcccaagaagcctgccgccaggaaggcgcccaccaagagatccacgccggtgaagaaggccgcgcccgccaagaaggcagcgccagccaagaaggcccccgccgccaagaaggccaagaagtagactcctgcgtgaagatcctagggcttggcggtagttttccagtagcagtttttcctgttctgtgctgttagtcgagatgtccgtgctgtgtcgagggttctaggctgtaaatttgaaatctgggttcgggtgcacctgtgatccggtgcacccttgtgtgtgcgtgagaaactgtggcgacgatcgcgttgtactaagcttatgtatttgtgtaactgaattggggtaattgaatcttcattttagcaaaaaaaaaaaaaaaattaaaaaaaaaaatagaacagatgaaataatataaa

SEQ ID NO: 30743 - DNA, 1802 bp, Triticum aestivum
  Clone ID: PAT_TA_30743
gggtcgacggctctatactacttgcattagagtagtgtagcatgttactactttccgttaatactattctgctgcatagcctgtctttgccactactgttgttaccttacctgctatcctaatgcttagtataggatgctagtgttccatcagaggccctacacacttgtccgtctgccatgctatactactgggccatgatcacttcgggaggtgatcacgggcatatgctatatactttatactgttacattactatgatactgttcggagatgggggctgaaaggacaggtggctccatcccggtagaggtgggcctgggttcccgacggcccccgactgttactttgtggtggagcgacagggcaggttgagaccacctaggagacaggtgggcctggccctgttcggcgttcgcggatacttaacacgcttaacgagatcttggtatttgatctgagtctggctacgagcctatacgcactaaccatctacgtgggagtagttatgggtatcccgacatcgtggtatcagccgaagcacttcagacgtcagcgacggagcggcgcgcgccgaattggactggaacgccactagggctaggtctgctttcggccgcccacgcaacgtgcaggtgtgctcagggcgatgggcccagacccctgcgcgcttaggtttagaccggcgtgctgaccgctctgttgtgcttaggtagggctgcgacgtgttgatcttccgaggccgggcatgacccaggaaagtgtgtccggccgaatgggatcgagcgtgttgggctatgtggtgcacccctgcagggaagttaatctattcgaatagccgtgatcttcggtaacaggacgacccggagttgtaccttgaccttatgacaactagaactggatacttaataaaacacacccttccaagtgccagatataacccggtgatcgctctctaacagggcgacgaggaggggatcgccgggtaggattatgctatgcgatgctacttggagatgctacttggatatgctacttgaagatgctacttggaggacttcaatctactctcttctacatgctgcaagacggaggtggcctgaagcgtagtcttcgacaggattagctatccccctcttattctggcattctgcagttcagtccaccgatatgggcctttacacatatacccatgcatatgtagtgtagttccttgcttgcgagtactttggatgagtactcacggttgcttttctccctcttttcccctttcccttctacctggttgtcgcaaccagatgctggagttcaggagccagacgccaccgtcgatgccgactactacaccggaggtgcctattactgcgtgcaggccgccgccgacgaccaggagtagttaggaggatcccaggcaggaggcctgcgcctctttcgatcagtatcccagtttgtgctagccatcttatggcaacttgtttaacttatgtctgtactcagatattattacttccgctgactcgtctatgatcgagcttttgtattcaagccctcgaggcccctggcttgtaatataaagcttgtattatttttaatttgcgtctagagttgtgttgtgatatcttcccgtgagtccctgatcttgatcgcacacatttgcgtgcatgattagtgtacgactgaatcgggggcgtcacagtccttgtagagcatgtagtcagcatcggtgaagcacggcccagaagagcagcagggccgcccggcgagagcagcccggggcgctgaacctcggccgcgaccacgct

SEQ ID NO: 30744 - DNA, 1520 bp, Triticum aestivum
  Clone ID: PAT_TA_30744
gcacgaggcccacgcctgcttcttgttgtagatgatggacgaccactggatcttctgggtgggcccgttcatcggcgcggcgctggcggccatctaccacgtggtggtgatccgggccatccccttcaagagccgcgactagtccaccaatcaaccagccgcgaatggaatcttatcgctgttcatcgtcggtcgatcgatcatgtggtggtggtggtggttgctcgcgcgcgcgtagtacgtggatcatgtctcggccgcgcacgctgtaatcatctatatctaccgtgctgttcctcccctcctcggtgtgtgtgcctgtcggcagcgtcacctgttcaagtctgcgagttgtactttcccttccttttgtattgcactacgcacgcgatttaatcgggcgtgcatatctatgtaaattattacgtattatgaaggaaggacgatcgagttaattaaaaaaaaaaaaaaaaaacagactagttctcctctcccctcgcttccccgcgaaaatgtcgactgacgtggctgccgctgacatcccggtgcctcaggtggaggtagccgccgacgctgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagaccgccgccaagtcgccggccaagaaggccgccgcgaagcccaaggccaaggccccagccaaggccaaggccgtcgcgaagcccaaggcggcggcgaagccgaaggcggccgccaagcccaaggccaaggccgccgccaagaaggcgccggccgccgcgaccccgaagaagcccgccgcccggaagccgcccaccaagcgggcgaccccggtgaagaaggccgcgccggccaagaagcccgcggccaagaaggccaagaagtagagccccgcatgacggacctagatgccctggcggtagtattgagtagcctaattctctgttcggtgttgtcagtcaagagcttcttgactgtgtcttgggcggcggtgggctgtaaatctgatctatctgtgccgggggtgtaccctttgtgtcgaggaagagtgatatccatgggaatcagttgtactagtagcagtaatctgtgtaatttagtcttttttattattgcagcaatgtccatgagctatttgtcagaaaaaaaaaaaaaaaaaaaaaaaaaaaaaaaaaaaaaaa

SEQ ID NO: 30745 - DNA, 1061 bp, Triticum aestivum
  Clone ID: PAT_TA_30745
tcggcacgaggcgcatctctctcacctccggcgaaaaacacaccagagctcgcatctcccctcgattcctagctgcaatgtcgactgaagtggctgctgctgacatcccggtgcctcaggtggaggtagccgccgacgccgccgttgacacgccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggacaagcacaaggcgcacctcccggccaacttccgcaagatcctgctcacccagatcaagaagctcgtcgccgctggcaagctgaccaaggtcaagggctcctacaagctggccaaggcccccgccgccgtcaagcccaagacggccaccaagaagaagccggccgccaagcccaaggccaaggcgccagccaagaagactgccgccaagtccccggccaagaaggccgccgcgaagcccaaggccaaggccccagccaaggccaaggccgtcgcgaagcccaaggcagcatccaagcctaaggcggccgccaagcccaaggccaaggctgccgccaagaaggcgccggccgccgcgacccccaagaagcccgccgccgcccggaagccgcccaccaagcgcgcgacgccggtgaagaaggcggcccccgccaagaagcccgcggccaagaaggccaagaagtagagcccggcatgaccggacctagatggcctggcgggtagtattcagtagcctaattctctgttcggtcttgtcggtcaagagcttcttgaccgtgtcttgggcggtgatgggctcttgtgtcgaggaagagtaatatccatggggatcagttgtacttctagtagcagtaacctttgtaatttgagtcttttttattgttgcagcaatatccattggatgtttgtcaaaaaaaaaaaaaaaaaaaaaaaaaaaaaaaaaaaaaaaaaa

SEQ ID NO: 30746 - DNA, 1175 bp, Triticum aestivum
  Clone ID: PAT_TA_30746
aaccctactaaagggaacaaaagctggagctccaccgcggtggcggccgctctagaactagtggatcccccgggctgcaggaattcggcacgaggcaagcatctccctcacctccggcgaaaaacacaccagagctcacctctcccctcgcttcctcgcgaaaatgtcgactgaagtggctgccgctgacatcccggtgcctcaggtggaggtagccgccgacgccgccgttgacacaccggcggcgaagccggccaaggcgcccaaggcggccaaggccaagaagtccactggcccgaagaagccccgcgtcaccccggcccacccgtcctacgccgagatggtgtcggaggcgatcgccgccctgaaggagaggagcgggtcgagcaccatcgcgatcggcaagttcatcgaggataagcacaaggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagacggccgccaagtccccggccaagaaggccgccgcgaagcccaaggccaaggccccagccaaggccaaggccgtcgcgaagcccaaggcggcggcgaagccgaaggcggctgccaagcccaaggccaaggctgccgccaagaaggcgcctgctgctgcgaccccgaagaagcctgttgcccggaagccgcccaccaagagggcgacgccggtgaagaagggccgctccggccaagaagcccgcggccaagaaggccaagaagtagaggccgcttgacggacctagatgccctggcggtagtattgagtagcctaattctctgttcggtgttgtcggtcaagagcttcttgactgtcttgggcggcggtgggctgtaaatctgatctatctgtgccgggggtgtacccttgtcgaggaagagtggtatccatgggaatcagttgtactagtagtagtaaccagtgtaattgagtctttttattatcgcagcaatatccatgagttatttgtcaaaattaccgtgtttcatttcgagatctgaaattgagttcgtatcttttgt

SEQ ID NO: 30747 - DNA, 3767 bp, Triticum aestivum
  unsure (1)..(3767): unsure at all n locations
  Clone ID: PAT_TA_30747
acattactctaaatgatcagcaagcaaatcctatgaaagaaaatgatgctccaagcaaaacacatatcatgtggtgaataaaaatatatctcgaagtaaggttaccgatgaacgaagatgaaagaggggatgccttccggggcttccccaagcttaggctcttggatgtccttgaatattaccttggggtgccttgggcatccccaagcttaggctcttgccactccttattccgtggtccatcgaatctttaaccaaaatttgaaaacttcagaacagaaaactcgtaagatccgttagtataagaaagcaaatcactgctacctcttgaacactgcgttggttttcccttgaagaggaagggatgatgcagcaaagtagcgtaagtatttccctcagtttttgagaaccaaggtatcaatccagtaggaggctacgctcaagtcccttgcacctacacaaacaaataagaacctcacgaccaacgcgataaaggggttgtcaatcccttcacggccacttccaaaagtgagatctgatagagatgataagataatatttttggtatttttatgataaagattggaaagtaaagattgcaaaataaaagacggaaggaatattaaattaataggaagattaatatgatggaaaatagacccgggggccataggtttcactagtggcttctctcaagatagcataagtattacggtgggtgaacaaattactgttgagcaattgatagaaaatcgcatagttatgagaatatctaggtatgatcatgtatataggcatcacgtccgtgacaagtagactgaaacgattctgcatctactactattactccacacatcgaccgctatccagcatgcatctagagtattaagttcataaagaacagagtaacgcattaagcaagatgacatgatgtagagggataaactcaagcaatatgatataaaccccatctttttatcctcgatggcaacaatacaatacgtgccttgctgcccctactgtcactgggaaaggacaccgcaagattgaacccaaagctaagcacttctcccattgcaagaaaaacaaatctagtaggccaaaccaaaccgataattcgaagagacttgcaaagatatcaaatcatgcatataagaatccagagaagaatcaaatattgttcatagataatcttgatcataaacccacaattcatcggatctcgacaaacacaccgcaaaaagtattacatcaaatagatctccaagagagagggggagaacattgtattgagatccaaaaagagagaataagccatctagctaataactatggacccgaaggtctgaagtaaactactcacacatcatcggagaggctatggtgttgatgtagaagccctccatgatcaatgccccctctggcaggacgccggaaaaggccccaagatgggatcttacgggtacagaaggttgcggcggtggaattaggtttccgtggatggagcaacgtgggccccacgagggtataggggtacgtaggtatatataggaggaagaagtacgtcggtggagcaacgtgggccccacgagggtggagggcgcgcccaggggggtaggcgcgcccccctgcctcgttctctccttgttgatgtcttgacgtggactccaagtcctctggatcacgttcgttccaaaaatcacgttcccgaaggtttcattccgtttggactccgtttgatattccttttctgcgaaacactgaaataggcaaaaaaacagcaattctggcactgggcctccggttaataggttagtcccaaaaataatataaaagtgtataataaagcccattaaacatccaaaacagaatatataatagcatggaacaatcaaaaattatagatacgttggagacgtatcagggacccaacggacgggccatcgtatttcgcgcaaaaaacgttcccctgctgtcagctcggacccaccggaagtgcctccttattacgcacaaaaaaatgaatacccccctgttagctgggacccaccttggtgggaggctgacttgtgggcctactaagttgatggggactgagggctttgtcaacttagtcaatatgaacgattctagctccagtgaccgtacgatgtccatccaacggtcatagtgcttcttcaacctctggtcttcttgctccagccgcccaaaccagcgccggtcgtgccgcctgctcctgcctcccgtggccggctgtgctgccgtggaggccttcaccgccccctactactcccaccgctggccaggccatccctccactcacccacaccccctgttattctgcggcgacggcagcctcacaccgcagccgaactagtgaaccctcgtactccgctccgtgcgggcttccactgctgcgtcttccccggctctgcgtcgtccccttcctaggcctcgccatcgtccaccgccctggtgctctcggcgcggcgtgctcaacatggtcaacgaccgacttccatcggaagagtactgtacgtggagaggctgacagcttggtccacggcggccgcaaggaagtgcctccttattacgcacaaaaaaatgaatactccccctgctggttgggacccaccttggtgggaggatgacttgtgggcctactaagttgaaggggatggagtgctttgtcaacttagtcaatatgaacgattctagctccagtgaccgtatgatgtccatccaacggccgtagtgcttcttcaacctctggtcttgttgctccagccgcccaaagcagcgccggtcgtgccgcatgctcctgcctcccgtggccggctgtgctgccgcggaggcctcaccgccccctactattcccaccgctggccaggccatcagtctacaaacccaccccctattattctgcggcgatggcagcctcacaccgcagccaaaccagtcaaccctcgtactcctccctgcgtgggcatctgatacgtctccaacgtatctataatttttgattgctccatgctactttatctactgtttggactatattgggctttattttccacttttatattatttttgggactaacctattaaccgaaggccgagcccagaattgctgttttttgcctatttcagtgtttcggagaaacagaatatcaaatggagtccaaacggaataaaaccttcgagaacgtgattttctcactgaacgtgattccaggaggcttggaccctactccaagacgtaacagaggcggtcacgagggtggggagcgccccccctagggcgcgccccctgcctcgtggcccccctgttgctccaccgacgtactccttcctcctatatatacctacgtatccccaaacgatcagaacatgagccaaaaacctaattccaccgccgcaaccttctgtatccacgagatcccatcttgggggcctgttccggagctccgccggagggggcatccaccatggagggcttctacatcaacaccatagcccctccgatgaagtgtgataagtttacttcaagaccttcgggtccacaagctagtagctagatggcttctctctctttttggatctcaatacaatgttctccccctctctcatgggagatctaatcgatgtaatcctcctcctttncggtgtatttgttgagatcgatgaantgtgggttttgatcaacttanctagaataatattgaacctcccganttcttaagtgtgatagttacttgcaatcctca

SEQ ID NO: 30748 - DNA, 1777 bp, Triticum aestivum
  unsure (1)..(1777): unsure at all n locations
  Clone ID: PAT_TA_30748
gttttttaaacgaattactgctttgtctgagaagcagcttatttatttagaagatgaaaaatacattacacaccaaacttaattgcaaagccttgcctaaatcattaacaagggtccttcctaccaataatcaattatctagaataaacaaacgtccttatcctgttttgtgttttacatacctaaaatatgggaatataaaaaattctctgacgtaaccacgctcaactaaaacatggaacgactagaagctggagcctaggattgtttttgcttcattcattccttgaaatcgtccttgtcatctgctggaaggcctctgtttctccagaatactgcaagagcactgcctccgagcgccatgcacacaacactgacagcagaaggaacagcaacaagagggtttgtgaagtgcttttgggcaagtaaaaatccaagcgcagaactctgcatcccacactcaattgagatggttctagaagttgattccccgaaagaagaccatttcgagatccaatagccaagagcgaatgcaacagcatgcagcagagcaacagggagaataagttgagcaccttgagttttcaacacttctgcgacttgcccaatagggctagcacaaagcaaggtggtgaggatgacccctatcagtggtgttatggagataatccgctcggtaaacttgggaaaatactcatgtgccaacactccaacgatagtcggtactaaaacaacctgaaaagtactgatggccaagcctgcagcatcaacagggactaattgaccagcaaggagtttagtaaggagtggtgtcatcgctatagcaccaatagtcgagcaagtggtcataagaactgaaagtgccacatttcctttggatatgtaagttgcaacgtttgatgcttgaccaccaggacaacatgagaccaaaataagaccagttgcaagaggagcagataacttcaatgacaatgcgatagcatatcctagcataggtttgatcaaatactgcgcaagaaatcccacaccaactgtccatggattccttaaacatctcctgaaatcttcaaatgttaatgttagtcccattgacaacattaggaatcctaggcccacggtaaaaagatcagtctccaaccaggtgaccattgatggcttgtagatgccaataactgtacctaatatgacccagacagggaaaagagtagtgagtagctcaactattttctcgtactggcttgctccagtaggcttgctcgctggcaggttactagaaatgttagcttctgccttgcagaaaatttgacggctcctgacaaccggaacaagagtggtcgctggtgagggcgcaatggccaatccccactcggccttctccgtggcagcacttccatatgctggcacagagcatccaactctcagtccgcacccaagacgaggagcggcgagacgcgggcgcgggcggagagcgcgggagacggatgccatggagtggagagggcaggtcgcggaaggcgccatgtctgacagagatggtgtgtgtggagaggtggtggaaggagaggagtgagggtttaagactcttgagagtgagcggaggagaagtggtggcgctggcgttgtcgtcgacggggagagcagcagtggggacgagggaatcgaggggcgccgggagaaccacacatccgggcggcttggccgcggcgcgcctgtggatcagagtcaggtggctcctccctctgtcgacggacgtgcctccttcannccggacgcgtgg

SEQ ID NO: 30749 - DNA, 1729 bp, Triticum aestivum
  Clone ID: PAT_TA_30749
ggatgacagttaggcaactggaggcgctaatcaggctgtcagaagctattgccagaagccatttggaaagaattgttctccccgctcatgtccgcatggcagttaaattactcaaaacatccataataagtgtggaatcaagtgaagttgacctatctgattttcaagatgcacctcttgatcatgatgatgaacagccaatacaaggagatgctactccaacaagatggtgcagatgaaccagcagaggtgattaagaagaaactggttattactgaagaacatttccagagagttacacaagctttggtcatgagactgcggcaacacgaaagaatcagtcaagaaagacggagatggtctggctggcatgaagcaaggggatctaatcatttggtatgttgagcagcagaatgcccaaggcgcatatagttctacagaagaggtgaaggaggaagtaaagtgcatcaaggccattatagagaggctgatacagagggaaggccatcttgtggtcatagatgaaggaacagcggcagcagaaggtgctgcggcaagggcatcggagcacagaatcctggctgttaacccgaactacgtcattgattgattaaccagctgaggtcacacagctaactagatccatcatatgtggttgaccaatagagcagacattcaaacggaagacatcctgttgtgatatgctctagaaatgatatgttgtacctgccatccccttcccaaggaagaacaagatctctggaattgtatcttctttccaaggttgaagtgtggtaattaatttgccaccagtattggttgcgtgaaatgtagggaaaggctgcgtactatagacccaaagtggtcggacccttccctggaccctgcgcaagcgggagctacatgcaccagtgcctgcatgctgatccatctacaagtagacaacaattgcaggacctgcgcacaacactcggtaccgaggcaaaattcatagttgtagttgtctgcaatttactatggcaaaaggtcagaagattgtccttccagcgtgtcgtggccacctccccatagcaccgcctccatccagcgcgccgccccgcttccccacagcgtgccgctgcaggcgtaaccctacatcgcacattgagaaatggtggcgcgcggggtgtgaggcggcgtctccccaccatttttgtaggttgccgcaaaaacaagatgcacaagttcatcttttgtatgcttttcagtacatctacttcccaatgctcgatccaggaggtgctagctcatgctggctggaactaggatgcaaaagggttgacggatccatgccgcacaagcactgcgccatgctcagtccaaccacgtggcttcagggtggccgagttcgtcgcgaccatcagttcagagacctgcgtcactgctcgtgtcgctaccatggccacctgcatcactgcgtgatcagtcaacaacctcctgcacaaggaaaagcaacaggagtagaggtgtctgagatgctctgttctagcgaggtggctgattatgtttgtcagtttgtaatactttggccgcagtgtacttatgtatctttttctggccggagcacgaccagagcttatgtcagtaccagctttgattgtgatggtactacaaactatataaaaacaccagcaatccatttttactcgtacttaccttttatacatttcacaaaaaaaaaaaaaaaaaa

SEQ ID NO: 30750 - DNA, 1868 bp, Triticum aestivum
  Clone ID: PAT_TA_30750
ggcgcgccacgagccccccccggcctcccctgctttgcggcgcgccagagcgagcgagcgagcaaaccagcccaaaacccaccagcgccgagcgagatggatcggcgcaagggcagcggcagccgcgacgccaacggcggcctcgcggaggcgacggcgtccaggctcaggttcgaggacgccgacgaggtggccggggaggtcgggatggaggtggaggagagccccgccgcgcccggggaggaggtcatcggcaacgacaagaccagcgccgactactacttcgactcatactcccacttcggtattcatgaagaaatgctaaaagatgttgttcggacaagatcatatcaaaatgttatcacccagaataactttcttttcaaggacaaaatagtccttgatgttggtgctgggaccgatatcctatcacttttttgtgcgaaggcaggagctaagcacgtctatgcgattgaatgctcacagatggcggacatggcaaaggaaattgtgaaaacaaatggattttctgaagtcattacggtaataaaagggaaagttgaagaaattgatcttcccgtcccaaaagtagatgtcataatctctgaatggatgggttatttcctcctgtttgagaatatgttggacactgttctttttgcacgtgataaatggctggctgatgattgtgaggagctcaaaattgaattttggaataatgtgaatggctttgatatgagctgtattaagaaacaggcaatgatggagccacttgtagatactgtggatcaaaatcagatcgtcactaactgtcagttactgaagacgatggatatttccaagatgtcatctggggatgcatcatttactgtgccgttcaaattggtagcagagcgtaatgacttcatccatgctcttgttgcttactttaacgtgtcattcaccaaatgccataagctgatgggcttctcgacagggcccagatcaaagtccactcactggaagcagactgttctgtatctcgaggatgtggtaactatctgtgagggagagactctgtcgggcagcatgacagttgcaaacaacaaaaagaaccctcgggacatcgacattacgctgaaatacgccataaacggcaataggtgcaaggtgtccagaacacaacactacaagatgcggtgaccaacacgaggaactcagctgccgtgcagtccactcaattttggtcgactgagtatcttgtgttttgcaaaatttgatgcttgttccccggtcttgtattttaacatgcgcttgtcaggcacctaggcaacaaagtagaaagtagagtttgactggcatgttaatgtagtttgcttcattgcaaatctatatgttgtgtccgtggcacagggattttgggaagtttgttgtacacgattgtgtcaaaagtggatccataatagatcacaaccctcgcaatttatgggttgataatatctgctgaacaaaaaaacctcaaagggggccccggacccgaagcgccccacccgcgcgtcctttggcctgatactggtcggcgatttccaacgttcgtggacagggaaaaacctcttgcgtaactcccaacttgaatcagctttgcgagattcatccccactatttcgcccaatttgagggaaattacggtgaatataggccctctatccgggaatgattcctatactcaacaaggttgatcatcgcttgatatccgtggaattagtctctatatttttacgcgcggttatatactcatctattactataacatactgccttgtgaaataatattgtgtgtctacataagccgggctatcatatatgtctccatccacaaatacgacgcg

SEQ ID NO: 30751 - DNA, 608 bp, Triticum aestivum
  Clone ID: PAT_TA_30751
gctcggtttatttcagcttttctcaccgccagtctctcctcctcctctctcttcacctgctctctctctctcagtcatgtccgacaaagttcgtgcctcccatctgttgatcaagcattccggttctcgtcgacctgccagttggaaggatcctgagggggctgaaatcacgaagagaacaaaggaacaagccattgcgattctgcaagggcatagggatgcaatcgtatcgggcaaagccaattttgcagacctagcgaaacaacattcggactgtggctcagcacagaatggaggggatttgggagagtttggaagaggggcaatgcagaaaccgttcgaagatgccacctatgctttgaaggttggtgagctctctggcatcgtggacacggattcgggagtgcacatcattcagcgcactgcctaaaaggaaaaaaaattcttccgcccatttgcttgggcgcagtggaacagcggaaactctctgcttttcttgccttcggtttcttctcccctccaccccgcctctcgccaactcgtcccgcttgctccgcgcagtcacgttttcgcttcaaaagcccattcgattgccattctttgttttg

SEQ ID NO: 30752 - DNA, 643 bp, Triticum aestivum
  unsure (1)..(643): unsure at all n locations
  Clone ID: PAT_TA_30752
agcgcgactcatagttccagaccaacaacaacaggagaggagagctcacaagataagatggcgcacatgcgcgtggtgcaccgggacgaggagggccacaaggtggcggagaagctgccggtgccggagacgaggcgcccggacacggccaggcacgtggagcgcaagctggaggagcaggggctgcaccggctggagcgccacccggccaacgcgccccggggcgtcggcatcggcgcgcccccgcccaagtccggccgcggcggcaagtacacctgggagggccccgaggggctggtcgacagcgagctcgaccccgcgcccgccgccatcgaccgcaacgaccccaactacgacgaggaggaaggcggggagcaggacgaggtggccaaggaggtggtcgtcggggaggtggaggtcgccaaggtggcccaggcccgggccggcgtcgccagggtcgaggtcgcgccgccgctcctccaggaccacgaccaccagcagtaggagctggtcgtgtgcgtgcgtgtgtgtcgtgttgatcttcgtttccttgctctgtgctctgcttaccatgaatgtgtgtgtaacaatagataataatcaagcgtggaagtggatcagttaacctctgtcatgatncana

SEQ ID NO: 30753 - DNA, 452 bp, Triticum aestivum
  Clone ID: PAT_TA_30753
ggtccaagattcccggggccacgatgacacaccttatcgaagactcggacatggaacttcttatggcgatggcatccacacatggccatcaccaccttgctgtcggtgtcgcaacttaccgaacaacaattcctttctccatctctcgtgacgcagctcgacgacgatggagacacgcaccagcagctagcagcatcgcgccgccacctacgtccaccttgtgccggcgacctccacctcacatggatttcgccgtgccgccgccgtcgccttggatcgacaaggctctgataccaattgttggcgccgcctcctcgcgttgcagcgccgctccttcttctacctcaagctgccttacacaactctcttgaggtttctctcaagaacacaagaatacacacacacacaagaaactctacacacacgcaccaaggaagaagcccaactacctt

SEQ ID NO: 30754 - DNA, 682 bp, Triticum aestivum
  Clone ID: PAT_TA_30754
ccccacgcgcagaacgagaggcagtcagagcagagcagagccgagccttcgccctcgccctcgccccagagagcgaacgcacacacacagccgcaatggcgcgcgccggcgctctctgcctcgcgctgctctgcctcctcgcggcgcactccgccgtcgcccagaaggccacggccccggccgccgcgcccaccaccaccacccccacgccggcggctcccgccaagaagacgaccgcgcccggccgcggcgccgaccaccacgcccgtcgccgccaccccaccgaccgcagcggctcccaccacccccgcaacccccgcccccgccgcggcgccacccaccaaggccaccccggcaccagccaaggctcccgccgcagcgccgcccaccaaggccgcctcctcgccccctgccccggctcccaaggccagcactccgccggtcgaggctcccgtcgccgctcctcctgctcccgtcgccgaggcacccgccaccatccccaccaagcccgacgcccccgcgcccgccccggccaagaagaagaagaagtcgtcctccaagaagaagaagagcaaggccccggcccccgctcccgtcgccgccgaggcccccaccaagtccaagaaggccaaggcccccgcggcctccgacgactccgaagcccccggccccgcactcgatg

SEQ ID NO: 30755 - DNA, 825 bp, Triticum aestivum
  Clone ID: PAT_TA_30755
cccgcccgcggccccgcggcccggcccgcttgcgccgctggctccgccgcccccccgcctgggcagccggccgcgccgcccccccccctgcctcccctgctcccgcgccccccgccccgccccccgccccgcccccagcgtcgtcgtcgtccggtccgggagcccccggcgtgcgccgccgggcgcagctgcccggccggcgcgcccgcttcgtccccttccccctctcccccggccgctccgccgcccgcgtcggcgtcctcctctccctcagcccccgccgcccccgccgccgcgccgccgccgcctcggccgcgcccgccgtcgcgccccccgcggcggtgccgccgcccctggccgcgcggccgccccccgccacaggcgcagcctccggcgctgtccgcgcggcagttcgagctcgccatggccgcgcaggcgtccgccgcgaccacggccgcaccccccgccggcaccagcggcgccgcccggcgccaccgccactacagctagcggcgacgtcaccagtcgggggcgtgattaagccgagcctgaatctggacggcgggtggtgggtcgtgccgtcgtcacgagcccttgtctcttgctccccgaattatcatcagtttcccgtcagagcgagcgatccgtgtgttcccttgtgtacgtacgtagccatggcgccatacttttttcccggggatttttttgttcggttcctgcttgttttacatacatggtcacaaccgaatcctgatactactgtaaccggagcactattttactcactaaactttggccggtgcccctcgtcgtaaaaaaaaaaaa

SEQ ID NO: 30756 - DNA, 1303 bp, Triticum aestivum
  unsure (1)..(1303): unsure at all n locations
  Clone ID: PAT_TA_30756
tcgacccacgcgtccggtctgccttacaataattaaaaatgacatccattcctgtgcgaagatcatgtgcctgtacgaccctgctgaatgcagcggaaccaagatattcagtgatgcgatatcttccggcaacaactgaatctaccacaataggaatggatgtctgccttaaaataattaaaaatgacaaggatttctttgatcagagtttggatgagataaagctccttaagtttgtaaataaacatgatccggcagatgcacatcatatattgcgcctatatgattttttctactatcaggaacatcttttcattgttaccgaattgctacgggcaaatctatatgaatttcaaaagtataaccaggagtccagtgatgaggtctacttttcattgcccagaatacaggctatagctcgacagtgcttagaagctttggtgtatttacatgatttaaatatagttcactgtgacctgaaaccagagaacatccttatgaagagctacagcagatgtgaagtcaaggttattgatcttggaagcagttgcttcttgacagataacttaagcctatacgtccagtcacgttcttaccgtgctcctgagattattttgggtcttccatatgaccagaggattgacatttggtctcttggatgtatattcgctgaactgtactctggtgaagtgctctttcctaatgaatcggtgtcaacaattcttgctcgnatgattgggacaattggcccaattgacacgcagatgcttgcgttgggacaggagactccgaagtactttacagaagagtacgaccttttccaaagaacgaggagacgggtcagctggagtatttgataccagagaaatcctccttgcggcgccacttgcgatgctccgactccaagtttgttgatttcctgtcctgcctgctgcaaatcaaccccagaaagagaccaacagccagggaagcgttgcggcatcgatggttttcacacaagtatcgttgagctgccaatcaaagaccattcttcacatggaggggacattttcgcagttcctcagctcatgaacgacacgtttttttttttcttccttttgcaactgggtttttgttcgtgtgcctttttttgcctggcaattcttggcctgctttgctaggtgaatacatacctgctcatgcatgtaaatatgagaaaaggttcctgcctgtacagctggcgtttactctgatggagctttttaaaatactaccctgatgtacttctaattcataatatagcaaaatcaagtttgctttaggc

SEQ ID NO: 30757 - DNA, 1497 bp, Triticum aestivum
  Clone ID: PAT_TA_30757
ctgggcctccatggccaggtgcagccgggattgttatctctcacagggcaatctgcctcaggcgagcctatagccacatctattattgtctctggtgggatgaagatgatgatgatcgtggtgatgtactggtgtacaccggccatggtggccgagaccccaacctgcacaagcattgcgtcgaccagaagcttgagggggaatcttgccctcgagcgcacatggcctatggtattgagattcgtgtaatccgtgctgtcaagtctaagcgcagccctgttggaaaggtctacttctacgacggcctctacaaggttgttgactactggctcgatcgcgggaaagcaggctttggtgtttacaagtataaaatgattcgcattgaagggcaggagcccatgggatctgtgaattatcgcgcagctgaacatcttaaggtggatgcactatctatgcgaccaactggatacctgagctttgatatttccatgggtcgagagattatgccagttgcactatataatgatgtcgatgatgatagggacccactcttatttgagtacctggcacggccaatattcccatcttctgcaattcaagggaagtttgctgtgggtggtggtgggtgtgggtgcatcgagaattgctcaattggatgttattgtgcagaaaggaatgggggtgagtttgcgtatgataaagctggtgttcttctaaggggcaaaccactgctgtatgagtgtggtccatattgccaatgcccacctagctgccccaacagggttagtcagaaggggcttaagaataggcttgaggtgttccggtcaagggaaactgggtggggtgttcgatctctggatctcattaagtctggcacgttcatctgtgagtttagtgggattgtgcttactcatcagcagtcagagatagtggcagccagtggtgattgtttggtgcatccgaacaggttcccttcaaggtggttagattggggtgatatctctgatgtatatcctgagtatgtcgctccgaaccatcctgccactacagacttgaacttttcgattgatgtctcaagggcaaggaatgtggcttgttatttcagccatagttgcagtccaaatgtatttattcagtttgtgctgtttgaccactacaacgtgtcttatccccacctcatgatctttgccctggagaacattccgcccttgagggagctaagcattgactatggaatgattgatgaatgggttggaaagttaactatgtagtcagtatccactggaaggcaaattcttctttcgttttcctttgtgtaacattttcgtaatgcttctcttgggatagtcgaggagattgctgctagaagttactctgctggtaatattcccaacccttgctgtaattttgtagtcttgagctttacatggttgtatttcaaagtcgtttttttatgtcattcatcaccattatatgcggcttaaaaaaaaaaaaaaa

SEQ ID NO: 30758 - DNA, 1013 bp, Triticum aestivum
  Clone ID: PAT_TA_30758
tggacttggctgagaaagttccctatgctgagtctaaaatggaaatcatcgagtggctgtcagaggctggtgcaaagaatgccgtaaatgttggtaaagttgacgaagcatcagaagctaaggagaactgtgagtgatatcaagcacaatgtgcaagcacagctcagtgagaatatgaagaccaacaaaagagtgacggggatcgccaaggagctgcggaagctgcacagggaagcggttcagaacaccatcaactcggttactctggtggcaaccctgattgcgtccatcgcgttcgtttccatcttcaacctgccaggccagtactaccaggacactaaacgcgggggagagatcggggaggcctacatatccaagctcaccgggttccgcgtgttctgcctcctgaacgccatcgccctcttcatttcgctcgcggtggtcgtggtgcagatcacgctgggtcgcctgggagaccggcgcgcagaagcagatcatcaagatcgtgaacaagctgatgtggacggcgtgcctcagcacgtgcgcggcgttcgtgtcgctggcctacgtcgtggtcggcccgcagcacgcgtggatggccttcaccatatcggccgtcggagggccgatcatgatcgggaccctcctgttcctcgcctacctgctgctgcgcccgcggttcagcttcggcgaggacaggcagcggcgcatcaggagggggagcggcagcaagtccttctcctggtctgtccgcgaagggttgtcggacctggaggccgtggaagaccacgagaagaagatctatgctttgtagtcctgctgccgcggcatgtaacattgggaacaggtagttgggaggaaaacattcgccttgtacatatttttcatggctgttttaggtctgtgtcgaggtacaacacgcagacctttctctggaatgtttgtactgttgctttaatactggagaatgaagagctgtactgcggtctagcggtgcagcgacggtgttatac

SEQ ID NO: 30759 - DNA, 818 bp, Triticum aestivum
  unsure (1)..(818): unsure at all n locations
  Clone ID: PAT_TA_30759
gccggccggggcagagtcgggaccgcgaggccgaggggggtggcgagagactccggagaagaagcaggaagcgggcgaggcggcgaggtcgatgtcgacgacggcggggtacctggcgcggcgcgcggggccggaaggagcgggtgcggctgctctaccgccgcgcgctcaaggacaccctcaactgggtccgtccaccgccacctcttctaccaggacgtcgtccggagctccagggacaatgttccagaggccaaccaagatatggtagaagtaccctggcacgtgatcgataggctccatcgaggacgcggaggcgcaagcaaggagcgaacttccgagcacccggatccttcacattgttccattggcatcttgcaggggcactaaattcaccaaggaaccctacgtccaccctgaagggattgaaggtttatctacaactatggcaaaataagaccaaatgaaacaaggaatcatgcattggtttatgcaggagcctggcacctgcgggagtgcgaaaggacttactttcacttttccagatgatagcatgcaactgagctgctgtatgattgttaagaacaaaataaaattactagccctccttccatgtgtttcttttatcatggtgttgttatatggcaactattttgtgctcatcagctagttcatcgtttacatttactaaaaaaaaaaaaaaaagtaaaaaaaacctccccggcggcctcttaacccccactgggcgtcctgggtnccaacttaaccctgcacaatccctttncantgggtatacaaaggcncacgttcctccaaat

SEQ ID NO: 30760 - DNA, 729 bp, Triticum aestivum
  Clone ID: PAT_TA_30760
attcaccatcgctccctctccttgccgcgcggccgacctcccgtccgctctccttgccgcgctgccgacctccacctccccgccgccgctccctactaggcaagccgcaacctgtccggattgatcctctcaagcggacggacgccggaagatcagccgctgtcctcgttgtctcctccgccggcacgactcgcaggtgagtcgtcctttgcctcctcgattacccggctctgtccgcgccgatgctctcaggctaaccctgtaatcatcagctctactaatacaagatcgcccacgcgcagaaactttagtcttcaactgtaatagctagctaatctgggcccaaatccgaccgccggagcacggatccttttagctgacgccgggagaccaaccaatcgacctcagcctggccatggccctcgtcgtctcctgtgccggcgaagctcgcaagcaaagccgcgaccagcagcacgtccacggcggggcacggagagtatgactatctgggtcgtcaggtagtccatcgcttccgtcagcctagcccctgtatggctatatcagccgtactaattcagtgcatccgacttcagaaactttccatggaaaatgcctgcatgaaacctcaccaagtcgtacgctcggtgcggctgctcaagatcgacgggtttagcctgacccggagcctgagctctgaatatcgcttccattgagatggaatctcgatgg

SEQ ID NO: 30761 - DNA, 1448 bp, Triticum aestivum
  Clone ID: PAT_TA_30761
cgcaggctcaaagacactggtgcgtgagactgaaagtgtagtgtagctgataagtgagactgtaactgttaagacatgaagaactctcactgcagcagtttgctcctggtgtgctcagttcttgtgctctgcctcgtaaccggaggcgcgaggtgcgacaagttaagcagcaatttctatgactggacgtgccccggagtgtacaacatcgtccagcagcacgtgttttctgccatgagggaagagctgagtatgggggcctcccttctcaggcttcatttccatgactgctttgtcaatggctgtgatggttcaatcttgctggatggtgctgatggcgagaaatttgcactacccaaccggaactctgtcagacggtacgaggtcatcgacgcaatgaagggcgacctcgagaacatgtgccctggggtggtgtcctgtgctgacgttgtagcccttgcagctggctatggagtactctttagtggagggccttactataatgttcttctggggacaagagacggtctgaagccgaatccgtcagggagctgacaacggcctcccctcgccatacgaaccgatcagctccatcctaaacaagtttgccgatgttggcctcgacacgaaagacgtggtggtgctgccaggggcccacatgatcgggcgagcccggtgcgtgctgctcagccaccgccgggcctccaccaagcgcccggcaaacccgacgctggacgccaccatggccgccaacctgcagaagctctgcaccggcggcgtgggcttccgctccgccgccctggccgccagctccgcggacgtgttcgacaagcagtactaccacaacctgctgagcaagaagggcctcctgccgtccgaccagggcctcttctccgccgacgaggacgtggtcgccagcaccaccaaggcgctggtacagacgtacagtgacgacggcgagcagttcttctcggacttcggcgcgtccatggtgaagatggggagcataccgttgccagcgggatccgccggcgagatccgctgcaactgcagggttcccaatcccaaatgagcaacggcgagcagagttcatcggcggttagatgaaaaagatgaaccggtagctaggaagaactagccgactggctaataaagcaggactgaggattcaatcccaggcgcttgtcgctactagaatgcggcaccaaaggacacactttgtaagtgatgattaactcctgtaaatggtgcaaagatcattgtcatactgattagtagtatatgtagaaacaaaggatgcaagactattttgtaattccgggtggcttgatgtatgttcttgttagatttatgttgaataataaataacgatggccgtatgcatcgattgatgcagaggccgggggtcttaacctccttttccaaaaaaaaaaaaaaaaaaactcgag

SEQ ID NO: 30762 - DNA, 852 bp, Triticum aestivum
  Clone ID: PAT_TA_30762
gcgaggcgccggcgacgattgtccacaccagcgtccccgttatcctttctttgctgactggtgacgacgagaagattcgcagcctggaactcgtcgacagggcgtctggctcgatcccgatggtccatgtccacgacctctgccgcgcaaagatcttcttagccgaggaggaggctgcgtcaggaagatatatctgcagctgccctggcctcgacccaccctcgcggagctagccaccttcctgaccgccaagtacccgcagtacaacgtcaatagcgacaggttcggtggtcgccccgagaagttgagagtctgcatttcgtcggcgaagctcgtcaaggaagggttcgagttcaggtacaaggcgttggacgagatatacgacgacgtcgtcaactacggaaggtccttgggaatccttccgtactagcagtatagcatgcttgatgagcctctatgtattagttggttggatgtctggaaccaaagctaaagttcaattgcttatactagcaaacactgcctgtgcgttgctacacgtcgattttagtttgtgtatattcttttttttcatatactgaaatgatcaaatacatagtccaaacatttgtacacggaagacaacagtaagatgaacatcgacgcagcactgaaatgatcaagagatggccgttgttcctgtttctgccgcgcaaggagaagatcaaaggaggcgtgggcacgtgactattttccttcttttgtgtatcattcacatttatatagctagcgattgataaatttgtaatgtatggatacttggtgtacgaaatgtgaagtaaatgaaatacaattgagatttgctaccaaaaa

SEQ ID NO: 30763 - DNA, 658 bp, Triticum aestivum
  unsure (1)..(658): unsure at all n locations
  Clone ID: PAT_TA_30763
cttcgccacgaggggagcgagtcggaacgcgcgcgcgcgggcggatcgccggcgagggagaaagctcagctccggccggccgtgcggaggcagcgccgatggcgccctccgcgcccccgcccccgcccctcgcccgccggctcgtggccctggccctggccctcgccctcgccgccctcgtttcccccgcctccgccgccaggaagatcccggcctccgtcacccccatggatacagtaagagctagtaacaaagggtattctgcggagatgctcgttgttacttttactctactgaagaaaaccgtacatgatgagcgaaagattaaaatccttctctcgtttgggcagcagggtagccaacttattagtaagagactgtcattaagtctgctctgcggagatgctcagttgttactttttaatcatgtgaatgaaaaccgtacatggagggctctaaagattaaaatccttccaggctgggcgctgctcggccgagagctttttgcccctgcacggccagtgagcctgctcccccctgtgcttggcattnaagtcctgctcctacattttttgaccggagaaagcgcaaaattgccngtgtnggattctttcnacccttttnggngaaaatcccngnacaccttngggattcaaag

SEQ ID NO: 30764 - DNA, 1018 bp, Triticum aestivum
  Clone ID: PAT_TA_30764
gtgcggcgctcgaggcggccggtcgggaccatatacatcccggcgaaatattaggccggcggggcatggaagggaggagcaaggccgccgcgatgccgtcggagccggtgaggctcatcggctgcttcgccagcccggtggtccaccgcgccgagctggccctgcgcctcaagggcgtcccctacgagctcatcgaggaggacctcaacaacaagagcgagctgctgctcacgcacaaccccgtccacaagaccgtccccgtgctcctccacggcgaccgctccatcccggagtcgctcgtcatcgtcgagtacgtcgacgaggccttctccgggcccgccgctcctccccgtcgaccccctcgcccgcgccaacgcccgcttctgggcccgatttctcgaagaggagtgcaagaagcctttgtggatggcgctgtgggcggacggcgaggcgcaggctgcggcggcgagggagacgaaggagaagctgacgctgctggaggcgcagctgccggaggggaagaggttcttcggcggcgacgccatcggcttcctcgacatcgccgtcggcggggcgctcgcgcactggatgggggtgttcgaggagatggccggggtgcggctgctcaccgaggaggcgcacccggcgctgtgccgctgggcgagggagtacagggccgacgagaccgtgcgtcagtgcctcccggacaggtcccgcgtgctcgctgccttggcggcgaggaaggatctgtatgtctccattgctaaggccatggctgcacaaaagtagtagcccggttcacgaccaagaaggggatatgcatgcttgtgaccatggcgtactggtcaatgatgctgaaatcagggctatgtatacatgtcgatgcatatccatagtggatccaatgttcttggaataaaaagaagggaaaagtgcgtccccccccgactatgtatacatgtgtcgatgcatatccaaagtgtatccgatgttcttgaaataaaaaggtccgctctat

SEQ ID NO: 30765 - DNA, 1407 bp, Triticum aestivum
  Clone ID: PAT_TA_30765
caccccttgcctcatagagacgtttcctgtaaatttaaatttggcccaaccattacagttagaatcacggaggccattcccaatagaaattatggaggccattgccaatagagtaagaccccttaattacagctgatacggttagaacttgaagccgaaaatatgccacaagtcgaagatgtttttatcaagccccgtcatttgagttccaatagaagtcacctccttcggttgagtagccatatgggagatgaggcccataaacaacactgccgttcaaaaacgtcatctggtccacctgcgacgctgcctggtaagcgtccggagcattggcctgagccgtgttgttctgaaccgggtagatgtttgtgctgacatcctgtgtccgcacacgggcagtccgcttgttctccacgtgaccgtctgcgctcagcctgaccatttgctgctggatttcaatcagtggactgcaagtgaattttgacttagcactcttctttgcttccgaagacttgaattcgagccggtataaggcaaaagcgtcgcggtcattgatctcgtactcatagaggtgccattcgtagctgctggatggctgtggatccatgtagtatgacctctttagacccccaaagtctttcatcacctgcttccttgattcatgccagccacggccgttgtaatctggcagtgacctttgcttccggtttccactgtcgaatgcccttcttggtttgtcaaagaaaagccattctctcatagattcaccttcaaagatgtaaaggtcgaaaagttcaggtgcattccaaggggacttcgtagttgcagccccttcacagacaggaacaccgacatgctttccttggattttcgcactaagagcagcaaacaaagggccatcttttagatcaatacctctcgggcggatcacaggcattgtgcctggagggccctcttccttcacggccaattcagcatggtacatgctgcagtaatcttgccagctttcagatccttgagcaggccgagggcagtcccagagagcgcactttggcctcagaaatgaagcaggtgctggagacattgttgtgagcaagtctgacatgtggaggaaaccatctccagcattctgcccatagttgttcatatcaagatatgcattagggggcaactcttgtggcaaattgaactgcagatattcttggtgaccaatcccttcaaggttattgaggatttctggattggacccaggaaggtttatcttgtaatcatcgtcgtaaagaaaatcctcaacactaagctcctggttcacatagtacatctgatcgtggaacccggcactagctggagtggtgataactcccggacccagcgacgtcggctgctgcgccaccgtcactggatccc

SEQ ID NO: 30766 - DNA, 648 bp, Triticum aestivum
  unsure (1)..(648): unsure at all n locations
  Clone ID: PAT_TA_30766
gtggaggccctcgccgaccggaacaccgtcgccatggtcctcgtcaaccccggcaacccctgcggcaacgtctacagctacgaccatctcgccaaggtcgccgagacggccaggaagcttggcatcttcgtcatcgctgacgaagtgtacgcgcacctgacgttcgggaagaaccggttcgtcccgatgggcgtgtttggctccgtggccccggtgctcaccctgggatccatctccaagagatgggtggtgcctgggatggcggtttggatggatcgtcaccaatgatcctaatggcgtatttcgcaggaccaagcttgtggaaagcatcaagagttaccttgaaatctcctgtgatcctgcaacgtttgttcagggagcaatcccagaactcctggagaacacaaaacaagaattcttccgacaagaccgtggacattctcagacaaaccgcggatatatctgggagaagcaaaggatcatcggacatttccaaagaaaccggagacccaagtgtgtaaggtttaacggggggactctggacaggacatgaagagacatgaattctgctgacatggaataatagtgantggttgtttgcaagatntctgtggatnaagaattggtccgntacttccaatcagacng

SEQ ID NO: 30767 - DNA, 1010 bp, Triticum aestivum
  Clone ID: PAT_TA_30767
cggacgcgtgggatcccttcaccctctgcttcttccacgcgtagcaccaaacccaccgcctcgtgctcttcctccacctccacttttctggagcaccaaagtcacacgcgagggcccaccatcctcacagagatggatctcaacggagcggatctagcctccctgtcgcctcctccaccgggagcgacgacatcctccaccaagatctgcgtggggaggctgatgttctcgacgggcaggagcactcgccgacgtgctccatctccttgtttgccacctccgtcgagagccgcgtgattgtcgccttcgagagcgcggctgcagcccatccatggtgtgcatccagagccttgcgacgacatcaccaagtcggcgagcattggatccacacctccggtgagcagtgtctccccttcccgtagtctgacaagacaccatggacgcccccgtcatagtccttgtgggccggtggatgaggcagctagcccaaggcgagctagacgatgcgtgcacgccgagcgaccacaacagcggctgctcgttcaggtcaaccaccacgcgtgcaggccaccatggtgtccgtcgcgaccgttgatggccttcgggcctgatctgcagatcggcgggatacggcatggtgggtaggaggtgagctggccgtggtggggaggaggagcagttatggcgggagagagattgccgttgtgaacacaaaccgcaaaaaaaaacatccacatcaacgttgttgaaattgaagttgtccatgagacaaaagcacatccacgggccatggcaaaattttccagacgctaaaccaggagaattatggcttattttgtctaaacttctatttttatgttcacgagcttggatgctaaattgtatactatataattgtttgtacatgactttgcaactttcctaaccggactttgatatttacaatattcgaaaacacttttaacttttgaaatgtgatgcttgtgctcctgcaccgagttttaatcttc

SEQ ID NO: 30768 - DNA, 1545 bp, Triticum aestivum
  unsure (1)..(1545): unsure at all n locations
  Clone ID: PAT_TA_30768
gngngnttaagnnnnnatcccctcgtcccctcccctccccccgctcgccgtcgaccctcccctctcccctcccctccgcggcctccaccgcggcggcggcccctcttctccctcccgccccccccggccgcgcgcttgcggcacccacctgtggtgtccgttgcgtccgcggacagagagagagaggcagggagaagggcggccatgaccaccggcggggaggagcagcaggggcggaggctgttcggcgtgtccctcacggacaggcccgtctggcagcagttcctcatctgctcctccggcttcttcttcggctacctcgtcaatggcatctgcgaggaatacgtctacaaccggctccagttcagctatgggtggtacttcacgttcgtgcaggggttcgtgtacctggcgctgatcaggctgcaggggttcacgatgaagcacatggtgaacccgtggcggacctacgtgcgcctctccgccgtgctcatgggatccaacggcctcaccaagggctccctcgccttcctcaactaccccgcacagatcatgttcaagtccaccaaggtgttgccggtgatgataatgggagcatttatcccaggattaagacgcaagtacccgttccatgagtacgtatcggcagtgatgctcgtcatcggcctcatacttttcacgctcgcggacgcgcaaacgtctcctaatttcagcatgatcggcgtggccatggtgtccagtgcactcatcatggatgccttcctgggtaacctgcaggaagccatcttcaagatgaaccctgacactacacagatggagatgctgttctgctcaactgttgttggcctgcctttcctcgctgtgccaatggtgttaacaggggagcttacgacagcgtggagcgcgtgctctcagcacttgtacgtgtatgccgtgttggttttcgaggcgatggcgacgttcgtcgggcaggtgtcggtgttgtccctcatcgcgctcttcggggccgccacgacggccatggtgacgacggcgaggaaggcggtgaccctgctcctgtcgtacctgatattcaccaagcccatgacggagcagcacgtcacggggctcctgctgatcaccatggggatcgtgctgaggctcctgccggaggacaaggagaagaaaggcatggccgagcgccagcaggcgaaggcgcagcgcggcgaggagaagcggcggggagacggagtagaggaggagacatcgccgttggtatgatcggtgacttggatgagctgaacgaataacaaatcagagtgcaggatttggccaagtctgcttttgtgaacctttgtccagtttgtgttgtttgatgtcgtggaactgttttggggattgtaacttgtaagttaaaggaacaaatcagagtgcaggatggcgatgatcagagatggattagatgttgttaatccttttcccttgaatctctgtgacaatatatcatggacaactgagattatctaaagaaaaaaatgggccaacaatcaaatgaaaaggacaatg

SEQ ID NO: 30769 - DNA, 1298 bp, Triticum aestivum
  unsure (1)..(1298): unsure at all n locations
  Clone ID: PAT_TA_30769
cgtcggaacaactaatctctttgtcctcatggcactcgctaagaacagtgcaggatggccgatagtcatgtgttccattgctattgctttcatggtgctttccatgatgtgttctaccttcccatcctgccatgcaggcactgaatctgttcataatgtggtttgtgagactctcgatccctgtaatagcccgaggtgtgaagacatgtgtaatcgtataatgcacacatcgcttcagacactattgcaagacccataatgtgcaaattccaaactgttgttgtatagaacaataatctaattgctggttctcctgcttgagccatgcaatgttgaataaatatttttaataacctctgaggtttaatcacaggggtttattggcatgtgccaatgctggcacacctcattcgaacggaagccagttctttattacccttgaccgctgcgattggcttgataagaagaatacaatttttgggaaggtcactggggattctatcttcaatcttctggccttggctgatatcgagactgataaggatgatcggcctgtatacccacagaaaattctttcagttgaggtactctggaacccatttgatgatatagttccacgacaacttaagaagattcagcctgctcccaaggctgatccacgcgtccgaccagaggtgggagctgttaagcaacttaatgtgctctcgtttggagatgaagtagaagaagaggagaatgaggcagcttcttttgtgaatgacaaaataaagagtatccacgatgtgctcgatgactcccgttttcttaaagtggaaccacaggttgaacaactgtccaaggaggaagaggagaagaaaaatgaaactgtcctatctatcagagaggctttaatctcgaagaaagctgactccagagagccagagcatgatccagaaaatgatgattctcctgaagacgagaatgaggaggattttgacaacaggatgcgttcacggattctaaaaaaacgtagagagcttggggattttcggcagattcaatcttccaaggaagacaaatctcatcagtagtataaagaattatcaactcacaggagttatgatgatgctgatgatgatgacgacgacgatgatcatcaattatcaaaatcatgaaaactgtctttgaagaaaaaagtaatagattctgaagctattactatagagaaatacaatgttgatgttattttgcgcctgctccatgcatttgaacatgagaaacattctataaagacagtgttcaagcaanacaaagncccc

SEQ ID NO: 30770 - DNA, 780 bp, Triticum aestivum
  Clone ID: PAT_TA_30770
ccaacacccaccctgctcgccgctcctgcccccgaaaccctagcggcgaggatgggccgcaagcgccgccagccgtcgccgccgccgcccccgcctccggaggaggagtcttccgccgacgagtccagctcggcggaggaggaggaggaggaggaggcggcggaggccacccccgcgacccaaaattcccccaaacccccttccgccgccacggccgacgacgccgaggccgacgccgattcgtcggatgaaagtgacgaggagtcctccgagtcgggcaagatcgacgccgaggccttcgagctgcgccagatcgcctcctccaagctcgaatccgacgccggtgagcccacgccgccggccaaggacaagaagaagggtaagtctttggcggagccctctccgtccggcccggccaagaaggcaaaggccggggtggcggagaaggcactctccgagctcactcctgccagcgagggtaagaagaagcgcaaggcccagccggagaagactgcgccgtggaccaagcttggagaaacccggacagcccaggcgctggactactggaggacgagatcaagatcctgggaggcgctgggtcgccacggcaaggccaatggcacccagccgggcgctcgtgagctcattgctgcggttggtgccagcctcggaaggaagaacgtcaccaagacggaaatgtatggggaggtgcggaatatcatgcagcgatataagaaaagagtgagcacgggcgctctgccggagaaaaatgatgacctc

SEQ ID NO: 30771 - DNA, 1660 bp, Triticum aestivum
  unsure (1)..(1660): unsure at all n locations
  Clone ID: PAT_TA_30771
ggcgccgtggggctcctagtccggcttccgctgctcgggccatcatccatggagcagagccagatggccagagtgaagcttggcacgcagggcctcgaggtgtccaagcatcgggttcggatgcatgggcctcaccggcgtgtacaacgatccggtgccggaggatgctggcgtcgccgtcatacggcgcgccttcgacgccggcgtcaccttcttcgacaccgccgatgcgtatgggccacacaccaacgaggtcctgctcggaaaggctccaaggcacgtgcccccttgatgcgttcaagtcgccgaccgccttgccatggcctgcttcgaccccggtggcctgtgtgtgaagggcactccagaatatgtgcgtgcgagctgcgaagcaagccttgtgcgcctcggtgtggactacatcgatctatatttccagcatcgcattgaccagtcagtgcctatagaggaaaccatgggggaactgaagaagttggttgaagaagggaaagtcaagtatgttggcttgtctgaggctagtgccgataccattagacgggcacatgcagttcatccgatcaccgcagtgcagatggagtggtcactatggaccagggatatagaggaagatattatcccactatgcagggagcttggcatcggagttgttccatacagcccacttggtcgcggtttctttgctggcagggcagccgtagagagcttaccatcagggagtttactgtccaaacatcctcggtatactggagaaaacctggagaagaataaagttctgtatacacgactcgaaatattgtccaccaagtatggctgcacacctgctcaacttgctcttgcctgggttcttcatcaaggggatgatgtcgttccaatccctggaacaacaaaactgaagaacctcgatgataacatcgaggctgtaaaggtaaagctgagcaaggaagacctgaaagaaatctcagccgctgtccctgccggcgaggtggctgggtccaggatcattggaatcctggagccttattcttggagggttgcaaacactccacctcaaaagtagccattttgcatcttcactcggaaatcaaagaacatctcaccgcgttatgctgaatttgcttccaccttgctggatacgtacattcaaggggggaaatgtgaaagaatcgagctcgtccatactcaagaatagggaaacattgttcctgaaacaacagatgccattgattttctgttggatgtatcaattgctacacatgataaagataaaaggtgtcgaattcaagttaaaaaaggtaaagctgagcaaggaagacctgaaagaaatctcagccgctgtccctgccggcgaggtggctgggtccaggatcattggaatcctggagccttattcttggagggttgcaaacactccacctcaaaagtagccattttgcatcttcactcggaaatcaaagaacatctcaccgcgttatgctgaatttgcttccaccttgctggatacgtacattcaaggggggaaatgtgaaagaatcgagctcgtccatactcaagaatagggaaacattgttcctgaaacaacagatgccattgattttctgttggatgtatcaattgctacacanataaagnataaaaggtgtcg

SEQ ID NO: 30772 - DNA, 743 bp, Triticum aestivum
  Clone ID: PAT_TA_30772
cgacctcgcggacagaagaagaagagagagagaaaaaaggttcccccgggttcgctctccgggaatcctccgcccgccgccgccgcagtttatggatttcggaaggaacgctgcagcccggacttgtgaagccaagagcagcgtctccccccgtccctccggtctgcccttctcaccggccccctccacgccgtggttccgtgagctgtgggtcaacgcccccaaataacacccttctgcagaggtggaaattggtggatttctcgattggttgaaggaagtaaaacaaaggggacccactacccagcgtcctttcggcgagtgttggggtcttatctatttaagctaaaataaggccattcaagaaggctgtcaactgtaaacatgtttaggccgaagatctccaagtcggggtgggctgctttcgatcgcaggttgcgtggcacagctgatgcaggcgatgatgttgatgttcaactcatttccgtgctcatctcgggttctaagaggctccagttctgcctccagctcggcgatgggcgacttggatatgcccatggcgaggccgggtccatccgcgattcgcccccccgttgatgtcgcggtggttggttccggcaacggtaataggcatttgactgatcacatggtgagaacaaattctggtgtaaactctgcatctggtaacaaaattaagctcctgaaggatgctcatagttgggccgacagtaatttaattgagg

SEQ ID NO: 30773 - DNA, 1124 bp, Triticum aestivum
  Clone ID: PAT_TA_30773
ccagctcggagtccggacagagaccagacccgatctcttttctctcctctttcccggattacacaacctctctccgagtctcccctcttttccagctttttcctccccccaccaaacttccacgagacctccggccacccacccgccaaggcctccctccgctccgcgctgtccccgctggaccaccgcagcgctcccctgtccgatcgggaacgaggagagtgtgccacaggagagcgcgatccgtccctccggccccaagacgagcgccatggcagacgccggctctcatatcgccgctgtcgtcgccacctccacctgcacccactgtcaacgagaaattccatcatcaaacatcgacttgcattccgtacactgtgctcgtaaccttcaaaagtgcgagcactgtggagaaatggttcccaggaagcttatggaagaacactacaatgaaaatcacgctccggtaaattgctccctgtgcaaagaaaccttgcgaccggagatacttgatcttcataaaagtgaacagtgcacacagaggatggttgcgtgtgcatattgtgagtacgaattgcctgcaattgatattcatgaacatcaggatgtatgtggaaaccgaacggagttttgtcaaacatgcaagaagtatattagacttcgtgaatggatagggcacgaaatgcagtgccacgttagctcaaatggttctgaagaatcatcaagtgccagaaccattccagagagagaagtgcggcctcctccaccggtacgaccagcgcgtgctgtgcctgctgcacaacacaggcgacttctctttacgattgctgtaactggaatcgccgtcatggttggatcaatactgttccagaaggaggagagtttctaggtccggcagccatggacttcatatgccagagttgttttcaacagtagtatgataagataatataatctcttgatgtataatgttatccccattattcagttggcacgtcttgcttgcttaagagtacagttccagtcatggccttgttggaagaatcgaaataaccatccaaatatttgttgttctcagtgctatgtttaaacgtttaaagaaactatctgagtcctttctcagt

SEQ ID NO: 30774 - DNA, 1213 bp, Triticum aestivum
  Clone ID: PAT_TA_30774
caggagcacgaaccatcacgcccacctgtgctccatgctcctctgcatcccccagggcgcctccggcaccttgctgcacaccctgcggatacagcatcgatcgaccaggcgccgcgagcacaccctagcctcccccgtcttccacgtggcgctgccgccctaatccagctccccgagcagcccagcacggtacctagaagcggccgtccccaagccggagtaccccccacctccgatcccgccggcgctggggaccccagagcgccagccgcgcctgctcggccgcccccagcggaagcctgacccgccccaccctctgctgccgcgcccgccacgcccggtggcgcccacgtagccaaatgagccggaacagccgcaccccgtgctgcctacggtgccgtagcgggagcaccctgcacaccctgccatgcccgagctcccggagccggcactcccgaagccggcggtgcccgaaaagccgcaggaactcgaagagccacacaccgtcgacccgccgacgcaaccgaaacagcaacgcccgcacaccgccgtgccccagacgctgaaggagctacaggtgccgcacgtcctcgagctgccggtgacaaagaaaccaaacgtgccacaccctgtggtgccgaaggagcccccacagcccgccccccgagacccccgcaagacacagtggccccgccctgtagtgccacacaaggcccggcccacggacacgaagcacccccaaatgctgtgccgcccgcagccgaaggagtccgcgttcccgagcccgactgcgacagaggaccggaagaacgaaatgcccaccgtgccccatatgtccccatgcccccaaatactgaattcctcttccccgaccctgcggccatgcctgtgtgtgtggttgtacatcggcgttgtggtctgtatctcagtgttgtctgtgctgctaatcttgtgcgcgccgagagcgtgtgttccggtgtgtgtgtgtgtgggtgtatgtgctcaatctgttcctgttatatatgttcaccgcgtatgtgcttggcaccagcgttatgtctgtgtggtgggccttcgtggagctgctcaacctattgcatacttccttttacgtgtgtatgcatgatgtatatgatatgtacatgaataaatatgttttcgtgtttggagtttttaaaaaaaaaaaaaaaaaaaaaaaaaaaaaaaaaaaaaa

SEQ ID NO: 30775 - DNA, 425 bp, Triticum aestivum
  Clone ID: PAT_TA_30775
ttccctagtccaccgcgggcgccgacagcttggggtcgcccgcaagcaccagaagagctcccgcaagtggacgtgcatcggcatcggcatcctgctcgtcgtcatcctcatcatcgtcatccccatcgtgctcaagaacaccaacaagagcaacaacaacaacaaccagcagtagtaggaatagcttgtgatgatatgatcctggcttgcttgcatgcttgctgggtgttgttgatcgttttttgtggaattttttgcgattgtaattactccatccgtgcggttcgttgagccaatcgattatgttatataactatatacttttcggcgattaaaaaaaaataaaaaaaaatagggaaaaaatttattgaattaatagataaaattgaaaagattttaaaaaattaaggaggagtaaataaaaa

SEQ ID NO: 30776 - DNA, 1241 bp, Triticum aestivum
  Clone ID: PAT_TA_30776
taaccccttctccctcccttgtccactctgcttctccccctccaagaaaccggcgtacagatcgatcgatcggcccttgcctgagccggcagcagtagacatgaacaacctcttctccagctcgtggaagcgcgcgggcgcggggggcgacggcggggacctggagtcgggcggcgtggagatgacggcgccgccgggcgccgcggcgggggcgagcctggaccgcttcttcgaggacgtggagtccatcaaggacgacctgcgggagctggagcggatccagcgctccctccacgacgccaacgagtcgggcaagtcgctccacgacgcctccgccgtgcgcgcgctccgctcccgcatggacgccgacgtcgccgccgccatcaagaaggccaaggtcgtcaagctgcgcctcgagtcgctcgaccgggccaacgccgccaaccgctccgtggccgggtgcgggccgggctcctccacggaccgcacccgcacctccgtcgtggccggcctgcgcaagaagctgcgggacgccatggaggccttctcctccctccgctcccgcatcacctccgagtatcgggacaccgtcgcgcggcgctacttcacggtgacgggggcccagcccgacgaggcgacgctggacacgctggcggagacgggcgagggggagcggttcctgcagcgggccatcgcggagcagcagggccgcggggaggtgctgggcgtggtggcggagatccaggagcggcacggcgccgtggcggacctggagaggtcgctgctggagctgcagcaggtgttcaacgacatggccgtgctggtggcggcgcagggggagcagctggacgacatcgagggccacgtcgggcgggcaaggtcgttcgtggaccgggggcgcgagcagctgcaggtcgcccgcaagcaccagaagagctcccgcaagtggacctgcatcggcatcggcatcctgctcgtcattatacttatcatcgtcatccccatcgtgctcaccaacaccaacaagagcagcaacaacaacaaccagcagtagcctgtggatctgcctgcccgtggcgatgatgatccgggcttgcttgcttcttgctgggtgttgttggttgttttttgtggaattttttgcgattgtaattactccgtccgtgcggttcgttgagccactcgattatgttattatattagtaaaaatgcccgtgcgttgcaacgggtcaaaaggtgca

SEQ ID NO: 30777 - DNA, 1171 bp, Triticum aestivum
  unsure (1)..(1171): unsure at all n locations
  Clone ID: PAT_TA_30777
ggcacgagctcacgcgacaccgcacccgcgcccccatctccggcgacgggaccatcatgagcggcggcggcagcccgagcgggccggactctcgcgtggagaccatctcccgcctcgcccagtggcgcatcgacaccttcggcccctgctcctaccgccgctccgaccctttcaagctcggcatctggaactggtacctgtcggtggagaagagcaggtcggtgtacgtgcgcctcttcccggagcccggccggctggccaaggagcagccgccgctcgcccgcttcgtgctccgcgtctcctgggttggcccgccgcgccgctccagcgtctccccagttttcgagcagcttctccgtagcagcgacgattttgtgtggcaagttgatgtgatgtcccatgggcgttttacgattgacgtcgagttcttggacctgaagatagccacgaacaatggcactgaatcatcatcgtcgatctggccgaacgaaggcatggtgcagggcgtggccagcaagagcacgctgggctgcctctcgcgcatgctcacggagtccatccacgcggacgtgaccatcaacacgacggacggcgtcctgaaggcgcacaagtcggtgctggcggcgtgctccccggtgttcgagagcatgttcgtccacgacctcaaggagaagtcgtcgtcgacgatcgacatcggggacatgtgcgtggagtcgtgctcggccctgctggggttcgtgtacgggacgatccggcaggagcagttctggaagcaccggctggcgctgctggcggcggcgaacaagtacgggctgggcgaggtgaagtcgtgctgcgaggagagcctgctggaggacatcagctcgggcaacgtgctggagcggctccacgtggcgtggctgtaccagctggagcggctcaagaaggggtgcctggcgtacctgttcgtgttcgggaagatctacgacgtgcgggacgagatcagcgggttcttccaccacgcggaccgcgagctcaccctggagatgttccaggaggtgctcagcgtgtggaagcccatnctgaagcttgtgtgtacatagggtttgtggaaagatcaaagggaagaagccaccggaaagggtggaaagaatagccccaaaagtatatactaaaatacatagggtttata

SEQ ID NO: 30778 - DNA, 831 bp, Triticum aestivum
  Clone ID: PAT_TA_30778
cctgatccctccctccccgcccgcccgcccgctcgcttgtgagttgtgactgaccccccgatcgattgaccgacaccatggcgcggtgcacgcccctcctcgcctccctgctgctgctggccctcgccggcgtcgcctccgccgagaaggcccccgagggcggcttcatcgtcaccggccgcgtatactgcgacccctgccgcgccggcttcgagaccaacgtctccaaaagcgtcgaaggggcgacggtggcgatggactgccggccgttcggcggcggcgagagcaagctcaaggcggaggcgacgacggacaacaaggggtggtacaagatcgagatcgatcaggaccaccaggacgagatctgcgaggtggtgctgaccaagagccccgacgcgtcgtgcgccgagatcgaggagttccgcgaccgcgcgcgcgtcccgctcaccagcaacaacggcatgaagcagcagggcacccgcttcgccaaccccatcgccttcttccccaaggagccgcgcaaggagtgcggcggcatcctccaggcttacgacctcaaggacgcacccgagaacccatgaacccccatcccatccatatagtctcgctcagttgcttcccatcatcatcatcatcatcatctcatgactctccgacgtacggcgccctcgcctagctacttctgttccagctatatgttttgtataagataaactctattggtatctttttgtctcgaataataagatgataaattgtatggtgattaatatatagagatcatatgtaccatgtatgcgtgcagtggttttgtattatatcccaaacaat

SEQ ID NO: 30779 - DNA, 986 bp, Triticum aestivum
  Clone ID: PAT_TA_30779
gttcctcctatcccaaaagaatacagccaagtcggcgtgggaggcgctcaagaccatgcacatcggagaccagcgcctgagggatgccaagctgcaaaccctcaagctggagtttgaggggttgcgcatgaaggagacggagtccaccgacgacttcgccgtccggctgacgacggtcgtcaacaagatccacgcactcggtgaacgcatcgaggagccatacaccgtcaagaagttcctccgcgccgtccccaacaagtacctccagattgcttcgaccatcggacaatttggcgacctcaacaccatgacactccaggaggttattcggcctgtcaaggtgcattaggagcgcctaggacgactccgtgctgccgagaaggagatgagttgttgacacgcccctgagtggatagcaagggaagaggccgaccatctcagccgtgatgcaaccaaggtatatgcttcagttgccaagatcctccttcgtgatgccgagaaggagaatgagttgttgacgcatgctgagtggaaagcgagggaagtggttgatcagctcaaccatgatgcacccaaggtatatgcttcagttgccaagatactcctcggcaggagcgggggaggctatggcggtgacacacaccgggtaagcgcttccattgctaagattttggacactttgtttacaagtgccgcgaggaaggaaagggaggtgaaatccctaatcgccgaagctcatggtgacaatgaagcaactcttcgcctctgatgatatcccgagaataaaggtcaagacaatggataattgtaagcgtttacctggtaaactggtgtgatgttttattatctggtgttgtgtgtgagtgtgtgagtgttgttggtggccagaccactctcttttttggtacagtttcgaccctactttaatgcaatagttgttctcgtgaaaaatgtataatcagtttgcttcatggacagctgggaat

SEQ ID NO: 30780 - DNA, 632 bp, Triticum aestivum
  Clone ID: PAT_TA_30780
gttcaggagagcccggcgtgaactcgcccagcacctgtctgagagcgcggtggacaagccgccggcgatgagcttcaacttcgcggaggaggtgcaggtgaaccagaaggagatcatggacatgtacatgaagagcatgcagcagttcacggagtcgctggccaagatgaagctcccgctggacatggacaatggcagcgacaagagcgggagcggccccgccgccgcctcgcccacggattccagcggcaccgactcgagcgcggcgacgaagaaaccgacggccggggctgcgcaggagaaatctcccaaggtgttctacggaagccgagccttcttctagttctaggaggaaggaagccggagtagtgccgccggacggaccccggactagaagatggcatttgcagccatccgtctcagctgaaaacttggtagcgcagaggaataacacttttctcatgctgttgttttacttaggcttcgtcagatcccaagacacatgcggaaattagctgccctgtctgtcttacttttaatgtatcgctactctaatgagaaatgcctggcttcttttgcttgagtatacacatctgaatgacaaaaaaaaaaaaaaaaaaaaaaaaaaaaaa

SEQ ID NO: 30781 - DNA, 1355 bp, Triticum aestivum
  unsure (1)..(1355): unsure at all n locations
  Clone ID: PAT_TA_30781
aggcccgcgcgcacccacgcaggaaccgcactccaagtccgaaaaatccaagtccaggaagaaggagcgtacgtcgagatggccggcgtggtggtggtgttcgacttcgacaagaccatcatcgacgtcgacagcgacaactgggtcgtcgacggcctcggcgccaccgacctcttcgaccgcctgctgcccaccatgccgtggaacaccctcatcgacaccgtcatgggggagctgcacgcgcagggcaggaccctccgcgacgtcgccgacgtgctccgggccgcgcccatcgacccgcacgtcgtcgccgccatccgggccgcctacagcctcggctgcgacctcagggtcctcagcgacgccaaccgcttcttcatcgaggccgtcctcgaccaccacggcctccggggctgcttctccgagatcaacaccaaccccagccgcgtcgacgccgacggccgcctccgcatcgcgccgcaccacgacttccacgccgccccgcacggctgcggcctcggcacctgcccgcccaacatgtgcaagggccaggtgctcgaccgcatccgcgcctccgccgccgcggcggacggcgccaggaagcgcttcatctacctcggcgacggccgcggcgactactgcccgtcgctccggctcgccagggaggacttcatgatgccgcgcaaggggttccccgtgtgggacctcatctgcgagaaccccggcctgctccaggccgaggtgcacccgtggagcgacggcaaggacatggaggagacgctgctgcggctcgtcagccgggtgctcgtcgaggagagcacgctgctgccgctcgactgcaagctcgagtcgctgccggtgaccgtccaggacggcatgcccatgccgctcggcgtcaagaactgatccgcccaaccctgctgcattacgattaatttggggatcgataccttgtcttctgatttgcttgcctgatatgctggcgtgtagtgcgtacgagtttgggtagggcgtcggtggaaactaattaagggtgaggacttcgagcgccaatggcgaactcgatagtagtattgactaatttgtgcgtgtcgtccttgtgccgcctggcaatggtgaaggctcgctgtatcccatctatctattgatttgatgaaagaatacatgagttgatgcgacgaaagtcaaaataagaaaaaaaaagttttcatctaaaaaaaaaaaaaaaaaaaaaaaaaaaaaaaaaaaaaaaaaaaaaaaaaaaaaanncnagggggggcccggaancnatttcncccnaaanggagacgnattncccggggggggncgggggncnatttnccccnnaggggggg

SEQ ID NO: 30782 - DNA, 717 bp, Triticum aestivum
  unsure (1)..(717): unsure at all n locations
  Clone ID: PAT_TA_30782
caatnagatngagnacatcttcctngcaaaatcaaagatantgtccaggacaatctgcatatgatccgtgcgtggtgacatagcttgcatgtgttagtgaagttactcttgacangctattngggcatacagatttttgagttgaaantgaagttgttatgaggaatgcccatagatgctaccattgaagcaggcaaattttcctatgcagttgtcgtaattggtgagttccctatgcagaaagcttgggggatagaaccgacctcagtattccattcaatggttccgatcttattactcgtgttgccaataaagtccctaccctagtgattgttatatctggaaggcccttggttattgagccgcaagtacttgagaaggtagatgctctagttgccgcttggctgcccggaagtgagggcatgggagttgctgattgcctctttggagaccatgattttgtgggcacgttgcctgtaacttggtttaggtatgacgaccaactgcctataaatattggaggtgctaattatgatccattatttccttttggatatggactcaaatgttcaaaagccatggagatttagcatgatgtcatgaaatatttgccgatcatacatttgaattaccagaatattgttacatatgtatgttgtacagttaaatattgggttatgtacaagagaaataaagttatgttgccgagtacatggt

SEQ ID NO: 30783 - DNA, 1310 bp, Triticum aestivum
  unsure (1)..(1310): unsure at all n locations
  Clone ID: PAT_TA_30783
nnnnggcgctcagcggcgggcggatttctcggacgaggagtacctctagctagtccggtcgcatcaaagccgaagaagcaatggccgccttcgccaccaggtcggcggccttcctcggcctcgccgtcgtgctctgtttcctcgccggcgcggcgagcgcgcagcagctctctcccaagcttctactcgaggtcttgccccaacctggcgtccatcgtgcggtcggggatgaccgccgcattgcagacggagaggcggatgggcgcgtccatcctccgcctcttcttccacgactgcttcgtcaatgggtgtgacggctcgattctgcttgacgacacctcgacgttcaccggcgagaagaacgccgggccggaaacgccaactcggcccgcgtgggttcgaggtgatcgacgccatcaagacccgggtcgaggccgcgtgcagggccaccgtctcctgcgccgacatcctcgcgctcgccgcccgtgacggagtcaacctgctcggaggtcccacctggagcgtgccgctggggcgcaaggactcgcgcacggcgagtcagagcgcggccaacgcgaacctgccggggcccggctccagcctcgccacgctcatcaccatgttcggcaacaagaacctgtcgccgcgggacatgacggcgctctccggcgcgcacaccatcgggcggtcgcagtgccagttctttcgcaaccgcatctacaacgagcgcaacatcaacgccagcttcgcggcgctgcggcagcggacgtgcccgcggtccggcggcaaccgccgccgcccgccccgcgacgtgcagaccgccgaccggttcgacaacgcacaccacctactcccggtgccgcgtcgcgccgcccggcatccggccctcgggccctggagcgctgcgtcgccgggtcgcatggcgcgctggtgcggcagcacaccagcagccccagccgccgctcccccgacgtcgtcacggccatgctgaagatgggcggcctgctgccgtcgtccgggacgcagacggaggtcaggttgaactgcaggagacccaactaaaaagtacacacataacaagtgtgctaaataatgattgatgccttggaaaaccaggcattggtcaggttcacgtaggtatgtgtatgtatgatgaagaacacaaaatgtacaaacgctcgtttgctcaatccggggcgaacctgcaatctaaaaaataaaaaactgtaggtcgggcccttaaaatgttccatgatcatcatcaacaattgcagaccaatgggatggtgcaatcatcataattaaaaaaa

SEQ ID NO: 30784 - DNA, 1189 bp, Triticum aestivum
  unsure (1)..(1189): unsure at all n locations
  Clone ID: PAT_TA_30784
cgaggcgcgaaatttgtctgcgatttcgtggagcggttccgcgccttctcgccggtcgccgctctccaggatgcgcaacctcctctcgaattcgtttgagctcaacaaggaggaacggcccccggggaatgtcgatattgagctaggtttgcaaggcgacctgtcgggttccgcacagccaggtttcgatggcttctatgaacaggtcagggagattgataagttgcttgagacgttgacaaaactactgaaaggaatcttcagaactcaaacgaggaatcgaacgttgtcactaaggcatcagctatgaaagatatcaaaaggcgcatggagaaggatgttaatgaagtgacaaaagttgcacggctcacaaaatcaaaacttcagcaattgaataaagagaatcttgcaaacagagaaaagccggactttcacaagggatcaggtgtggaccgatctcggacctcagtgacaattacattgactacgaggttgagagaacgcatatcagagtttcagacactaagagaagcaatccagacggagtacagggaagttgtagagcggcgtgttttcaccgtaacgggcgagcgtgctgatgaagagactattgacaagctgatagaaacaggcgacagtgagcaaatttttcaaagagctattcaggaacaagggcgtggaagggtgcttgacacactccaagagatccaggagcggcatgacacggtgaaagagatcgagactaagctccttgagctgcagcagattttcctcgacttgtcggtactggttgaggcgcaaggcgagatcctgaacaacatcgaagtgcaggttacaggtgcagtggagcatgttcagactggaacaaacctccttcagaaggcgagggtcctgcaaaaaaacacgcggaaatggacctgcatagcgatcatcatcctgctgatcatcgtactcgtcatcgtcctctcgttgaaaccgtgggcaaagaagtagggaaaaaggagcatcacgctatgctaggacaatatacgatattccatatcggatttgcactttggctcatgggagcttcctcccgctatcggagccggaccccgcagtctcgtatattttcctgcttagttttttcgtggggtgtgaacattgctggantntgtggttngattaacaaaattcngnttgattanaa

SEQ ID NO: 30785 - DNA, 552 bp, Triticum aestivum
  unsure (1)..(552): unsure at all n locations
  Clone ID: PAT_TA_30785
cgtttcctcctctgcccatggctctaccaaacctcgccgccgggcacccccgtcggcggcgcctgcccgccgccgggccgaccgggccacccgacgcatgcctgcgctggatcggacgtgtgacgtcgccgtcgtccaggcacggcacaccgccggacgtgtcgatgtaatcctgggccgtcgccggatcgaaagtcgcggtcggcgaagcgctccgcgggtgtcgacgtatggctgggccggtggatcgatctatccggtgtcgtcgatcctggccatgactgaagcacgacgtcggatccaactcgtggttgacaagtgatcgccgtgcatcatcggtttgctgtgaggaagccaaattttcgtaccagggatcgaagtggatcagccatggcaacgaatggtagcgcaaatcgccggtgaggccgcaacggcagcaaggagaaccatcccttcacgaggtgacttgctgcggaccacaacagagagataagncacagtagatatatgaatcaattctgagataggactgagttatcaaaganaggacag

SEQ ID NO: 30786 - DNA, 753 bp, Triticum aestivum
  Clone ID: PAT_TA_30786
ctccggaggccgcatgataaggcaggccctcgctgtgatcggcgtcggctctcattcctctaccttcgaagtacgagccggcgaaagtcttccaagcagaagcagctagcctagctccatggcttcgttcgggccgacggggttgccaaactcagagcacctgcggcacaccaacaaagggacgatgatcttcagctacacctgcgtcggcctcacgggcgccgcgctcttctccgtcatcttcttcttctgctaccagctccgcaaccgggcgccggtggcggctgcgggggcggagaccggccgccgccgcaccgtggaccttgccaagctgccggagttcgcgtacacccactccgccaggcacagcggtaaggagggcggcggggaaggcgcgcagtgctcggtgtgcctcggcacggtgcaggccggcgagatggtgcggctgctgcccttgtgcaagcacctgtaccacgtggagtgcatcgacatgtggctggcgtcccatgacacttgcccgctttgccgcgcggaggttgagccccagcccccggaggacgacggccagcccgaggtgacgaccgagctgccggtctagggcgtcggccggtcaccgaagctgtcttccgcaaggtgcatgctagtttagtttgtagcttgtcgcctgtgttagttctcatacagcatgtagttgtaacttgtaaatgcctccgtatacagagaaaaaaatattctgtgtacaacggctcctgc

SEQ ID NO: 30787 - DNA, 406 bp, Triticum aestivum
  unsure (1)..(406): unsure at all n locations
  Clone ID: PAT_TA_30787
gcgacagcgacgacgaggaggggctcggcgggctctcgcgccgcgtggccggcctcgactgcggcgccggcgaccgcgccattcccaaggcggaggtgatgtctgggtctccgcagtccacgctctgcgtgctgcaggcctccggggaggacagccccaccggcggcgcctcgcaggtcagctcgccgccgtcctcgccgctggagcagcagccggccgacccttgggacctgctgcacgaggcggccggccaggtggcccgcctcggcgtggacagcatccccgtgcctgtcaaccctcctcccatccatggcgccggcgtcgcgccgccggcgaggaagccctctccgccgctgcttccgtccccaaagcccgncggccattaccagttcccgccgaacaactc

SEQ ID NO: 30788 - DNA, 1901 bp, Triticum aestivum
  Clone ID: PAT_TA_30788
ggttccctaccctacaccccggcagcagccactgccctccgctgccgcgcccgcaccagccccaccaccgccgcctccaccgtcaccgccacctctgcaccccaacagcccgccgcaagacgcgggaggcgaggggcggttgctcgctctactgctgctccctccctcctagcgctgtgccgccgccgccgccgccgccctccccttctagcgcttcgcgtcgtgtcgtgtagcaggagagtgctgccctgcttttcccctccggggttcgctattttgtggcgagcgccgctattatttccccaattcctatctaccgccggagaggcgccgtttcgcttttgatcgatcctatcggtcggtcggtcggccggcgcggatggaggcgctcaagaagcaggccagcaagctgcgggagcacgtcgccaagcagcagcaggcggttcgcaagacgttcagcgcacgccataatcaagacacttcgcttgtcgatgaagctgaacttgagtgccaccagaatctccagaagctttataataccacaagagcagctaaacatttccaacgaaccattgtacgaggactggagggtcttgttgctgttagcaccaaacagatggagatagtgaaaaagctagctgaggattgttgcaaatatgggaaacaacaatcaaaatgttggttttgttcttggaaaggcttccgttgagtttggtaaatcccacaaccaaatggagatagagcgggagaaacttcttagagttcttggagagcaggtttttgagcctcttcgagaaatgataatgagtgctcctcttgaagatgctcgcttgttaacttaccgctatcaacggatcagacaagatatggagtctcagatagctgatgtggttagaaggcaactgaagtccaaggagagtagtggtaatacagattcggtgaaactgcaacatgcagagtcaaaactatcagagctccgaactacgctggcagcattaggaaaggaagcaacggcagctatggaggctgtagaggctcagcagcaacagattaccttcgatcgtcttcttgcaatggttgatgccgagagaacttaccatcagaacgttgctgatattctgaacaaacttcatgatgagatgctcaatgcaagaccccatgaagagtcagacaacaacgatgatgtgccatcatcagatccatcatcggagcctaaagtatcatcacctaaagtatcacccacacatgtgcactcaaatagcatatcagaagatccagcattaactgaaactagcgaacctacaaggaatggtcaggaagtgcattatgttggggaggtaatccatccgtttgatggtcaggctgatggtgagctcagtatctccgtgggcgatttcgttgtggtccgccaggtgtctccaaacgggtggtcggaaggggagtgcaaaggaaaggcaggctggttcccatctgcgtacgtagaggagagggacaaggccccggcaagcaaggtgatagagcctggacgtctgactgcgtgatccctctttcttctcttgtactaaatggctgctgtccatcgtcctgctttctcccctgtacatgatatgaggtacttgttcaggactgctcagcattttgtagaacttttttatacttacctttctgtgcagattcttgtgcttatgtaaaagacatagtagtagcattttgcctgttaggatctctctcctgtttctcttcttcttttattcgattcgacacgaatgtatagaagagctatttatttggccatgggatgctgtattcttccccctgctatgtggaaagcgttcctgccgaattcatgtttatcggtttcagaacagtgatagatattgtcaccactcttgtttttctct

SEQ ID NO: 30789 - DNA, 658 bp, Triticum aestivum
  Clone ID: PAT_TA_30789
gcgagcggccgctaggacaggtgccgccgtcgtcgccgcccagtgccacccttcgcccctccaatgatttcttccctcctcctccgctgctcatcagcgatttcggctgcaaattattaacctcgggacctctgcagagcaattcaagggagcctccgcccccgtttagccactttacagtgattgcctcgattgatctagcggttagatatgtgtgaaccttgccaaatctgtgtcgatatctctttgcgacagggagacattctctctgaaaattgtttgatcgattgttccgattactactaactcttccagtttctacagcaagtgccgagcgagcattctcaactttgaggatcattaagacaaggttacgaaaaaccgtgcaggacgagaatctagcgaatcgctcgctagtaaaaataggtggtggtaccacgcagaagtacctgcgccgcgaccccgctagacgcttggggccgccggggcggagagcgggatggccggcgacttcgtaatcattcgcaggggtacggtgccctcggttatgctttacgtcataacgacgatgaccaagagcagcgaatgtcaggacctgctccggggtccggctatccgggtctgcctgctgctcgatattctttctgggctcaaaaaa

SEQ ID NO: 30790 - DNA, 666 bp, Triticum aestivum
  Clone ID: PAT_TA_30790
ccacgcgtcgaccctttgggctttttctccacagacgcaaagctgaattgttagaccccttgaggaaggctcacatgtatatagacccccgggaaaaggtcactgctcggtatcagctcatctgtccatcgaagagagaggtgatgatattcggaagcctgaagcaggccggcactttcctgcccaaggctccaaaagggtggggttggcgcacggccatactgttcgatgaacttgctgatcttctccagggtggagccctgagaatcgccgcagtagtccagcttgtgtaaaccgaaaatcgccccctcgtgcatcaagaaacaaacgctggtactatatatagtagcgtggatctatgcaaaataggtgagacgatagtacgtaaataatgcctccaaggttggtggtgtaactatcaccgtaatgtaatgtattacctccgtcccaaaattcttgtcttacatttgtttagaacactaaaacatgattagatacatccgtatttaggcaaatcgaagacaagaattttggaacggagggagtatgtagtttttcctgcatgacttgtattccgtgaatgaggtacgtactgtgccttgaagcagtgtaataagagttctgtagcatagttccccgcaaaaaaaacccacgcgtccgcggacg

SEQ ID NO: 30791 - DNA, 2939 bp, Triticum aestivum
  Clone ID: PAT_TA_30791
gcaagcctccccatcgcaccgacacgactccaactaaaaccctagcccctccccccccctatggcggcgccgcagcagccgcacccgctgccgcccctcccggcggagggggcggcgcccctggccgcgccggccggcgcgccgcggccgtacgagctggcggtcgcggcggcggagctccgccccgtggactgcaacctcgcggccctctgcgaccacgtgctggccgaggaagtcggctccggccccttctccgatgtcgtcgtcgaggccatgggcgacacctaccgcctcctccgcctcatcgtctcccgcagcgcccacttcagtaataggttgcgtggcccatggagagaggctggagcaccgacagtggtccagcatagcgaagattctattgttgatccagttgcgattgggcttgcatgtgcatagacccccggggaaaaggttactgctcgggatcacctcatctgtccagcgaagacagatgcatcatttctggatctcctgaagcaggccggaatctgtacagacatgactatttctgggttttggagatcaaactttttactgtatcagtagtttgctgaaatccctcactatggtagccatggagagcgtgtcagtaatgcttcctggggttatctttgtcaacgtgctacactggaactacgagaggtgcgtccaaaactttcttcacaaactttgcatgctctccttacatctgacgaactgtgggtacctaatgaggagaaacggtttgaactagcattatttgcactactggcaaaggtcactgtttctgatgtagaagtttgcggaaaagaaaatttggaccttatggcaagctcatcaactgttgattgttccatgggaaagggaaagagtctgatgaatgaaactggtgagaagcagctaatggaatctgaactgcagaagttgaagttgcatgataacatgccgagtaaaactgccaataacattattgatgttccaaatgttgtaattccgcaggatagcacaccgcactccattccacaaaatgctgaagcttccaagaggatggagaatgatatttctacaggaggaccatctgcagaaagcacctcttatcaatttaacgaaaatatgtggctttctaatgagcaaacaaagaattacttctcaagaacttcttcaagtaatggattagttccatgtgagtggggaagacccactgcacctctttggggtggtagggttgttggtcgacggcaggttagatgcagcaggggaagttctttgtctgctgatgaatataatactttcatgaatatatttgaaagggattctcttctctattgcaatatgtcatttgatgcactgttaagtgttcgaaagcaacttgaagaatttgaatttccttgcaaagctgtaaacgatggtctttggctccagatgctcctgtgccacagagtgcaagcaatagttgctgatacttgcagaaactgttgccttacaagtaattcttgtgcttgtaaacaagcatatgttggtacacacagccactacaggcaggagcatgataggacaagtgcttcaggaactgcaggtagtatctaccttgcagatgcccaaggcgatgggaatggtatgtttagtcctgtgcgtgttaacgtaagaggagcagttgatggacttgctggcattgggagaggaaactcaaatgtgcctggcgctgcttgggctcctacgcgttatgtcttctctcgtgttccctatgggcttggttcaaggaatggtcagcaatcatttgcgaatgatgaatcagaacctagagttgaccacaatggagatattccaggagatggtctgactgcattggtcaatcttagccaagaaagcaatgcttctcatcatcaggcagaaagtatatttgaggcaggcatgcaaactagatattctggtgctgctactgtttctacaccaggtggttcttctctccagatgcaagagtcaaaagagcacgaacttgggtccagttgggaaagtgcagataatacagctatatccttggacatgagaacaccgcttagtcatttccctcctttccgctttggggttgaatttgaagatgtgcataggcttgcagatggtcaagtgaaacactcagctgaagtattttacgctggctcgctatggaaggtaagtgtccaggcattcaatgatgaggatcctcatgggcggcgcacccttgggctttttctccacagacgcaaagctgaattgttagaccccttgaggaaggctcacatgtatatagacccccgggaaaaggtcactgctcggtatcagctcatctgtccatcgaagagagaggtgatgatattcggaagcctgaagcaggccggcactctcctgcccaaggctccaaaagggtggggttggcgcacggccatactgttcgatgaacttgctgatcttctccagggtggagccctgagaatcgctgcagtagtccagcttgtgtaagccaaaaatcgccccatcgtgcatctggaaacaaacgatggtactatatatagtagcgtggatctatgcaaaataggagagacgatagtacgtaaataatgccttcaaggttggtagtgtaactatcaccgtaatgtaatgtattacctccgtcccaaaattcttgtcttacatttgtttagatacggaagtatctaacactaaaacgtgactagatacatccgtagaaaaatcgaagacaagaattttgtggacggagggagtatgtagtttttcctgcatgacttgtattccgcgaatgaggtacgttcggtgccttgaagcagtgtaataagagtcctgtagcgtcgtgccccgcaaaagaattgtactaattcaaagtggtcccccccaaagtaaaaaaaaaaaaaaaaaaaaaaaaaaaa

SEQ ID NO: 30792 - DNA, 596 bp, Triticum aestivum
  Clone ID: PAT_TA_30792
ccgacgtgttcctgcacgacgtggaccgcagggtggagaggatgtacgccgaggagttcctctgcgagaggttccgggtgggagcgaccggccggctctggcacttcaggatcccgccggtgtcacggcggaacggcacggcggccggcggcgacaagaggcctttctgctgacgatgcagatctccgaggggtgtttttagaagatggcctcatcggtgcaagtgtcaagctctgctgctgttctgctatcatgttctctttattgattgtactgtacatgtcgggcacagcacacagtatgctcatgtgctcagttgacaggtgtagtaattaggcgctttggttgctgcaaaaatatactgtatgaaataataagggacctcacgtgtccttttttttgggtgaaggggcctggtagaagtgggcccagaaacaggctgtggtgtaatcagtcatatttcgtactcccataatatagaacatgtgagtacattgattgtattatgaggcaggaataccttagagcaattatgataagataatacaagcaggttgtaagcatttgaattttaatattatatttttgctgagttg

SEQ ID NO: 30793 - DNA, 1202 bp, Triticum aestivum
  Clone ID: PAT_TA_30793
gtgattttcatttgtccagttaatttatttctggttgcaagaggtatgttacttagttccagcgcacattagatacgagttggaagaattgttataaaataatataaccatggcttgcatatgtccatctttgcgtaagtgtcaagcaagggaaaaagtagtgcctaaactcccaagtcaattgcttccttactgtaacaggatctgggacaaaattttggagaacgttctttttttgcacctgcttctcgcctcctatgtttgccatagatttgtgcattttttgtcaataacaatgatgctaagccctaagcaaatgtttctttcatttgtgttggttcttgttgcacgattatcattttctcctgcttctgaaacaggaggccaggggcgctcgccaagcctagcataagggcgtcgagtaaccggaagccagcgccgctctccaatgaaagcatgagggcgtcgattagccggccgccgacgccggacgaggacgtcgacgtcgggggaggggcaagggacggaggcttctcgcggagatatcatcagcctcaagggggtggagagcggcgcagaaggtgaggctgatcgggtgcttctccgggagaggctagtcgagtggtggctgatggggttacatgagggcgctgttgccgggttatgcatggaaaatggaaatcttattagctttcgttagatgattgtaatcaagttaatagtccagaaggatgtacctcggtgtccgatgtggtgtaggcgaacctgctgcacctcaggcaagcagctcttatcaacttgaagcgtagctggtgctcgggtcgcgcttcctggaaggggatgttattggccttgttctgtgactgcgccatcgccacgctgtctgtgtagcgctacattgcacggtcgcttcgatccgacttggtaatcttgtttagagatctcagaatcaatgcgtctggttgtccgactgtaccgtcacctcactgtatttgttgcgctacattgcgcgggcgcttacatgccgcgtcgctcatgtcatacctgattgagggatcctcatgagggaccaacaagaacagacgccacttttgtcattgtgttgtgaaggccttatctgattctagtattttctgtgtgctgcattattgattgttacatgtgtgtgctgctaaaaaaaaaaaaaagtcgacgcggcgcga

SEQ ID NO: 30794 - DNA, 576 bp, Triticum aestivum
  Clone ID: PAT_TA_30794
tttgagactctgaccttgaggagctgaggtgtttatggatttctagctagcagcacgtagggacgagcgtcgtcattggtcgtacgcactagccatgaacggcaagagcaagaagagcaagggcacgccattgctgggcaagtacgagctcgggcgactgctcggccgcggcacgttcgccaaggtgtacttcgcgcacccggtcactggcggtgagccagtggcagtgaaggtgatcgacaaggcggaggtgatgggcatggagggcatggcgcctcgcgtgctccgggaggtggtggccatgcgccggcttcgccacccgggcgtgctccgcctccacgaggtgctcgccacgcgctccaggatctatctcgtcatggagctagccccccgtggcgacctccagtccatgctcgccgctctaccaaaccgccgcttttcggagaaagccgcgcggcgcgtgttcgtccagctcacggcggcgcttgcccactgccacgcgcgcggtgtgacgcaccgcgacgtgaagccgcaaaacgtcctcctcgacagcgcccgcaaccttaggtgtccgac

SEQ ID NO: 30795 - DNA, 610 bp, Triticum aestivum
  unsure (1)..(610): unsure at all n locations
  Clone ID: PAT_TA_30795
ggccanggantgagcaaaaggagcatcgaagtagttcctgcgggtgtcttgatgatgtnantacaagatttcacttggcgacgcgcacctgcgaacaagccgctttcttgtagcaggaagatgtatctgggcatatttgaaccattcagcgtgcatgcctcactccatggttttagaaaggtttgctggggcttaaggggaccaacaggataaaaccttcagcagtgcttcgtctatgctgtccagatgcaaattgttgcgaaaaatgttgattgcaaggaacatatatggtcggttatagaagtcgttataaacatcttagcaatgtggaatgtaaggaacaagggccataccatgaacttagacggatttgctgtaaacaaggatgagcagtttgtcgtccagctatttttgtaattcattttgtactaactgcagagagttttgctgtgggaagcatttgggcttccttttttgcactgtctaggaggaatagcagggggttatgagtaggttgtacatgtacagttacaatggtcgcatgaaccgttgcgttctagatgttaaactgagatggttgcatgaatcgtggtgttctagatgttaactg

SEQ ID NO: 30796 - DNA, 850 bp, Triticum aestivum
  unsure (1)..(850): unsure at all n locations
  Clone ID: PAT_TA_30796
cgtccgggaggaggaaggtcttcgagctccggcccagcattatgtgggacaagggcaaggcgctggagttcctgcttgaatcgctaggattcgccagctgcagcgacgtcctgccggtgtacatcggcgacgaccgcaccgacgaggacgccttcaaggtgctgcggaagaggggccagggcgtggggatcctggtgtccaagtgcgccaaggagaccagcgcgtcctactcgctgcaggacccggcggaggtcatggagttcctgctccggctcgtggagtggaagcggaggtcgtcgacggcggcgccgcccatggtccggccgcgggtgtaaccccggccggcggcccaccagctagcctagcagcagcacagaagccggtcgggtcggtcgaccaccggtcaatccagctcgtcgcgatcggcgtcccgtcgtgccaacactaccccacccccaccccaccccaccccgcccaaattttctctgatggttctgtggtggcctccggagcggaccctgcggtggttacgtgcatgttcttcggtcgagcccccgtggaaaacgatcggaggcccacgcagctcgctcgctcgctgctcccgaactgcacccctgtgtgctgggagctgcggaagcatatgacacantgaccgaccgacctntctaactanaatgtacnangctgctggccaacaantacccnacnatcnactaccnataccctngtttttttttccaangggtggaaagganatncaaantactgccctccnaagcccggntgccggctttaanaaaaaaangtcttcntannacttttattcaccatttacnnctgggtcaacacc

SEQ ID NO: 30797 - DNA, 1351 bp, Triticum aestivum
  Clone ID: PAT_TA_30797
cggccggcacgatgccctcttgtactactaggtacaagaagaagctgagctacagcaatggcgcccagagcagctgcggccgtggccgtcgtggccttggtctgcgcagtgcagtcgtccctctcaggggcagccgtcccgggtctgtcccctggcttctacaagacgacctgcccagggctggagcaaatcgtgaacgcccaagtgacggcgaccttcaacaaagaccaaggtgtcgctcccgccctcctgcgcgtcctcttccacgactgctttacgcagggctgcgacgcgtcggtgctcatcaaaggccgcggcaccgagcagatccccggcggagccaacgggactctccgccgcgtggctctggacctcatcgatcgcatccaccgcgaggcccaagctgcctgcggtcgggtggtctcatgcgccgacgttaccgtgctcgctacccgcgacgcgctgttcaaggccggcggtccccgtttcaacgtcgacctgggccggcttgactcgttcgccccggcgccagatagggttaaggacctgccctcgcccttcgacggcgcggacaggcacatcgaggccttcaaggcccgcaaactcagcgccgatgacctggtttccctctccggcgcgcacaccttcggtgtggcccactgcggggtcatcccaccccggggcacccattccatggatccccagctcgccaagcagctacaggagaaatgcaccaaacccacggcaacaaccacgcaagacctcgacgtcctcacgccgcacgtcttcgacaacaagtactacgtgggcctgacccagaagaaggggatgttcctgtccgaccagtcgctcatcgaccacccgctcaccaagaacctcgccctcgccttctccaagaaccagacagccttcttcatcgagttcggcaagtcgatgaccaagatgaccgagatgggtgtgatcaccagcaagctgcagggcgaggtccgggccgactgcaccgtcgcagggaagcccccccgcatcgaggccgccaccgccgccgaccaggggttcacggccgacatgtaagacatgttccatgcaacgtagcgttcctcagctaaccgtgtccgtgcgtatacgcacgcgaacgcgcggtggcttatgttggtgtgtgcgtcttgtgcttgtgctgcctagctagtactactcctagttagttaataatgagcggtcggttcacttgcttcctagcatcataggattgatcgaggttcctagttttgggacacccttgtaagatcttcgtcatgtcttttcagatttccaacatccgtaatgtcatattttcattccaagatgtttcaca

SEQ ID NO: 30798 - DNA, 532 bp, Triticum aestivum
  Clone ID: PAT_TA_30798
cgtggctgaatatctcagttgctttccatggcgcgacgcctccactctgctataatcgccaccttcgttctgcttgcggttggacagtgtagcaatgcagtcccgacggaggctgaagtgtactggcgcaccgtcctgcccgattctccgctcccggaccccatcctcaagctcctccatcctgagaccagctctgtgaagaaaccaaaggatgatacggttgctgaagcgtactccctgacatggttaatgtgggggcttcgctcgcgctctgggccgaccaagcactcgtctcccaggccatcatcaaaggatgaaacggttgctgaagcgtactccctgacatggttaatgtgggggctccgctctctctccggaccgaagaagcactcgtctcccgggccatctcacgaccgtgaccacagcgccgacgagtatctggcccgagggctcttcttccatgaggaggcagtccaagtaggcaagaccatgaccttatacttccctttggcagccagtgcaccgctagggc

SEQ ID NO: 30799 - DNA, 679 bp, Triticum aestivum
  Clone ID: PAT_TA_30799
ttcgagcggccgcccgggcaggtgccaaacaaggtgatgcgattgaaactggtagcatcatcaggttgcaacacatgaggacacggagatggttacacagccacctgcatgcttcaccattatcttggtaacctagaggttagctgttttggtggggatggacaatcagataccggtgactattggaggcttgaaattgagggaaaggacaaggtatggaagcgagatcagaaggtaagattgcgtcatgttgatacgggaggctatctgcacagtcacaacaagaagtataacaggcttggtggtgggcagcaagaggtctgtggtgttcgagacaagcgagctgagaatatttggtcgacagcggagggcgtttatctcccagtcgatgaaagcaagtgaacatagcatcaggaattttactgacattttccatttttctatctgttcatgcttttaaattaaacaagggacatggtacccagaactagaatgattgttagtgcagtatatttctatttggaaacggcgattacaactacacacgcgtcatagtgtgactctgtcagcatcatcaccctgaactaaattgggcctcggaatgcttgaacccctgggacagtaaagactttgtgtgactatctacaactcaactttgttgtggggtaaatggaagagg

SEQ ID NO: 30800 - DNA, 560 bp, Triticum aestivum
  Clone ID: PAT_TA_30800
tttgtcaggaggcttattgtgtagagcatacagatgaagcatttctccggaaccatctattgctatctacggtggtggccatgcttactatatactcctcgattaatttaatgtttccaacatcttcttgggcggttcctctaaaatatatggtatcttcaaagaagatccctgtttgcacaagtagagataattacatattacattaagagtggcatcaaatcagtggcaaaacaattgctcgttccagccatagcaataaattaagatgcaaaactatattattacttgtgtcatcacaattccagtgcttcattacagcaccgggagttgatttttgtttttcttccgcttgttcttccccttcatcacttggttcaataacagacaagcttcgccttcaatgtaagatttggcatgtcaattagggagcacaagtatagtactaaacttaattttctgatgaaagtggcaaaatacgggccagctgttgtgaaatatccttatcttatctcaatgggatattacggtgcacatacagattggaagtcttgtctcca

SEQ ID NO: 30801 - DNA, 1282 bp, Triticum aestivum
  Clone ID: PAT_TA_30801
aaaccccagccgcgggacgggaacgggaacggaaacttctctgcccgcgcccgtacacggctcttgcctccatggcctccacggcggcggcggcggcggcggcggcgccggtggtgatggtgacgaacgacgacggcatcgacgcgccggggctccgcttcctcgtcgaccagctcgtcgcccaggggcgctaccgcgtcctcgtctgcgcgcccgacacagacaggtcgggcgttagccactgcattacatggcgttctgcacttcgctgtaaacgtgtcaatatcaatggtgctacagcatttggagtttcaggaactcccgctgactgtgcctctttaggcatctctgggaagctctttgatggtttggttcctgatttggtgcttagcggaatcaacattggcaataattgtggattacatgttgtatattctggaacagttgctggtgctagggaggcatttatatatgggattcctgcattagctatgtcatacaattgggttgctggtcagagcagtgttaatgacctcaaagtggctgcagaggtttgtatccctctgataaatgctgtcatggtcgagatcaagagtggaacctaccctaaaggatcattcctgaatatagatgtgccatctgatgctgcacaccacaagggatacaaaattacaaagcaaggaaaatatatggccagaattggatgggagcaaacagtctaccaaaagccttccgtagaaagttaccagacggcaagcatggttattgacggtgaaaaggacagagatatagacacttcatcagcgaatgacctactgtttaaaagagtgatagtaaagagaagttatgatgaagaggaaggggaggacatggactacaaatcccttgcagatggatatattactgttactcctttgggtgctctctcccgcgcagaagcagatgtcataccctactacaaggcttgcttgtctcgcatttgaagatgttcatcttcctcatccctctatgcaagcatgctatttgggaggctggccaaactgaacctacagatgtcatcgcctgtaaattgcgaataaatcgatctgtgacattcttgttgacttgacccctatgctgcatttgccatgttatgtattgctgtgattatcttggcagcctcgaacaactctagctattcgtaaccgtggttttcagtattagtgggagactgtttctttttttgaaatgacagttaccttgcattcaaaaaagaaaaaaaaaaaaaaaaaaaaagggcggc

SEQ ID NO: 30802 - DNA, 631 bp, Triticum aestivum
  Clone ID: PAT_TA_30802
cgtcttcctcccttccgcccctcacgagggtcgatcaccaccagctcgaggtccggctctccgtcccggggaccgatctccgcacacggtaggtgcccatggagacgaggaagggaatcctggagctgcgcgaccgtctggacaagacgctggcgtgctctgatctcgccgacgagggctctctgaaatctctggtcaagaagcagattttggagtcgtctctgcccggctctgaccaaggcaacatcgatttgattgctgaagcacgagccaaagaagtctcgaattttcttgaaatgctagacacttcaggaaatgaacgggcttcagatattcgtgggccgcaacagaaggagtggaaggtgaagcaggatacagaccaattacgggtcatgtaccgcgaaggtccagatgggaccccatttcatactcttcttgctgaaggctttgctgatggtcctatcgatgtttgtacatgtgtgtcatgggaatcaggtctatacacaaaatggtttccgcagtacaatctgccaacatttaaaattgctcagtcaggctgcttgaaaaagattcggattggcgaagaaatttctttgatcagatatccaatttggataatctcagtatgcag

SEQ ID NO: 30803 - DNA, 1337 bp, Triticum aestivum
  Clone ID: PAT_TA_30803
cgagggtcccctccggcctctgccgccgtcccctcccctaagccgcagcagcggcgggagggggagaaagaagggggggttgtaaagaccggcagggccggcggggtacaagcgccgacgaggacgtccgtccaacgggggcctgatcggtgcgtccggagcagggggggccggcccacctgcggcagcatgtgcccgccgggggcccttcccgtgaccgaggcttcagcgccgcggcgcggcgccggcactgcgtaccagccagactcgagggcaagaggccgcgggaattggccattattacatgtggtcaacaagagctatgaccccatattacagaactaattggagaggttatagtgcgtgtgtttactggtgcgccacgaaattaaaagttcctgaaccaactgctccagctgaatatgattggtaagacgacctgtatgcctgcttacaggaccaggaaccaaagcaatgctttgtcaattaaaaaggagtgtccccggcgttcatccggcagcccaagctctggccgaccaagccggccgccttcactgacaccctcgagaggtactccgccgaggtcagggcgctctgccatcgtctcctggagcacatcgccgagacgctgggcctggcgcccggcacgttcgcgggcatgttcggcgacgcggtgcaggcggtgcggatgaacttctacccgccgtgtccgcggccggacctggtgctggggctgagcgcgcactccgacgggagcgcggtcaccgtgctccagcaggacgccggccgcgcggggctgcaggtgctccgggacggcgcctgggctcccggcctccccgtcccccccgcccgcgtcgtcgtcctcggcgactcgctcgaggtgctcaccaacggcaggtacaagagcgtcgagcaccgggcggtgaccaacggcgagcaggaccgcctgtccatcgtgacgttctacgcgccagcctacgatgtcgagctcggcccgctgccggagctagtcgccgacggggagccctgcaggtaccggaggttcaagcacggtgagtacagccggcactacgtcaccagcaagctcgaagggcaagaagacgctggacttcgccaagatcagctagaccgccaagaactataatcctatattataggcatcatactgaaggtgatagtgcgtttgtgtacaggattgctaagtaattaagattcctgaagcatctgctgaacctgaatatgcttggcagaagaactgtattcctggtaccggaatgggtaaccaagcaacaattggccaattaaaagtactttttttctaaaaaaaaaaaaaaaaa

SEQ ID NO: 30804 - DNA, 969 bp, Triticum aestivum
  Clone ID: PAT_TA_30804
actcgggttaacactgaagttcaagtcatatccataggtatcacgcaagggagaaatggccggcgaagacgagctgaagctgctgggtacgtgggcgagcccctgggtttccagggtgaaactcgcgctccacctcaagggcttgagctacgagtacgtggagcaggacctcgacaacaagagcgacctgctcctcacgtcaaacccggtgcataagaaggtgccagtgctcatccacaacggcaagccaatctgtgagtcggtcgtcattctagagtacatcgatgaggcctacggcactacaggcccctccctcctgcccacagacccctacgaacgtgccattgctcggttctgggtagactacattgaccagaagctagtcatcccgtggaaagtggcgttcacggccgacggagaggaggagaagaccgaggggataaagcagatgttggcggtggtgcagacgctagagggggctctcaaggaatgctccaaggggaagcccttctttggtggtgatagtgttggatacgtggacattgcactaggcggtctcttggcatttttgcaaggaactgaagagctatgtggtaccaagccctttgacatcgcgaacaccccacttctgcttgcttgggtggagcgcttcactacgctggacgctgccaaggcggctcttccggacgccaataaattggttgtgtttgcaaggacaaggcgggcccggattgctgctactataaatgtatctgtcaagaactgagctaagttggcacccaattggttcggataacggataaaaaataatacttattacagttatgtttgctgaataatgtaagctgtattattatacttatgcccgttgaaaaatgtaaggtgtattatctcttgtgggtgtctctgacaaacatcttatctatgcaatattgaactgaataaggaagatggattttcctcgtgccg

SEQ ID NO: 30805 - DNA, 361 bp, Triticum aestivum
  Clone ID: PAT_TA_30805
ctatccgagaaggtctccaagatgcatgcctagtgcagcaacaacgacggaagtcggcaccacatttctcatttctgtcaggtacaccggatgctgatagcaaagcagtgcactgcaagttggagatggtttagcgagtgcatgttcctgtcaagcgtcgttgctgcacgcaggggctggccctgcatggattgatgtatttttacactcaagctcgcaatgtaacaccgagatttgttgttctctagcatctactactatacgtgattgcaacgaacggaccaagacatctgatgaacacttgtcatgtttccctgtcgaacatccttaatatatcaagaagcgttgctgctctgtatct

SEQ ID NO: 30806 - DNA, 750 bp, Triticum aestivum
  unsure (1)..(750): unsure at all n locations
  Clone ID: PAT_TA_30806
gcccagnatagcttcctctatccagtggtgttgaccgctttaaacggcagtttgcacacctggaggagcattacagcaaaggagaacgaggttctccgctgcaaagaaagctgcctctttaccaaggcagagggtaggtgcatcgaacgacggtaataatgagcagcatattagtgatcaggagatgagtgcagagcctgatgcccatggtgcagtgagccctcaaaagtcacaggatgcacccggtgttggccagaatggtctgagccccaccagcttgagctcgcggacctacctcaagagcgcgagcattagcgcttccaagtgcgtcgttgtcaacccgaataaacagccagagtatgacgacgcgatctctgaggaaacagaaggagccgtcgatggactatccgagaaggtctcaaagatgcatgcctagtgcagcaacgacgacggaagtcggcaccgcatttctcatttctgtcaggtacaccggatgctgatagctgatagcaaagcactgcaagttggagatggtttagcggagtgcatgttcctgtcaagcgtcgttgctgcacacaggagctggccctgcatggattgatgtatttttacactcaatgtaacactgggattagttcctacacctatcatctatgcatgattgtaacaacgaacagagcaagacatcttgacgctgtcatgtttcgctgtcgaaaattcttaatatatcaagaagcgttactgctgtgc

SEQ ID NO: 30807 - DNA, 2271 bp, Triticum aestivum
  Clone ID: PAT_TA_30807
cttcatctgccccgagaacacggactaccatccccgcggcctggaggattacttcgagccagtgagtggcggcgggagggggaggcgagaagagttggtcgaggaggaggaggaggagctgtgggctgtggctggaggaggcggctagcagctagccaatgcggcacgggtagagcgtggatccatggggggagggaacggcatcgtcgacggcttccgccgcttgttccaccgccgcacgccctccggctccgtgctcggcagctccaaccagtcctccgccggcgaggactcctccgacgtcgaggccgccgagggcctggatctcgtgggcctccgccccatccgcgtccccaagcgcaagatgccgctccccgtcgagagccacaagaagaacataatggagaaagaattcttcacagagtatggagaggcaagccagtaccgaaaccaagaagttgttggcaaggggagttatggagtagttgctgctgcaatagataagcgcagcggcgagcgggttgcgattggcacgatcaaccatgtgtttgagcaggacgcagccggcgttcgccagaatggtgtgatccacctcagtttgagcttacggacttcagtcaagagcgagagcatgagcgtttccaagtgcgctgttctcaacccgattaaagagctataagtatgacgccggcatctctaagcagacagaaggagccgtcgatggactatccgagaaggtctcaaagatgcatgcctagtgcagcaacgacgacggaagtcggcaccgcatttctcatttctgtcaaggtacttcagcgcgtgctgaggcccaagaatatactggccaacgcagactgcaaactgcaaatttgtggctccggtcctgccgcgtgtctcctctaatgaacgcgccttccagcgattgttgtaggtcggcactcgtatgcaacacgggggttaatggcccctcctatcatgtggctccttttttctcagcaaacacacccctgctattgatatttggagtattggatgcatatttgctgagcttctcactggacggccactctttcctgggaagaatgtcgtacaccagttagatataataacagatcttcttggaactccatcatcagaaaccttatctcggattcgaaatgagaaggccaggaggtacttaagttgcatgcgaaaaaaacaccctgtacccttgactcagaaatttcctaatgctgatccattggcggttcgcctactgggtcgtttacttgcatttgatcctaaagaccgtccttcagctgaagaggctttagcagacccatattttgcatctcttgccaatgtggagcgcgagccttcaaggcatccaatttcgaaacttgagtttgagtttgagagacgaaaggtgacaaaagatgatgttagggaattgatttatcgagagattttggagtaccatccacagatgctggaggaatacatgaaaggtggagaccagattagcttcctctatccaagtggtgttgaccgctttaaacggcagtttgcacacctggaggagcattacagcaaaggagaacgaggttccccgctgcaaagaaagcatgcctctttaccaaggcagagagtaggtgcgtcgaacgacggtaataatgaacagcatattagtgatcaggagatgagtgcagagcctgatgcccatggcgcagtgagccctcaaaagtcacaggatgcacccagtgttggcccgaatggtctgagcccaactagcttaagctcgcggacctacctcaagagcgcgagcattagtgcttccaagtgtgtcgttgtcaacccgaataaacagccagagtatgacgatgcaatctctgaggaaacggaaggggccgtcgatggactatccgagaaggtctccaagatgcacgcctagtgcagggacgccgatgaaagtcgagctcggcgccgcatttctgtcaggtacgccggatgctgatagcatagcagtgcactcctaaggaagcagagcgctgcaagttggagattggtttagccgagtgcatgttcctgccaagcatcgttgctgtacccaggagctggccctgtctgtctttgatgtatttttacattcaagctcacaacgtaacactgcgatttgctctctgtcatctatgccggattgtaacgaacagagcaatgcatctaaacactgtcctgtttgtgtcgaacattcttaatcttaatatatcaagaagcgttactgctccgcgtcta

SEQ ID NO: 30808 - DNA, 1337 bp, Triticum aestivum
  Clone ID: PAT_TA_30808
gcttttcacccacaagataaaccacccacgaggtgagctgtgagctgtgagcattgagagcaagcacactgatctatcggcctgatccgatggacgacgccaagccgcggaacctcggcggctcgctgcccgtgcccaacgtgcaggacctcgccgcccggcccgacgacctcacgctcacgcccaccctcctcgaccgctacgtgcggcctcagcccaacacggtcgacctgcgccccgacgcccctgccggcgaagaacaggagcacgtccccgtcgtcgacctcggccggctcctccgaacggcctcgccggcggacggggcgaggaggccgccaggctgcgctcggcctgcgaggactggggcttcttccagttggtgaaccacgggatacccgaggagaccctggaggagatgaagaggaacgtcatgggattcttcgcgctcccgctggccgagaaggccgccctcgcgcagcagcccggagagatcgaggggtacggccaggcgttcgtcgtctcggaggagcagacgctcgactgggcggacatgttcttcctcctcacgcagccgcccagctaccgcgacctccgcctctggccgtccaacccttccacattcaagaattgcttggagaactactccgaggaggtgcaaagggtggcaggcgagctgctgggagccatggcggagatcctgggcgtgagagaccactcggacatgacgaggctcgccgcgtcgcagtcagtcaggatgaactactacccgccttgcccggaggcgcatgtggacagcgtgttgggcctgtcgccgcactcggacgccgtcgggctgacgctgctgctgcaggtcagcaaggtccccgggctgcagatcaggaggaaaggcggctgggtcccggtcacgccgctccccggcgccctcgtcgtcaacgtcggcgacgtgattgaggtgttcaccaacgggcaagtacaggagcgtcgagcacagggcggtggttaacgcacgccatgagcggatgtccatcgcgacgttccacagtgggaggttcggcaccatgtacgggccgctggaggaggtcgtccggagaccgggagccccggtacaggagtgtcagcgtccaggaatatgtgaagctcgtggtccccagcaagctcgacggctagaacatcatgcacgccatgaagatcgattgatactttgatagcaatacatggtcgtccttctggtgtgactggtgtccactaaagtcggttaatgccttaccagcctccccacccgccgcccacacccgttaaacccggtgacagcgccgccccagtcaggttttgcgcgc

SEQ ID NO: 30809 - DNA, 901 bp, Triticum aestivum
  Clone ID: PAT_TA_30809
attcggcacgaggccgccttcctcttctctccaatgccaattctcgtggctgcacaccagatttcgcgaccacgccaatcccggctgctctgagcccgccgtcggagcaccgcgaatccttgcaacagccaccggcttgctgcgctcgcggcggcgctgcatatgaggacaccggcgctgcaatggacgggcgctattgtcggcggcatgacaagtcgagcatggcggcgctgcaatggagggggcgctgcatgtcgaggacggtggcgctgcaatggagcgggcgttcctgccggcggcgctgcatacgaggatggcggcgctgctgccggcggcgctgcaatggagcgggcgttcctatcgccggcgctgcaatgaagctggcgctgctgccgccggcgttgcatacgaggacggcggcgcgacaagttgatggcggcggcgctgcaatggagcggggttcctgccgccggcgctgcatacgaaggatggtggtgctgcaatgaacctggtgctgttgtcgccgacgttgcatacgaggacggcgacgcgacaagtcgatgacagcggcgctacaatggagcaagcagccgcgtcggttgtcctgcgaggagccgaggagggccacctccgcgctcacgcatccgagcattgcggcgacatgggacgaagcagcagtggcgttttagtgacctgcgcgttgaccaaatctgacggccaggttgggatgatcggagggctcacgagacggcttaagtttcacacttatcaaccgactgatttgtagcagtcgcctttaatatactatgaacatttacctcaaatacacgttgaacatttgtcaactgcatgatgaacattttttctattatacattgaaacttacatgcgaacacttctt

SEQ ID NO: 30810 - DNA, 567 bp, Triticum aestivum
  Clone ID: PAT_TA_30810
agcaaggagcatacggtccatcattgtattctgtttgaaagggttcatttcttcttagagacttgtttggcaaacactgtggttctacttctgtgttcatgctcctcggcggaggaacataatgtggtttgggatcatagggatttccacgcccgccatctgtaattttattctatgttcggcaacgcaaagctacctgtatctactcgtcgtacctgcccgggcggccgctcgacgtggtcgcggccgaggtacagattgtattccgggaggacttcggaactgatggacgtggaggatattttgatcaatatggtatcattcgggatatcattcagaaccatttgctgcaggtcttttgtttggtagccatggaaaagcctgtctctcttagtcctgagcacataagagatgagaaagtcaaggttctgcaatcagtgagctgtataaaccatgacgaggtagtccttgggcaatatgatggctacaaggatgatccgacagtgccaaatgaatccaacacgcctacttttgcgtccgttgtacctgcccgggcggccgctcgaa

SEQ ID NO: 30811 - DNA, 485 bp, Triticum aestivum
  Clone ID: PAT_TA_30811
tgcggcctcgcgggcctcgccgccggcatggccatcggcatcgtcggcgacgccggcgtcagggccaacgcgcagcagcacaagctgttcgtcggaatgatcctcatcctcatctttgccgaagcgcttgccctgtacggcctcatcgtcggcatcatcctctcctcgcgtgccggccaatcccgcgccgactagaagaaagtccttgcacgaaaggaggacacggtccatcattgtattctatttcaaaaagggattatttcttcctagagacttgtttggcattacactgtggttctacttatgtgctcatgctcctcggcggaggaacataatgtgggtgtgatcatagtgatttccacgcctccatctgtaattttattctgctcggcaacgcaaagctacctgtatctactcgtacctagcacctgttgtatttattgtttggagtaataatcggcgatgacccgcttgggacgtggtcg

SEQ ID NO: 30812 - DNA, 550 bp, Triticum aestivum
  Clone ID: PAT_TA_30812
gcggcctcgcgggcctcgccgccggcatggccatcggcatcgtcggcgacgccggcgtcagggccaacgcacagcagcccaagctgttcgtcggaatgatcctcatcctcatctttgctgaagcccttgccctgtacggcctcatcgtcggcatcatcctctcctcgcgtgccggccagtcccgcgccgactagaaacaaagcgcctgcaagcaaaaggagcatacggtccatcattgtaattctgtttgaaaggggtttatttcttcctagagacttgttcggcattacgctgtggttctacttctgtgctcatgctcctcgacagatcaatcaaggaacataatgtggtttgggatcgtagggatttccacgcccgccatctgtaattttattctatgttcggcaacgcaaaaaagctacctgtatttacccgtcgtcgtacctagcacctgttgtatttattgtttggagtaataatcggcgctgagcctcttgggacgtgatatgaatgaataagcagagctagacctagttccacttttgtgtgt

SEQ ID NO: 30813 - DNA, 1207 bp, Triticum aestivum
  Clone ID: PAT_TA_30813
gaggcctccctctccatcccctctctctcctcactcgccgtcgccgtcgtcgtcgccgtccaatctccggcgatatcccctcccccgccggcagccatggcctccaccttcagcggcgacgagaccgcccccttcttcggcttcctcggcgccgccgcggccctcgtcttctcctgcatgggggcggcgtacgggacggcgaagagcggggtgggggtggcgtcgatgggggtgatgcggccggagctggtgatgaagtccatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgttagggccaacgcgcagcagcccaagctgttcgtcggaatgatcctcatccttatctttgccgaagcccttgccctgtacgggcttatcgtcggcatcatcctctcctcgcgtgccggccaatcccgtgccgactagaaacaaagcacttgcaagcaaggagcatacgtggtccatcattgtattctgtttgaaagggtttatttcttcttagagacttgtttggcattacgctgtggttctacttctgtgttcatgctcctcgacagatcaaggaacataatgtggtttgggatcatagggatttccacgcccgccatctgtaattttattctatccggcaacgcaaagctacctgtatctactcgtcgtacctagcacctgttgtatttattgtttggagtaataatcggcgatgagcctcttgggacgtgatgaacgaataagcaaagctagacctagttccactttaaaaaaaaaaaaaaagggcggcgctcgcgatctagaactagcgctgacaagcaagcagcgtgcaagtgcatcaagagcgctgctgctgggctcaacgctggcaaggccgccggcatccccacaaagtgcggcgttagcgtcccctacgccatcagctcttcggtcgactgctctaagattcgctgatcgagcacttgctgccatcgttgttgctatcgtacgtcccctacgccatcgttgctggatctacgcttagtacgttgaggtcacacacacgcac

SEQ ID NO: 30814 - DNA, 903 bp, Triticum aestivum
  Clone ID: PAT_TA_30814
atctctctctcctctccccctcccctctctctcctccactcgtcgccgccgtccaatctccggcgagatcccctcccccgccggcagccatggcttccaccttcagcggcgacgagaccgcccccttcttcggcttcctcggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcgcagcagcccaagctgttcgtcggaatgatcctcatccttatctttgccgaagcccttgccctgtacggcctcatcgtcggcatcatcctctcctcgcgtgccggccaatcccgcgccgactagaaacaaatcgcttgcaagcaaggagcatacggtccatcattgtattctgtttgaaagggtttatttcttcttagagacttgtttggcattacactgtggttctacttctgtgttcatgatcaaggaacataatgtggttgggatcatagggatttccacgccctccatctgtaattttattctatgttcggcaacacaaagctacctgtatctactcgtcgtacctagcacctgttgtatttattgtttggagtaataatcggcgatgagcctcttgggacgtgatgagtgaataagcaaagttagacctagttcc

SEQ ID NO: 30815 - DNA, 687 bp, Triticum aestivum
  unsure (1)..(687): unsure at all n locations
  Clone ID: PAT_TA_30815
tcacttagcaaatctagccaccttatcatctccagttgagctcagcatcactactagtgcaaactcgatcgggatggctcgcgctgcagctactcagctcgtgctggtcgccatggtggccgcgatgctcctcgtagccacggacgcggccatctcctgcggtcaggtgacctccgccttgagcccctgcatctcctatgcccgcggcaatggcgccaacccgactgcggcctgctgcagcggtgtcaggagtctggccggcgcagcccggagcaccgctgacaagcaagcggcctgcaagtgcatcaagagtgctgccggcgggctcaacgcttgcaaggccgccggcatcccctccaagtgcggcgtgagcgtcccctatgccatcagcgcaaaagtcgactgctctaagattcgctgatcaaccactgcccacaatggctgccgcctatagcgccatccatggccgctgagtatgctgaggtcacgaatacttatgaataaatgctctgatctgatctccatgtgagggagaaaggagtgcgtangccgagctactctgcatggccggcactattgtctactacaatggtgctttacttcactgncttcangagaacgagacttantgtctntacatgtctctcctgtatttgatactaatacatcttccanggatttatcaca

SEQ ID NO: 30816 - DNA, 732 bp, Triticum aestivum
  Clone ID: PAT_TA_30816
gcacgaggcctaaccacataaaatttcggccgatccaccacaccctgcaatggcgtccgcgctcaccaacgtgagcctgtctaccttcgcgcccacggccaggggcgacgtcctggcgaggccgcaggtggcccccgcccgcgtcaccttcccgacggcgtaccgcggcgtgggacgaggtggaggagctcagcgccgcggccagccacgcccgggacaagctcaaggactcggacccgctcgagaactactgcaaggagaaccccgagaccgacgagtgccgcacctacgacagctgagcgtacgtgctaatttgttctggacggcggatagtgaagctggacgtggtgttcttggctcatgggagcccgagaaacctgctatgtctcaacctaccgttacttacacgatcgggatgtatgtagtaaaaacgcgccaaatattttcccagggacatacgtggttgatatacaattgatattacagacgtttatttaaaaaaaaaaaaaaaaaactcgagccgaggtccgagtaccaagcgctgcagcgctgaagtatgagccccgtggactagcgattgcttctccacgaggctcataccaggcgctacggcgctgaagtatgtaactgatgccatactcccaggaaaagctcgaacgaccttcaacaaaagggtacctgtacccgaaaccgacacaggtgggtaggtagagaataccctcgtgccgaatc

SEQ ID NO: 30817 - DNA, 514 bp, Triticum aestivum
  Clone ID: PAT_TA_30817
gaggaattcggcacgaggccacccgcctgcggcctgctgcagcggcgtcaggagtctggccggtgcagcccagagcaccgctgacaagcaagcagcgtgcaagtgcatcaagagcgctgctggtgggctcaacgctggcaaggccgccggcatcccttcaaagtgcggcgtcagcgtcccctacgccatcagctcatctgtggactgttctaagattcgttgatcgaccacttcttctcatcgtcgctgcatatagctccagcgatctacgctgagtacgttgaggtcatacacatacatatacatatatatgaataagtgctctcatattatctcactgcgtgacagcgagaggagtacctacgtccggccggccagctctgaatggcaggccacactgttatattgatgtttggttgttccttcacccttttgaaaggactcatgggtttgttcttctttgtaccgtgtgcacttttgatatatggtcttacactagtagaaaaaaaaaaaa

SEQ ID NO: 30818 - DNA, 667 bp, Triticum aestivum
  Clone ID: PAT_TA_30818
tccctgtacatcacttagcaaatctagcccatctcaccatctccagctgagctcaacaccactactactgcaaactcaatagggatggctcgcggtgcagctactcagctcgtgctggtcgccatggtggccgctatgctcctcgtagcctgcgatgcggcgatatcctgcggtcaggtgacctctgccttgagcccctgcatctcctatgcacgcggcaatgtcgccaacccgcctgcggcctgctgcagcggcgtcaggagtctggccggtgcagcccggagcaccgccgacaagcaagcagcgtgcaagtgcatcaagagcgctgctggtgggctcaacgctggcaaggccgccggcatcccttcaaagtgcggcgtcagcgtcccctacgccatcagctcatctgtggactgttctaagattcgttgatcgaccacttcttctcatcatcgctgcatatagctccagcgatctacgctgagtacgattgaggtcatacacatacatatacatatatatgaataagtgctctcatattatctcactgcgtgacagcgagaggagtacctacgtccggccagctctgcatggcaggccacactgttgtattgatgtttggttgttccttcacccttttgagaggactcatgagtttgttcttctt

SEQ ID NO: 30819 - DNA, 1059 bp, Triticum aestivum
  Clone ID: PAT_TA_30819
gctcccgcgacgacgatagccatttcacctctctctctctctcccccacatctcttctctctgtggactagctctcgaggccggacgagcgctgcacggcctgcggcgccgtgcgggaggcaggatgccggcgtggtggaagggcaagggcaggagcaagagcaaggcgccggcgccggcgggggacgccggcacaattccggccgtgagggacggggagaaggacaggaagaacaagaaggcgaccagcttcgacgaggcgcttattggcagggaaggccgtgggaagcagctgcagcagccggcgccggccgtcgggcacccgctgccgcgggccggcgttcatgccgtcggcctccgcccccgcgtccgcgtcggcgtccgcttcaagcgggggcagctcgtcgctcgggtcctccgcggcgtccgacgagccgctggatctcggaatttacaggatatcagatgcaaatagaacaccggccattgattctcggaaacaaagtcttgtcctagaagaagggcgctttgtcgtacataatctggcttcggagaataacagatcgtgtgaaccctcagtttctccaaggaaagaatttcaatccaacattttggatcttccaagtgatcgaacgacgtactgtcatggccgaaaatcgacagaaattgtgtttgctacacggatgcccagctctcctcctagttcaagaggcaaaaactgtccaacctcacctgtgcattcaagagcattcgggcaatgcccaggatcccctactgcgtggcaagaggatgcacggagctcaagctcaccacacccacttcctcttccgccaggctcgccgtgcacatcttcccggtccctccattcacaatggaagaaggggaagttgttaggcagtggtacatttgggcaagtatacctcggattcaacagtgaaggtggccaaatgtgtgcaattaaagaggttaaggttattgctgatgattcaaattcaaaagagtgtctgaggcagctaaatcaggaaatgctgctcctgaatcagctttcgcatccaaaca

SEQ ID NO: 30820 - DNA, 953 bp, Triticum aestivum
  unsure (1)..(953): unsure at all n locations
  Clone ID: PAT_TA_30820
ctttcttctgaacgaaagctttttgaaactctgcttgcagcgcgatcctgctgcgcgcccaactgctgctcaattgatagaacatccttgggtgaaagaccaagcttcagttaggtcctctaggtctggctctggcattactagggatatgttctcaacttccactgatggcagcaaagccacggtaaagacaagcatcgagttgtcatcctacagaagcttatcacctctacgagatactaatctcaggctgagaaacttagtggtgccagcatcttctattccttcgatatcaactcgcaaggcctctgccatcagcgcatccaatgtgcgtatgaacatgtccctgcccgtctcgccatgcactagcccgttacggcagtacaggcagtcgaaccggagttgtttgccatcacctccacatccagcatattcggctggagcagccaactacagccctatcaacaatatgctgtaccctacacggccaagcaactatctcacagacccgtggcttgaaacccctcgccagaaaacgcaaacatttgattctccaagaagattgtagaaattccaatcgtatatgttttgtatactggaagaaagtatactccataagttaaggtgttagaacttaggaggacaaaggtgtcttttttgctttctgttttgccctgtatgtatctcccctcaggatacagttgcctcgtcctttgtacaaattcaggaaatgagatgtagtgaaaaacaatagcatttttgttaaaaaaaagagagaatggcatttcaggctgtacctgtnaaaaaaaaaaaaaaaaaaaaaaaaaaaaaaaaaaaaaaaataaaaaaaaaaaaataaaaatacaaactaataaaaaacatataacggggggggcgcaatataggatccaatgttccgtctgctgcgcaaacaacgtcacttgctttttttt

SEQ ID NO: 30821 - DNA, 1061 bp, Triticum aestivum
  Clone ID: PAT_TA_30821
ctctcctctccccctcccctctctctcctccactcgtcgccgccgtccaatctccggcgagattccctcccccgccggcagccatggcttccaccttcagcggcgacgagaccgcccccttcttcggcttcctcggcgccgccgcggccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatctacggtctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcacagcagcccaagctgttcgtcggcatgatcctcatcctcatctttgccgaagctcttgccctgtacggcctcatcgtcggcatcatcctctcctcgcgtgccggccaatcccgcgccgactagaaacaaagcgcttgcaagcaaggagcatacggtccatcattgtattctgtttgaaagggttcatttcttcttagagacttgtttggcaaacactgtggttctacttctgtgttcatgctcctcggcggaggaacataatgtggtttgggatcatagggatttccacgcccgccatctgtaattttattctatgttcggcaacggcaaagctacctgtatctactcgtcgtacctagcacctgttgtatttattgtttggagtaataatcggcgatgagcctcttgggatgtgatatgaatgaataagcaaagctagacctagttccacttttgtctgtaactcctgtgtctagattcattttgttatgtctggggcatgtggagtgaatgttgtgtttgttatgtttagtgcgtattttgtgatgcgaactactagctgtatcaagcagactggtgtttgatagtttgcatatgagaata

SEQ ID NO: 30822 - DNA, 964 bp, Triticum aestivum
  unsure (1)..(964): unsure at all n locations
  Clone ID: PAT_TA_30822
gccggccgggtcgggccgtcccccataatatctctctctcctctccccctcccctctctctcctccactcgtcgccgccgtccaatctccggcgagatcccctccccgccggcagccatggcttccaccttcagcggcgacgagaccgcccccttcttcggcttcctaggcgccgccgccgccctcgtcttctcctgcatgggcgcggcgtacgggacggccaagagcggggtgggggtggcgtcgatgggggtgatgcggccggagctggtgatgaagtccatcgtgcccgtcgtcatggccggggtgctcgggatatacggcctcatcatcgccgtcatcatctccaccgggatcaaccccaaggccaaaccctacttcctcttcgacggctacgcgcacctctcctccggcctcgcctgcggcctcgcggggctcgccgccggcatggccatcggcatcgtcggcgacgccggcgtcagggccaacgcacagcagcccaagctgttcgtcggcatgatcctcatcctcatctttgccgaagctcttgccctgtacggcctcatcgtcggcatcatcctctcctcgcgtgccggccaatcccgcgccgactagaaacaaagcgcttgcaagcaaggagcatacggtccatcattgtattctgtttgaaagggttcatttcttcttagagacttgtttggcaaacactgtggttctacttctgtgttcatgctcctcggcggaggaacataatgtggtttgggatcatagggatttccacgcccgccatctgtaattttattctatgttcggcaacgcaaagctacctgtatctactccgtcgtacctaacacctgttgtatttattgtttgggagtaataatcggcgatgagcctcctggggatgtgatatgaaatgaataagcaaagctagacctagttccacttttgtctgtanaaaaaa

SEQ ID NO: 30823 - DNA, 706 bp, Triticum aestivum
  Clone ID: PAT_TA_30823
accattacaatcacttagcaaatctagctatctcatcatctctgcctgagctcactaccactactattgctagcttgatcgagatggcccgttctgctgttgctcaggtcgtgctcgtcgccgtggtggccgctatgctcctcgcagtcacggaggcggctgtatcgtgcggtcaggtgagctctgccttgagcccctgcatctcctatgcacgcggcaacggcgccagcccgtctgcggcctgctgcagcggcgttaggagtctagccagctcagcccggagcaccgctgacaagcaagcggcgtgcaagtgtatcaagagcgctgctgctgggctcaacgctggcaaggccgccggcatccccacaaagtgcggcgttagcgtcccctacgccatcagctcttcggtcgactgctctaagattcgctgatcgagcacttgctgccatcgttgttgctatcgtacgtcccctacgccatcgttgctggatctacgcttagtacgttgaggtcacacacacgcacacacatatatatatgaataaatgctctcatattatctcactgcgtgagagagagaggagtacgtccgtccaagcagctctgtatggccggccacactgttgtatcgatgtttggttgttcctcaatccccgagtttgctgtactttgtacaagtgtactttgatatatggattgtatacaa

SEQ ID NO: 30824 - DNA, 1071 bp, Triticum aestivum
  Clone ID: PAT_TA_30824
ggaccagcgtatatctctcctccctctcccatcccctctctctcctccacccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaagagcggggtgggggtggcgtcgatgggggtgatgcggccggagctggtgatgaagtccatcgtgcccgtggtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcggggctcgccgccggcatggccatcggcatcgtcggcgacgccggcgtcagggccaacgcgcagcagcccaagctgttcgtcggaatgatcctcatccttatctttgccgaagcccttgccctgtacggcctcatcgtcggcatcatcctctcctcgcgtgccggccaatcccgtgccgactagaaacaaagcacttgcaagcaaggagcatacgtggtccatcattgtattctgtttgaaagggtttatttcttcttagagacttgtttggcattacgctgtggttctacttctgtgttcatgctcctgaacagatcaaggaacataatgtggtttgggatcatagggatttccacgcctgccatctgtaattttattctatccggcaacgcaaagctacctgtatctactcgtcgtacctagcacctgttgtatttattgtttggagtaataatcggcgatgagcctcttgggacgtgatgaaacgaaataagcaaagctagacctagttccacttttgtggtgcaactcctgtgtctagattcattttgttatgtttggggcatgtggagtgaatgctgtgcttgttatgtttggtatatatagctgtatcaatcaaaaaaaaaaaacctgcccgggcggccgctcga

SEQ ID NO: 30825 - DNA, 1861 bp, Triticum aestivum
  Clone ID: PAT_TA_30825
cgtccgggaaagcaaaatattcccatcccaccggcaccacctcctcctccccaagtcaagccccatcgtctcttcagtgttcactggttatcttggaaggacggagaaaccatacagactagactaccatgtcaggaggatcggatgtatcttcaccatcatcgggacgaattagcacgagttctttgtcagacttgaaggacttggagctttcttcagagtctggctgcttgtccattgttgtactaggtgcttctggggaccttgctaaaaagaaaacttttccagcactcttcaacctttttcaacagggatttatacaatctggagaagtccatatatttgggtatgcaagatcagatatatctgatgaagggttaagagaacgcattcgtggatatctcaaaggagcttcagatgaacatctttcacaatttttgcaattaattaagtatgttagtggttcatatgataatggggcaggatttgaattgctaaacaagacaatctctgagaatgaaacatcagagaacaaccaaccaggaaactcccgaagactattttatttggcattacctccttcagtgtacccctcagtatgcaaaatgataagatcatattgcatgactccatcctctcatactggttggacaagggttattgttgaaaagcccttcggaaaggatttagactctgctgaggaattgagtgcccaacttggagagcttttcgatgaagaacaactatatagaattgaccactatttaggaaaggagttggtccaaaacttgctcgtgcttcgctttgcaaaccgcttttttctgcccctctggaatcgtgataacatagataacgtacagattgtattccgggaggacttcggaactgatggacgtggaggatattttgatcaatatggtatcattcgggatatcattcagaaccatttgctgcaggtcttttgtttggtagccatggaaaagcctgtctctcttagtcctgagcacataagagatgagaaagtcaaggttctgcaatcagtgagctgtataaaccatgacgaggtagtccttgggcaatatgatggctacaaggatgatccgacagtgccaaatgaatccaacacgcctacttttgcgtccgttgtactgagggtacacaatgagagatgggatggagttcctttcgtccttaaggctggtaaagcactaagctctaagaaagcagagatacgtgtgcagttcaaggatgctccgggcgatatttttagatgcaagaaacaaggaagaaatgaatttgtcatacgcctgcagccatcggaagccatgtatatgaaattaactgtaaagaaaccagggctcgaaatggcaacagaacagagcgaactggatttatcctatgggctacggtaccaagatgtaaaaatcccagaagcgtacgagcgtcttatcttggacacgataagaggtgaccagcagcactttgttcgccgagatgagctcaaggctgcctgggagatcttcactcctttgttgcacgacatcgatgctggcaggctcaaggctctgccataccaaccgggaacccggggtcctctggaggccgatgagttgagcaagaggatggggtacgtgccgactcttggctatgtttgggcaccgccaactcttgcaaagttttagccgctaccaagtgccggttaagaacaggagcgttgtgggtttacagagaattacgtacttcagagggaaattacttgctctgtatgttatatatggagagcatttgtaataagcagtctctgcttttcaaaacagtgtaccattttacgattataaataaatgatactaccatcttgtt

SEQ ID NO: 30826 - DNA, 2253 bp, Triticum aestivum
  Clone ID: PAT_TA_30826
gcttagagaataacagatcgtgtgaaccctcagtttctccaaggaaagaatttcaacccaacattttggatcttccaagtgatcgaacgacgtactgtcatggccgaaaatcgacagaaattgtgtttcctacacggatgccgagctctccccctagttcaagaggcaaacattgtccaacctcacctgtgcattcaagagcatttgggcaatgcccaggatcccctactgcgtggcaagatgatgcacggaactcaagttcaccacacccacttcctcttcctccaggctccccgtgcacatcttcccgttccctccattcacaatggaaaaaggggaagttgttaggcagtggtacatttgggcaagtatacctcggattcaacagtgaaggtggccaaatgtgtgcaattaaagaggttaaggttattgctgatgattcaaactcaaaagagtgtctgaggcagctaaatcaggaaatgctgctcctgaatcagctttcgcatccaaacattgtgcagtactatggcagcgaactgtctagtgaaacactctcagtctatcttgagtttgtttctgggggctctatacataagttgcttcaagaatatggtccatttggtgagaccgtcctccggaactacactgcacagatcctttctggccttgcatacttgcatggacggaatacagtgcacagggatatcaaaggagcaaatatacttgtagatcctaatggtgacatcaaacttgcagatttcggtatggccaagcatatatcagcatacacatccatcaaatctttcaaaggaagcccctactggatggctccagaggttatcatgaataccaatggatatagcctttcagtggacatttggagccttggctgcaccattcttgagatggcaactgcaaggcctccatggagtcagtacgaaggggtggctgcaatattcaaaattggaaacagcaaagacatacctgatatcccagatcatctttcttctgaagcgaaaagctttttgaaactctgcttgcagcgcgatcctgctgcgcgcccaactgctgcgcaattaatagaacatccttgggtgaaggaccaagcttcagtcaggtcctctaggtctggctctggcattactagggatatgttctcaacttccactgatggcagcaaagccacggtaaagacaagcatcgagctgtcatcctacagaagcttatcacctctacgagatactaatctcaggatgagaaacttagtggtgccagcatcttctattccttcaatatcaactcgcagagcctctgccatcagcgcatccaatgtgcgtatgaacatgtccctgcccgtctcgccatgcactagcccgttgcggcagtacaggcagtcgaaccggagttgtttgccatcacctccgcatccagcatattcggctggagcagccaactacagccctatcaacaatgtgctgtaccctatgcggccaagcaactatctcacagacccgtggctcgaaacccctcgccagaaaacgcaaacatttgattctccaagaagattgtagaaattccaatcatacatgttttgtatactggaagaatatatactccataagttaaggtgttactgtagaacttaggaggacaaaggtgtcttttttgctttctgtttagccctttctgtatgtatctcccctcaggatacagttgcctcgtcctttgtacaaattcagaaattgagatgtagtgaaaaacaatagcatttttgttcagaaaaagagagaatggcatttcaggctgtacctgtatctgttgtgtccctcgtatgatcagttttgaatgaatacatgtttcttctatcttcagaagccgggtgatttacagataaggtgttgcgaatttggagaaaatcagggcagctttatctgatgcactttgaaaacatcccctctgtatgtcaccgtcttctcttcgacaccaaggccccacagatgcccttgcagcttcagtactcccttggcaccctcacctttcttgacgacgatatcgttgttagtcccagtgtcagtatttgccgcttcccagacaaagctgaagacatggagagcgcggctcagctgcttgatgccgctccggaccgtgagttcatcgccgtcgacgaggaatttcacggcgtgtatggtgacattcttgccttccttgccggacaggcatttgccgatatgcacctcgatgtccccctcgtgc

SEQ ID NO: 30827 - DNA, 681 bp, Triticum aestivum
  Clone ID: PAT_TA_30827
ccaaggccaagccctacttcctcttcgacggctacgcgcacctctcctccggcctcgcctgcggcctcgccggcctcgccgccggcatggccatcggcatcgtcggcgacgccggcgtcagggccaacgcacagcagcccaagctgtttgtcggcatgatcctcatcctcatctttgccgaagcccttgccctgtacggcctcatcgtcggcatcatcctctcctcgcgtgccggccaatcccgtgccgactagaaacaaagcgcttgcgagccaaggagcatacggtccatcattgtaattctgtttgaaagggtttatttcttcctagagacttgtttggcattacactgtggttctacttctgtgttcatgctccttgggtggaggaacataatgtggtttgggatcatagggatttccacgcccgccatctgtaattttattctatgttcggcaacgcaaagctacctgtatctactccgtccgtacctagcacctgttgtatttattgtttgggagtaataatcggcgctgagcctcttgggacgtgatatgaatgaataagcaaagctagacctagttccacttttgtgtgcaactcctgtgtctagattcgttttgttatgtttgggacatgtggagtgaatgttgtgtttaaaacctcggccgcgaccacgct

SEQ ID NO: 30828 - DNA, 949 bp, Triticum aestivum
  Clone ID: PAT_TA_30828
ctcccatcccctctctccccaccactcgtcgccgccgtcgccgccgtccaatctccggcgagatcccctcccccgccggcagccatggcctccaccttcagcggcgacgagaccgcccccttcttcggcttcctcggcgccgccgccgccctcgtcttctcctgcatgggggcggcgtacgggacggccaagagcggggtgggggtggcgtcgatgggggtgatgcggccggagctggtgatgaagtccatcgtgcccgtcgtcatggccggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcgcagcagcccaagctgttcgtcggcatgatcctcatcctcatctttgccgaagcccttgccctgtacggcctcatcgtcggcatcatcctctcctcgcgcgccggccaatcccgcgccgactagaaacaaaagcgcttgcaagcaaggggcatacggtccatcattgtaattctgtttgaaaggggtttatttcttcctagagacctgtttggcattacgctgtggttctacttgtgtgttcatgctcctcgacagatcaatcaaggaacataatgtggtttgggatcatggggatttccacgcccgccatctgtaattttattctatgttcgacaacgcaaagctacctgtatctactcgtcgtacctagcacctgttgtatttattgtttggagtaataatcggcgctgagcctcttgggatgcgaatgcgatgaatgaataagcaaagctagacccagttccaaaaaaaaaaaaaaaaaaggccccta

SEQ ID NO: 30829 - DNA, 642 bp, Triticum aestivum
  Clone ID: PAT_TA_30829
ccgcgctcaccaagtgagcctgtctaccttcgcgcccacggccaggggcgacgtcctggcgaggccgcacgtggccgccgcccgcgtgaccttcccgacggcgtaccgcggcagcggcgccctctcctgcagggcgggcgggccggccacgccgccgggcatctccgacaagatgtcggacagcatcaaggaggcccaggagacgtgctcggaggacgccgccagcggggagtgcgcggcggcgtgggacgaggtggaggagctcagcgccgcggccagccacgcccgggacaagctcaaggactcggacccgctcgagaactactgcaaggagaaccccgagaccgacgagtgccgcacctacgacagctgagcgtacgtgctaatctgttctggacggcggatggtgaaggtggacgtggtgttcttggctcatgggagcccgagaaacctgctatgtctcaacctaccgttccttactcgatcgggatgtatgtagtaaaaaaaatgctccgaatattttccccagggacatacgtggttgatatacaattgatattacagacgtttatttaaagttgtattatggatgtgtgcatgggtatggtgtacaggcgagagagtctgatcatccttttccat

SEQ ID NO: 30830 - DNA, 634 bp, Triticum aestivum
  Clone ID: PAT_TA_30830
cacttagcaaatctagcccatctcaccatctccagctgagctcaacaccactactactgcaaactcgatagggatggctcgcggtgcagctactcagctcgtgctggtcgccatggtggccgctatgctcctccgtagcctccgatgcggcgatatcctgcggtcaggtgacctctgccttgagcccctgcatctcctatgcacgccggcaacggcgccaaccccgcctggcggcctggctggcagcggcgtcaggagtctgggccgggtgcagcccagagcaccgctggacaagcaagcagcgtgcaagtgcatcaagagcgctgctgggtgggctcaaacgcctgggcaaggccgccggcatcccttcaaaagtgcggcgtcagcgtcccctacgccatcagctcatctgtgggactgttctaaagattcgttgatcgacacttcttctcatcgtcgctgcatataactcaagcgatctacgctgagtacttgaggtcatacacatacatatacatatatatgaataagtgctctcatattatctcactgcgtgacagcagaggagtactacttcggccggcaactctcatggaaggcaaatgtaattgagttgggtgtccttacctttaag

SEQ ID NO: 30831 - DNA, 771 bp, Triticum aestivum
  Clone ID: PAT_TA_30831
aactaaaccattacaatcacttagcaaatctagctatctcatcatctctgcctgagctcactaccactactattgctagcttgatcgagatggcccgttctgctgttgctcaggtcgtgctcgtcgccgtggtggccgctatgctcctcgcagtcacggaggcggctgtatcgtgcggtcaggtgagctctgccttgagcccctgcatctcctatgcacgcggcaacggcgccagcccatctgcggcctgctgcagcggcgttaggagtctagccagctcagcccggagcaccgctgacaagcaagcggcgtgcaagtgcatcaagagcgctgctgctgggctcaacgctggcaaggccgccggcatccccacaaagtgcggcgttagcgtcccctacgccatcagctcttcggtcgactgctctaagattcactgatcgagcacttgctgccatcgttgttgctatcgtacgtcccctacgccatcgttgctggatctacgcttagtacgttgaggtcacacacacgcacacacacacatatatatgaataaatgctctcatattatctcactgcgtgagagagagacacactgtccaagcagctctgcatggccggccacactgttatatcgatgtttggttgttcctccactccccgaggttgctgtactttgtaccatgtgtacttttgatatatggattgtatacacagctgatcagctctacttgcgtgcgcatgttattcagcacttttgataaaaaaaaaaaa

SEQ ID NO: 30832 - DNA, 849 bp, Triticum aestivum
  Clone ID: PAT_TA_30832
cacttagcaaatctagctatttcatcatctctgcctgagctcaccaccactactagtgctagctagcttgatcgtgatggcccattctgctgttgctcaggtcgtgctcgtcgccgtggtggccgctatgctcctcgcagccacggaggcggccgtatcgtgcggtcaggtgagctctgccttgagcccctgcatctcctatgcacgcggcaacggcgccaacccgtctgcggcctgctgcagcggcgttaggagtctagccagctcagcccggagcaccgctgacaagcaagcggcgtgcaagtgtatcaagagcgctgctgctggggctcaacgctgggcaaggccgcgggcatccccacaaagtgcggcgttagcgtcccctacgccatcagctcttcggtcgactgctctaagattcgctgatcgagcacttgctgccatcgctgttgctggatctacgcttagtatgttgaggtcacacacacgcacacacacatatatatatgaataaatgctctcatattatctcactgcgtgagagagagaggagtacgtacgtcaagcagctgtgcatggccggcccgagtttggttgttcctccactccccgagtatgctgtactttgtaccatgtgtaattttgatatatggattgtatactcagctgatcagctctacttgcgtgcgcatgttattcagcacttttgatatatgcaagactgggaaagtattccattccagtttgttgctccaagcaagacgtaggaatgaaccccaacaatttcagtctttttccatcaaaaactgtactccctccgacccataataagtgtcgcatctttgagct

SEQ ID NO: 30833 - DNA, 1956 bp, Triticum aestivum
  Clone ID: PAT_TA_30833
gaattcactagtgattgccacccccctccccattcctacccacccagcatctcggcagtaactctcccgccctcccacgcggcgcgcccgctcgccgcgcgcgcgaatctcgatcgccactggtgtactgttgaaggaagaagagaatcatcctatttgtcatggcgggaactgactcctcggcgtcatcgagacaaagcagtttcaactcattagcaaaggacctagaacttcctttggagcaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgtataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaagggacctggactctgcagaagaattaagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtgatatcattcagaaccatttgttgcaggttttctgtttggttgcaatggaaaagcctgtatctcttaagcctgagcacattagagatgagaaagtcaaggttctgcaatccgtgaacccgataaaggacgaagaggtagtccttggacaatatcagggctacaaggatgaccctacagtgccagatgactctaataccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgtgaagaaacctggattggaaatggctactgaacagagtgaacttgatctgtcatatgggatgcgttaccaagatgtcaaaattccagaggcatatgagcgcctcattttggatacaataagaggagaccagcaacactttgtgcgccgagatgagctgaaggctgcctggcagatcttcactcccttgttgcacgacatcgacgccggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtagggttgtttagctaggaagagtgaaagtatcacggataaaaatcttacgaattttagctgtactgcggtttacctggcgttgtaataacggatctgtttgacggagtatacctcaccacggtgtgaaataaaaaatggagtgtttcagtcaaaaaaaaaaaaaaaaaaaaaaaaaaaaaaaaaaaaaaaaaaaaaaaaaaaaaaaaaaaaaaaaaaaaagagtcgcgcgatcgatgccgaatc

SEQ ID NO: 30834 - DNA, 693 bp, Triticum aestivum
  unsure (1)..(693): unsure at all n locations
  Clone ID: PAT_TA_30834
cttagcaagtccatccatctcatcatctacatctgagctcagcactactactattgctagcttgatcaagatggcccgtgctgcagctgctcaactcgtgttgttcaccctcgtggcagcaatggtcctcacagccacagacgctgcaatctcctgtggccaggtgagctctgccttgagcccctgcatctcctatgcacgcggcagcggctccagcccacctgcggcctgctgcagtggtgtcaggagtctggccggcgcagcgcggagcaccgctgacaagcaagcggcgtgcaagtgcattaagagtgctgctggtgggctcaacgctggaaaggccgctggcatcccctccaagtgcggcgtcagcatcccctacgccattagctcatccgtggactgctctaagattcgctgatcaaccactggccaccatggtcgccgcctatagtgccatccatcgacactaactatgttcgggtcacacacacacacacacacacacatatatatacgaataaatgctgttcatgtgagacagagaggagtatgtatgtcgagccagttctgcatggccggtcacactattgtatcgatgtttggttgttacttctctcccgttgaggagatacatgaggttgttgtactttgtaccatgtgcacttctgatttatggatcgtatatcnagcagt

SEQ ID NO: 30835 - DNA, 788 bp, Triticum aestivum
  unsure (1)..(788): unsure at all n locations
  Clone ID: PAT_TA_30835
gccggccgggccgggatcaacacttctctctaccaacacaaacctacatcctcaacattcaaaatgggtaacttccacgagagctccaacaacatctggctcgaggacggccacatcctccacgccgagtgcggcaacggcgagggcgactatgtcgagtcaactcttgaccttgactactatatcggtaacgacgatggctctttctcatggggaggcgagaacttctctggctctgcttccaacatcaccctcgacatcgaaggcgatgataacattcccgttctccgcgccgagttgaaccccatggatggtgatcccgtcgaggccaatgtcaacctttccgagcgcatcggcaacgactgtggcactcttatcttcctcgcttaaactggatagagaacagcacatgtgatgagaagagaggtagcatcaaacaataaacaaagttaaacatttcaaaaaaaaaaaaaaaaaaaaacaccgttgagatcagtgccgaggttccaatgaaaggactggccttggaatgcgaagatgacgatgtcagatttgatgacaatttagttgacattgtccctggcgaggttgtaaagattggtatcaaaggagcgaagaaggacactgtcctcaagacacattatctggggatgcagtatgcttagatggagaggtagcattctagttcccatttggtggtttatacaatgttatataanannnnnnnnnnnnnnnnaaaaaannnnannnggcagttgccttgtaaaaaaaaaaaaaaaaagccccta

SEQ ID NO: 30836 - DNA, 859 bp, Triticum aestivum
  Clone ID: PAT_TA_30836
catcgtcgagagggaaacagcccggatcaccagctaaggcccctaaatgaccgctcagtgataaaggaggtgggggtgcaaagacagccaggaggtttgcttagaagcaacccaccctttaaagagtgcgtaatagctcactgatcgagcgcccttgcgctgaagatgaacggggttaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtcccacggaggttgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagcgattgcttctccacgaggctcataccaggcgctacggcgctgaagtatgtaactgatgccatactcccaggaaaagctcgaacgaccttcaacaaaagggtacctgtacccgaaaccgacacaggtgggtaggtagagaatacctaggggcgcgagacaatctctctaaggaactcggcaaaatagccccgtaacttcgggagaaggggtgccccctaaaaaaaaaaaaaaaaaaaactcgagactag

SEQ ID NO: 30837 - DNA, 972 bp, Triticum aestivum
  Clone ID: PAT_TA_30837
gaaccgcgtactccaaccgccatcatttgcatcattgcatgccatacaagaaaaaactaacaaatacttctagcttattgattctagatttctaccaccacttgtattactaggaacaccaagccaacttgccatcgcaattccggtttgtccatgtttagtaaccttatcctatattgtacatatcacggcatgcagtgcatccttgagactcttggcatatacttccagcctctttaatccgcaaatctagctatctcatcatctctgcctgagctcactaccactactattgctagcttgatcgagatggcccgttctgctgttgctcaggtcgtgctcgtcgccgtggtggctgctatgctcctcgcagtcacagaggcggctgtatcgtgcggtcaggtgagctctgccttgagcccctgcatctcctatgcacgcggcaacggcgccagcccatctgcggcctgctgcagcggcgttaggagtctagccagctcagcccggagcaccgctgacaagcaagcggcgtgcaagtgcatcaagagcgctgctgctgggctcaacgctggcaaggccgccggcatccccacaaagtgcggcgttagcgtcccttacgccatcagctcttcggtcgactgctctaagattcgctgatcgagcacttgctgccatcgctgttgccatcgtcccctacgccatcgttgctggatctacgcttagtacgttgaggtcacacacacgcacacccacatatatatatgaataaatgctctcatattatctcactgcgtgagagagagaggagtacgtacgtccaagcagctctgcatggccggccacactgttgtatcgatgtttggttgttcttccactccccgagtttgctgtactttgtaccatgtgtacttttgatatatggattgtatactcagctgatcagcccaaaaaacaaaaaaaataagggcccta

SEQ ID NO: 30838 - DNA, 738 bp, Triticum aestivum
  Clone ID: PAT_TA_30838
gccggccgggtctgcgacattacaatcacttagcaaatctagctatttcatcatctctgcctgagctcaccaccactactagtgctagctagcttgatcgtgatggcccattctgctgttgctcaggtcgtgctcgtcgccgtggtggccgctatgctcctcgcagccacggaggcggccgtatcgtgcggtcaggtgagctctgccttgagcccctgcatctcctatgcacgcggcaacggcgccaacccgtctgcggcctgctgcagcggcgttaggagtctagccagctcagcccggagcaccgctgacaagcaagcggcgtgcaagtgtatcaagagcgctgctgctgggctcaacgctggcaaggccgcgggcatccccacaaagtgcggcgttagcgtcccctacgccatcagctcttcggtcgactgctctaagattcgctgatcgagcacttgctgccatcgctgttgccatcgtcccctgcgccatcgttgctggatctacgcttagtatgttgaggtcacacacacgcacacacacacatatatatgaataaatgctctcatattatctcactgcgtgagagagagaggagtacgtacgtcaagcagctgtgcatggccggcccgagtttggttgttcctccactccccgagtatgctgtactttgtaccatgtggaattttgatatatggattgtatactcagctgatcagctctaaaaaaaaaaaa

SEQ ID NO: 30839 - DNA, 718 bp, Triticum aestivum
  Clone ID: PAT_TA_30839
cacgaggatcacttagcaaatctagcccatctcaccatctccagctgagctcaacaccactactactgcaaactcaatagggatggctcgcggtgcagctactcagctcgtgctggtcgccttggtggccgctatgctcctcgtagcctgcgatgcggcgatatcctgcggtcaggtgacctctgccttgagcccctgcatctcctatgcacgcggcaatggcgccaacccgcctgcggcctgctgcagcggcgtcaggagtctggccggtgcagcccggagcaccgctgacaagcaagcagcgtgcaagtgcatcaagagcgctgctggtgggctcaacgctggcaaggccgccggcatcccttcaaagtgcggcgtcagcgtcccctacgccatcagctcatctgtggactgttctaagattcgttgatcgaccacttcttctcatcatcgctgcatatagctccagcgatctacgctgagtacgttgaggtcatacacatacatatacatatatatgaataagtgctctcatattatctcactgcgtgacagcgagaggagtacctacgtccggccagctctgcatggcaggccacactgttgtattgatgtttggttgttccttcacccttttgagaggactcatgagtttgttcttctttgtaccgtgtgcacttttgatatatggatcttacactagtagaaaaaaaaaaaa

SEQ ID NO: 30840 - DNA, 1319 bp, Triticum aestivum
  Clone ID: PAT_TA_30840
aactctctctctctaccacacaaacctacatcctcaacattcaaaatgggtaacttccacgagagctccaacaacatctggctcgaggacggccacatcctccacgccgagtgcggcaacggcgagggcgactatgtcgagtcaactcttgaccttgactactatatcggtaacgacgatggctctttctcatggggaggcgagaacttctctggctctgcttccaacatcaccctcgaaaaaaaaaaaaaaaaaaaaaatcatcatcaaccaaaaaaacggacatctccgtttttttcgtcctcatcccttctccctccagcctaacggcctctctgcaaacgtaggggaggccgccgccccctcaacttgaatcaatggcagcagcgtgtgcatccgccgccgcctgcagcctcgcctcggccatgtcctggtagtctgctcgctgccccggcgtcgttacctagtaacgatctcggcatcgatcctggtctgcttctctttgaaaactattctccctacttggaatttctaccggccgattacaacgggtttgatggagcgacgtgggatttcgggaacatcgccaacaataataacaccaccgctgccaccaacgacaatgacgttcagaacttcagcggtgatgggctattcgacaatatcatgatcccggaattgaacgttttggatacacagtcttcgctcgatgtggctggagatggcttcctctctcaggagcagcctctcctcactgtcaactctacaacacccatcgagtaccctgctactgcaagctcttcatccagcactcctcatcccccaccaacgattagaaccaaatctccaacatcaacatccgccatcccaggaacatctaccttttctctccacccctccccctcttcatcatcatcatcgtcctcctcccgcaaacgcaaatcctctcccgaagaagaggactcagccgtcaccctcaagcgccagcgcaacaccctcgcggcacgcaagtaccgccagaagcgcatcgaccgcatcactgagcttgaggaggccttggctgccaaggcgaaggaatgcgatgattggaaacttaaatttatgaggaaggaggcagagaacgatactcttagggaaatgcttgcgaagaaatgagaaaacaaagagaaacaagaccaagtttgacaccgtgtttgctattatgctatggcgattcggggcattgagaggacttctagatacattgtttcgagttagcgagtttgcttttttccttattgcttttacgaatgactacaaatattttttttttacactta

SEQ ID NO: 30841 - DNA, 643 bp, Triticum aestivum
  Clone ID: PAT_TA_30841
cccacgcgtccggcctaaccacataaaatttcggccgatccaccacaccctgcaatggcgtccgcgctcaccaacgtgagcctgtctaccttcgcgcccacggccaggggcgacgtcctggcgaggccgcaggtggcccccgcccgcgtcaccttcccgacggcgtaccgcggcagcggcgccctctcctgcagggcgggcgggccggccacgccgccgggcatctccgacaagatgtcggacagcatcaaggaggcccaggagacgtgctcggaggacgccgccagcggggagtgcgccgcggcgtgggacgaggtggaggagctcagcgccgcggccagccacgcccgggacaagctcaaggactcggacccgctcgagaactactgcaaggagaaccccgagaccgacgagtgccgcacctacgacagctgagcgtacgtgctaatttgttctggacggcggatagtgaagctggacgtggtgttcttggctcatgggagcccgagaaacctgctatgtctcaacctaccgttacttacacgatcgggatgtatgtagtaaaaacgcgccaaatattttcccagggacatacgtggttgatatacaattgatattacagacgtttatttaaagttgtatt

SEQ ID NO: 30842 - DNA, 736 bp, Triticum aestivum
  Clone ID: PAT_TA_30842
gatcacttggcaaatctagccatcttatcatctccagctgagctcagcatcactagtactgcaaactcgatcgggatggctcgcgctgcagctactcagctcgtgctggtcgccttggtggccgctatgctcctcgtagccacggacgcggccatctcctgcggtcaggtgagctctgccttgagcccctgcatctcctatgcccgcggcaatggcgccaacccgactgcggcctgctgcagcggtgtcaggagtctggccggcgcagcccggagcaccgctgacaagcaagcggcgtgcaagtgcatcaagagcgctgccggtgggctcaacgctggcaaggccgccggcatcccctccaagtgcggcgttagcgtcccatatgccatcagcgcttcggtcgactgctctaagattcgctgatcaaccactgcccaccatggctgccgctcatagcgccatccatcaccgcttagtatgctgaggtctctaatacatatgaataaatgctctatctgatctccatgtgagggagaaaggagtgcgtacgccgagctagctctgcatggccggccactattgtactactactatggttgtttttactttcactacctttgaggagaaccgagactttattgtacgttttttttttttgcgggtaagagactttattgtacgttgtaccatgtacacttccagtatatcgattatacttacaatcaaaaaaaaaaaa

SEQ ID NO: 30843 - DNA, 2004 bp, Triticum aestivum
  Clone ID: PAT_TA_30843
cgtccgcccacgcgtggggcaaggaaggagccacccccctccccattcctacccacccagcatctcggcagtaactctcctccctcccacgcggcgcgcccgctcgccgcgcgcgcgaatctcggtcgcaactggtgtactgttgaaggaaggaaaaatcatcctatttgtcatggcgggaactgactcctcggcgtcatcgagacaaagcagtttcaactcattagcaaaggacctagaacttcctttggagcaagggtgcctcaccatcgttgtacttggggcttctggagatcttgccaagaagaaaacgttcccggcactctaccacctttttgagcaggggttcttacaatctggtgaagtgcatatagtggggtatgcgagaacaaatctttctgatgatgggttgagagggcgcatccgtgcataccttaaaggagcctcagaggaacatgtttcagaattcttgcaattgataaaatatgtcagtggttcctatgacagtggagaaggttttgaaaaactgaacaaggaaatatcagattatgagatgtcaaacaactcaggaagctcccgtaggctcttttatttggcattgcctccatctgtctacccttcagtgtgcaaaatgatccgaacatattgcatgagtccaacttctcgcgctggatggactagagtaattgttgagaagccctttggaagggacctggactctgcagaagaattgagttcccaacttggggagctattcgaggaagatcaactctacaggattgaccactacttgggaaaagagttggtccaaaacttgcttgtgcttcgttttgcgaaccgtttgttcttaccactttggaaccgtgacaatgttgataatatacagattgtattcagggaggacttcggaactgatggacgtggaggatattttgatcaatatggaatcatccgtgatatcattcagaaccatttgttgcaggttttctgtttggttgcaatggaaaagcctgtatctcttaagcctgagcacatcagagatgagaaagtcaaggttctgcaatccgtgaacccgataaaggacgaagaggtagtccttggacaatatcagggctacaaggatgaccctacagtgccagatgactctaataccccaacgtttgcatctattgtacttagggtacacaatgaaagatgggaaggtgttcctttcattcttaaagctggtaaagcattaaactcaagaaaagcagaaattcgtgtgcagttcaaggatgttcccggtgacatttttaaatgtaagaagcagggaagaaatgagtttgtcatacgcctccagccatcagaagccatgtacatgaaactaactgaattcgtgcaggtgaagaaacctggattggaaatggctactgaacagagtgaacttgatctgtcatatgggatgcgttaccaagatgtcaaaattccagaggcatacgagcgcctcattttggatacaataagaggagaccagcaacactttgtgcgccgagatgagctgaaggctgcctggcagatcttcactcccttgttgcacgacatcgacgctggcaagctgaaggctgtttcatacaagcctggcagccgaggccccaaggaagctgatgaactgagtgagaaggttgggtacatgcagacccacggttacatctggataccacccacccttgcatagagtgcctccctcgatccttgtaggtttgtttagctaggaagagtgaaagtatcacggataaaaatcttacgaattttagctgtactgcggtttacatggcgttgtaataacggatctgttcgacggagtatacctcaccccggtgtgaaataaaaaatggagtgtttcaatcattgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaattccggaagggcgccgtccccc

SEQ ID NO: 30844 - DNA, 2239 bp, Triticum aestivum
  Clone ID: PAT_TA_30844
ttgaattccacagaatgccaaaccataagcataaaaagggaaacaaaacaattgtacaaggttagaagttgcagcgcatgacatcggttttaataccgtagaacaattgcctgtcaaagaactcttatatacagaaacatgctaccctaaaatcttgtagctcgggttgacaagattgtctaggcctgagacaacctggattgattcaataacgtccccaaccttgagatcagccaagaaatcctcattttcggttacatatccaaacaccgaataccgcccatccaatatattggaattgcttggcgtcagctcactttctttcaagagccagaagacttgactagaagcggagttgtcatcaaattcttctctagcccattgccatcgttccaaatgcattaaaaggaagctttgtttgagccttgtaaagaccaagttcctcaagtgtttcgccatatataggcgccttgtcaccatcaaccattatctcaagaggtatggtacgactcttgcccagtaccgggatcaataaaaccctcggctggtccctcgggatctcccgtctgaacaacaaaaccatcagctctttggatttccatgccatcatagaatttccgttccaccagatctacgaagttcccagaagtcacaggagcattatatccatccagaactatccgaaatacacaatcttctacgtttggattatctttaatcttaaccgtcatatccacagtagctcttcctttaagaagaggcatgttgttgtattcttctggtacttcataggggaagccatcaacccatatcttcttctacagttccaacataattgagaagctctttctgctttggagctaccgcattcctgtttctatcctcgataattcgttgaagctcttcaagtccaacagctaatttatccaatgttttttctccgtttgctctttttgattcagcaagacccgaaagtattaaactcctcccattagtcagcgctcttgaggcctgcctcacatttctttcaactgaatccaacgctctaacaccagaaactttgagactatcggtaatatcctctagcggtttttgaacttcacgaatagctttattatctatgggcaaagcatatctcaacaaagcacctggatctttaatgggaggtccagaaataagaactgaaatatcaggaattacaggttcgagaggataagcatgggccgaccatccaaatgttggtgggacagtaattaatccaacagacaatgctacagaaattgcacattctttccagctaaatgagtttcctttcccgccggagagcgcacaccgggcgacggagcttcggcggcgatcaatggtaagaagcgaagggcggcggcagcagcgggaggaggcgagcgccgcggccatgcggtggggaggggatgggggtacggttccgatgaagcaaggcgttggtggaagaccgatctcgtgccgaattcggcacgagctcgtgccgaattcggcacgagataaaatctccgtcgatccaccacaccctgcaatggcgtccgcgctcaccaacgtgagcctgtctaccttcgcgcccacggccaggggcgacgtcctcgcgaggccgcaggtggccgccgcccgcgtcaccttcccgacggcgcaccgcggcagcggcgccctctcctgcagggcgggcgggccggccacgccgccgggcatctccgacaagatgtcggacagcatcaaggaggcccaggagacgtgctcggaggacgccgccagcggggagtgcgcggcggcgtgggacgaggtggaggagctcagcgccgccgccagccacgcccgggacaagctcaaggactccgacccgctggagaactactgcaaggagaaccccgagaccgacgagtgccgcacctacgacagctgagcgtacgtgctaatctcttctggatggcggatggtgaaggtggacgtggtgttcttggctcgtgggagcccgagaaacctgctatgtctcaacctaccgttacttacacgatcgggatgtatgtagtaaaaacgctccaaatattttccctgggacatacgtggttgatatacaattgatattacagacgtttatttaaagttgtattatggatgtgtgcatgggcatgatgtagaggcgacaatctggtcctccttttccattaacaaaatggaagctctaaaaacctgacatccaacctttagc

SEQ ID NO: 30845 - DNA, 727 bp, Triticum aestivum
  Clone ID: PAT_TA_30845
ctcgtgccgaattcggcacgagcaaatctagcccatctcaccatctccagctgagctcaacaccactactactgcaaactcgatagggatggctcgcggtgcagctactcagctcgtgctggtcgccatggtggccgctatgctcctcgtagcctccgatgcggcgatatcctgcggtcaggtgacctctgccttgagcccctgcatctcctatgcacgcggcaacggcgccaacccgcctgcggcctgctgcagcggcgtcaggagtctggccggtgcagcccggagcaccgctgacaagcaagcagcgtgcaagtgcatcaagagcgctgctggtgggctcaacgctggcaaggccgccggcatcccttcaaagtgcggcgtcagcgtcccctacgccatcagctcatctgtggactgttctaagattcgctgatcgaccacttcttctcatcgtcgctgcatatagctcgagcgatctacgttgagtacgttgaggtcatacacatacatatacatatatatgaataagtgctctcatattatctcactgcgtgagagcgagaggagtacctacgtccggccagctctgcatggcaggccacactgttatattgatgtttggttgttccttcaccccttttgagaggactcatgagtttattcttctttgtaccgtgtgcacttttgatatatggaccttatactcagctctaaaaaaaaaaaa

SEQ ID NO: 30846 - DNA, 784 bp, Triticum aestivum
  Clone ID: PAT_TA_30846
aggacgcgtgggcggacgcgtgggtaacgcacataaaatctccgtcgatccaccacaccctgcaatggcgtccgcgctcaccaacgtgagcctgtctaccttcgcgcccacggccaggggcgacgtcctcgccaggcctcaggtggccgccgcccgcgtcaccttcccgacggcgtaccgtggcagcggtgccctctcctgcagggcgggtgggccggccacgccgccgggcatctccgacaagatgtcggacagcatcaaggaggcccaggagacgtgctcggaggacgccgccagcggggagtgcgcggcggcgtgggacgaggtggaggagctcagcgccgccgccagccacgcccgggacaagctcaaggactccgacccgctcgagaactactgcaaggagaaccccgagaccgacgagtgccgcacctacgacagctgagcgtacgtgctaatttgttctggacggcggatagtgaaggtggacgtggtgttcttggctcatgggagcccgagaaaacctactatgtctcaacctaccgttacttacacgatcgggatgtatgtagtaaaaacgcgccaaatattttcccagggacatacgtggttgatatacaattgatattacagacgtttatttaaagttgtattatggatgtgtgcatgggtatggtgtagaggcgagtgtctggtcgtccttttccattaaaaaaaatggaagctctataaacctgacatccaaattttagcactaaaaaaaaaaaaaaacctgcccgggcgg

SEQ ID NO: 30847 - DNA, 1038 bp, Triticum aestivum
  Clone ID: PAT_TA_30847
gagcaacaacaacaaatcccgcaacaacaaatcccccaacaacatcaaatcccccagcaaccacaacaattcccccagcaacaattcccccaacaacagcaattcccccaacaacaccaatccccccaacaacaattcccacaacaacaattcccccaacagcaattgccgcaacgggaattctcacaacaacaaatctcccagcaaccacaacaactcccccagcaacaacaaatcccccagcaaccacaacaatttctccaacaacaacaattcccccagcaacaacccccccaacaacatcaatttccccaacagcaattgctagcctctcaccatctccagctgagttcaacacgattactactgcaaactcgatagggatggctcgcggtgcagctattccgctcgtgctggtcgccatggtggccactatgctcctcgtagccaccgacgcggccatctcctgcggtcaggtgacctccgccttgagcccctgcatctcctatgcccgcggcaatggcgccaacccgactgctgcctgctgcagcggtgtcaggagtctggccggggcagcccggagcaccgctgacaagcaagcggcgtgcaagtgcatcaagagcgctgccggtgggctcaacgctggcaaggccgccggcatcccctccaagtgcggcgtcagcgtcccatatgcaatcagcgctaacgtcgactgctctaagattcgctgatcaaccactgcccaccatggctgccgtccatagcgccatccatcaccgctgagtatgctgaggtctctaatacatatgaataaatgctctgatctgatctccatgtgagggagaaaggagtgcgtacgccgagctagctctgcatggccggcaactattgtactactactatggttgtttttactttcactacctttgaggagaaccgagactttattgtacgttgtaccgcgtacacttccagtatatatatggattatgcttataatcattttcctacgaaaaaaaaaaaaaaaaaaggccccta

SEQ ID NO: 30848 - DNA, 1229 bp, Triticum aestivum
  Clone ID: PAT_TA_30848
gaattcggtaggcagaaccgttccccacgcttctccgaaccctcgctccccgcttcccgctcctcacgcctctcgccgtcgccgtcccgccgagcccatggctaagacgcgtccgcccaagaagatcctcgagtcctacaccatcaaggggtccgacaaagtcatcaagcctggggactgtgtgctaatgagatcagctgatacatcaaagccaccatatgtggcaaaagttgagtccattgaggcagcagggtctcgaggcacaaatgtgagagtacgggttcgatggtactatcgtccagaagaatccattggtgggaggcgaccatttcatggttccaaagaggtattcctctctgaccactatgatgtacagagtgctgacacaatagagggaaaatgcaatgtccacagcttccgtagctacacaaagcttgattctgtgaatgccgaggacttcttctgtcgctttgactacaaatcagcatctgggcagtttcgtgcccgaccgtatagctgtgttttgcaagtgtgagatgccgtacaatcctgatgaccttatgatccaatgtgaggaatgctctgactggtttcacccttcttgtattggaatgaccattaaagaagcaaagaaacgagaacactttttctgccagagctgtactgctgaaaatgggaagacaactgagaattttcatgaagccacggcagagtcagaagaaaagctggtggagtcgaaaaggcggagaaggtgatgggctggattaatttgatggaattcccacacggatatacaaactacatagccttctagtatgaggtctgtggtgatgtttgtggcagtctgtgaccccttctaatgtcaggcatgcagtgtacataacgtgcaacctgagattgttgtattaggagaaaatagaatttggacgctagtgtcagagtttgagcagtatggcaccatcaagatcccttgtgatcttccctcaaaaaaaaaaagagcccttgtgatccattctgcgatggggcctgaacagccttttacgtttgtgagagtcgaatcttgtgttgccatgtggaatgtttgtctttgtttcagagcaactcgtggtgcagtatctgtgtagaaggggatctgatttttagcatttgatttagctgtgtaatttttattaacgatcttaagcgacaatagttctataaagctggaaaaattggtctcaaaaaaaaaa

SEQ ID NO: 30849 - DNA, 1263 bp, Triticum aestivum
  unsure (1)..(1263): unsure at all n locations
  Clone ID: PAT_TA_30849
gtggtgctgttctaggaggagagagagagagaggttgggagggaagaaggaggcggcggcggcgatcccgtctctgagtctctgcccgtcgggcctgctgctctctccggccggccggccagcggcacggcgcgacctcgtgcgcggctgtcatgaaaagatacatttggtaggcaaagttcattcagcatgggttcaggaaatctggtgatgaagaaggtggtgaagcccagctctttcgacctcgacatacaacttgataaaagttggacggaggatgttacttgcccgatctgtctcgatttccctcacaacgcggtcttgctgaggtgcacatcttatgagaagggttgccggccgttcgtatgcgacaccgacaagtcccgttcgaactgcctcgagcggtttaagagtgcccatgggcagccggtgaatgtgaaggtctcggccgttaacatcgccgttcgtgacagcatccatttcatctcgtcaaacacaaacaaccacccggcttgcccgttgtgtagaggcgatgtcatcgggtgggctgtcatcggcgaggcccgccagcacctaaaccagaagtaaagctcctgcgacacgagctgctgtccggcttgcccgttgtgtagaggcgatgtcatcggggtgggctgtcatcgccgaggcgcgccgacaccgtcaccgcgagccgagttggctgggagaattgccgccgttcgtatgttggcatcttccatgagcttccgaaacacacccagcagaagcatccgaactcgcgcccttcggagatcgaccccgctcgccgagtcgactgggagaatttccagcagtcgtccgacagccatcgatgtcctgggcacgctacacgcgcacccgtctaaccccccggccttcggacattccggaagcgagcagggccaagggcaagggaaaggggtctatgggagggcccacccgcaacggtgggcccgggaaactcaccgtccctttccaaaccccgttcacgtacgcgagggaatccgattggagcatatacaccgtgaaaggggatacgatggcaatccggaccctcgcctcagtcagggccccatttcccgccgtccccgtcgcccgccgcactcgcaccctangtccaatgaacacatcaggatnaagacaccactcacgccgntnatcctgcctctcnccgcatcaanccgnttcttgataaacatacacanaggctcccgtatgtaagncncacattngtctatagaaaan

SEQ ID NO: 30850 - DNA, 1153 bp, Triticum aestivum
  Clone ID: PAT_TA_30850
gcggcatataagccggccatcgacaagaaaaggcggagacatctctcgcccgactccccttgcttctcccctctttcttctcctcctgatctggagcagacgccaccttcgccggatcccctctaggagcgctccgcccccgaatccgccggaacccagccgacgccggccatgagctcctccgagtacgactacctcttcaagctgctcctcatcggcgactcctccgtcggcaagtcctgcctcctcctccgcttcgccgacgatgcgtacgtcgacacctacatcagtaccatcggcgttgatttcaaaatccggaccgttgagctcgatggcaagtcggtgaagctgcagatttgggacacagcaggccaggaaaggttcaggacaataacaagcagttactaccggggagcgcatggaatcattatcgtatatgacgtgacagatagggaaagcttcaacaatgtcaagcagtggttgagtgagatcgataggtatgccagtgacagtgtgtgcaagcttctagtggggaacaaatgtgatttggtcgatagtaaggtcgtcgatacagaggaggccaaggcttttgcagaatcgttgggaatgaattttcttgagacaagtgcaaaggaagccatcaatgtggagacagctttcttaaccatgtcatcagaaatcaagaacaagatggcgagccaaccaacggcggagaggaaatcgacggtccatgttcacatgaaagggcagcccatacagcagcagaacagcagttgctgctcctcataagctcagcaagtcgagcagtgaattggatatactgaatacagaatttgtatacaacagagcgtgtgttaatacttactgttttaatatacttgtcacagtttgagcttgttctgcaatctcattagtcattactttgtcagtgttttaggcgcatttgatggatgttaggttacaaaaattgtatgaaaatatggtccaagcttgtcagtcatcctgttatctttcagaaaggaccatatattgttgctaagtctttaatcattactttgtagcagaaattgtatgaaaaataatggttaattcaaacctgtcagtcaaaaaaaaaaaaacctcggccgcgaccacgctaatcactagtgaattc

SEQ ID NO: 30851 - DNA, 726 bp, Triticum aestivum
  unsure (1)..(726): unsure at all n locations
  Clone ID: PAT_TA_30851
ggtacgaacccacgacgtcacgaccaaaccaaatctgcggcggcgcgcgcataggaggcgaatcagcatcagaaccaagccgatggcgccaccatgggtatctagcgtgactccatgcacaagcgccgggccaccggtgggaagcaaaaagcctggaggaagaagcgaaagtatgagctcggccgccagccagccaacactaagctattcaagcaacaagacacgctgaggagggtccgtgttcgcggaggtaacgtgaattggagggctactcgcggtcttgacactggtaacttctcatggggtagtgaggctagtgacccgcaagacccgtctactggatgtggtttacaattcgtctaacaatgagcttgtgaggactcagaccctaggtcaagaatgccattgtgcaagttgatgctgcccccttcaagcagtggtacctgactcattatggagtccaaatcggtaggaagaagaaagctgctgcagctgccaagaacggaacctgctgaggggcaagaggctgaggttgctgctgctgccacagaggaagcaacagaagagcaacaatgtccagaggaagcttgagaagcgccagcagggacgtacactggactcgcacattgaggagcagttcagctggtggaaggctgctggcctagcatttcgtctcgccctggacagtgtggcaganctgatgggtacatcctgganggcaaggga

SEQ ID NO: 30852 - DNA, 639 bp, Triticum aestivum
  Clone ID: PAT_TA_30852
cttctgtatcctcctgcgcggcggccagagcacaatctgacgccccttcggcaggaccgctggccggtcgcccctatccattcgacgcggcggccgagatctgatcccatgcccctccggcaggaccgtcggcctggaccgccggtccgactctcctccgatggatctacaattccgtcacgaccaccggtctgcctccgacggctctccgagattgttctataggcagactcatcctcaagcagatctctgtatggattggcactctcaagtatccacaccggctttactgaatcacaagttcacaagaaatgtcagcatgcactatgtactggctttagttgatacagtatctatctagctcaaataatcctcgtggattggtatggtgatttcaaggattgtgcagtgatcctggtgactgtacactcaagtgctaccccggtgaggctctgcataccgtggactggatccagcacctgcagctacagtaagtgacaagtttgtctccctcaagctgcgacctcctactagaatggtggatgtttttaaattgctaaacttctccacacacgactcgtactacgaagttattgtcggtgcaaaatggtgcatgcttgcagctagcttgccccgatg

SEQ ID NO: 30853 - DNA, 1308 bp, Triticum aestivum
  Clone ID: PAT_TA_30853
tggatactagctaattcgaagccttgtcccaagtgcaagcggcctattgaaaaaaaccagggctgcatgcacattacgtgcacaccgccatgtaaatttgaattctgctggctttgtcttggtccatggtcagatcacggggagaggacaggtggtttttatgctggtcaccgcgccggcgcggctggccgactggggccgctgcaggctccggatcggcggcgcgacgcgtcggggagctccgagatgcggccctcccgtttgcctgcccgctgccgagccaatcagtcatcaaggcaaaaggcgcttggggatctgcagagtctgcagaatgataagcttgaaaagctaagtgacatacaaagccaacctgagtcacagcttaagttcataattgaagcatggttacagattgttgaatgtaggcgggtattgaagtggacttacgcatatggttattaccttccagaccatgaacatgccaaaaggcagttcttcgaatacgttcaaggtgaagcagaatctggtttggaacgccttcatcagtgtgcggagaaagaacttcagatctatctcgatgcagactgcccatcaaaagattttaatgacttccgtacaaagttggctggattgaccagggtaactcgcaattatttcgaaaacctggtccgtgcattggagtctggattgaatgatgttggagctcatagcggccaaggtgcatgtagcaaggccgtaagctccaagaaccttggcggtaagagcaagagtggcaagaacaaggcacctgttggagcctcaaagtcaggcagctcaacccgtggtatggatgatgggaacatttgggcctgtgatcagtgcacatttgcaaaccctaggtctgctaggagctgccaggtttgtgaccatcagcagcaccgttagatcttgtcaagcattgaacatatggattcgattggattggaacaccctgccccgtgaatgcctagaggcacatggcgcatgaagttactggcctctagggcaggaaaaaactagagggtggaaatagaagactctgctgcattggaagcgcagcaaaagctcaagaggtagaatttttcgtgtcctggttgtctgttaaccgacgatgccccagcagcctcactcaaatatcatggctcgtttgtatataacttagcacccagccctcttgtcttgtttgagaggggtattgacgggtgtttgctgatgcatggactgacctgttgtagtgttgtacaactgttgtaaaaactgtaataatattgacctgtattgagtacattt

SEQ ID NO: 30854 - DNA, 1203 bp, Triticum aestivum
  Clone ID: PAT_TA_30854
attcggcacgaggcgtaaaccattcttctccctcctcctcccaagaatccccgccgctcaagcaagggggacagggcggccggagccggccagcgcaccgaccgcgctacacgttcaccccccacgtcgcgggggcggcagcggggctcctcctccgtgccggcgatgggcgccgacgaggcggggccgggcggcggcggcgggatccgggtgctcctgcggcggaagcaggtggactccgaccgggcccgcgccgccggcggccagcagctcgccaaggagctctccatcacgcagctcatcgctatcggcgtcggttcgacggttggagccggagtctacgttctcgtggggacggttgcccgggagcactctggcccggcactgacgctctcgtttctgatcgccggaatagcggctgcgctttccgctttctgttacgcggagcttgctagccgctgcccttccgcgggaagcgcctaccactactcgtacatctgcgttggcgaaggggttgcatggttgatcggctgggctctcatactggagtatacaattggcggatcagccgttgcccgcggcatcgcgcccgcgccggcgttattttttggaggaccaaatagtctgccatggattctagcacgccatgagctcccatggttagatgttgttgttgatccttgtgctgctgccttggttttccttgtcactgccctgttatgcgtcgggataaaagagagtacattcgtgcaaggaattgtgacagtcctgaactgctgcgtgatgctatttgttattatagccggcagttacattggattccaaacaggatgggtcggctacaaggtgtctggcggatttctgccatatggggtgaatggaatgcttgctggatcagcgacagttttctttgcctacataggctttgattcagttgcgagcaccgctgaggaggtgaggaatccacaacgggatctgccgctgggaatagccacgtcattgacgatttgctgttccttgtatatgctggtttcagttgttattgtcggtctggtgccatactttgctatggacccagatacccctatttcatccgccttcgcgaggcatgggatgcagtgggcaatgtaccttgtaacatctggtgccgttctcgctctctgctcaaccttgatgggatcacttctgccgtcgacgcggccg

SEQ ID NO: 30855 - DNA, 1035 bp, Triticum aestivum
  unsure (1)..(1035): unsure at all n locations
  Clone ID: PAT_TA_30855
ttacccacctcgcctcccggaaatcgcaggattttcaccggcttcccgttgacgtttccgccactgcggcagcacaattcgaaacccccccgcacactcccctcccttccgtgcctaggcggcaacgcttcttctcgcctcccctcccatctcctttataaccgagcgggcggcccctcccgcgtgaggcaccgaggacgggggcacaagcgcagccgagccgagaccagacgaaccgtgccgagccctaccctcctccaccaccgggtctctctgcgagggcggaggagcgacatggagccggccgagaagaagccgccggcggtgtccgacctcggcgcctgggggatgaacgtcgtcagctccgtcggcctcatcatggccaacaagcagctcatgtcctccgccggctacgccttctccttcgccaccacgttgaccgggttccacttcaccgtcacggcgctcgtcgggtggatttccaaggccaccggctactccgcctccaagcacgtccccctctgggagctcgtctggttctcgctcgtcgccaacgcctccatcaccgggatgaacctcagcctcatgctcaactctgtcggcttctatcagatctccaaactgagcatgattccggtggtttgcttgatggaatgggtgctcaacagcaagcactacacaaccaaggttatatcggcagtggttgtcgtcgcagcgggcgtcgggatttgcaccgtcaccgatgtggaggtcaatgctaagggcttcatttgtgcttgcgtggctgtgttctgcacgtcgctgcaacagattataattggctcctttcagaagaagtacaacattgggtcatttgagctgctgagcaaaactgcaccaatacaggcagtgtcacttattatactgggtccctttgtggattactacctaaatgggcgttggctattgaactacagtttttcaacaggggcaactttcttcatactgctttcatgctccttggctgggntctgcaacatgagccagtacctctgc

SEQ ID NO: 30856 - DNA, 1938 bp, Triticum aestivum
  Clone ID: PAT_TA_30856
cggcacgagggtggccgagccgagggccggccccacgaaccgcgcggacccctaccctactccaccaccggccctgtctgcgacccccgcgctcgaccgggtctccatgcgggcgccggtgggggccaacgtcccggcctggaggatgacccccgtggtctccgtccgcgccgcccgtggccagaaagcagttggcgccgtcggcccgatccccgccaacccgccgcccacacgctccgcgggctccgcttccctcctcgcccccccggtctctctgctacgcgccgacgagcggcatctcggccgccgagaagatcccgccggcggagcccgtcctccgcgcccgggggatgaacctcctccgtgccctcggcttcttcatgcccgacgcgcagccctttacctccgccggctacctcttccccttggccacctcggtgagggtctttcacttcaccgtcatggccctcgtccggtggatttccatggtcacaggctaccccgcctccaagcacttccccatctgggttctagcatggttctcgctcctcgccaacgcctccatggctttgatgaacctcagccgcatgcttcactctgtaggcgtctattatatccctaaattgaccatgatccggacggcgctgctagatattatgattggctcctttcagaagaagtacaacattgggtcatttgagctgctgagcaaaactgcaccaatacaggcagtgtcacttattatactgggtccctttgtggattactacctaaatgggcgttggctattgaactacagtttttcaacaggggcaactttcttcatactgctttcatgctccttggctgtcttctgcaacatgagccagtatctctgcatcgggcggttctctgcaacctctttccaggtcctgggccacatgaaaacggtgtgcgtgctgatcctcggctgggttctgttcgactcggctctcaccatcaagaacatactcgggatgctgcttgccatcatgggcatggtggtctatagctgggcccatggagtctgcagaagaaggccacctcggccgatcccgcaggaacaagagcgacatgctgggatgggttctgacgtacccctcaagtcgagaacgagcggcattccgctgtcctctgatgacctcgaggaaggcccgatgaagaactagcctgtcgctgttattcattcattcttcttggttcttttgtatgtgtttgatccacaatgtccgccagtccagtcctcgaagctatcgacagtcttgttaattttgcctcttgcttgcggggtggagtaccatcataggtgctgacgaccccggccggccggcctcggtgtacattcacactacttaggaaatttgtcaaggccgataccagccgagccatgggtattcttgatggctgctattaaagatgacagcaaattatacttatataatggaatacaggtgttcccccggttgaacaagaaaaaagagcccctgaagtcgaagaacgagcggcattcccgctgtcctcggaacttgatgacctcgaggaaggcccgatgaagagctagcctgtcgctgttattcattcattcttcttaggttcttttgtatgtgttcccccccacaatgtccgccagtccagtcctcaaagctatcgacaatcttgttaattttgccccttgcctgctgggtggagttccatcataggtgatgacgaccccggccggccggccggcctcggcgtagatgaccaccacttaggaaatttgtcaaggccgatatgggccgagccatggtgattcgtgatggctgttgttatagacgacaacaaattatacttatataatggaatacaggtgttcccccgttgtagcatcccggtgaaaaaaaaacctcggccgcgaccacgctaatcactagtgaattc

SEQ ID NO: 30857 - DNA, 700 bp, Triticum aestivum
  unsure (1)..(700): unsure at all n locations
  Clone ID: PAT_TA_30857
gcctcctcctcttcctccccgctcgtcgtctgtctcccaccgcgtctcctcctcctccacccccgacccggcgaccaaccccgcgatccggcgagcccgaagcgccagcgatggggttcgtggtgacctccgccatcttcttcctcgccggcttcatcgcctgcctcttctcgctcctctgctgcaaccgcggcgcctccaccaacatattccatttgacactggttattaccgctacagtttgttgttggatgatgtgggcaatcgtgtacctcgcccagatgaagcctttgatcaaccccatcctgagcggcgagtgagccctgccctgccctgtcatgtgagacaacttaagtatccactgttgaatgtatcattattcggctcgagaacctctattcattttgttgccgccatgataactgaaattaaaagaacctgctgtgagattttgctactccgtccgtcctccggagaacacttccgaggaggcacgctgtgattagtgtatgcaaattgtattatatacacaacaataatgatgattctgtttatccaaggaggcacgctgtgattagtgtatgcaaattgtattatatacacaataataatgatgattctgtttatccaaaaaaaaaaaaaaaaaaaaaccatcccgctcccccttttcgcgctgccccaagggctcanagctagctag

SEQ ID NO: 30858 - DNA, 816 bp, Triticum aestivum
  Clone ID: PAT_TA_30858
gaccggtcccgacggccggggacggacatcgcggcatccgcagtccccccagcccacaccttccaaccaagcaccaagctccaccgccgtcgaagcacccatggcacccaaggcggagaagaagccggcgccggagaagaccccggcggggaagaagcccgcggcggagaagaggcccgcggccgggaagacggcgtccaaggagggcgggggcgagaagaaggggaagaagaaggccaagaagagcgtggagacgtacaagatctacatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcgagggagatccagacctccgtccgcctcgtcctccccggcgagctcgccaagcacgccgtctccgagggcaccaaggccgtcaccaagttcacctcttcttaggcttcatccttgtatcatgagttgatggcggtgttctgtgtgtagttagcagtgcgatgttacaatctctgtaagaattgtgctgcttgtgggtctgaagatgttgtcatgttgctgtctaatttattgctcaatcgtgtgcttgtttagtgatgttgctgtctgaattattttttaagggtcttgctatttattcaattttggctgctaaaatctgctccagcccctgctaagtctgcacctggtaccctctatatccgttactgtgtctcgattgcctgcgcgtacattca

SEQ ID NO: 30859 - DNA, 631 bp, Triticum aestivum
  Clone ID: PAT_TA_30859
cccacgcgtccgattttgtcaaccacggacaatttgatcttgatgacccatctggcagaaagcgctcgtttgatgaccgttttgtcgaggcggcctttggccagaacccatcctcgtctatcacgtcaagaccaatggcggattatgatgttgacagcttccaacatggccacaatacaacctcgcactggaggagcagcatcgacggtgtcttttacaatcataacgatacagcactagacgagctaaggaaaatactttccgtcgtggaacgcggcatgggcctactgactgccgagattgatcggatcaataccgccatacggtttgatcctaccgccgcctaagtcgtcccatgtgggatggggtggtgcgttttacgccgacgtacaaatatcgatttttaaaaagagtcgcccagtaactattcttacttaacgactcgaagaggggatcatcaggtgaacgtaggcattggaagagggactggtttgggggtgataaaaaagggctctgtttaaaggcgttatcaaacttggaatacgtatacccatgttgctatggagcaatatccagcacattcctactatattatagctttgatgagaatataacggagtattttgatttt

SEQ ID NO: 30860 - DNA, 430 bp, Triticum aestivum
  Clone ID: PAT_TA_30860
gaagaaaacccacctccgcccgcatcgcacctcccggacgcgtgggcggacgccggccgaggaagcccccgaattcagaggagaagagaagagaagaggaaggggcagatctatcatctatgggcaactgcaagagttcatctcgtgcactgctaggaaaagcccatgttgttccggatgctgaatggaggatgcaggactttgtaaagacccatgttccggatcctgaatggaggattcatgacttctcatcgctgcttgagacgggagctaagtcagcaacatctgccactttttactgctctgggtataactggcagctgcaagtgattccaatgcataaagaaactggttctgaaacaccatatgttgctcttcatcttatgacatccccagaaaggatggtgccaggtcacacgatgcatgtggt

SEQ ID NO: 30861 - DNA, 424 bp, Triticum aestivum
  Clone ID: PAT_TA_30861
cccacgcgtccggagaggagaggactggtgactggagagcgtggagaggcaaaccccctccgggaccccgacgaacgccgacgaacgccattgtgagaggagagaagaagaggaaggagcagatccatgggcaactgcaggagttcatcccgtgcactcttagggaagacccatgttgttccggattcagaatgggggattcaggacttcggaaagacccatgttccagtttttgaatggaggattcaggacttctcgtcactgcttaagactggagctaagagcacaatatctggtgcttttcactgctctgggtataactggttcctacaagtgattccaatgcataaagaagctggtgctggaactccatatgttgctcttcgtcttatgccatcccaattgagcttggtgccaggtcaca

SEQ ID NO: 30862 - DNA, 1176 bp, Triticum aestivum
  Clone ID: PAT_TA_30862
cgtccggagagagagagagagagaggagaggaaagtgaggggcaagtttgttcctctttgtgacttgtgactgtggagcgcggagaggcggccatccccttctccttgacccgattaaaaccccactcccctcgcacctccggctccgggaccccgacgaacgccgaggaagccactaggaggagagaagaggaaggggcagatctatgggcaactgcaagagttcatctcgtgcactcctaggaaaggcccatgttgttccggatccagaatggaggattcgggacttcggaaagacccatgttccagatttcgaatggaggattgatgacttctcatcactgcttaagactggatctaagagagcaacatctggcccttttcactgctctggttataactgggacctgcaagtgagtctaatgcataaagaagctggtgctggaactccatatgttgctcttcgtcttgcgtcatcccaactgagcttggtgccagctcacacggtgcacgcagtgtttgagttgtcaatatgcaaccatacaaaaggaatgtactgtggatgcaaagcgtttacctaaaagcagctagctacaactttgacttcaagaatacctactcgaaggagcgttgcttgattcctcttcaggagctactgaaatcatctgcttttctagttgatgatagctgtgtctttgctgtggagatattgaagattgatgtctcttctcctgaaaagaaggctgttgtggttcagaagaaggctaccatagttcagaacctctttgtccagagtaagggattcatcaaagggacatacacttggaccatgaacaatttccttgaattggacttgaagcacttcatccagtctcctacatttgaagttggtggacagaaatggtacatcggcatgtatccgcgtggtgacaagtacagcacggattgcctcagcttgtacttatacccggatgtctcggatgagctccaactcgagtccaagaaggtggctgtaatgactctgtccatcctggaccaaaagaatgggaaacacttcactagaacttcaggttcaactttccttagcaagtatcagtgctactgatgtgtgattcaagcagctagtgtctgtaacctgatgatgattgcagttgatcttacttttgtggtgatcgc

SEQ ID NO: 30863 - DNA, 1607 bp, Triticum aestivum
  Clone ID: PAT_TA_30863
cggacgcgtgggctttgtgacttgtgactgtggggggcaggggggaggccacgcccctcctccttctgttaaaaccccacccccctgccccccacctccccctccgggaccccgacgaacgccgagcaagccattgtgagaggaggagagaaggggagggggcagcacctttggacaccagtaggagagcaggatgggcaaggaaggggcaaatctatgggcaactgcaagagttcatctagtgcacgcctaggaagggcccatgtcgttccggattcagaatggaaggatgcaggacctttgtgaaagattcatgttcctgatttagaatggatggattaatgatcttctcatcgctgcttgagacaggagctaagtcagcaaaatctgacgcttttcactgctctgggtataactggtacctgcaagtgagtccaatgcataaggaaactaggttctgaaatcgccatatgttggctctttgtcttaagacatcccaagcaagcatggtgccaggtcacacggtgcatgtggttttttgagttgtcaatatacaaccatacaaaaggaatgtactgcggatgcaaagatacctacaactttcatttcaagaatatctactcgaaggagcaatgcttgattcctcttcaggagctactgaaatcatctgcttttctagttgatgatagttgtgtgtttggtgtggagatattaaaaattgatgtctcttctcctgaaaagaaggctgttgtggttcagaagaaggataccacagttcagaacctctttgttcagaagaaggggttcgtcaaagggacatacacttggaacatgaacaatttccttgaactggacttggatcactttgtccgttctcctacatttgaagttggcgggcataaatggtacgtctgcatctatccgcgtggtgacaagtacagcactgattgcctcagcttgtacttatacctggatgcatcggatgagctccatctcgagtccaagaaggtggttgtaatgactctgtccatcctggaccaaaagaatgggaaacacttgactgcaacttcaggtctcttggtgtttacgggtggacgcggctggggatgggctgatttccttggactcaagaaactgaaggacccggcgggaggctatgttgtgggatcgagctgcgttgtgaaggcggatctcactatcgttggttcatccaatgatggttagatgtttacctcatggcctgatggagagataatgcccttgcatcctacttataactagacttctatttgagataatgttgtggtagcactactaaaaacttgtgggatgatttagtagtaatgagctggatttgagacgtgagatgatttcacgcatatatttctagatatatgtatcgaacagattatgtcatcggaagtacttctatatgcatggatgatgcaactatgtcggttagcttgtttcgctacatggatgtttggttcagctgaaccatgttatctctcgcttggtttttgtgcatcatggatgtccccagttgatgaatcttatcaaggttccatgtaaagcactttgcttctatttattttgagaaggaaggt

SEQ ID NO: 30864 - DNA, 515 bp, Triticum aestivum
  Clone ID: PAT_TA_30864
ggcctgcaagctcgcccccgcgtccgcagaaggtctggagagagaggatttcattgcaaaacaaaaagatggcagcaattgaagacgactcgtgcaggagggcgggctcgataccgttcaagtgggaggtctgtcctgggacgccgaagcacacgaggagcgcgagcgccgcggcggcggtggcggcatcgcctgccaaggtggcgcccaagctgacgctgacgccgcctccctccatggcgtcctcgccatcgccgtattaccaccactcggcggcttcgtcgcctcgtgtcacctccgcgcgctcggcgtcggtgtcaccttcccggcgccggccctacgcgtatgccggcggtcaccgccgagcgccgcccaccgccttcatcgacgccgcgcctcggccagccacgaaggagtacggcagccccgcgcctgagccagacacggcggcgtttgggtgcatcgctctggctatgctccggaggaaaggcagcaagtttggcgccggcctcgcg

SEQ ID NO: 30865 - DNA, 1499 bp, Triticum aestivum
  Clone ID: PAT_TA_30865
ccacgccacgccacgcagacgcgatcacagtcctccccgcaccaccgatacctagcgccgcctcgtcccccgccgtcgacgcgcctccgcgagacgggaccccgccatgccgatctcatcctctctctccgcgcgcctcggccccggtcccgctcccgcgcccgcacggtggggcccttacgcccgcccctccgaaccccgcaggaccggcgccggaagcggctgcgccaaggcctcccgcccgcccctccgcctcgaacccgcgacggagagactcctcgggcccgcgcggagggctgaatcccgcggatcgagtcgcggcgccgcagcccctacacctgcacgacggcggcttggagacctgaagaagtcggacccgaagactgatcccaagccggcggggacgaatccagagccgatccaggagccgcgcgtcgaggagagccgtggctgcggcggtttcgctttcctctgcgccctcgctggacacgaggaggctattactggaatctctatgccgatggggtccgacaagctctactctggcagtgccgatggctctgttcgcgtatgggacggcaactctggcaaggtagctgggctatccgctctcgggattcctctcagactctttatgctcggttcacttttggggtcgtgtctgcgttgattcctgcattgcctctgctggttgatttctgctgcctgatcaattggggagtaactctggttgcttgaggtggtcgatgtgccgatgggctcagatagtgcatcgcttatgatggttgatgtgtgctgactgcttgatcagcgggggagctcctctcattcctcagcgcgtctgatgtacccgttgattcagatcaggttgtcatttggcacgcctggggtcgacgacatgtcagattgatttgccttggaggcctttcgcctgcttgtggtaatcagtgtccaccggatcagtctcaggaggtgatcaggctggttgactgacaggcaaagctctctggggttaaagttgtactctcattgccagacggccatgcatttaatagcaagaaagaaaaagagtaaaaaaaatgaaaagagagatgagctttaaggagagaaggttcttcaagaaaatggagaaactttatgaaaagattgctgtgtagtagagaaaaaaaggagagagtttctaatctactatgttgccctttctattcttaatgtttttgcaatagtgcgttgatgtcatcaagataggagggaagattggttgtatgatcactcatgacaagtgggtatttattggaatcccaaaatccgtggaggtattctcaattttactatgagtgcaagtcaattttatgctatatattgaagcgctattgggtgttgaactattgttctttgttgttccgatggcttctaggcatggaacatacagacagggatgaagctaagtcttcaggggccttctgggcttgtttgttccatgactatcaaggatgaga

SEQ ID NO: 30866 - DNA, 451 bp, Triticum aestivum
  Clone ID: PAT_TA_30866
attcccgggaccacgggtgctggtcatgccgtcgccagagcagagcggaggaggccgatgcagggtcgaggaggggcacgagtgagggtcatttggttgtactgcatctgccaaagcactattgagacaacgaatttcagctatattaggagctgaaccatattaagtatgtgcatcctgggtggaatgctttctgttcatgagctggcctcccagcatgtactgttgagaaaagaaaagaagggagctttcaagttcttatgaaaagcaagagagcttctaagttctacacactagagctggcgtacacgcgttctcagagctcatgtccagggcttcatcagagctattttctatgctggaaacctaaaacaacaaagattttcaatccacccagactaatcaaaatttgtctaaagtggaacggatggtcgtcacttttgactaagct

SEQ ID NO: 30867 - DNA, 1121 bp, Triticum aestivum
  Clone ID: PAT_TA_30867
cggacgcgtgggtccggacgcgtgggcggacgcgtgggcagcagccgcagactcagagtcctttcaggttgcagcagatgtcttcttcagctgcacagacatatgcggatcatggtctaaagcccattctgggaggccgaaccccacctgatccatacggcttgttaggattgctgggagttataaggatgaatgatcctgatttgtcatctcttgctttgggaatagatttgacaaccttgggtttgaatttgaattcaccagacaatctgtacaagacatttggctctccattttcaaatgaaccagcaaaaggagaacccgaatatactactccagcttgttatgtggctgagcaacccccagcactacagcctatgcattttcagaagtttcagacactcatactgttatacatattctacagcatgccgaaggatgaagctcaaatatgtgctgccaatgaactatataatcgtggatggttttaccataaagaagcgcggcaatggttcacaagaattcctaacatggagcctcttgtcaaaactcctacatatgaacaggggtcttatgccttctttcatcaaggcaattgggaaacagtccgtaaggataactttgttctccattatgagctagtagagaaaaggcctagtctcccttccgcgtcccaaattgttaggtgaaaattttctgggtacctcctgactctagctttcttgtacatgaatggagagccttctttataaacatagtgaagcgacattgccctaatttgtcaaggccggctatgtagtgaatcagagagcaccatgtcatgtctgacacgcggagaggaggcggctgcggaaggaggagaaaatgcctttgtaattacagggtatagttaggaaaaggatggcaccgtcgttaaactttaggcctagcttcttggtacatcattcggggagtttgtctgtaatgctccttgacaaacagtttcggagcagtcagtcagtctgcctgtttctagatcccaacgcagatgtacgcacctacctttggatggatggatcatggagggttgcttccttaaattaattcaacggaacaaaacaaacaaaaaaaaaaaaaaaaaa

SEQ ID NO: 30868 - DNA, 600 bp, Triticum aestivum
  Clone ID: PAT_TA_30868
acttgccagcaggaggaaatccaaccccgccgccgccgccatgagcgccatgaagttctgccgcgagtgcaacaacatcctgtaccccaaggaggagaaggagcggaaggtcctcctcttcgcctgccgcaactgcgagcaccaggaggtcgcaggcgacaactgcgtctaccgcaacatcgtgcatcacgaggccggggagcgcacgcaggtcctgcaggacgtcgcttccgaccccacccttccccgcaccaaggacgtccgctgcgccgcctgcggccacggcgaggccgtcttcttccaggctacagcaagaggggaggaggggatgactctgttcttcgtgtgctgcaacccctcctgcggcaaccggtggagggagtgaacgattcacatctccttcctgcggaagctaccgtcaacccgtgccctttaggatcatgctctggaatttaggttccgacagctagccgtcttgttagagcacaagggagctgaacttgtgaaacatataattgtggtttcagtacttgctcgtgaccatgtacttaatttataaacccttattctctaatcacattttataggttggttcttgcc

SEQ ID NO: 30869 - DNA, 1042 bp, Triticum aestivum
  Clone ID: PAT_TA_30869
atttcacgcaccagctttggatttgggagccagacggacaagaggagaggaggatcagcggggccgagttcatcagcctgatcggaacgaggaagactttgaggggttttggccggccggcgatcatgctcatcgaccatgaccgatgtattccagggctacgagcgccagtactgcgagatgtggggctccctctcccgcaaatgcacgggcgccgcctcccaggagggagagaaactgaagcagaaggcctcggagatcaaatccggaatcgatggcgccgaggcactgataaggaagatggatcttgaagcaaggaacccacgcgtccgcccaagcgtgcgcccacgcgtccggccgggcaactggcgaaactgagagagtacaagtcggatcttaacaatctgaagggggtgttgaagagaatcactgctggtaatggccaacaaggggcgagagaggagttgctggagtcaggaatggcagatacgttggtggtatctgctgatcaaaggtcaagattgctcaggacaacggaaaggcaaaatcagacaactgataggatcagagatagccatagaactatgctggaaacagaagagcttggagtctccatcatgcatgacttgcatcagcagcgccagtctcttttgcatgctaatgatacgttgcatgacgtggatgacaacattggcaagagcagaaagatcatgggggccatggtgagaaggatggataggaacaagtggattatcggcttgctgatagcccttcttgttttagcgatcctagtagtcctgtatttcaagtttgtgcactgagggattccttgccattaccatatgactgcacttttctatgccaactacctttacatttttggtgtgtttcacactttccatgtcatttttttggtttggttttgcagaaccatttaatgtggccgtgtttattgtttttcctataaaaaaatgttagatgatcgacctcgctgctcggtaccgcctgccgagcgtgagggtcgggcaactggcgaaactga

SEQ ID NO: 30870 - DNA, 1045 bp, Triticum aestivum
  unsure (1)..(1045): unsure at all n locations
  Clone ID: PAT_TA_30870
ctcttcccccttcacgtccgcgtcctcgcggcgtataatcctttctttttctgacaagatccaaatccaagtgtacagatcggccttttcgtgtgcaagggaacgctacaagcctatccggatcggttctgctccggccggccagcggcggaggttgaaatcaagaaattcccagccgcactagagggaaagcgcggctctagggctgccgccgcgccgtaccttagcgtcaccgcgggcgcctcaatcacgcctccacccccaccccacctcaccccctcctcccgcctctcacgcgcgtcgccgttcccgttctatctcaccgggacatcgtgttcctgctgtcttcgccccgtcccagtctttggccatcgaggttgggcttcccaaataatttgtctcttgctgcatttacctcgtccgtccttggaaatggcagcaccgaagcccattactcgccttatttcccatgtcattcttgatttggatggtaccctcttaaacacagattgcattgtaagccaggtgctgaaaccatttattgttaaaaatgggaaaaagtgggatagcaagaaagctcacaaatttgtcggaaagacaccttatgaagccgcagctgttgttttagaagattacggactcccttactccaccgaagagttcctctcattgattaatccaatgttcagcgagcaatggggcaacataaaagctcttcctggagctaatcggttaataaaacatttgaagagcagcagggtgccagctgctttagcttccaactcttcaagatcaaacattgagtccaaaatctcgtgccagcaagggtggaaagagtatttctctgcaattgttggtgcagatgaagtagagtcaggaaagccatccccagatatatttctggaagctgcaaaaaggatgaatgctgatccttcaaattgcctagtaattgaggattccgtgccaggagttacggctggcaaagctgcaggaatgcatgtcatagctgtcccttcagtacctcggccgcgaccacgctaatcnn

SEQ ID NO: 30871 - DNA, 539 bp, Triticum aestivum
  Clone ID: PAT_TA_30871
tgtacggacaccgaagccttagaagctttcaagcatagcgttcgagacgaatggcttgccatacacctcggtcaagaaaagccgagaacaatggtagcattaacaagcctcatgacccgtttttgcgcgggcgaggacagctggttagcccgatgcggcaccagcgactcaagtacatccgaagtcagggatggaaacgggaaatcatgacgcagcaagaataagcgctagaataaagaagacagcccgaagagccgggcggtaaacgccggatttagaagctctcagccagggcagcagaagccgccctgcaaaggcaacagagacgaattgtccagcctaaacaaaattctagaccaaatatgtcagatccatagcaccccggataaacctgcaaatcatacccacagagaatgttgggtcttcaaacagtccggcaagctcaacgccgaacacaaggggcaggatacaacaagtgaagacgaaactagtagaaaaggggcctttagtcccggtccaaaaaaaaaggcaggaatccc

SEQ ID NO: 30872 - DNA, 702 bp, Triticum aestivum
  Clone ID: PAT_TA_30872
cccacgcgtccgctttcccctacctccatcgctccaccctaggctgcgcggccggccggaacccccgcgcgcctctctacgccaccgctcttcggccctgccttctccgcggccgagatcttccacttggttctcatggacgacaagagtgaaaaggggaaagagaaggatggctctgcttccactccacccaatcgccgcaaggccggacttaaattttcacccaaggtgcctactaagaaaacaccaaaaattgtccctaagatggaaccagaagaggagagcgagcttgacccaattgataaggagttactgatgaaacttagaataccacagagtcaaggtgctctcgaaagaagatccaaggctgagaaaagtgaagcctgtgttcaggttgcatttggacaagtgaactcttcaactgcaagatccttccccaaccctaaaagttcttcatcagttaaacaagagcaggaggtaaacctttttagcaagtatatgatgtctggcgttacgtcttctgctgcaaagttacccaaacagttcactggacctcaggactttacccatcacagctacaactatcctcctattactctccctctgaggaggccccactctgcagatccagaagattttgacaaagacgcgttcggagagttttcttccagcagaacacaagatggtgaattaactgcagct

SEQ ID NO: 30873 - DNA, 859 bp, Triticum aestivum
  Clone ID: PAT_TA_30873
ctcgtgccgaattcggcacgaggcccgacccggcctacttaacccgaaagattttgctgggctgcttcgtgagtgaagccgcggctcccgtccgtgccggcggcgggcggcgcgacggcgacgcgcagggccgccccccagcttctgcgtcccggggcggcagaacctctacgcatcggacgaacgcaggggctatctagggagaaatgctagttgtacaaactagtgttctagttgcatccacattgtctctttcagcaagccaagatctctcgttcatttgatgaggggagctgtgtggtgctcaatctattgcctaagccgggatatattggcacctgaaagatcctagcttgcagctcgacggacgggctggtacagaaggggacagggaaaggggaagagacaacgtgtgtgtccaggaatattcacccaattgagtgactctacgaggctgaagatgtaaaatgttcctgcaaccatcttgtcctacatctcgtccatttgttgtccacccagcggcccataatcaactggtgcatccggtgcacccattgatgcgttgcacatgatacactcttctcggcactcccttgccttctgtatgccaaaggatttttcttcttctgctctgatgatagtatattattgtgtttctttattaatttttattggaccatttggaatgaaccccgtcacaagagtgctcctccaaccgtctcaacaacatcaaactcgaaccgaaactttgggttgccactggtgccaacaaacaagggaatataataccgggatagtgatgatctttttgtaataagtggcatatgtcctcatgtgcatagtgtaaaccaaagtctgt

SEQ ID NO: 30874 - DNA, 1277 bp, Triticum aestivum
  unsure (1)..(1277): unsure at all n locations
  Clone ID: PAT_TA_30874
cgccctccggcccgcctgctgctccggctcttgcctctgaaaaagaaagaacccacgctcaggcgtctgctggacacgttaaagaaaaggaaaaaaagagaatcatccgccggaggagcgagcggggatcggagggagccgggagcagctgggatcgggatcctctctcttccttgcattgatggcttccctgggcttgcccggaccctcctcctaccacgacctctgctgctacggggcaggaatcgcagggaacatcttcgccttcgtgctcttcatctccccgctgccaacattcaggaggatcgtccggaatgggtcgacggagcagttctcggccacgccctacatctactcgctcctcaactgcctcgtctgcatgtggtacgccctccccttcgtctcctacggcgtcgtcctcgtcgccaccgtcaacaccatcggcgccgccttccagcttgcctacaccgccgtcttcatcgcctacgccgacgccaagaaaaggctcaaggtgtccgtgctgctggctggggtgttctgcgtgttcggcctgattgtgtatgtcagtatggcgctgtttgatcacaagcctcggcgaacattcgtcggctatctcagcgtggcgtccctcatattcatgttcgcatcccctctgtccatcattaatttggtgatcaggaccaagagcgtggagtacatgcccttttatttgtcgctatcgatgtccctgatgagcatgtcgtttttcgcatacggggcgcttctggatgacttcttcatatacgttcccaatggcatcggcacagtcctaggtgtcatgcagttgttgttatatgcctattacagtagaaaaggatcgagagacgaagccagacggccattactagtcacacatacatgagcgtgcaagggaaacaagatggatgattcttagggcatgtacagtacagccatcgctgtaagcctacagcctgcctgcatctcagggttgaggttctctgcattattttgcttatgtaaaaaggtggagtagggctagttttaaggtcctcgagtcatttgtttatattgtttttccggtgagccattatttgtttatttgatgctatgtacggcgagcattaatggatcactgatgtgcagacttgatggatgtatcatgtatgtgatctgtacaagtgtagaataccagtgatacccacttccacatgatcccatgctcccatttgaaaaaaatattaattttaaatattttccagaaattcnggaaaaaagta

SEQ ID NO: 30875 - DNA, 432 bp, Triticum aestivum
  Clone ID: PAT_TA_30875
agtcacggatggccggcagctcgagcactcctggagtttgcagctgccgtcgtagcagtagctacagccctgtcggctgccgtagacgccctctcggtggaagcggctgcgctcaatgcggatgtggcggcactctcggtgtaggcggccgagctcttggtgcaggcgcggcgctcgggggggggggggcgcggccatcgtactggccttcacgaagcgtttccacgacgtcatctttgcaagaagggggtgcgggaatggggattgggattcatggattcgggggttgccggaactggagcagacgagccggcgaagcttaaggagggagacttaaatagacccagatattttcatcgcaaacggttcctagaaaacaattgtgtgtgatgttgtagatatttttttattagctgtgaaagacgaatttgg

SEQ ID NO: 30876 - DNA, 1349 bp, Triticum aestivum
  Clone ID: PAT_TA_30876
gtggtttgtgttggcgtgtgctgttggctcgctggtgggtgtcttcctccgtgtggttcgcccgcttgattggtccatttgcatctccttttattagccctaattaagtttttcagtattgaagagttgaaaaaacaaacaaattacatgggtgaaattcaacgaaagtcactcaagtaggtgacaccgccagtgcaaaaaaaaaagtgcacaaacaaaaataggacgccatgatgattcgttggttcagtggttgaggaccctgcagttcctcctggatctctccctgttaaccggtctttcacttcaatagcttcccatctttgaccatgtccttgttgaacttggcttcccaactcgcccgggtaatgttggcgctgtcgcgctcctatctcgggtcgtcgccgggtcggagggaggtgggcgtcggagcgcaaaatgcacctcgtgcgcggcatttcatgtatgctggcatccgaagtcaagagcgcgttgtgcgccaggaggttcttgtagtattggttgtcgagcgcgttgggggtcaccacgtcctggttcaccgtggggtcgttgtccgggcttgggctggcggggcactgcctcctcagcacgttggcgaagccggtgttgatgtcggaggggacggcgaggcgatcggagacgaaggacgagcaatgggacacgccgatggtgtgggcgccggagagcacgaccatgtcctccgccggtgaggcccttggcggcgaagctggcgatgagctggtcgaggttgaagaccggaggcgggaggttgtcaagggcctccgtggagttggaaacgcggccgtcgaggcggccggccggcatgttgatcttaagcgtcaacgtggtgaggaagtaggccgcggcccggccggcgaaggtcgatgacctcgagcacgcgaaggctggggaagttgggagggctgagcttctccggctgcgggttggccggggtcgggtcgaggaggacggagccgtcgcacccctggacgaagcagtcgtggaagaacatgcggatgaggccggcgccgatgccggcgttcttgtagacgaagcgcttcacctcgtccctcacgatggcctccacgcgggggcacgtcttcttgtagtagcccacctgcaggccatggcacgccgacgacgacaagagcaatgcgcatgtcagcgcgacggatagcttaagccaggcggcggccattgtcacctcaagctcttaactaagttatcagcctttgtgtactagtactaccaatatcgagagtgtgatcggacgcgtgggtaatacgtgcaacaaaccccgacttctgggaggggcgcatttattagat

SEQ ID NO: 30877 - DNA, 610 bp, Triticum aestivum
  unsure (1)..(610): unsure at all n locations
  Clone ID: PAT_TA_30877
gaattcactantgattagcgtggtcgcggccgaggtgttttatgcatcaaagactgatataaaccatgttttgatataaacttgcattcaaatatttaaattggaaaacatgttgtctgcaatccacacatgaacgatatatgcgtatatcaaacaagttcattaatttgactttcaacatgttcatggagtactataatactatacaacatgctactcgattgaggggttcaattttggatttagttcactattttgacctaagtgaatgagctatttcattgaatcgagatatttcattttcggtttgattcgcgtttttgagtgtgtcaactatttttcatatagtaaaccgctagcaacgagcatgtaaaaacacattactcccgagcatcatctctccatctaaaaaagaagtggcaagctaatatttcaaaatttgattcccatccacttggtaaggtagacgtggcttgccccggccctggttccagatcgaacggtccggctaccnctgccggtggaatcgctgagcaaataaatgggaactgaaatacgtccatgtggncataatgcagtggatatgcagtgttttnccagtaatggagan

SEQ ID NO: 30878 - DNA, 1336 bp, Triticum aestivum
  unsure (1)..(1336): unsure at all n locations
  Clone ID: PAT_TA_30878
attcggcaccagatttctttcggtttcgaatcccctggggacgagctcgcgtcgccttccccctccgcccgccccgtcgccatccgcgcccccttcgaatctgcaggcggcgccgcctggcctcgttgtcgccacgggaggcgcgcgggatggggcggttgtttgcggtggacgccgcggccgcggcggcgctgaacggcgcggtggactggtggaaagatgtgaacgactcgccgatgtggcaggaccgcatcttccacgccctcgccgtgctctacggcgtcgtctccgtcgtcgcgcttgtccaattgatcacaatcgagtgtagggtgcccgagtacgggtggacgacgcagaaggtgttccatttccttaacttcatcgtgaatggcgtgcgggctatcgtgtttgtgctgcggcgaaacgtgcagctgatacaaccagagatacttcaacatgtggttcttgacatgcctgggcttgcgttcttcactacatacgcgcttttggtgctattctgggccgagatttactatcaggcacgtgcgatgtcgactgatgggctgaggccaactttctattggatcaatggggtggtgtatgcaattcagataattctgtggttggttttgtggtggaaaccagttcgaattatggtcatattgtccaagatgttctttgcaggcgtatcactgtttgcagcttttgggttccttctgtatggtgggaggctattcctcatgttgcaacgttttccccgtagaatcaaaaggtagacggaagtaattacaggagctgatcttgatgttctgagccatccgattctgaatttcttttattacctgctggtcgagatcgtaccttcagctatggttctgtttatactaaggaaactgcccccaaaacgtgggatcacgcagtaccatcctatccattagagcagagcagccctggtaccaggctggtacagacaaatgcttcttacagagttggtaaatacaggagaggcaatgtgaagatcaccgcacttgcactgaagcttgcccaggttttaaatgaggaagcctttaggatttcaggttgctattgcttgtaaaagagatttgcaatgtagttcaaaaaaagaagagatttgcaatgtcatgctgtttacaggtctagaaaaatgcaagttatataatgtatgtatacctttgttcttctcaagaacattcaccatgtagtctgcaccgcgccacagcaatcgcggccgggaaccgcatatttgatttttgacccaccttaagggcgggccggtaccaattcgcctatagtgagtcntantacggcgctcacg

SEQ ID NO: 30879 - DNA, 934 bp, Triticum aestivum
  unsure (1)..(934): unsure at all n locations
  Clone ID: PAT_TA_30879
gtgcaagcaagcaaattagtttagcatgccgtcccttcgggcggccatggcggacggcgccgaccgcgtcgaggccacgacgatcggcaacgacaaggagaccctgctgagcctgctccgcgccaagtcggagcggagcgccgaggcggaggagaaggtggagtgggtgcgatcgcagatggtcggccgcgacgcagagttcgacacgccgttcggccgccgcgccctcgtctacgccgaccacaccgcctccgggcgcggcctccgctacatcgaggactacatcctcacacaagtcctccccttctacgggaacacgcacacggaggacagctacgtcgggagcaggacgacgaagatggtgaggacggcggcgagctacatcaagcggtgcatgggcgccggtgccgacgacgcgctgatcttctgcgggtccggcgccacggcggcggtgaagcggctgcaggaggcgatggggatggccgcgccggcggggccgcttctgcgggcgaggctgctcgcgcagctgcgcgcggaggagcggtgggtggtcttcgtgggaccctacgagcaccactccaacctgctgtcgtggcggcagagcctggcggacgtcgtggaggtcggtgccggcgacgacnggctcgtcgacctcgccgcgctccggcgcgcgctgggctcccccgagcacacgaagcggcccatgctggggtcattctcggcgtgcagcaacgccaccggcatcgtcaccgatacccgagcgatcgcgcgcgtcctgcaccagcatggggctttcgcctgcttcgactttgccgcgaggtacgtccacgtagccaatcctaatgttttagtcttatattgtgcaccaacaccatgatcgaccgaacatgttgcgttttactcgcatttatttggaaacaatgtacttttttgc

SEQ ID NO: 30880 - DNA, 704 bp, Triticum aestivum
  unsure (1)..(704): unsure at all n locations
  Clone ID: PAT_TA_30880
ggcgcctttgtgtccaatttgtgtccaggctcccctactctctcccccgccactaccccgcctttgccttctgtctgtctctgtctctctcttgaagctgaggaaaggtagctgcatgctctccttgcctgcaggccggcgccatggaggccaacaagcctagctactatctcttcgtcttcgtcttcgcggcgctcctcttgtcctctatggctggagttagcgcagaggaagctgctgatgaatgaagatgatgcaggatcgacgatgcagcaggaagacgacgaggtgttggtggtggtgcacggcgggagaatcctcaggcaggtgaagacgaacgactacgggacctatgactcaactccgaccatggccaagcctcacttcaaggacatacctaactaactgaccatctacatatatatatgagatcgacggctggatatatatatactgccgctacgtgcttcaaagatcaagatctcaacaccgatggcagggttaaggctttcatatacatatatatgcgagaatatgatgtgtgctacatattatttgtccctgaataaatcgtatctcatgtatcaatgcacgacacgcgtgtggaacttatatatgtctatatgtatgtacactagttttgtgtggatatatataaaaaaaaaaaaacatccttgtttggtactaaaaaaananaaaaaaac

SEQ ID NO: 30881 - DNA, 709 bp, Triticum aestivum
  Clone ID: PAT_TA_30881
aaagaacaccattgacaaggacggttggctgcacactggagacattggctatgtcgatgatgacgacgagatcttcatggtcgacaggctcaaggagataatcaaatacaagggattccaagtacctcctgcggaactcgaagcccttctcatcacacacgccgaaatcaaagatgctgctgtcgtatcgatgcaagatgaacttactggtgaagttccagttgcattcattgtgcggattgaaggatctgagatcagcgagagtgagatcaagcagttcgttgcaaaagaggttgttttctacaagaggatccacaaagttttcttcgcagactcggttccgaagagtcctgccggcaagatcctcaggaaggacctgagagcaaagcttgctgcaggcttcccaggcagtggaagcacacagtccaaaagctgagtcccatcttacacacacacacacacacacacctctgtccaaaatcatgtaatgttctcaatgaaatggcaacaatattattattacatatagaagggctggctggcacatggtcgtcgattctttcagttagatggctaagttatatgatttgtttgttcgctcgttcgatgatgtgtatcctgtcatgtatagataccaaactctttttgacaacaaaggctgattataatataatgtatactgcttatgatttataccacaagttgaatt

SEQ ID NO: 30882 - DNA, 514 bp, Triticum aestivum
  Clone ID: PAT_TA_30882
gatatacatatcagttactaatcatcatgttcagcttagtcaaatatttggatttgcccatgaacaactgctacttaggaaccagattttttgtggatggagaattagaactcgtgactaagatgcattacacgctgcaacaggttgttttctacaagaggatccacaaggtgttcttcaccgactccatccccaagaacccttccggcaagatcctgaggaaggatttgagagccaggctcgccgccggcatccccagctaggggctgcggccgtcgtccgcttctcaggcactcagccagccagcagggtgctgttatagatcatgtaatattgtttgatctccatgaaatggtcggaggaggttgagtttgttggttcttcctgcttgtgtaatgttgataaaaatgaaatgatatatgtagatgcgttgttgttgaccacaagaacaaggctggcttccaaagggtacaatgtatacttcttttccatcagagaatatcttgtccgaatc

SEQ ID NO: 30883 - DNA, 2368 bp, Triticum aestivum
  Clone ID: PAT_TA_30883
agcgagcgcgcgcacgcacacgcacaaagcagccgtctcctcctcctacacacgccaactaatttaaccagcctggtaggtttactatcttccgttcgtcgattcaccagcggggagctagcacgacgatcattgacatggggtccgtgccggaggagtcggttgcggcggcggcgccggaggtggtgttccggtcgaggctgccggacatcgagatccccaacgagcagacgctgcagagctactgcttcgccaagatggccgaggtggggtaccgaccctgcatcatcgacggccagacgggcgcctcctacacgtacgccgaggtggagtacctcttcctggaggggacggcgccacccgcaacgccccgatggcgccgccccctcctcccccgcctcctcgaccaacccggcgtcgcagctttgttgtcttcccttagggagttcatcaagtacaagggcttccgggtggcgccggcggagggcgaggccctcctcatcacgcacccggagatcaaggacgccgccgtcgtatcactgaaggacgatcttgctgccgaagtcccggtcccattcgttatccaggatcgaaggctccgagatcacccaggatgatatccagaaattcgtcgcaaaggaggttcttctctacaagaggagccacgaaggccttcttcaccggcgccagccccgcagaacccgtccggcaacagcctgaggaggcgcttgcagagcccggctcggcacctgccccgctggtcgccgtctccctcctcggcgcggcgcgcctgggcgccggccaccaccaccgccaaccccttcttcacctcgcacgagacgcaccgccagacggacgcggccggcgccatgctgatcgtcactgaggcctgcgccgtcgacaaggtgctggagtacgcggccgggaagggcctgcccgtggtcaccgtcgacgggaagggcgacgggtgcgtcgagttcagcgagctgatcgccggcgaggagctgcccgaggccgacgaggccgggatccaccccgacgacgtcgtcgcgctgccctactcctccggcaccaccgggctgcccaagggcgtcatgctcacgcaccgcagcctcatcaccagcgtcgcccagcaggtggacggggagaacccgaacctgtacttcagcaaggaggacgtgctgctgtgcctgctgccgctgttccacatctactcgctcaactcggtgctgctggcggggctgcgggccgggtcggcgatggtgatcatgcgcaagttcgacatcggcgcgctggtggagctggtgcgcgcgcacggcatcaccatcgcgcccttcgtgccgcccatcgtcgtcgagatcgccaagagcccccaggtgaccgcatgccgtgctcgcatccatccgcatggtcatgtccggcgccgcgcccatgggcaaggacctccgggacgccttcatggctaagatccccaacgccgtgctcggccaagggtacgggatgacggaggccgggccggtgctgtccatgtgcctggcgttcgccaaggagccgttcagggtcaagtccgggtcgtggcggcacggtggtgcggaacgcggagctcaagatcgtggaccccgacaccggcgcctccctcggccgcaacctgcccggcgagatctgcatccggcggcaagcagatcatgaaaggttacctgaaatgacccagagtccacaaagaacaccatcgacaaggatggatggctgcacactggagacatcggccgcgtcgacgacgacgacgagatcttcatcgtcgacaggctcaaggagataatcaagtacaagggcttccaagtggcgccggcggaactcgaagcccttctcatcacgcaccccgaaatcaaagacgccgccgtcgtatcactgaaggacgaacttgctggcgaagtcccggtcgccttcgttatgcggatcgaaggctccgaaatcaccgaggatgacatcaagaaattcgtcgcaaaggaggttgttttctacaagaggatccacaaggtgttcttcaccgactccatccccaagaacccttccggcaagatcctgaggaaggatttgagagccaggctcgccgccggcatccccagctaggggctgcggccgtcgtccgcttctcaggcactcagccagccagcagggtgctgttatagatcatgtaatattgtttgatctccatgaaatggtcggaggaggttgagtttgttggttcttcctgcttgtgtaatgttgataaaaatgaaatgatatatgtagatgcgttgttgttgaccacaagaacaaggctggcttccaaagggtacctcggccgacctcggccgcgaccacgcta

SEQ ID NO: 30884 - DNA, 398 bp, Triticum aestivum
  Clone ID: PAT_TA_30884
aacttttatctagcatccagtcctacaaggtagggggatgcaagaacagagggacaagatccaagtcacggtctgcaaacacttccataaggggggcaatttttgcaactagaagattaggggggaggtacagagagggaaatcaactagttctaaaactaaaagaagttcatggccagaaaattttggaacaacaccttttacctttttgttttcacttgggaaacttgcccaactatgccaatttttttttgcaattctccagatttattgcctggtcagcacggagaattgcagacacatttgcgttttcaaaaaaatattccccacgattttatgtcttgatttctcgtcctttttactatgtttttcaatgtgcaaggagagcttcccaacgc

SEQ ID NO: 30885 - DNA, 780 bp, Triticum aestivum
  unsure (1)..(780): unsure at all n locations
  Clone ID: PAT_TA_30885
gtgcggcgctcaggcggcggttctgattccatttcaagatttgagcttcactacagcctttgagcgtctttcctcctcgtgtgtgtgtgtgtgtcttgcgctgcactagtgagtgcgtgtgtaggtgagctgagtgcaagtattaccactagatagccacgaccctctggtttcagtagttctgagctaacagttggcattagagccccaagttatgccgaagtatatgccgaaagaaggcgtcgccgacgacggctccaagaccgccgggcagagctcgactgaggaggcgcgtgcggcggacgcgcttgcactgcgaggcaggctaggagggaggttgggtgcgccacgctccatgcgagacgtgggcatgtccagcacctccttccttctcctcacgcggaccaactaccccagttgatcggtcatgatgaaagtcatcatggaggcgcggcatatcactactagggaaaaccttatacacagaatcttagcagcatcgcggtttaaaaacagacgctactgctaattagcagcaacgagctttagaaaagagcgctgctaatgactgagtagcagtagcgctctaggtaaaaagagcgctactactataattggccacnggtgttgcctccaggctagatatagtagtagcgcccttcccgtggacgcgctactgctanagaacttagtagcagcggttttgctcanaactcgctctggtaagtatgaccgcaactaaataagtttagtcccatactgctaagcgaaacaggtgta

SEQ ID NO: 30886 - DNA, 615 bp, Triticum aestivum
  unsure (1)..(615): unsure at all n locations
  Clone ID: PAT_TA_30886
gccggccggtccgggatcccattccgatcaaatcaaggcaacaagccacttcaatttcctcctctgctcaagtagtactccagtatctcgtgtgtgtgtcttgagctgcactagtgagtgcgtgtgttactagtgagttgagtgcaaatactaccattagatagccacgactctcttgtcgcagtagttctgggctaacaattggtatcatagcctcaggttatgccgaagcatatgccgaaggaaggcgtcgccggcgatggctccaagaccgccgggcagagctcggctgaggaggcgcgtgcggcggacgcgcttgcgctgtgaggcaggctaggaggggagttgggtgcgccacattccgtgcgagacgtgggcatgtccagcacctccttccctctcctcacgcggaccaactggggtagttggtctaaggaagtagtataggtcagcagtgacgtggtgttttggaatgacgtaagagcttagctcatttagaacagtaggtcggttcaaactgctatannnnnnnnnaaacccaccccccccccncccccccgggttgtaaagcattcccattcccgatcaaatcaaggcaacaagcccacttcagtt

SEQ ID NO: 30887 - DNA, 948 bp, Triticum aestivum
  Clone ID: PAT_TA_30887
tcgatacaacgcaatcagcctccagtactccgctccggtgcttgtgtgtgtgcgttatagactgcactagctgtagtgctttggtctatcttccgtatagatcagtacaccacgagtagttcagtacaccactagtagttagggctaacaattcactgtgcgattacttagaccaggcaccggtcctgtaccttgcttctgatccacaaattgtcaagcgcacatggtacaaccatcaagttctgggatattagctggcttcaagttttcaagtgcaggcaatcttttaacaaaggatggatgcgagtagtgagatatggtgaataccatggatctatgttaactgaagaatacatttcttcagagaacccattgctgtgtgcagaatatatttcttcagataacgttgaaaaagaacatccagacgaatagcgttgagaggcaatgagcttattttgttatgagttggtttatgtttccatccttctagatttgttctaagagaacggtgtttccatccttctagatttgttctaagagaacggagttgaatataatgaatgatgcgctcagcagacaggcacaacttttgccagtaggttcaacatttgtaccctatgactatgtttccagaactgattgggacattcccccttttctttagagatgaagggatcatttgtactctctctgccatgcctgtgtgcatgattactcagtatactcatgttcattttggtgattctcacagctcgccgggtccgcccccagcagcaccagtctctgccccatcccgccccgagcgcggcggggcccgccgccgggccgcgcgcggcgcggcgaggccgccggaaggcgggccgggggcgcgccgccgccccccacggccctgcgggcgcccgccgcctccgcgcctccgaccaggcgggcgcgcggcggcagcaccgc

SEQ ID NO: 30888 - DNA, 708 bp, Triticum aestivum
  unsure (1)..(708): unsure at all n locations
  Clone ID: PAT_TA_30888
cggttctctacgtcgcgttcggctcgcaggccgagctgagccgggcacagctggaagagatcgccgtcgggttggacagctccggtgtggacttcctatgggtggtccggtccaaatggctcaatccagatgaccggtttaatcagaggttcggagacaggggcaaggtggtggaaggtttcattaaccagctcggagttctgggtcacaaatcagtgaaaggatttttcacccactgcggatggaactcggtgctggagagcatcaccatgggcgtgccaatactggcgttcccaatggcggccgagcagaagctcaatgccaaattcgtcgtggacgtgatccatgtggggctccgagttcggccgaaggaagacgccagcaagggaggtagtgggttggttatgggtggagacgtgcaggcgttggcaagggaactgatcttgggagaggaagggaaacgcgccgctgctagagctggtgagctctccatgtcttctagaaaaaccatggacataggtgggtcctcgtttgaaaacttggcgcggatggttcaggaggtcagtgagacccatgccaataatggtgagtaaatataatcgttgctatgtggttgatgccggctagtcgtgcaggcttagtatgaaactcataattgaggtcgatgtttgtttggagctttaaaaaaaaaaaaaaaaaaaanaaaaa

SEQ ID NO: 30889 - DNA, 1416 bp, Triticum aestivum
  Clone ID: PAT_TA_30889
ccggcacgcgtcgccgtccgcctccaattccctgcattggctcccgtatcaaccatatcgaatccaatccaatcgaatcgccggaggcggaagcgcgcatcgaactcggtcggcaatggcgagcctcaccttgccgccggcgccccctaacccccgccaggacgccatcgacctccacaaggccttcaaagggtttggctgtgatactacaacatttcaaagtatacttgctcaccgtgactcaatgcaacgtggatacattcaacaaggaatacaaaactatgtaattctgaaggaactttctacgtcagtaatatcagtctgaactcatttgacaaccacgagtaagcccagtcaattaggattctccgttctgctggaacgtgatgcgactgttctgaaagaagctcgtaagtgctgaaagtcttgatctgcaaccagctactgatataataggttctagtactccaccgcacacgctgattctggttgaatcattttacccaaaaggccgaacctaactggctcataacattccaaagcgtacatcggggtcacaacagaatatcttactcgcctactgacaacttctttcttctttcgcttggtttatgcatgcctaaaaagtgacaaatgatgagatggacctctggacagctggtgagaaaaagccgggcacagatgcgaaaatggcattccgcatcttcactgaacgcagctgggcacacatggcagctgttgcttctgctgaacatcacatgtatgtttagtcgttacagaaggttgtgaagaatgaaacatctggaaactttgaagttgctctgttaactatcctcagatgtgctgagaatccagcgaagtattttgctaaggtgttgaggaagtccatgaaaggtctaggtactgatgacaagacacttgtaagggttgtggtaacaaggactgagattgatatgcagtatatcaaggcagaatattacaagaaatacaaaaagcctttagctgatgctatccattccgaaacatcaggcggttatcggacattcctgctttctcttgttggtagccattaggctatgtttcctcaccgcacactctgctctgtcgcattactttaccctaaaggcctaaacgcagtgactctacctggccaaaatgtatgacgtcgtcatcactgtgttctggagcttcgctgacaactatttctgctttctcttggtttatgcttgcctaaaatgtgtgtatattatttggatccggggactctagtgcagtggctgctgctggttccatctttcatggcatgtgttatcagtgcagttggtttgatgattgtatttggctttactgctttcactgaagttcacactgttatttaactttattgagaaaaaggagtggcgtaaaaaaaaaaaa

SEQ ID NO: 30890 - DNA, 1974 bp, Triticum aestivum
  Clone ID: PAT_TA_30890
cggccgggcagcggccgtgcccccacctccctttattatgtacacgcctctagtagataccttctggttgcctgttttacttgcgtgtctcaggtcactggtaatgagcagggcgcggtcgcgggctttcgatagaaccgaaggattctgggttcggcgacatggggatctcggggcggttcctcctcctggccgtggcgctggtgatcgccgccgccgcggtggccgcggatgagcaggcggcggaggacctgacgagcgtcggggagaacgcggcgggcgacaagggggccgctgtggcggccgcgctcgggtgggatctggcgccgctctgggaaatgttcaccgctttagaatcccacattccacggagctcccaggacctcaaaagctaggatgatggaatttcgtaacgggacgaggacattggggaagagtctcaggagtactctgctctccagaacgagatcacatctctccagaaatgaggctttgttgctgctgaggaacaggctggcaaggccattcgctagggttgttgagcttgagactagcaccttgaggaagctcaataatcacttctaagcacagagtagccagagaacaacacttgcagctagggctaacaagcctgagaagaagatgcaaggtttgaactggaaagctcgagtcactgcagaaggcaaatggcgagcaaaagcgtatgatccagaaaacggagagtacgcgtaaagttggcggggaggaattgatgaggctgcaattagaagcaacaacgaaggcaaaacagctgacagaggtacatggagcatggctgccaccttggttggtgacacattctgcccaatatttggaggtggtctcaggtcactggaatgagcatggaaaacctgccatggacatctttttgcagaaggcatcagaaaaatcagcacacgcaaagaaatgggctgaaccacatatcgagaccgcgaagctgaaattggttcctgttaaggagaaactggctgtgctaaagaaaaacgcagaaccttacgtggagaaggcgtcagcaaaatcagtggaagtttatgaagcatccagggatgctattacaccccactttgtaaaatttaaagaagtttctgatccctacttccaggaagctaagaagatctctaaaccttacattgatcaagttgctgaggtcacgaagccacatgttgagaaagttaggagtactcttaagccttacactaaaagagcagttcatgtgtatggaacatttctcgagtctgcaaccacataccatcgacaggctcaagcaaccatttcagattacttgcaccaacatgaaataacaaaatcacttgtgactaaggagttggtttggttcctggcttctgctttgctggctctacctgtgtttattatgtacaggcttctagtagataccttctgcacgaagaagcagaagagatcgcctcttaatggtaacggaaacaatggcaataggagacacaagcgccgacatgctgagaagtaaactatcgtcggctgccatgtagggttgcagaaatcagagcatgtccttccctgatgaggctgcgctcctgttcatggtagaaggatggaacgctgtacaccaccagattttttcgttttccttttgccccctattgtacggactctagtttcagcagcggccttatgtatctgcatcttgccgaggtttaatatgggcttaaacctcggcgtttgttaattgtttattgtaactttgttgatacgcttgagtttgtttgcagcgtgctttgctagtttttgttctcgctcatcggcatcctaactatacgagatacggttgttctacaatttatgtaattaaaatccgtacgtgctaaaaaaaaaagcgtttgttaattgtttattgtaactttgttgatacgcttgagtttgtttgcagcgtgctttgctaaaaaaaaaaaaaaaaaa

SEQ ID NO: 30891 - DNA, 993 bp, Triticum aestivum
  unsure (1)..(993): unsure at all n locations
  Clone ID: PAT_TA_30891
cggcgccagtgctcccaggccagcgccagtgctcacagactgacacagggcaagctagagcactgtgctagttgggaagaagagaagagaaggcacgagagggagctaaacagcaaccagcaatggcgctcgttcctctcctcctctcgctgctcctcgtctcctgcgccgcgcagtcgccgtccgcgtccaaggctgccccggtcggcgccttcccgccgcagacgttcgccgcggcgccgacaacggtgaaatcaccgccgcaggcctcctcgccgtcgcaggtgtctgcagcgccgccgacgttctcggccgcctcgccgtcacaggtgtctgcggcaccgccgacgacctcggccgcctcgccgtcacaggtgtctgcagcacctccgacgaccgtcgctgcctcggcgccacaggtgtctgccgcgccgccgaccgtcaccgcctcggcgccgcaggctgcggcggtagctccgccgacaacggctgcctcgccgcagtttgctgccgcgtcagctccgacaaagagcttcgccgctgcaccactcacagccacgtcgcctgcggcgtccactgttgcctctccgccattcactgcaacctcatcgcaacccgtctctgcaccccctctcgcagtgaccgcggcccctccggcgatgccacccaccgtcgccgcgccgcttccggccccagtccgcgtccccatggcaacaccacacccatgggcgccccacgcaatggctcggttcaccctgctcatccctcccgccgcaacgccgatcccgtgaccaccgctggtcgccccaccaacantgcnncccgcaccggncgnccgtgtcaccggtntccngcgncatgttcacctgtaccgntancggatcttcgnnccgagtccgntcgcccncgattnggatcnggntgcncggcngcccaccatntggggcctngaagctgtcgnccaatcnatggnccccaatnnggcttgtcccc

SEQ ID NO: 30892 - DNA, 1457 bp, Triticum aestivum
  Clone ID: PAT_TA_30892
ctctcatcgctcaatccagcggatggtgcttcttgcatgcctgctatgtcgtgcttctgtttcatccgttactcaagctttctatgatctgtttggttgatttctagagggccaaaaggaagtgatggagcacggcgagcaggagcagcacgccatggacctgccgccgggcttccgcttccaccccaccgacgaggagctcatcacgcactacctggccaagaaggtcgccgacgcccgcttcgccgccctcgccgtctccgtcgccgacctcaacaagtgcgagccctgggacctgccatcgctggctaggatgggggagaaggagtggtacttcttctgcctcaaggaccgcaagtacccgacggggctgaggaccaacagggccaccgagtccgggtactggaaggccaccggcaaggacaaggacatcttcaggggcaaggccctcgtcggcatgaagaagacgctcgtcttctacaccggcagggcgcccaagggcgacaagtccggctgggtcatgcacgagtaccgcctcaacgccaagctccacgccgccagcaccagccgcggctccctctccggcggcagggccgcatcgtccaggaacgagtgggtgctgtgcagggtgttcaagaagagccttgtaggcggcgtagtgtcgtcggcgccggcgtcgtcagcagcaaagaaaagcggcgtggagatgatcgaggagatagggtcgtccgtggccgccgtcaccccgctccctgcgctcctggacatgtccggctccggcgcctccttcgacccggcggcgcacgtgacctgcttctccaacaacgcgctggaggcgggccagttcttcaacccgacggtgacgggcggctgcgccacggacacggacaaccacggcctagcctcgtcatactccccgttggcaagcttcacgcagtacggtgggcagctgcaccacggcgtgagcctgagcctggtgcagctcctggagagcagcgggtaccaccgtggtctcgccgacgacatggctccgtgcggcaaccagcagcagccggcggcgtgcaagggcgagcgggagaggctgagcgcgtcgcaggacaccgggctcacctccgacgtgaaccccgagatctcttcttccttcggccagaagttcgaccacgagcccgcgccgtggggctactgaccaagcaagctctccgcatgcaccgcgttcgtggcgaaggatggatcgattattagcgcatttaccggtgctagattactgtaaataagcccgcgagggatcgagctagcaccgttaattagcttcattgtggtgtgatctgtatagttgtagattaatcagcagtgtggtgatttgggggtgtaattagcattattgtattgggatccatcgacatactagtatatttcattatcattttgccaggttatgatcaatcaatcaactaaaa

SEQ ID NO: 30893 - DNA, 687 bp, Triticum aestivum
  Clone ID: PAT_TA_30893
actcgctgtcggttcatcacctctccgtccaccaaaatttaggtcgttagagatcacttcaaatttcagctcagttgctaagcaatacttctcagactgtcactcgctgaatctattgttcagtgatgcttccacaggtgcttctaatggtgctgcagttgctgtagaccaaatgtattcgaagaaacatgatgcaggggacgggattgccaacagctgggtgccggtgaaagggcaagcaattgcgaactcagacattattctgccagaagctcctcgggaagttttgccacttatgacaccatccaatttgacagctgataaaaagaaagagtttcagttgatcgaggggaatcagtatctacggagtactgtcagtgatctgtcacttgctgtggatgatctgatcattccatggagtgagctggttttaaaggagaagattggagcaggttctttcggaacagttcatcgtgctgactggcatggatcggatgttgctgtgaagatactgatggagcaggattatcatctggatcgcttcaaggaatttatgagagaggttgcaataatgaaaagtctgaggcatccaaatattgttctattcatgggtgctgttactgaacccccaaacctatcaatagttacagagtacctaccccgcggccgctcgtataaacttttcac

SEQ ID NO: 30894 - DNA, 859 bp, Triticum aestivum
  Clone ID: PAT_TA_30894
tttgtgatcatctgagagggaaaaatggtgctggtgaaaccttaagttgggcgacacgtgtacgaatcgtgctcgaagctgcacaaggcctggattatctgcacaagggatgtagcttgccaataattcaccgggatgtgaaaaccaacaacattctcctaggtcaaaatctaaaggctaaaatagctgattttggactatgcaagacctatcttagcgacatgcagacccacatatcaactaatgcggctgggacagcaggatacatggaccccgagtactatcacactggctggctcactgagagcagcgatgtgtatagcttcggggttgttctacttgaggtagcaaccggtgagcctccagtattggcgggccatggccacatcgttcagcgtgtgaagcaaaagattgccactggcaacatcaccaccgtggctgatgcccatcttggaggtgaatatgatgtcaactccatgtggaaactggtcgacaccgccatggcgtgcacagcggatgctgctgtccgaaggccaacaatggccaccgttgtggcgcagctgaaagagagccttgcgttggaggaaggtcgtgaggacagtagtgccaggggaagcatcaccagtacaactgctgctccgatgtcggcgttcggtccatcggcaagatgaatcactgatgtgtttcttcacatcgttgatgggtctctagtctctttttatgggattgcaaggtctttattacaacggtttattctgaactactcactcggtccaaaagtacttgtcatcaaaatggacaaaaagggatatatctagaactattatacatctggatacatcaccttttattcattttg

SEQ ID NO: 30895 - DNA, 1350 bp, Triticum aestivum
  unsure (1)..(1350): unsure at all n locations
  Clone ID: PAT_TA_30895
tcttgccagtggccgctctttttttgttggctggcagttcttctcttcccaatgaaacatcaatacgcgggagaaaaatcatcctaactagctagcttggtagaacaatctcattgtgatctcaatctcatacacttcaaaggtagttaagatcttgccatgggtggtctctctcttcagcacccgtgggcctttgcctttggcctcctaggcaatgtcatctcgttcatgacctacctggccccactgccgacattctaccgaatctaccggcgcaagtcgacgcaggggttccatatcggtcccttacgtggtggcgctcttcagcgcgatgttgtggatctactacgccgctgctcaacgtctgacgaagtgcctcctcatcaccatcaactccgccggctgtgtcattgagaccatctacatcatcatctacctcacctatgcaccaaagcaagccaagctcttcacggcgaagatcctcctcctcctgaatgtgggttgtgttcggccttatcctcctgctcgccctgcacctgtcgtcgtcatgcaagggctgggtcttgctcgggtgctcgggtcagcgtcttcgtcgcacccctcagggtcatccgtcctgtgttacgcacccggtgcttggagttcaggcccttctccctctccccctccctcaccgccactgccgtcgtctggttcctctacggcctcctcatcaaggacaaatacgtcgcccttcccaacattcttgggttcgccttcggggtgatccagatggggctctacgccctctaccgcaacgccacgcccaggccggcacccaaggaggtggatgcccccgtgtccgacgatggtgccgtcaagccgtccgagcacgttgtcaacatcgctaagctcggcccggcggccaccgccatcgagctcaacacacactaccctgtcgacccaccgcngagtccaagggaaggggggccgggcaaggagaacggcgtgggcctgcgccaagcggagaagaagcttgacaaaggcaaccatgttcgagcaagtctaggcatgcatgcgttcaatgacacggatgtatatatgtcctgcatcccaaatttagcaatgacggggatcgttagcaaacaagcgtgggagaatgcatgcatgcatgcatgggggccttgttaattcatttctacgggccgcgccctcttcgattcaatgttatccntagaanactcnttcnaangtcttatttattccgnccgatcattaaggttcatcgttacttagatttacggctattataaggacaacaggataacgnggtagatttaatatatatattattcattnaaaaaaaaaaaa

SEQ ID NO: 30896 - DNA, 901 bp, Triticum aestivum
  Clone ID: PAT_TA_30896
ccggatgctggtcaccggcctgggcatccagtgcttccagcagatcaccggcatcgacgcgctggtgtactacagccccaccatcttccgggacgccggggtgaccaccgagagccagctcctcctcgccacggtcgccgtcgggttcttcaagacggcgttcatcgcgctggccatcgtgctcatcgaccgcgtcggccggaagccgctgctgtacgtgagcacggtcggcatgaccgtctgcctggtcattctggcatcgacgctctggctgctcgcgcacggggcggtgcccaaggccctcggcgtggccgtcgccgtcgtggcggtgtgcggcgacgtggccttcttctcggtggggatcgggccggtgtgctgggtgacgagctcggagatcttccctctgcggctgcggtcgcaggcggcggcgctcggcgcggcggtgaaccgggttacgagcggcaccgtggccatgtcgttcctgtccgtctcccgcgccatgaccgtcgccggcgcgttctcggcgttcgcggccatctcggcgttgtcggtcgtgttcgtgcacaggttcgtcccggagacgaaaggcaagacgctggaagagatcgagctgctcttcggcggcggggaaggtggcgagggagtgacagtgagccccggggaggtggagctcggtgacgccgagcacctggtgcggaagggatgagaaggtccttgtactctgatggatccgtttggaattgtcactcccgtctgaatgtttagtttcagaatgtgcatttgatttatttattggtcatttaggagaaaaattatacacagttaacagccttgcagcttgaaattcttagtttcagcttgcaacacagagtaacagttatgacagaaatgggaggcactg

SEQ ID NO: 30897 - DNA, 1194 bp, Triticum aestivum
  Clone ID: PAT_TA_30897
ctctccgcccgtccggctcgcgtcctctcaaggccctattagcctgactatagaatagaccgatcgatagagtagcatcgtaagaaacacctatagaccgatcatggctgcgcgcgccattgttgtcctctcgctcatcctcgcgctggtcgccatcgccagcggaggagcgtcggcgcagctgtcgtcgggcttctactcccgctcgtgcccgggcatgctcaaagccgtgcgctcggcgctgcacccggccatcgccacgggagcgccccggggggcctcccaccgtccgcctcttcttccccgctgctttcgtccggggcggcgacgcctcgctgctgctggacgacgccccgggcctgcgcggcgagaagaacgccacgcccaacaagaactccgccagggggttcgaggttatcgacgccgtcaaggcgggcgtcgaggggtgttgtcccggcgtcgtctcgtgcgccgacatcctggccatccccagccgaggagagcgttgtcttcctgggtggcccgagctgggaggtgaagatggggcggagggacaacaccacggcgagcttcaacggcgccgacaaccacatcccgccgccgacgtcggggcttgccaaccttacgtcgctcttcgccgcgcaggggctctcccagaaagacatggtcgcactctcaggagcccacacaatcggcctagcacgctgcacaaacttccgggaccacatctacaacgacacaaacatcgacgccggcttcgccaggagccgccagtcaggctgccctcacgccaccggctcccgcgacaacaacctggcgccgctggacctacaaaccctgaccgtcttcgagaaccactactacaagaatctcgtccagaagaggggcctcctgcactcagaccaggagctcttcaatggtggtgctgccgacgcgctggtccgagagtatgtcggtagccagagcgccttcttccaggactttgtagagggaatgatcatgatgggggacatcacgccgctgacgggatccaacgggcagatcaggatgaactgcaggaggatcaactaagattgttctcccctttccgcagcaacaatccgacgttgttaccatgcttgaattcattatgatttgccccttttcttgtaaggataaaaggttaaaatatattacaatactgcccttttgtgg

SEQ ID NO: 30898 - DNA, 801 bp, Triticum aestivum
  Clone ID: PAT_TA_30898
gacaaatcaggaaacaaagtggcagacatagacaagcagagcagctcgcggatcgatccatggagttcgacaagcgcacggggacgccttctccccttctcccccggagcgcctccaccgtcacctactgctgcgggcggtgcgggtacgacctgaagctgagctcgtcggcgcgggacacggcgggcatcgtgggggccggcgcgggcggggcgaggcggcggggctggcggagcgcggcggtggtggtgttcgacgccatcgacgacgcgcgcttcggccacctcgacgagttccgctgcctcgacctgcgcgcgcgccgcctcttcgcgcgccgcacgcgcctgctctgccgcaagtgcggcgcccacgtcggcttcggctacgacgacaacaccaccgccaccaggccgccgcggtaccacatcaagatccgcgccctccaccccgcctcctccgacgacgccttctccggcgccgccacgccgccgccgccgtcccacgcgccggcggatccgcgatcttgatctccattgcctgacatgcccgtgcgcacattccgtccctttttttgtgtttccattttcttccttcctttctctgtccgacgcaaacgggaattgccgttccgcgctcgctagtgtacaaactgatttgattgattgggaattggaatcaaatctctttccgataattttgattgattgattgctccctggcaattgattgtgtcactaatgtacaaactaactgattgatggtattgaattcatgctttagtcaattcaaaaaaaaaaaaaa

SEQ ID NO: 30899 - DNA, 1141 bp, Triticum aestivum
  Clone ID: PAT_TA_30899
agtggaaactgtgggaggatgcaattcagaaagacactgcaggaatgggcccaagaaggtgaacaatgtacacgatttcgaatttatcagggagcattttaagggtattggcaaagattctagaatattgagttggctgcattcttttttcaagcagttctacggatcagtaagtaaaaccgactacaccacaatgcgtcttggttttatcatgacccactgccgtggaaacctgaaattcgatttccataaatacatgctgcgggttttagagtccgattttaagaaggtggtagggataagctggtacttgtgggtcttcgtggtgatctttctgttgctgaatgttaatgggtggcacacatacttttggattgcattcattccccttattcttctgctagccgtgggcaccaagttggagcacgtcatagctcagttagcccaggatgtagctgagaagcactcggcggtcgagggcgatttgatcgtaaagccatcggatgaccacttctggttcgggcggccgaggatcgtcctgttcctgatccatttcatcctcttccagaatgcctttgagattgcattcttcttttggatactgaccacctacggattcaactcctgcatcatggggcaagttggcttcattgtgccgaggcttgttattgggctcatcattcagcttctctgcagctacagcaccctgcctctgtatgcaattgtaacacagatggggagcttctacaagaaggagatcttcaatgagcatgtgcagcagggtgtcctgggttgggctcagaaggccaagatgaagaaggggttcaagaagagcaatggcgcggcccaatcgacgagccccgtcggttctgcggggccttctgctaaggttgagatggtgagacgaccggcgcggcaaggcaacgatgctggtgaaagcatagaatgatgtagtatgggtagtgagtagtgttgtctagagcaatggcgtctatgatgtctattttggtgctgcaatgaaagcacttaagcgtgtgctatcattatgcaaatagttcttgcagccggaaaacattgtggtggcaaggggtaaaaagaaattcggtccaaatagttttctctcaaaaaaaaaaaaaaaaaa

SEQ ID NO: 30900 - DNA, 666 bp, Triticum aestivum
  unsure (1)..(666): unsure at all n locations
  Clone ID: PAT_TA_30900
cttcgggagcggcgggtcgctgaccgtggaacagacggccgagctcgccgccgggctggaagcgagcggccacaggttcctttgggtcgtgaggatgccgaatctggacggccatgaccatgaagacaagcaaaacccattggcatggcttcccgcggggttcctggagaggacggcggacaaggggctgaccgtggcggcgtgggcgccacaggtgcgcgtgctggcccacccggcgactgcggtgttcgtgtcgcactgcggctggaactcggcgctggagagcgtgtcggccggcgtgccgatggtggcgtggccgctgtacgcggagcagcggatgaacgccgtggtactggaagggagcgtcggggtggcgctgcgcccgcgggcgcgggagcgcggcgagatcgcggccgtggtgaaggagctgatggagggggcggacaaggggcgcgccgtgcggcggcaggccggggacctgcagcaggcggcggcgcgcgcgtggtcgcccgaggggtcgtcgcgccgggcgctggagcaggtcgccgccacgtggaagaaggtgacgctcgccaaggtgaagtaaagaacggacgtgcggtcatggctgntggcgtgttgtgtgtatcggcggtgtatggttgctttgtttgtgccgcattaata

SEQ ID NO: 30901 - DNA, 1121 bp, Triticum aestivum
  Clone ID: PAT_TA_30901
tgataagggagatctgagtacagcaaatgagggcagtcctagcgaggatggggacaggaagagaggagggggacataggcggggcagcaaagggactaggaagaggatggcgatggaagctgaactaagctgcaagctggtggactttggaaatgcatgttggacgtacaagcagttcacaagtgatatccaaacaaggcaatacagatgtcctgaggtccttctgggctccaagtactctacatctgctgacttgtggtcctttgcatgcatatgctttgaacttgcctcaggagatgtgctctttgatccgcatagtggagataactttgacagggatgaggatcaccttgcgctgatgatggagctacttggaatgatgcctcgaaagattgccttgggtggccgatattcacgtgattacttcaatcgttatggggacttgaggcacatccgtcgcttgcggttctggcctctcagcaaggtgcttgttgagaagtacgagttcagcgatatagatgccattgccatgtcagactttctcgtcccgatacttgattttgttcccgagaagcgtcctacagctgcacagttgcttcagcacccatggtttgatgctggaccccttcgacggcagcccagagcgctggcggacacggctgagaatccagttgatggtgctccagagaacaaaggcaaggagaaagacgatgaaagagatgcaatggcagcggagctggggaacatcgccatagacggcgcttcttcatccaagacagtgaaggatccccaagcaagctccaagcaaaagattgcgaatggtacgccttctaagaagtgaggtgccattcggtctacaaggctcgggttttcggtgaagattgctccatgagtgggaaatgagtgagtgctcgttaggtttgtgatgtgttaggatatctacccgtgcgaaaaagagtagtaggccagacatatgttgtatgaggttggtcgaacaggattagatttgttggggttgatgcggcccctgacctttttcacggacatattcttttgtactatcagaatctgcaaatttttttgaattgttaaagaaaaaaaaaaaaataaaaaaaaaaaaa

SEQ ID NO: 30902 - DNA, 654 bp, Triticum aestivum
  Clone ID: PAT_TA_30902
accgcagggacgcccccaaccggaggtgtttggcgtgccaagcttcagctcaaggatcgcagcaggatcgttgatatgataatagagactctgaagacacgtctgacattacctgcgccagaggatctgaatcaacttcgagaaattgttgtgcgatacgaaaagaggatctatattgaagcaacaaatcagtctgattatttaccgaagatttctctgaaaatgctctctatggagaagaagaagacacaacaggttcctaggaatgctcatcgaatttcagatcaaaacaactcccgtaagccacatacgcaggcctctcaaaagcgtgctcgtctgaactactgattactcttgatcgttgtcacaagtggactggaacaaacgccatgttgaagaatgatcaaggatctgcgattgacttctacttgacctgctacttggcgtttgataataataaaaactccaatagaactttaaaataactattcgtcttggactccgagtgtcactttatcagtattgcttattgttgttgtattggcgtgggttatgactttaaatgtgccactctcagtgttatgcagtctgataaaaattgtattgatatgggttacatagtagaaataaaaccatttatattgtttgcgtagt

SEQ ID NO: 30903 - DNA, 719 bp, Triticum aestivum
  unsure (1)..(719): unsure at all n locations
  Clone ID: PAT_TA_30903
tctgcttctcacaacaagaagcggacgctagctagagcctaggagcagaggaggaggaggacgaggaagaagaagcttcacacacagcgcgggcgccatgagggggaggaggagggggagcagcggcacggccaccgacttcctcgtctgcttcccgccgcgggcgcacctggcgctgatgccgcccaagacggcctgcagcccgtcgcggccgtccgcgagctccgagcgccggcacagcaccagcggcgcccggccgtcgtcgtcgtcgtccagggcggccaccaacaggaacccgagccggcgccaccacgccgtggacgtcggcgaggacaacgagccgtcgtcgcccaaggtgacgtgcgcggggcagatcaaggtctcccggtcggccaagcccaaggccgccggtgctggcgggaagaagaaggccacgtggatgcaggcgctcgggatcaagaaggacgccctgcccttcctcaacgccctgcacggcgccttccggctcaacgtctccggctgcttcggcaggttccccggagccgtcgtggagtacacctccggggaggaggacgaggaggaggaggagcacgtggagcgcgcggngaaggagacngatcggcgccacggcgacgcattggccaagtggttcatggtgctcgaggaaggcaagagggctcccaacaagaaccaggagcacgagctacctcacgaggagc

SEQ ID NO: 30904 - DNA, 436 bp, Triticum aestivum
  Clone ID: PAT_TA_30904
cagcggcggcggagtgtgtggtgggtgttccgcgcacacccaacagggatgccacgcgcactatactatgccgggtagtgcgccaccgatgtagcctcccagttggagttgttgtctgatgacagtggtgtggctgagcgaccacgatggaccagcgccattggtgattatgggagaagcagacgagataagctacagggagggaggggaaaatgcgacgcaggactcgcgagccgtgagggtttatatagtaggcctgtaagtattggatttttggtgatttcaccgagtcgggtgggaagctcgcgcaggaacctgcgaggttacgcatggaatgagctcactgacgattcattggcaccaccgtttgggcaaaagaacgcccccgcgcgttgcataagcttgcgttgtacgcctactgcgatagcggtgtgac

SEQ ID NO: 30905 - DNA, 900 bp, Triticum aestivum
  unsure (1)..(900): unsure at all n locations
  Clone ID: PAT_TA_30905
cgagtgcctctgcgctggcattggtggtggagctcttccatgtccatcagggtgggacttggcttcgatgtactgggcgtcgagtctgattgtgttgtcctagacgtcgcaaggaactattttggactggtggaggatgagttccttcatgtacgtgttggcgatgctattcaaatgattcaggattttgcacatggagatgagcctgattcgaaattcagtgcaattatggtggatcttgactcccctgatgcaatgtgtggtgtcagtgcgccgccattggagatgacccatagaagcatccttcttgctgcacgcagaattctacatcatgatggagtgctggtactgaatgtaatccctcctgctgctgatgcatccttctacaaagggctgattgatgttcttcaccaggttttctctgagttatatgagatagatgttggtaatggtgaaaattttgttcttgttgccagagtgtcaccgactgaaagcacccttcttgatagttcaaggctctttcggacggaattgaggaaattaactggggattttttggaacgtataagaaaagttgaaattccaagttagtgttgctgtttgaagtcatgacctacagagaggctgttccagacttatatttgggtctgatatatagtgctaaggtcatggctatattagaattttgacagtactattctgatacccaatcaagaaagcctgtttgagcattactacagaactgctgggtttgcttttgttattttgctgctatgcaaactgagcatttgctgctgtgctntagatcatatctgagtgagcaatacctgaacttcatattgtcttccaaggctgaatactttangaggagcgacaatttttttgaaatcaatggtggaa

SEQ ID NO: 30906 - DNA, 1337 bp, Triticum aestivum
  Clone ID: PAT_TA_30906
gtgcggctcgagccccgacctctgcgtcccccaggccccacactcccccgcgcgcaagggcaccgttcccgccgccccgccccgctcccggcccctccacgtcccctcgcgggtctcctcctcccgattcgggtacaagctgtggccaaccacacccctcccccctccccccttcccgtccttcccccagctcagcttcctagggtttcctcccgatccaaccccgacctccatggccaagaccaagcagggcaagagggacatcgactcctacaccatcaggggcaccaccaaggtcgtccgagtcggggactgcgtgctgatgcggccgtcggacacggacaacgcgccctacgtggcccgggtggagagcctggagtcggacggtcgggggagcgtgcgggtgcgggtccgctggtactaccggccggaggagtccaagggcggccgccggcagttccacggggccaaagagctcttcctctccgaccacttcgacacgcagagcgcacacaccatcgagggcaagtgcatcgttcactccttcaagaactacaccaagctcgacaacgtcggcccggaggacttcttctgccgattcgagtacaaggcggccaccggagcgttcacccccgaccgtgtcgccgtgtactgtaagtgcgagatgccgtacaacccagatgacctcatggtgcaatgcgagggatgcaaagactggttccatccaacctgtatgggaatgaccattgagcaggccaaaaagttggatactttcctgtgtgcggattgtgctaaagaaaatggtgcaaagaggccttcaaattcatacccgagttcaccaagttctgattctaaggttgagccgaaaaggcggaaatggtaatcgcttcaacaaaaaccatccccggtgaggagatgcactgtttatggcgtcagccctccattgctggtgcagaaaaaaacgtggcgttgtacagtgcatgagatgagctaggctatttaactgtaggattgaaattatgtttgctgctgtatctcgggagcgtttcctgcaatctaggtatcggcgagaaggaaatcgggaattgtactgtcatttgctcttgtcaaagtagcccttgtgtgtgaattaacttgttccctgcaggaaacgttcccgtttcctgtgtgaatgatgatgatgagcttgactgttgtagtttcataatttagatgtgtcagagtcttatgaactggtgaccatgacgacatgtttatgttgtttcaataattctgcaataatccgtgctacatacttttgtagggattgtttattcccaagaaaaaaaaaaaaaaaa

SEQ ID NO: 30907 - DNA, 1631 bp, Triticum aestivum
  Clone ID: PAT_TA_30907
cccacgcgtccgcccacgcgtccgataatgtctgggggagaaccagaagtttctagtccacgtgctaataatgaaccatctgaacttgtgcgtgcacttgatccgaaatcaaaacgccagtcattagggaggacaagtactttcaaagaaccagaagaatcgctccatcctcaggcatcaactcccagctggcgtagatccaaatcaaagtcaaggacagaaaaagcgtggccaggtttgactgctacaaatgacactaaatcttctaagggcaccacaacacatgataaagaagacacatcatccacaatttcagatcctggacctgcgtgggatacaggacccaagtgggatatggagcctaaatgggataatcaacctaattgggaacctgaaactcctatcgagctacatggtccatcagatgacattgagcttggtctgactaaggaactagtcccaagcttagatgaaagatgggtcattaggaaagggcgctatctcggtgtattggtatgcaaccattcatgcaagaccgtgcagagtttaagttcccagattgttgctcccaaggctgaatatgacgacaactgtctggacctgctgctggttggtggaagtgggaggctaaggttattaaggtttttggtgcttttgcagtttggaaaacacatttctcttccgaatgtggaatatgtaaaggtacgatccgtgagacttaaggcaggcccgaatacacatgatgggtgtggtattgatggggagctactccatgtcaaggggcaagtccggtgcagtttgctacctcagcaaagtcgtttgatcggcaggccagccaaaaacactgtacagtaactgtaaatacatcaccctgcagccctatatctgcctggaaatccgcacctgtgcaaccggcaactttcttcatccttttacctctgcatccagaacagcctcactgacagacaggcacatataactccagcgctgtacattggtgcttgatgaccgaaagtgccagatggtgacatttatccaaagaaatgtaaaagcctatctggtctgcagcccactgcgcttctcttcgtttcgccttttctttggctggtatcggatgtgctagagcgccatctatctgatcagcgtacttggggggacggttctgttcagaacagcatggtgcctacacctggtgtgtgcggttgtttggaggtccctggtgccggccacttgatgcttgtcaccccccattagagggacaagcaaaacactgccaatgctatgtccctgatcagcttgtgccgtttacagaaagcgcgaacagatttctatcatgtcgtgttcccggtatagtataggatttggacgaaccaaaaaaggagagaagatatttgtggtgctgctggctttcccacctatagttctttttgtgtttgtgtttgtgtttgtgcgccaagtgtgatgtattgagttgtaatttgtcccagctgtctgccataaacgttttggatcataaatctttgtcaagataaacctgcaggtacatatgtggtactaatgtgttgttctctgctggggaataaatagcatggtttgtttgtaaaaaaaaaaaaaaaaaaaaaaaaaaaaaa

SEQ ID NO: 30908 - DNA, 1076 bp, Triticum aestivum
  Clone ID: PAT_TA_30908
cggcgacggcgacgcccgccatgcccactatgccgaacaactcggactcgacgacggctacggacttctacttcgggctgcggggcatgcccgcggccgtgccgtcgccggtggacgtgaacatgacgccccagctggggctgggccagctgccgtgcgacgcggcccagaccaactgctccgtgaacgccttcgcagcggcgatgaacggggtctcgttccgcctgcccacgcagatgtcgctcctggaggcgcagttcggcaacgcgtccggggtgtacaccgccgacttccccgacggcgtgccacccaacggcacggccatggtggagggcaccaaggtgaggagcctgccctacaactccacggtggagatcgtgctgcagaaccctatggccttcccgtcggagagccggccgatccagcgccacggcttgaacttcttcgttctggcgcaggggctcggcaccttcgccccgggcaacaccagcgcctacaacctgatcgaccccgtggcccgcaacaccatctccgtgttcgtcgtgctggcggcggtgatccgctccttcgcccccggcccacgcatgcggctttcaacctggtcgatcccgtggcacgttccgatggggctcgggatggtgttggctgtggcgaacggcgcgacggccgactccatgctgcctccgtcgttggctgatctgcccatgtgctagcgcacgcaagtttccagcgcgatttggtgttgatcctgcgtgcaagttcacagatttaatccatgctgccgccgccgaaggcggatctgcccgtgtgctagggaacgctcgcaagtttccttgcttgatttcaccatgatcttgcgtgcaaatttacatgaattagtttttctttgtgtgtgttaaaaaactcgagggtcgacggataagaatgtatacgtgtgcagggccgttggttgatttgccgcgcgtgtctacggtgaacgtgtgcatgaattgggtttggtgtaacaacgttctctttctttggtgtaaataccaatgattattcaatttcagaggttcttttcctgtgccgaattc

SEQ ID NO: 30909 - DNA, 220 bp, Triticum aestivum
  Clone ID: PAT_TA_30909
cccattcgtccggttcgcgtcgtttagcgtttagctgtgctccttccagatcgaagtcgttgtctgtctgtgtaatgtttacctggtactgattcagtcatttggacatggtgtttatgttcgtcgttgactctgtgattggactctgaatgcaaaaaccttttaaacaaaaaaaaaaaaaaaaaaaaaaaaaaaaaaaaaaagaaaaaaaatataaagg

SEQ ID NO: 30910 - DNA, 822 bp, Triticum aestivum
  unsure (1)..(822): unsure at all n locations
  Clone ID: PAT_TA_30910
agtctgggtatatatatacgtacagattgtttgggaatcttacatctttacacctgatttgtccagaaatccatcttacaacatggtcactcacttagctacgagtgcagaggcgcacagcacactgctgttcgtcacattctacaaccacctctaagttctttattcttcacccatatggacaacaagcacagagaatttttgtaccaattgctgatcttgcatccactcttctgatttatgaagcccgagtagtattttctgcctccacggcaacatcctgcacattgccatcttccattgtgggatggacatccatcggcttaccctctattgtaacaggcccttcattcaccaccaactcacgtccatacgcatcggcctgctccgggacatccggcgtcttgtcgtcccgtctcttcatgagatcgctcagtgtgcgtcagtgatctacccggctcctgcgctccaccattcgccatgtcctgtcaagcttcccgtctcctcctttgcttgcatcgtcgctgacgacaatctttatcgatgtccgcttctcgccaagctccttcaggttgggacgtggggttcgggggagccttggatcaagatccggcgaaccttgacgcggggtccgtgggaggttcggatcaagctctggtgcactctgaggaccaggacttgtggggatgataggatcaagatcgcgagacttcttcgagttcctccggaaaaatgagcccatattgaacataccgccatgaccactctttggggtaggagcaggaggggcttcctttgatatgtcaacctnttggaggatat

SEQ ID NO: 30911 - DNA, 1608 bp, Triticum aestivum
  Clone ID: PAT_TA_30911
cccacgcgtccgcccacgcgtccgcccacgcgtccggactagttctagatcgcgggccgctcggccacgccaccaagaaaaaaaatctctctccgctccccgctccgagtcgcgtcgcgtgaggagaaaggaagggaagccggaaagggttctcgccgacgcggaaggaggagatggccgggaagggaggcaagggcctgctcgcggccaagacgacggccgccaagaccgccgagaaggacaaggggaagaaggcccccatctcccgctcgtcccgcgcggggctccagttccctgtgggccgtatccatcgtcagctgaagcaaaggactcaggccaatggccgtgttggtgctactgcggcggtctactctgctgctatcctggagtacctgacagctgaggtcctggagctggctggcaacgccagcaaggatctcaaggtgaagcgtatcacccctcgtcacctccagctggccatccgtggagacgaggagcttgacaccctcatcaagggcaccattgctggtggaggtgtgatcccgcacatccacaagtccctgatcaacaagtcctccaaagagtgaacagaaaaaatagcaaaggagcatctctagcttaaactggacattttctcagtcgtctgtgagataagtttatcgtcgtgtcgtttagcgtttagctgtgctccttccagatcgaagtcgttgtcttgtctgtgtaatgtttatttgctccttctcttgagactttgtctttgtgtcgtttgtcgtttagcgtctctcccctggtactgattcagtcatttggacatggtgtttatgttggttcgttgactctgtgattggactctgaatgcaaaaaccttttaaacatgttctgagaaaaaaaaaaaaaacaaaaaaaaataacttccctcggcccgcctcctctaaatcactggacccttgtcgaccacacctcgtcctccccaatttggtccacgtgtgggacacgcttcgcttcctatgtcaccctcttggcggatctacgtgtctggattgcgcgcccgtcctttcccgcattcccatgtctggggaacaccagttccagggcgatgtacatatacacctccaggttgttcttgtccatcaaagtcaatgtgctcaacttcatccattatgactttcctttcttcaagcagcttagcagcatccgacttgctatcagcagaggtgggcagtggcagtttcacatcagttttcgccggtgattcttccaaactcgttgttgcctccgtctcctctgatacatcttcaatcgttatagccaggtggatccttcctttcttgacattcttcagcgatatccatttgtcatgtctttgtccacctctcagttcatttacgtctaccgtacattctccaagcgagtcatcaaacatgtggtccttatcgcgaacttccataacaagttcatttgatgcttcccacgacgtgatgggtatcttgaattcctcaaaccatttaggagataatgttttcctctgtatttgagtttggaatttaaaaagaccaatacgacctctgacataagggtccgacagcctcgtgccgaattcggcacgag

SEQ ID NO: 30912 - DNA, 804 bp, Triticum aestivum
  unsure (1)..(804): unsure at all n locations
  Clone ID: PAT_TA_30912
gggttggggtggcctcggacattggcagaaccaaaanattccatatatgttcttgacaactgccctcacgactggcttttcctgcagtgtaaggcagtggtacaccatggtggtgctggaacgacggctgccggcctgaaagcagcgtgtcctacaactattgtacctttctttggcgaccaaccattctggggagagcgggtgcatgctagaggggtagggccttcgcctataccggttgatcaattcactttgcagaagttggttgatgctataaaattcatgttggatccagaggtgaaagaaaaggctgtggagcttgccaaggccatggaatcagaagacggtgtaacgggcgcagtcagggcattcctcaaacacctgccctgtaaaacagatgaaaattcacccccaccaacgcacggctttctagagttcctaggcccagtaagtaaatgtttggggtgctcttaggtgctggtcagatgcaggtataccattcctccctgctgaaagaagagtgtaaaaaaggctcttgggtgacgcgctatgccattgtgtgcgataagaatgtggaagccaaatgttagaagttgatgtacatgcatgcgaccaggagcccgtgatttatcgttttgcgtttttttgtatgtgtgttgtgtaaagagtatttgtctgatgattttaatacatcattttggtgtggttgcaaccttggcctgcagcaaccgatgatctctcatgtatgaccaggcaacctgtgtatatggaaaacttcagagtgcagattagttcagttaaaaa

SEQ ID NO: 30913 - DNA, 986 bp, Triticum aestivum
  Clone ID: PAT_TA_30913
tctgaactgatgaagatgcaggtcaggacttgctaagggcatcagttcttgctttgtttgtctctgactgttttggaggttgtgatcgaagtgcttctctgaggagaacacggggagctattgttagcttgaggaaagagcaaccgttcatttgtacttgtgctgctggtagcatgtgtgatagcaatgaagcatcaaaacaagccagtactcctcctgggcacttcaattttactggtctctgtgataaatcaatacacatcatcaaggaaaggaataattcaggcattgtaccaataggggcattgcagtttggtgtttgcagtgcaccgagctgtcctgatgaagtatttgtgtgcaccgggcggaccctccagttccttagtgagcttgtgacgggggcatcttgactacgcgcctctatgcttggaatgttgtccctgttagacaagggaatatcttggtaaggatgattgttgatgcgtgttaccccacgaacataaaggaagagacggatccagagtacttctgcaggtatgttcccctcagtcgactgcacgttgcgcttgacgatgaaggctatacacctcggtcttccttcccttcggtctcactatgcaaagaaattgaagctacagcttccagcgctgtctaccactgcaaaattggttcagttgatgcagcagcaaagatacggtacctagatacccggcgtgcttctaatgatgaagtaaaaaaatttgaatacaagcttcttggggaagtaagaatgatgaatgctctaaggaagcacagatccatagtggacatatatggtcaccaactttcttctaaatgggttcaagatgatagtgataaggagtacaggataatgcagtctgtaattttaatggaatatgtgaaaggaggttcactgaagggctatttgacaaaactactgaaagagggcaagaaacatgtacctgtggacctggcattttacattg

SEQ ID NO: 30914 - DNA, 669 bp, Triticum aestivum
  Clone ID: PAT_TA_30914
ctgcaagaccaagactctgccgaggcctctccgcgccggcgccggcatgcccaccacgttaggcccggtgctcgccgaccttccttcatccgagccggacccagatgacgcctttccttcatccgagccggacccagatgacgcccttccttcatccgagccggacccagatgatgcggtccgtgcgtcgtcagaggcgcccgaacatgaggcgatggggccacgtccaccgttttcggagatccacgctgctcctccggcgtccgcgtgacaagaatacctcggcgtacggccgtgacagttagcattggccgaccaatcgatatgtaagcgcgatcaccaggtgcggagggattagcgcatcgaccaaaaagccgcgtgctaatgggtgtacacgtattatttataacactgctgaatgaagtgtcttaggctacttgtaacgggaagttctccgtatcaatatagtgtacgggtttgctaaactcagctaaccgagattaaatctggtctcattcagtgggccatctagaattacaaaatttaaagaacttgctgatttagaaaaggtgcaaggctgtattcttgagtttggatatatgcactagatggaatgtcacatatctaatgttgaaaaccgcaatcaactatgaaaaatgtttgtgaggt

SEQ ID NO: 30915 - DNA, 417 bp, Triticum aestivum
  Clone ID: PAT_TA_30915
gcagcgagaagacctgctacgcgggcgcgccccagcggcccttggcggcggctgccgcccccggcgacatgggatgccagctctcctgcgccaggacttcctgccaccgtcttgatccaggtaatcagattggcacagttcatgtgcgccatgaattagtaatgcgcaaccactgcactcacgtctgatgagccgacaacgacgatgtggtggtaaactctttttgcagaccgcgaggccgctgaggcctgcttcgggcagtgctatgacggctgcaagaccaagactccctgccgaggcctctccgcgccggcgccgggatgcccaccacgttaggcccggtggtcgccgaccttccttcatccgagccggacccggatgatgcggtccgtgcgtcgtcagaggcgcccgaacatc

SEQ ID NO: 30916 - DNA, 406 bp, Triticum aestivum
  Clone ID: PAT_TA_30916
aataactaagcacgcgtgcattaaccgagcaacgataccttaaggtagaagaaccagagctaggaatcggtacctatggggttcgcggtgacgaggacgagcaggtcgctggtggcgccgtcgtcgccgacgccggccggggagacgctgcggctgtcgtccctggaccgcgtgccggggctgcgccacctcgtgctgtcgctgcacgcgttcgacggcgccacgcgggtcgacgccgccgtcggcgagggggaagctgccgccagcccggcaagggcggtgcgggaggccctggggaaggcgctggtggactactacccgttcgccgggcggttcctggagccggaggaggagggcggcaggtgagggtggcctgcaccggctaaggcgtgtggttcgtggaggc

SEQ ID NO: 30917 - DNA, 1676 bp, Triticum aestivum
  Clone ID: PAT_TA_30917
gcaggcgttagggagtagctagggaggccgggcgggccgtgggccctttgctcggtgcgtgttgttggtggtggtgggggcgccgttcctggtggccggcgcggcggaccccgactgcctcgagtactactgccaggactgcatcgccaaggacaagaacatgatcgtccaccgcaactacggccgcgacaagacctgctacgcggccccgcccccgcggcccgtggcggcgggcgccgcccccgacgacatgcgagccctcctccgccaggacttcctgtccccccccctgatcgagaccggccgcgcggtgaccgctgcctcctgcagccggtgctcggctggcggcccgagccactgtcgacgacgctccgcccgcgccctcggcggcacgccccgcaaggccggcccgtcgtggtccttccctcatccgcgtccgacccggacgatgcggtccgcgtttcgtcataggcgcccgaccatcaggcggcggggccatctaccgcgccttccgcagatcatcccgtctccgccggggtcggcgcaacaggaataccggcgcggagggccgggacaccttgctctgagagacccgccgctctttaggcgccttcgccaggagcggagcgattagcgcatggaccacagaccggcgtgctaatgggtgcacacgtattatttgtaaaactcctgaatgaagtgtcttaggctacttgtaaccggaagttctctctagcaatattgtgtacggctgtgttaaactgtggcttaggctacggccggcagggtgctcgccggcttgtcatcgggtgctccctgggtgaccgtagcgaagcgggtgtgggtagcgtggcaaccgggcggaagtggccaaccccactctgcaccgtgaaggggtccatggcccacgaagattcaccccgtccacgtctgcttcttcgccaacacgcgccacctcatgctcgccggcgccgccgaggggttctacggaaactgcttctacccggtgacggtgacgtgcagcagcgcggaggtggcgacgggggaggtggtggacgtggtgcgcgcggtgcgggacgccaaggcgcggctcgccggcgacgtggcgcgctgggcggtgggagggttcgcgcaggacccctacgagctgaggttcacgtacgactcgctgttcgtctccgactggacgcggctcgggttcctggaggcggactacgggtggggcgcgcccacgcacgtcgtgcccttctcgtaccacccgttcatggccgtcgccgtcatcggcgcgccgccggcgcccaagatcggcgcgcgggtcatgaccatgtgcgtcgaggaggcgcacctaccagagttccgggaccagatgaacgccttcgccgccggcaagtaattgatcgtcgccgatcgacacccaaccaagtgtgcaatgcaagctgttaatttctacttttaatctagctctttatacttgtcgaaacggccgtcacggttcgtgtgggtgtgtaatttggtttgctttgaatttccctaatcaatctggcgcaattagcgttgtgcttgtacggatttgccaagactgtgatgtaccgtgagatggtccatgtaccgggaagaatatctctaggtgcaatcgatgaatgatgaaaacaataaataaccatcatttgtactcc

SEQ ID NO: 30918 - DNA, 675 bp, Triticum aestivum
  unsure (1)..(675): unsure at all n locations
  Clone ID: PAT_TA_30918
gaggaattcggcacgaggcgactccggcgggcggcgacaggaggctcgcccttctgagagggagagagagatggaggcgagcagcagccggagccggagcggaggtctcccctcgaagcggcgcagcggcggctgcggcagaggaagcgggtacgggctgaccgggcagccgctgaacgacgataccctccgttccatcttctcccgcctggacgaccacttcgacctcgcccactgctccgccgtctgcaagtcatggaatacgatcatcagcacaggccatctgatgaggggtctatattacaagaggaatccgcaggcaagaggctcgagttctactatttcaatgagaagttattttgaggcacttgccatgaatgagcacgcatcaactctcgctagagggtctgctgaagttcatcagtggattggtcatgatgtgagggccaccttgtgccgtatgaaaagcggttcagtcttaactggaatgggagataaggttcttcgactctggtctgctgaaagttgcaaatacatgaatgagtacaatgttccaaattccaaaatgttggttgactttgattttgatgaaaataagattgtaggtttaactagctcccaggtttgcatatggaaacgcagtcgcaattgggcccaaaaaantaaantttcaat

SEQ ID NO: 30919 - DNA, 1301 bp, Triticum aestivum
  Clone ID: PAT_TA_30919
cggcacgaggctccggccagcaaacacaaacgagcttctctttctcctctttcttcagggtagttatttggccggagtctgggacgaagccgacgacgaagacgaagacgccaggaggaggatcatcggttcatcacatagatcgaccagccatgtgtaacaacagcggtggccgcggcggggcgatggcggctcggaaggggccgtggacggagaacgaggacgcccaactggtatggttcgtgcgcttgctcggcgaacgccgttgggatttcttagctcaggtctcaggtttgcgcggtggcgggtgatcgatccaacctgacctctacggccagtcaccattaatcttctctcttctccctcccctgctccggcgtgttctcggctgtgctccatgcaggtctccggcgcaccggcaagagctgccgcctccgctgggtcaactacctccacccgggcctcaagcgcggccgcatcaccgccgacgaggagcgcctcatcctcagcctccacgccgagtggggctcccgctggtccaggatcgccaggaagctccccggccgcaccgacaacgagatcaagaactactggaggacgcacatgaggaagaaggcccaggaggagaagatgctcgccaagaacaaggcctcctcctcgccgtcctcctcctccgccgactccacgtcgcttacgacgacgacctgctcggcctccccaacggccacgtcctcctcggcggcgaccaccgaggaggcgccgcaggaaagtactaccagcatggacgacgaggccgaggaggaggccgccacgtcggcgagcgaggagaagaaggcggaggtggtgcagtactgctcccccgtggacatggaccagctctggaacgacatcgccgcgtcggagaggtacccggagatgatgatgagctggggcgtagccggccacgtggtcatgcccgcccccgccgtggagccttcgtcgccggtatgggagttctgcgaggattactccctgtggaggatcgacgaccaagagtactacaacaagatcgatcaacacgctctgaattgagaggctttcattacgtttctcttgttgttcttgttcttcctagctagctagcttaattgcactacttttgtattactactatatatactaattcgtgcatgcatgtaattatatgtaaaacttgagttgtgagattatattagtgacagctgtttgtgcgtgcacatgtgtaagtcactaattatcatatttctggagaatctgttgcaaaataacttgtcaaaatcaaa

SEQ ID NO: 30920 - DNA, 821 bp, Triticum aestivum
  Clone ID: PAT_TA_30920
ctatattttgagaaaagcgcaatgataatcacgtttgtgttatttgggaagtatcttgaggttcttgcaaaggggaagacatcagatgctattaagaagcttgtagaacttgtccctgctactgctattttgcttctgaaagataaagaaggaaaatatgttggggagagggagattgatgctctgttagtccaacctggtgatgtcttgaaagttcttcctggttcgaaagttccttctgatccggttgttgtttggggaacaagccatatcaatgaaagtatgataactggtgaatctgcaccgatgcctaaagaagtatcaagtgtagtaattggagggacaatcaacttacagggcatccttcatatacaagcaacgaaagtaggatccggaacagttttgagtcagataatatctctggttgaaactgctcaaatgtccaaagcccctattcagaaattcgccgattatgtggctagcatttttgtccctattgtcatcagcttgtccattctaacgttctccgtgtggttcttatgtggatcgttgggagcatatccacattcatggtttgacggaactagcaattgctttgttttctccctcatgttctccatatctgttgtggtgattgcttgtccttgtgcccttggtttggcaaccccaactgctgtaatggtggcaactggaatcggggctaaccatggagtacctgtaaaaggcggagatgcattggagagggctcaaaatgtaaattacgtgatctttgataaaacagggacactaacacaaggaaaggctgttgttacaactgcaaa

SEQ ID NO: 30921 - DNA, 446 bp, Triticum aestivum
  Clone ID: PAT_TA_30921
cggacgcgtggggcgccaactgtttcccgcgagcgattacgcaaaccctagttttcgctcgcgcacccggttccccagatctcgagtttgcccggcgatccggcgcgcgcatattgacgaagatgtcaccgatcatggcggcgcgcgggcaggggctgggccagggccagggccatcaggtgcagcaagatttcgacttcttcttggtggtggacttcgaggcgacatgcgagaaggacgcgcggatctacccgcaagagatcatcgagttcccggccgtgctcgtcgacggcgccaccggcctcatcgcatccgcgttccgcagttacgttcgccccagacaccggcctgtgctgacccagttttgcagggacctcaccggcatccggcaggaggacgtagacggcggcgtggatctcggcgaggcgctctggctacacgacgct

SEQ ID NO: 30922 - DNA, 774 bp, Triticum aestivum
  Clone ID: PAT_TA_30922
cgctgccctagttctcgattccctctttccccgatcttccccgccctagtttccgatccctagtttcctcgatctcgattctcggagttttcgcgcacctcgtcgaacatggcagcgatcatggcggcgcgcgggcaggggcaggtgcaagatttcgacttcttcgtggtggtggacttcgaggcgacgtgcgtgaaagacgcgcggatctttccgcaggaaatcattgagttccccgccgtgctcgtcgacggcgccaccggccgcatcgagtccgcgtttcgcaggtacgttcgtccaaaacatcaccctgtgctgacccaattttgcagggaactcaccggcatccggcaggaggacgtcgacggcggcgtggatctcggcgaggcgctctggatgcacgactcttggctgaaggcggcgacggcggggggagggagcttggccgtcgtgatctggggagattgggattgccgcaccatgctcgagtccgagtgccgcttcaaggggatagagaagccctcctacttcgatcgctggatcaacctgagggtccccttccaggctgcgctcggcggcggagggcgggtcaccctccagaggcggtcagggcagcgggactggactgggagggccgcctgcactgcggactggacgacgcgcgcaacacggcgcggctttttgttgagctgatgcggcgcggggtcaagatgaccatcaccggttcgctggcgccgccggcggcgatccagcagaaagagcaagccccgcagc

SEQ ID NO: 30923 - DNA, 780 bp, Triticum aestivum
  Clone ID: PAT_TA_30923
tcgaggccgggcccgggggtccggaattaaaaaaaaaaaaaaaaaaacagccgtatacccacaccacaccgcttccgcacttcctcccggcgcctcgttttccatttcacaaccgcggatcccctccgagtactgtagacatggccggaaggggcaaggcgatcggctcgggcgccgccaagaaggccatctccaggagctccaaggccgggctccagttccccgtcggcaggatcgcgcggttcctcaaggccggcaagtacgccgagagggtcggcgccggcgcccccgtctacctcgccgccgtgctggagtatctcgccgctgaggttctggagttggccgggaacgcggcgagggacaacaagaagacccgcatcgtgccgcgccacatccagctcgccgtccgcaacgacgaggagctctcccgcctgctcggcatggtcacaatcgccagcggtggtgtcatgcccaacatccacaaccttctgctccccaagaaggccggaggcagcaaggccgtggctgccgacgacgatagctagatgacgactcctcctcggtggtcgtgggtgctcggctgtatccagttctgtgtagtagcgtgttcagttaaatgttgcctaggtgttgcgttttacttctaggatggtagtactactattagtttctgaatctgtgtgcttgtaccggtgctaaactagccgtggacaatggttgcatcctttgtaattcgttgctagtacgttctataaaagttgcacctatggattgcttact

SEQ ID NO: 30924 - DNA, 2410 bp, Triticum aestivum
  unsure (1)..(2410): unsure at all n locations
  Clone ID: PAT_TA_30924
ggcacgcgtcctaaacaaatcatatttcgatcccagctttccctcccaactttcccccaactttgctgccctagttctcgattccctcttcccccgagtttccccgccctagtttccccgatctcgattctcggagtttgcgcgcacctcgtcgaacatggcagcgatcatggcggcgcgcgggcaggggcaggtgcaagatttcgacttcttcgtggtggtcgacttcgaggcgacgtgcgtgaaagacgcgcggatctttccgcaggaaatcatcgagttccccgccgtgctcgtcgacggcgccaccggccgcatcgagtccgcgtttcgcaggtacgttcgtccaaaacatcaccctgtgctgacccaattttgcagggaactcaccggcatccggcaggaggacgtcgacggcggcgtggatctcggcgaggcgctctgtatgcacgactcttggctgaaggcggcgacggcggggggaggcagcttggccgttgtgacctggggagattgggattgccgcacgctcggcggcggagggcgggtcacccttcaggaggcggtcagggcagcgggactggactgggagggccgcctgcactgcgggttggacgacgcgcgcaacacggcgcggcttcttgttgagctgatgcggcggggggtcaagatgaccatcaccggttcgctggcgccgccgctgccgatccagcaagcagcccccgcagcttctcacaagctcttgcggtggctcatctgcgctggcgccgctgccgatgatccagcagaagcaacagtcgccgcagcttcgcacaagcccttgcggtggctcatcggcgctggcgccgccgctgatccagcagaagcagcagccgccgcagccacacatgataagcccctgcggcggctcctcgctacatctcctcttccctattcggcacgaggcaccacaccgcttccgcacttcctcccggcgcctcgttttccatttcacaaccgcggatcccctccaagcactgtagccatggccggcagggccaagtccatcggcgcgggcccttccatgtaagccccgccggggtgccctcgggacgtagtgcagacatggcgctcaaggggcagggtcgagtggttcgtccgcccgcccaagaaggccatctagggggggctccaaggcccgggctcccgttccccgtgtgctcaggtttcgcgcggcttccgcaacgggcgggtaagccgcgcagcgacggtcgggcggccggccaagccccgatctaccatcgccgccgtgcgcgagtatcccgccgctgacctgctcggcgtcgccggaacgcggcgatcgcaccccgcgaagacccgcatcgcaccgcgccacagccaggctgtcatgcccaacaaccaggagctctcccctcccctaggcatggtcacgaatcgcaagcggcggtgttatggccaacatccacaaccatacggctcctcaagaaggccggggggcaccagggtggtggctctgcgacgacgttgcgtagatgagggctcttcctctgaggtcgtgggggtctcggctttatctagtagtagtgtagttacttgttcaagtttatggttgcctaggggttcgcattttagcactactaggatgtgatgtactactattagttttcttaatcagtgtgcttgttactgatgctaaactaggtgtggacaatggttacatcctctgtaattcgttgctatgttctataaaacgttgcacctatggattgctgactcacccgaaaatccactgcaatggcccgcctgggacgtgcttctgctactgcagggtaccgaccagaggaggcgtggtgtccgtgccagggccgatgcaggggaagtgcttcttcgggtgtggcaactggacgccggccatgggacccgtctgcccctacttatgccgtttggaccaactgaatgaaccacccatggcaccagcatcagtgtagctcagctgttagtgtaaatcgtgctagccatcagaatcagagcttagctcggctgattctagccagtctaggtgtgaatgtggtctctggaatcaaacgtgtccaatggggctactcttgatgtaattggtatctgaaatagtattttcaatagaaattctttttagttaaaatcaaaagcttccttttcgggttgggagtaatatattatcaaaaaaaaaaaaaaaaaaaaaaaaaaaaaaaaaaaaaaaanaaaaaaaaaaaaaaaaaaaaaaaaanaaaaaaaaaaaaaaaannaaaaaaaaaaaaaaaaaaaaaaaaaaaaaaaaaaaaaaaaaaaaaaaaaaaannnnngggggggccccttttaaaaaacccaattttactacccggggctgggaaagtaaaaatttttttttggg

SEQ ID NO: 30925 - DNA, 1409 bp, Triticum aestivum
  Clone ID: PAT_TA_30925
tctttcgcgtccgcggacgcgtgggcgaatgcccgtgccgcgcgctcccgcccgtcgtcagctgaggaagctgctgtgggccagctttgcgggtgcatacttgcgtatatggactgtgcggcggcggcggcggcggcgatctaccggctgccggaggagtgcgtggcgcacgcgatcgcgatgacgacgccgggggacgcgctcagctcctccgccgtgtccccggcgttccgggccgcggccgactcccacgccgtctgggatcgcttcctgccgcccgaccatgccgccgtgctcgcccgcgccgacgatgctggtgaccaccttgggcgctccaagaaggagctcttcacgcggctctgcagccgcccggtcctcctcgacggcgccaccatgagcttcgggctggacaggcggagcggcgccaaatgctggatgctgtcggctagggcgctgagcatcgtgtgggtcgacgacccgtcctgctggatatgtccgatcccttcgtgtatttctaggtttcctgaggtggccgagcttgtggacgtgtgctggctagagatcaccgggaagctgcagctctccctgctcaccccacggaccacctacgccgcctacctcgtctacgccatcgccgacgactcctacggcctcgagtgtaacatcggcatcctgccgcccaaggccacggtcaccgtcgtcgtctccgggaacagtaccaagccgacgtcaaccgcgacgtccacgtcgacggagaacactatctgcctgcagcacatgcagggggaggaggagacggcgatgcaccggcggaggcaggagtacgtgcggccacggaagaactacgggtggaagctggtcagggaggccgacatggacatcaggtgcccgcgacgaagaggggacgacgggtggacggaggtcgagctgggcgagttcgccgtggccggcgaggaggacggggtggtcgaggtgagcctcaaggaggtggagtgccggcggtggaagagagggctcatcgtgcagggcatcgagataaggcccaagcacacgaactaattaattaaccgattggtttgcttcggggaaaaattgcgtgcggattctagagcaaaggatatattagtgcaggaactaatgctgaaatgatcaacggatcataagtccgtcttttaataagttgttgcatgcatgggcagagcaccagcgtatgcatgcatgcaataagcatatgtgtgtgtcggattaaggcacatgcgggaggacatgtattggtgcatggggccggggtagtaaagttgttgccgtagcctgtaaaatttaagcaattcatccttttgttgaccgttgaacaaattatttagaaatggttcatttattgatatggtatatattccttttttacacgc

SEQ ID NO: 30926 - DNA, 1077 bp, Triticum aestivum
  Clone ID: PAT_TA_30926
gacccacgcgtccggaaaaaatggtcgaatcgggtatgtgcgctaagcaagaagaagctgacaagttccagcaagtgaaacctcgcgtccgtgaaatggtcaaagcacgtctagacaccaagcccaaggttactgaacaaagggatgattcagcacatgattttcaagggggtgtcagtattgatgataaaacagccttaaaaggcaaatttgttctggatgctccactggaggacaggatctgtgatctatatgatctttatgttgagggtatggatgaagacaagggccctcagagtcgtaagttatatgtagagcttgctgacttgtggccacaaggttacatggataaagttgaaattcgaaatgccatttcaagatcgaaggagcgaagaaatttattgtaccggcagcgcaaggttcgcaacgaggagagaatgaagaggagaaggatagctgctgccgccaagtcacgagatggcaacccaatggtggctcagtatgctacagcacagcaagttatgcaaccgcccgtgaaagacgctagtccatcgatgacaagcacacacaccttgtatcctgttgttaactatggacatagccaggtctgcagaaacgctgacagagttggtgaagtgaccgtgggtgcagcatctgacggcaaccgtagttcttccacggacatcaagaggagaaaactagggtctgacgccgccgtggatctgcaactgcaagctaacccactgaaggcccccccgcggtatgtcagtgagaagcagaagcctgcgaagcgtgtggatgatgcaaaggtcggcagtagcagtagccttcctcagacggtgcttgccattgcaggctatgacccccagcggcccggctacagctaacaaaatcattttggtggtgctccattggggaacagaagaataaatcatggccaaaggttggcttgtaacaaagataggtaggtagatgttcgatgtgctcgctgccaattgacttctgagcaaattatgattgaactcttagcgcgtcatcttgactgagaagggtattttctggcccatttgtagtttg

SEQ ID NO: 30927 - DNA, 1350 bp, Triticum aestivum
  unsure (1)..(1350): unsure at all n locations
  Clone ID: PAT_TA_30927
gcccgggagggtggcgctggtggggacngggcccggggacccggagctcctcacgctgaaggccgttcgggccatcgaggcggcggacttggtgctgtacgatcgcctcgtgtctaacgaggtgctcgatttggtcgcggatggcgccaggctactctacgtgggcaaaacggctggataccacagtcgcactcaggaagaaattcatgagttgctcctgagcttcgcggaggctggtgccaatgtggtgcggttgaaaggcggcgatcctctggtctttggaaggggtggagaagagatggattttctacagcaacaaggaattaaagttgaagttattccaggaattacctctgcttcaggaattgcagctgaacttggtattccgctaacccatcggggtgtcgctaccagtgtcagatttttaaccggccactctagaaatggtgggactgatcctctacatgtggcagagaatgcagccgacccggacacaactttggttgtgtatatgggtttgtcaacattaccatcactagctcccaagttaatgaagcacggtcttccaccagatactcctgctgttgcagtagagcgtgggactaccccccaacagcgaatggtatttgcaatgttgaaggatcttgtgaatgaggtccactctgcggatctggtttctccaactctgataattatcggccaaggtggtggccttgtcacccctttgggttgagtcatctgaacatgatgcacttaataatgagaactcgtcgcaaccgagtacaacagtttctcctgtataaagtacaaggccacaagggatgttgatgaacgtcatgcttttggaacatttccaaattgagatctaaggctatatgatctggtttaggttaggacatgcaaacacaggacgtagtgaatctggacaagagagcaaacacaggaagcatatattttgaatattgcagttgcagaagacagtacataaaaccacagagaacaagggttcactttaaccggcggcaacagtctgtgattcggcataatctactgaactgcagcaaatcttcagcatagtttagttttggtcttggaccatatgtatatcttgaatcaaaggtaggatctgttttttgtctccctttgtcgcattactttgtttaggggctactcttgaaacacgttgggcattgtatgccattattctgtcaagctcatttgttgggcttaataacgaattttgaactagttccgcacgggatcagtcgaggaatcatggactagtctctgaaggtttcggttggaaggcaaatacagactcatagactagtcttgcaacccttaatcgtt

SEQ ID NO: 30928 - DNA, 655 bp, Triticum aestivum
  unsure (1)..(655): unsure at all n locations
  Clone ID: PAT_TA_30928
atgtgacatggggtctgagtttgttatatgctctggagcacaagggagacagagctttgacttcgacacaaggggagctcgcacatgctctgcggttcttggcatcagtggtgtcacaaagcttcatagcctttggcgatattcttgagttgcacaaaaaattccttgaactttctggtgggattaaccggatctttgagctcgaggagactctgcgtgcagctcaaaaggatgctctggtgccttccagtgccattagtgcagcctcagacgaaattattgaattccatgaagtggacattgtaacaccatcgcagaagctattggctaggaagctgtcatgcagtgtggtacaagggaaaagccttcttttgactggccccaatggtaccgggaagagctctgtttttagggtgctcaccagttttatggcctgccttttctgggggagttaccaagccctctgaatgggatgttgtagtgttcctcacaccatcgatacaccaagcttggggaacccttccgggatcagatcataataccctatgtcaaagggggaagggccccgagggtaccgggtcctgccctgtttttaggctgcccacagggtcctggccgccccctgctggggctgtttccaccaccctgaagacng

SEQ ID NO: 30929 - DNA, 789 bp, Triticum aestivum
  unsure (1)..(789): unsure at all n locations
  Clone ID: PAT_TA_30929
ccactcctcaacgctaatcgctgatactgtaccactaatcaccctcttcgactccaaccccccctacgctagtcccgtcgcagtctctgcgcggatcgtcgatcgccgcgatgtcgtcttcctccccgtcctcgtcggaccagagcgggaaccctagcccccagccgccggcgccagcgggggtccggccgggagcggggccggcggcgtagcccaggcgacgctgccgcgacgtcttctggctggtcgtcttcctcctccacctgctcgtcttcggcggggcgctcgcgctcgccggcctcaaccgtttccgcgtagccgaccgcttcaacatcgaccgctacgccaaccacaccgccgccccgccatccgccgcagtcgcgccgccggggtcggatgtcggcgtgtccaaggagaaggcgctgccccccgagctgacggagacgtactggaagtactacggcgctgcgggggcggtggggatgctgctcgcgtggtcctggctggccgcggcggccgggaagaaggacggggggagggtgctcatgcgggccgccgtgcacagcctcacggcgtaccttgccgtcatcagcgtgctctgcttctggggaaaccactccttctggggcgtggcgctcgctgtaggcgctgcgctccacttcctctacgtcatgtcagtgattgatagatttccatttacaatgctagtactgcaaaaggcantaaagatggtctgggaacttccagatgtgatgagagtagcatatgcatttgtactggtaatgcttt

SEQ ID NO: 30930 - DNA, 307 bp, Triticum aestivum
  unsure (1)..(307): unsure at all n locations
  Clone ID: PAT_TA_30930
cgcttggaccatgacngcatcccccgccgctcgccgccgntagaactcgtcgtagattaggttcaaccaagaatggagagaccgccaagaaggtcaggtcaggtcagtgaatccagtagtagtagtagcagttggttttgcccaagcaagcaagagcgtccgctctatgccccttttgatttcttgcaactctgatgaacgagcaaccccgaggttccggatggggattaagaatccaaatctccccacatccagacctcccatgtaccatatttttgctcatttggttcaacaagaaactttcccc

SEQ ID NO: 30931 - DNA, 1363 bp, Triticum aestivum
  unsure (1)..(1363): unsure at all n locations
  Clone ID: PAT_TA_30931
cgggctctggggcgcgctcatcgagggcccccgcattgggcggttcgaccacgccggacgagcggtggcgctgcgcgggcacagcgcgtcgctcgtcgtcctgggcaccttcttgctgtggtttggctggtacgggttcaaccccggctcgttcctcaccatcctcaagtcctacggcccgcccggcagcatccacgggcagtggtcggcggtaggccgcgcggccgtgacgaccaccctcgccggcagcacggcggcgctgacgacgctgttcgggaagaggctccagacggggcactggaacgtgctggacgtctgcaacggcctcctgggcggcttcgcggcgatcaccgcggggtgctccgtggtggacccgtgggcggcgatcatctgcgggttcgtgtcggcgtgggtgctcatcgggctgaacaagctggccgccaggttcaagttcgacgacccgctggaggcggcgcagctgcacggcgggtgcggcgcgtggggcgtcatcttcacgggcgctgttcgcgcgcagcgagtacgtggagcagatctacggcgcgccggggcggccgtacgggctgttcatgggcggcggggggcggctgctgggcgcgcacgtggtgctgatcctggtgatcgcggcgtgggtgagctgcaccatgggcccgctgttcctggcgctgaacaagctggggctgctgcgcatctccgccgaggacgagatggccggcatggaccagacgcggcacggcgggttcgcgtacgcctacaccgacgaggactccagcagcaggccgggccgcggcgccggcggcagcgtcggagggttcatgctcaagtcagcgcagacctcgcaggtcgcggccgacgccacgtccccgagcagctcggtctagtgatttacactctaataacggatacacgtatttcatacacctcggtatgtttgcacgcacaaatgacatgcgtgcaagtgcaacgcctcggtatgtttgctctttttatgttgggttgggtctcgaactcctcaacgtttgatgctacgtgagtactactacgtgattgtataataagatcaaaggggggaggttcccccctttttttccccgggtaaaaaaaaaaccnangggggggcccggtaccaattcncctanaggntcgattanncgcgccangggcncgtttaaactcgggacggggaaaaccgggggttacaantaacnctttnaaaaatcccttnccaangggggnaaaccnanagccccccgnttnccttccaaaaanngcaaccctaanggaaanggaacccccnttggggncataaacgcgggggttggggtnaccccanttgccggaaatt

SEQ ID NO: 30932 - DNA, 592 bp, Triticum aestivum
  Clone ID: PAT_TA_30932
cggccacggcaccggcagcggctgctgcgccgggatacccgggggtcggggcggtgccgtcctcggggggcgggccccggcccctccgccccgccagcggccccccggggccgaggcgccggccgcggccgggcgcaagctcgccggcatctccgtaggcgcccctgctccgacggtcgcgcaggcgccgtacgcggactaccctccgactacggtcgcgccggcgtacgcgcagtacccgcccgctccaaacggataggcgcattgacagtaccctacaccggctcagggggacggtcactgactgtgattccagcccgcttgccaccatctcgggtcaaggatacgggcaagccgtgtagattgatcactggcctatgtgcaggcgtgctatgttcttctgtctctagtagaattctgctgcgtaaatcaccacacgggtcacggctcgtaggctgttcccgttgtggtgaatgatgatcgtctctgcttggaagtgcaaatttgagctttgagattttgtgtggtgtgattcgccgatgatgcgacgaattttatcgatttcgtttattacaaaaaaaaaaaaaaaaaa

SEQ ID NO: 30933 - DNA, 890 bp, Triticum aestivum
  unsure (1)..(890): unsure at all n locations
  Clone ID: PAT_TA_30933
tccgactcctccgcctgcctgttgagctcctccagccgctcgcgcagccttgcggatctcgtgtcggcgagctttaaggatttctctgcggcgtcgcgggccgccattgcggcggccgccgtctcctccttgaacttgagcttgttttccagctccaccattgtttctcttgcttcctctagttccttgtggagggacgaaatctgagtctggaactcttgctcaattgatctaccagcatcagcttcctcctctgctgccgtcccccacctttgaatctcctcttcagcagctgttatgtccaccatcagatcctcaacgctttcattggccatcttttccttctcttcaagatgttttatctgcttccgtagctgaccaatctccttttcttgcccttccatcctcgtccttagtagactagactctgccctttgtgcttcaacaagatgttgcagctcaatgatcttaatctgggactccttcatgctgttctccaatgcccctgccaatgtatagacttcatccttctccgtgctccctggcctgtgatccctgtggccgttgagtcctatctcgattccggcctccctcagcccatcctcagccaccttcaaaacctcggtcgtgttagcctgcggcgcgctccggagcagcaccccaatgtgatccttctcccgggtcagctcctccaccctctcctcaagctccgtcaccttgctcttccccttatcccgccacaccccgaccttctgcagcgccattgcggcgatgtcgtaggccatcctggtcccttccagcgaaaccttgaggctctcctccacgtctgtctnctttcagacgaagacggagtcgggcagcgctgtggcagcggcgtcgtccaccagcat

SEQ ID NO: 30934 - DNA, 814 bp, Triticum aestivum
  Clone ID: PAT_TA_30934
cgtcaacgtaacctcagcctgggggctgctcaggtatttcagcggcgacgagctccggcgggagctggacgacgtcgcaaacctcacgacgcagcggctcgacgagatgtcagacctgttcctcgaggacctgggcaagggcaatggcgcgctggagcgccgcgggtggccggccgacccggtctacgcggcctacatggcctccaaggcgctggtgtgcgcctacaccagggtgatcgccagggaggagggcgccgcgctgcgggtcaactgcgtgcaccccggctacgtcctcaccgggatgaacgactacaccggcgtcctcacggccgcggagggcgccgccgccgcggttgcagttgcactggcggagaaggggggcgtcaccggcgcctacttcgaccgcactgaactcggagcgtcctttgtgtgatttctccgtggagcagttgtgacataagtatatctagaattatgttatctttgcaataacaccatgtcatgagttggtccagatatggagaattatgttgtgttcacttttttctctctctcccagaactactctctgttcgctattatacgatgttctaactttttctataaatcggatgtgtgtagacacgttgtagtgtgtctgtccgctcgttgctgttcgtgtgttgtccatatcgttttattcaaaacattttataataagtgaatggagagagtagaatatttccaatgtcaaggtaaatctcttgaaactactagtcctttcgatccatattaattgatgataaaaaaaaaagtcgacgcggccgcgaattcg

SEQ ID NO: 30935 - DNA, 759 bp, Triticum aestivum
  Clone ID: PAT_TA_30935
ccgaaagcggtgacgaggtcgcgactggcggaagcggcgacaaggtcagatcccccgacggaagcggcggcgacccggcgaccgtacgccgaccacctcgctctcagaccctccttcctcattgagttcgacgagatcagcgccggccccatccagatggtccatcagcttaactcatttgagctgccgggcagccgtgtgcaatcacaaggatttcttcacatggatgttgatcgtgcccgcggctgtgtgcagtcagaaggacttggtgctattgatgacgatcgtgctcgcagtcgtgggcaatcacaaggacttggtgatattgatgacaatcacggggctgttgaatgatacctagtaccacggtatggagcaagaaattggggtgtgtttgcataaccagcatcaacaagattacctccaaaacccgaccacaggaggtgcctgctgcgaacaacgagttgtggcgtggtcagggtgttctcctactacaagttgtttttgctggagtactgttgtgcaatggcgctctgtttctgatgttgctcaaagcagagcacccacacccctcccacccatggatcgtcattcatgttgtttgggtttaatttcttgttgcatgtattttaaggaattaagtagctgcttttgttggcgtcagtgcaatatgatgtggtggtctggactcttttggtgtagaagtggcaactatttcttacagctagagcctacatcctatatatattttctgaatct

SEQ ID NO: 30936 - DNA, 783 bp, Triticum aestivum
  Clone ID: PAT_TA_30936
ggcgcccccgaaggagtacccgttccagcgggcgctcaagatggcggagaacgcgagcgacccgtgcggcggccggtacatctacgtgcacgagctgccgccgcgcttcaacgaggacatgctccgggagtgccacagcctcagcgtctggaccaacatgtgcaagttcacgggcaacgacggtctcggcccgccgctgagcaacgaggacggtgttttctccaacaccggctggtatgccaccaatcagttcgccgtcgatgtcatcttcggcaaccggatgaagcagtacgagtgcctcaccaaggactcgtccatcgccgcggcggtgttcgtgcccttctacgccgggtttgatgtggcaaggtatctctgggggtataacatttcgatgagggacgctgcgccgcatgatctggtggattggttgaggaagaggcccgagtggaatgtgatgggtgggcgtgaccatttcttggttgggggaaggattgcgtgggatttcaggcgattgacagacgaagaatctgactggggcaacaagctgctgttcatgccggctgcgaagaatatgtcaatgctggtggtggagtcaagcccatggaatgccaatgattttgcggtgccatatccgacttactttcaccctgccaaagatgaggatgttttcctttggcaagatagaatgaggagcctggagaggccatggctgttctcattcgcaggggctcctcgtcctggtgatccaatgtctatcagagggcagctcatcgatcagtgcag

SEQ ID NO: 30937 - DNA, 1420 bp, Triticum aestivum
  unsure (1)..(1420): unsure at all n locations
  Clone ID: PAT_TA_30937
tttgacccagtggttgtgagaaacaattattcaacattgtcttgaaccatgctcctaatgtaccaaaaacatgcatatctcatgatcggtcattcctcagggnaaacaaggcgccgagnactgcggatcacacgataacaacagtaggaaaactaaaaagatgactccagtggactctccttcaccgagatctgaaggtgtcacgtctccagaagtcaccatgaattcagctggccttcgggaaatcaccgagcctcactatgtcctagcaacggggtgcaatctgaccacagcacagaatgcagaagtcgacgcgcttgtgaagaaagttaggcctgtaattccattttacatcacagccatgaacaagacaagtcatctgcaaggattacgctgccaaataccttccacatgaagaacaattcatcacactctgccatcctcataagagcaacatatgggtagacaatttgaaggttatcactgatggttcatgcatgctttctgttggctggtcgtgcttcgttctccacaacgagttgcgggaaagtgacatctgcctatttgaagtatcgaaaaacgacggtgaagtgacaatggttgttcattctcttgaaggaggtcatcacctacaagggaaagagcccgaatctcaaaacaagtgcagttatccagttaaggtcgaggtgaccgacgaagaggagagtgacaaagaacatgccgagtccagctactactactcaaggtatgcctatgacctgaccggcgaggagcaagaggagatattcaggtcagcgttgattcaacagggcaatccggtatacgtcgccgtcctgcaggagaatcatgttagcagcaggaataacttgctgaccttccccagagagtttgcggctaagcatctcgcggagaggtcgcatgacatcctgctcctgagacctaacaggagagagaagtggtgcgtgaggtactactaccattcgatgatgaggatacagggtttcagctacaggtcctggaccaagtttgtctctgacaacgggctgcaggagggccacgtctgtgtcttcgagctgatgaaaggcgtgtgcgaggcgacgatgatggtccatgttttcaggaagttcaatgggaggtttgttctgctggactaactagctaggttcctgcgtagctgcatccatcttaatttgtggttgaataactgaagctgttgtcactgggagctgaaatgggagtagcttgtgtaccagtagaagtagttgtcgaaacgtaccgtgtgaatgttcactcctgatcaccagccatgactgtgatttcagaaccaagaggaatatttcagtgcttgtagccgtaggtagaaggccgtgccaaagcatctatggctcactcccctgaaattttattaatgtaaatcggt

SEQ ID NO: 30938 - DNA, 1133 bp, Triticum aestivum
  Clone ID: PAT_TA_30938
ccgaccgacacgccacctccaacaccggatccggccaccgcgccgcctccccctagatccgcccgcggggccaccttctccccctggatccccctgcaccatcgcgcaccgccgatccaccacaccacctctctgcccagatcctcgtgaccacccaccgccgccctagctccggcgagccactggcccctagctgtggcgccaccctccgatgcctcgacgcgctgcccggcaccgaccccttgcctccggcgcgccaccctccactgcccccactgcctcgacgcgccaccctccacgaccaccacgacctcgacgcgccacccgctgctgaccgcctggctccagcgcgccacccgctgtcgctcccaccgggaccccagacgcatctcctacagccgtcccttgcccttggccccgacgagcctcctgccgccactcatcctcgcagcacctctccgcgaccggtcaattgctcctgcaggtcaactgctactcccgcgaccggccaatctccactagcgcctttgtactgtctcctgcatcgcgcaaaagatctccccctaaccagcgatggcagcggtgtccgggtccagtcccgctcacctccccaatccccgtcccactggccgacctgcagctgggggggtctcgatctgcagctggaggaggtctcgacctgcaggtggcgaccatcaaggattttttctggaaaagccactctgtgccgagagagatgcctccaaccttatcttcttgtgggtatttgcaagttgtcgtcattctgttcttgtagcacaaccgcgaagctgaggaaaagtagaggttgagatttcacggccaggagctcgatcacttctcaaaccctatgtcctatgatctgattcgtttagaattttgttagattaactagcaagcaattttctgcaaactacaaaaatgtacagagtaaactttaaggccgagcacagcgcgagcttcagtacatggaagtcacccggtccctacccgccctacgctattgaatcagacgcgcaacagagacattgttgaaaattatagagatgttttatgtctgcaacaaaaacaatgttcacatttcttatgcgtggaaaatcaagaattgatgcgtt

SEQ ID NO: 30939 - DNA, 617 bp, Triticum aestivum
  Clone ID: PAT_TA_30939
gaaccacctactactcaagtactgatcgactactaagctgtccctttgcataggtagcaagtgagaatcaatggcgacatatatgggctcccagctagtcatgtcgcacgggaagggacgtctgttgagctctcgttcctcctcatcctccgtcgggcgaataactgttacgcctctggctgctcaagtaacccgagtcactcgggccgtccagcatcctccacccggtccagtttcagatggacctcgtcctgatggttcagggagcatacttcaggtcgatcgggccaagaagacggacaaggttcatacgggttgtggtgaccctccctgcggaaagcgtcctccaaggccaaagaggatggctcgacaaggccaagagaaagaggaagcccaatcgccgttttgatccaactacgtgggagctgtgagccgagggctgagacgagtgaggcatctgagttatcatttggctgtaatctgttctccccttcccctgttcccctgttcccctctcgaacctacccttcttcctcctccagatccccaatctccttccccaaaaaccttgtatctggatatgaatcagtgctagttagcaaagaggaacctaacag

SEQ ID NO: 30940 - DNA, 624 bp, Triticum aestivum
  unsure (1)..(624): unsure at all n locations
  Clone ID: PAT_TA_30940
tctcgcccacgcgtccgccgtccgcgtacttctcgggtcgtaggatcggtggctgccctgctcttgctactcgccgtcgtcgtgccgtttactcagacccagacgcagagcgcacgggacaaggctgccatggcggaagacgcagggccgttggtgggaggcatcaaggactcgccgatggggcaagagaacgacctcgacgtcatcgcgctcgcccgcttcgccgtctccgagcacaacaacaaggccaatgccctgctggagttcgagaacgtggtgaagctgaagaagcaaattgttgctggcacgatgcacttcattacaattcgggtcactgaaggtggggccaagaagctctatgaagctaaggtgtgggagaaaccatgggagaactttaagaagctcgaggagttcaagccggtggaggacgctgcaatcgcataaggcgcgtcccagctttgcaaggatctgcagctatggtgttgatgtagctatcaatcggacatggtttagcgtgttctcgtgtaatatcaagaataagtccgcttcttgcaagctgtgtttcaaccacgtctctaaataaaattctcagtattattgtattctaaaaaaaaaaaaaaaana

SEQ ID NO: 30941 - DNA, 1055 bp, Triticum aestivum
  Clone ID: PAT_TA_30941
gctccgcccggatcgtatcccccctcccctgctctgccgctgcaactataggggccgagcccggttggaggatcggtggcttgccttgctctcgctgctccccgtcgttgtccccctctttctacccgccatcgcagtgccgtcgactccgacccagccgcagagcgcacgggcgaaagccgccagggggggaagatgcggggccgctggtgggaggcatcaagtgactcgccgatggggcaagaaaacgccctcgacgtcatcgcgctcgcccgctccgccggctccaagcacaacaacaaggccaatgcccggctggagttcgagaatgtggtgaaggtcaagaaccaaactgttgctggcacgatgcactacattacaatccgggtcactgaaggtgggaccaagaagcactatgaagctaaggagtgggaggaaaccatggaagaactttaagaagctcgaggaggtcaaggttggtgggacgacgttccaagcgcataactcataacggcgcgtgcccagctttagcaacggatactgcagctagtgggtgctttgatgtagctatctagtctggacagtggtttagctgtgtttctcagtgttaatatcaagtaataagttccgcttcttgcaagttgttttaaccacatctctaaataaaattctcagtattattgtattttgtttttcctttgatcgacttgttttaccctgggcagcaattagcatcacattagcctgcccattatatctgaccattagagtttgagatggtttagcttaattagaacgtaactgctgcagtggagttgatgtagctatctatcggacatggtttagcgtgttctcgtgtaatatcaagaataagtccgcttcttgcaagttgttttaaccacatctctaaataaaattctcagtattattgtattttgtttttcctttgatcgacttgttttaccctgggcagcaattagcatcacattagcctgcccattatatctgaccattagagtttgagatggtttagcttaaaaaagcataattattgc

SEQ ID NO: 30942 - DNA, 1277 bp, Triticum aestivum
  Clone ID: PAT_TA_30942
ggtcctttgtttttccttccttgtctcgcatataaattgctctcgtattccattctgtgaagggcaagagacataagctattttacacactacataggcacacacatcataagcagacctgaaaatctacaatgttacagtagatttgtaaatatttagatcaccctccatactaatgcaaacgtagctactggcaattctggcaagcatatatatgtatatgcagacatagctacataggtagtggaaatctgttaagcatatatatgtatcttagtaacctgacctcgatcctgacagcttgaaccttcaatagcaggaacgttctccattaccataaccaaattgtggagctaacatcttgagatcaccattgtccatcttccagactacctcaggagggcagtagcgatctcccataggagatggcagcagaggacatgggagattgctgcatgctttatcatcaataggcagcatggccggtgcctcgatctccttccatatctggtccatagaatatccatccatgacactctggttgctcttaagtacacttgagaagcaggttgtgccattatgagtgctgcctccatccatcctgattattggtgcagtttcaaggaggcaggattggtatgtaaatgatgatcaggaggaagaaggtgacatgtctatcttcctctcttgtgctttcttcctcatgtgtgtcctccagtagttcttaatctcattgtccgtacgccctggcagtctgcgtgctattctagaccacctgttaccccatcgagcatggagctcaataataaggtgttcctcttgtggcgacatgcgcccatgcttgaggccagggtggaggtagttgacccaccggaggcggcagcttttgcctgtcctgttaaggcctacatggccatagataaggtgatgtatgaaaatagttggttagagacaatgatatttgcatgctgtttgcatctttgtgccaaggattgcaaaaatggctacctaatttgcaggtctcccacccctcaaacctgagactttggcaacgaaatcccagcggtggtcaccgaacaggcggacagtgcataccagttgcaggtcttcctgctctgtccatggccccttgcgcatctcatcttgcactgtcaccatctctaacgttgttcgcttctaccttggatgggctgggagccagccttgttgctcttcctcctctgtgtgcttgtgggctccagtttcaggcttagatccttcctcgtgccgaattcctc

SEQ ID NO: 30943 - DNA, 901 bp, Triticum aestivum
  Clone ID: PAT_TA_30943
gattgaaagaatgtgcgtgtatgcatctgcctttatataccgtgttaaaaaaaagtcaaataaaccccaagacctgaaacagatttgaagttctttttctgtttccccctgaaatgctgcaaatttacataattatgaacataccccacgcaaagaagaagaaaagaatgtacatacgactgcctgctagggaatattgcttttgaaggcctcgaagattgctggggcacttcgttctctatattttcatggcaggaggatccaaaacaacttgttctggaaatggctgctgcccgttcaatggtttgacaaaaatgacgtatctgacatgagattaaaatacttgatgtatctggcaaatgatcaagccgaccgttcagtatttggcgggctctggagcttcggtactgcagtcgctggtgcagtgcttctgacatttgctcaaaaaattcaggatcccatctctgaattagaagagggtcctcagcatagcatatgtatattgatgtaactgcgctttcaacaaccacgacagctagcccaaccagtatcatgccaatcagcatagaggtcgagccaaccataattgctttatcacgttgtgtgaaatatgtccaaacaccagtacaagttcctgtaattaacccacctaatattgtgctcatcaaaagaacagcaccagaacaatcataagcaataagtgcttcaatgccagtcgactggaacagctcccaagcatccctagctgaacgattgaaactctgtccgttgacagctatctgtacatatgcatatttgttgaagaaacgaacaagcgtctccacaatatgaaagaaaaaatcaacacagcacagaagacactcgttgttgccaattttagaacgaactcctctaatctccc

SEQ ID NO: 30944 - DNA, 1079 bp, Triticum aestivum
  unsure (1)..(1079): unsure at all n locations
  Clone ID: PAT_TA_30944
gtgcggcgctcgggccggccgcgcgggcgggccgccgatcattcgcaccgaccacatcctcatcgtctccaacctcggcgaaaccctagcctagccccaccgaaccgcgagcggcaccccggggaccagaggcgtgggcagtccgctccccccgaagccggagcaagccgagatgtctcgcaccggaccgatcgcccaggactgggagccggtggtcgtgcgcaagaagctgcccaacgccgccgccaagaaggacgagaacggccgtcaacgccgcccgccgcgccggcgtcgacatcgacatcgccaagaagcataatgctgggacaaacaaagctgctcatagcaccacatcgctcaatacaaagaggcttgatgatgatacagagaatcttgctcatgagcgtgtgccgtccagaacctgaagtaaagagcattaatgcaggctagaacggacaagaagctcacacaggcacagcttgcacagctgatcaatggagaagccacaagtcattccaggagtacgagtcaggcaaggctatcccaaaccaacaggatcatcggcaagctggaaagggctcttggcacaaagctgcgaggcaagaagtgaagctggcgtgtgcatcttgacaggagtcgaggctttcaagagagaagcttggctgggcaagtttaccgctaaataaagcttgtctactaaatcatgcgacttaagaaaaccctggagtttggtatttcgctcaggtttgggtgaatgtaattattagcttctgtgaacaactctgtatctgggtttcgtttcgtcagtgtgtcttcgtgaatgtgaactgttctgaatgcctgaacctttatataacttgtctctgttactaatgcattattacttaaaaaaaaaaaggcccctaggaaccattaaaattcatgaacagtacatgggcanttacncacaacatngnatgcanantacatcaggactaaatcatgatattaaggcaattancatttctanganccacatagatngaaccnccaacancagngtcanttancattannaacatgngttacataanggtatt

SEQ ID NO: 30945 - DNA, 560 bp, Triticum aestivum
  unsure (1)..(560): unsure at all n locations
  Clone ID: PAT_TA_30945
ttttttttttggaaaacagatatttaactcatatattgttgagaaatattcataattttgctgtcaaagcagcatgtacacacgaatacaattctgctgtcaaagcagcatttcaaacgtacatctcataacatcgtacataaagaacagcaataaaaagtttacaatatgccatatggctcagatcacacaacacatgacatccaggttcaaatgatcccagcaacgaaaaaacttcaccagcacagcatactatcagttaatgatggcgtcaacaatgatatggatgaggttggcgtcggtgagcagggatccacctcccgtcagttccatccacgttccggtgaggcattttcctcataaccaggttatatcaccaccannacagaatagagtcagcgaacagtaagaacctcctcacggtcgaccaagaacaagaacataataaatctggtcaaatgcatgacttttgttcanctcacatacacaatcangtacaaaggatgagaataagtgggtgttgtttctaaactgcacgtcaacaacaacaacagtgtncg

SEQ ID NO: 30946 - DNA, 697 bp, Triticum aestivum
  Clone ID: PAT_TA_30946
cccggcccgcattccagtcccccgctccctccattcccctgaagcgtggcgactggcgaccactcccaggctccacctcgccgccgccgtcgccgcggcgtcttctccgcctccatggtcgccggcgtcgtctagacagagagggagaggtcggcttaactgcgatggcgcgggctccccttcctggccccgctctgcccctcctcgccgtcatcctcctcctcgtcggccgccgcggcgctgccgggggcggcggcggcggaggaaggggcagctccgtgtacccggcccccgtcgtctacccgcaccactccaggcagatctcctggtatcccagggccttcctctacccgcacttcctcaccgacgacgaggccaaccacctcgtctccctcgccagggcggagctcaagaggtcggcggtcgccgatgacacgtcgggcaagagcaagctcagcgaggtccgcaccagctccggcaccttcatcggcaagggccaggatccaattgttgctggtatagaggataaaattgccgcatggacatttcttccaaaagagaacggcgaagatatgcaagttctaagatataagcgcggtgagaagtatgaaccgcaccatgatttcttcaccgacagtgttaacactatccgcggtggacatcgggtagctactgtacttctgtacttaacagacgt

SEQ ID NO: 30947 - DNA, 882 bp, Triticum aestivum
  Clone ID: PAT_TA_30947
caagaccgtgatgccttcatcgaagaccctgacggctacaagttcgagatccttgagaggccagggactccagagccactatgccaagtgatgcttcgtgtcggtgatctcgaccgagccataagcttctacgagaaggcttgtggtatgaaacttctccggaagcgagacaaccctgaatacaagtatacggtggccatgatggggtacggacctgaagaccagaatgccgttctggagttgacctacaactatggtgtcactgaatatgacaaggggaatgcatatgcacagatcgcgataggcaccgacgatgtctacaagaccgccgaggtggtgaagctgtctggaggacaagtgatacgggaggcaggtcccttgccagggctcggcaccaagatcacagccatcctggatcccgatgggtggaaatcggtgtttgttgacaacattgacttcgccaaagaattggagtaaccatgtacaaattttgacttgccgaatgaaccgtaaacatcaactctttaccctttttaccatttttgtaaacatgaacgcataggctttgggataatttttaatctctgaataacgacacacggaggagaggacaatgagagccaactccaagtttatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaaagaaccaaattttaataccgggggttgggaaagtaaaattttttttttggggccccaaaaataaaataaaggggccgggttttaaaaa

SEQ ID NO: 30948 - DNA, 1302 bp, Triticum aestivum
  unsure (1)..(1302): unsure at all n locations
  Clone ID: PAT_TA_30948
acacaagcacagcggacggcccagctttgcgaccacgatgagggctctccccatggccgtcagccgcggcgccgtcgcctgcgccaccccggccgccgccgccgcagccgtcccccggagatccatgctcctctccaccgctgccgcaggcgcagcgctgcagtccgaccccatcaggctgatgagcacgcccaagctcaagctccgcgcctccgccggcgccgcgcaggccgcggccacctccttctccagcaatgacgaggccttcacctgggccaagaaggacaaccggaggctcctccacgtcgtctaccgcgtcggcgacatcgacaaaaccatcaagttctatacagagtgcctgggcatgaagctgctgaggaagcgtgacatacccgaagagaagtacaccaatgccttcctcggatacggccccgaggaaaccaactttgccatcgagctcacctacaactacggggttgactcgtacgatgtcggagcggggttcggtcatttcggcatcgcaactgatgatgtggcgaaaacagttgaactcataagggcgaagggaggcaaggtgactagggagcctggccctgtcaagggtggcaagaccgtgattgcgttcatcgaagaccctgacggctacaagttcgagatcctagagaggccagggactccagagccactatgccaagtgatgcttcgtgtcggtgatctcgaccgagccataagcttctacgagaaggcttgtggtatgaaactgctccggaagcgagacaaccctgaatacaagtatacgatggcgatgatggggtacggacctgaagaccagaatgccgttctggagttgacctacaactatggtgtcactgaatatgacaaggggaatgcatatgcacagatcgcgataggcaccgacgatgtctacaagaccgccgaggtggtgaagctgtctggagggaaagtggtgcgggaggcaggtcccttgccggggctcggcaccaagatcacagccatcctggatcctgatgggtggaaatcggtgtttgttgacaacattgactttgccaaagaactggagtaaccatgtacaaactttgactttgcgaaagaaccgtaaacatctaccctttaccctcgttaccatcatggccaccctggacccggaggcgtggggatccttttgagtccaccaaatgcaacagaccaaaaaaagagactaaccctgttttatagatgccattcccccngagaagttaattttatgtaaattnagcaagtttaaatgnagctcagaagaat

SEQ ID NO: 30949 - DNA, 1110 bp, Triticum aestivum
  unsure (1)..(1110): unsure at all n locations
  Clone ID: PAT_TA_30949
actcacaggcgttcccgtgtgcgtgtgcgctgcgtgtggtgtgagcggatcgcgatggcggcccgacccgcgtggcgggcgctgctcatgccgctcgtcgcagcactgctgctcattgcaggcagcggtgttgcgcgaggcgtggatgccacgggcggcagttgggggcgcatgcagcggctgcgtgcgacttccctgcaggcggctgccgctgccgctgccgagcccgtgacttcttcttcctccgagttttctgccgaagatgcagacgacagggcgctgctggagacgggcgataatccgctgtactacgacgcggcgaacgcagaggcgttcatccgcgcgccctatctgcccagcaccgtgaacgggccgatgtatccgcgcacgggaccgcagagcggccctgcccaggcgtggctcgccaaggccgcccaaccagcgtggtctgcattgccctacggtccgcgcactccttcggcgcaatacgtgcttccattcgatcacatgcgcgaagtgcaggacgaattcagctggaactacgactatcaaaaccccgccgtgccgccacagttctcgttcgccgcgcccatcttcctggaaagcggcgcgcagcagtatgcggcggtggacgcggatacggatgcggatgccgacgcgacgagtgaagccgagacggtggcggatgcggccacagagatggnctgcgtatgcggacgcgggatgcggagacgggcgcaaggcgaaggagacggaggtttcgcaatggcggnnccaccgctggttcnccatggcgacggcgctcgaggtggngacaattcttgaaagccagcctgtcgggggttcgggaccccgcnncctggacgcggggccgtgctgggccgaggcatacactcgcctcccggcgagcggaggcgcnnctcagctttcatacacaaacgactnntnctggagccntcggcgcggggccctnntcgccttccccttcgggattcctacnntcgaatnnnccataatggcgacccctgacgnnaacccgnnacgctgatgnngcgcacccccacgtgggaatgcgtcgtacaggcgcantgtggacaccgccgcggcggc

SEQ ID NO: 30950 - DNA, 920 bp, Triticum aestivum
  Clone ID: PAT_TA_30950
gtcgtcttcaaatcctcccgctgccccacaccgcccatcccccatgagctcgtaccctctcccccaccaaggtgctccattcccaccccgtcaccaagaacttcggcctcgtcgtcgtcctgggcaccgggcagatcccggcgaagaccaggctcaaccggtgccagaagctcctgtcggtcgtggcagggcactgctccacgccatcctgcttctccaccatcgcccccgcgtcgtcccgcctctccaccagtgaccccacaccggcctgctccccgccgtcactacccactccctgttgctcctggcaatttcccacaatcggaacacatcagcaccagggggttcctcttcgtatgtgatttagtgcgctgtgaacatttaaaacactgcccagcaaatgaagggtggaacagtactaaccaggaacaccactattcagtgatgtggtagatgcgaatgacgcctggaatcccgaaaggtcaaagctaaatactagtctgcgtccgcctaccttgggtgaaaatgttgggaactatttggacacatctaccttttaagtgttctctcccttcctgcccaaaacaatgtaaggaagcaaacataaggagtggactcgcaataaaccatgaagccaatgatccgcgtcaactggatgttttagttttcattttgtacaactgatatctaatacttgcagactttaagtgtcctttgttgaacctgatgtatggtgtcttggtggttatgtttagaacagactgaagtgcatgtatgtgacaattagttgatggaataaataaaaatttggtgcacctgatgtgaacctgatgtatgttgtcttagtgattatgctttgaacacatgaattatatgtatgtggcaaacagtaccatatgttaattaaagttgtgttggat

SEQ ID NO: 30951 - DNA, 1338 bp, Triticum aestivum
  Clone ID: PAT_TA_30951
accatccctcgtctttaatggcctccccctcagcagcggttgcgccgtgcagattcctgtccccgctagccaccacctcccgcactctcctatcatctatcctacccacaccggcgacaacgaggaggaggccgctcctctcctccaccaccgccatttgcgccgccgccatggccgcctccggcaaggccggccccgcttcttgcaaggtcgtggactcccacctccacgtctgggcctcgccgctgcaggctgccgagaattacccctttttcccgggccaggagccgacgctccggggtgatgtggacttcttgctcgagtgcatggatgaagctggagttgatggcgcactcattgttcaacctattaatcatatgtttgaccactctttagtaactagtgtgttgaagaagtatccatcaaaatttattggttgctgcctcgcaaatcccgcggatgacggaagcggcattaaacagcttgaacatctgattgtgcaagaaaaataccgtgctgtccgtttcaacccgaatttatggccttcaggtcaaaagatgactaatgaggtcgggaggtcattgtttgctaaggctggagaacttggagcaccagttggaataatggtgatgaaggggatcagttcatatattcaggaaatagaggagctgtgtacggattatcctgcaactactgttatatttgatcatatggctttctgcaagccaccaacgaatgatgatgaagaaaaggcattctcttcatttctaaacttatccagattcccacaggtttacgtcaaatacagtgctcttttccggatcacaagagaagcttatccgtatgaagacacgtctcaacttctttctcgggtgatctccagctatggagctaaccgaataatgtggggaagtgacttcccctacgtcgttcccgaatgtggctacaagggagcaaaggaggcaatctctcatgtcgctggcaaggcagctgtttcgtcttcagatctggagtggattttaggcaaaacagtaagccaactatttcaaggtgcatgggttactccatgagggagatgtggcatggcaggcatgacagtgttgcggctcagtttggtattgttcagtttagacatccttgtttgaaagggggaaggatctatctagtttggtattgtgcagtttgacagtcatgttcaagtgtgtaccccttctccagaggtttaataaattcaatagttcttcctactgcaaacctttctgctcccccacaagagtacatagtatatgaaaataatgacttgtatcacaaaaataaatcagaattttctcttttttt

SEQ ID NO: 30952 - DNA, 1577 bp, Triticum aestivum
  unsure (1)..(1577): unsure at all n locations
  Clone ID: PAT_TA_30952
cccccccccgccgcccccccccccgcccccgcgctcctcctccgcccccgcccctccgccggcccctccgcccgcgtccccccccgcgccgccgggttccgcgcccccgccgtcgcggcccccgccgcccccccccccctccccgccgcgggcgagcgcggcgtctacaacttcgcggcgggcccggccacgctgcccctctccgtcctccagagggcgcaggcggagctggtcgactaccgcggctccggcatgagcatcatggagatgagccaccggggcaaggagttcgacgccgccatcaagaaggccgaggcggacctgcgcgcgctcctcgccgtccccgacacccacgaggtgctcttcctgcagggcggccacaccacgcagttcgccgccgcgccgctcaacctctgcgcctcccccgcggaccccgccgacttcgtcgtctccggctcctggagcgacaaggccttcaaggaggcgaaaaagtactcggccgcctccgtcgcgtggtccggcaaggccgccaagtacacctccctcccggcggacttcggggccatgtcgcagaaccccgaggcccgcttcctccacatctgctccaacgagaccatccacggcgtcgagttcaaggacaagctcgactccaagaacgacgcgggcctcctcgtcgccgacatgtcctcgccctgcttctccatgtccgtctgcgggctggtgttcgaggacctgctcgcgcacggcggcctcgccgaggtccagaagaggaacccgcacacggtcgtccgcatggacgtcatcggcagcgcgcagcggctgacacctcttatgcccggcggcaaaaccggcgccgacgcccacgcgcgtgcccttcacgctggccacgggggccgacttggaggagcagttcatcgccgaggcggccaaggagggcatgctgcagctcaaggggcacaggtcggtcggaggcgtgcgcggcccccgatcgacaacagccatgcccgcgcccgcgactgggtcagcccggcggcacaatccggtgcggtcgctcaatgaacgtgccattcacgctggccaagggggccgactctgtagaaccagttcatcgccgaggcggctaaggatggcatgctgcatctcaaggggcacaggtcggtcggcggcgtccgcgcctccatctacaacgccatgccactctccggcgtggagaaagctcgtcgccttcattaaggatttccaatcgaggagccctttttccggccttcgccgcaacgctctttccatttgcattcctttgacgtgggaaaagggttgttgtttatcatatatcataacataagtaggctgcaagatgtgcaccgtcgctcatatgagatttgctatccacctgtagtattagttatggtaaccatttcgcaatgctgctgcattttcaccgcgtttgcgggactcttctccatttgctcgcttttgagattggaacatgttgtattggggaataaaggtcgattggtgtcttcagattacctgattcttataaaaaaaaaagagtttatatgttacananaaaaaaa

SEQ ID NO: 30953 - DNA, 652 bp, Triticum aestivum
  Clone ID: PAT_TA_30953
gagcacaaaaccaaaggaattggaaatgttcgtctttttctggttttctcgtgttgtggccacatatatataccagtttaccacaagagtgagaaaagagattacagtccctacagtctacagagaaaaatggcaccacaggctcatgaaatctgtcatggaccaactctaacaatcaactcgtctctgcctgcctagcacaaaccacgagcactaatcaacaggggtctgtcctctgatactatctacccaggtttaccgttcatcaatcaataattaaacactggtagccaggaaccaacttgtcatcagggagtaacaagaaaccggtaccatctggacgaccaaacctcgtgcgacaccagctcagttcgacccgccattgccgctcctgtatgaacctcagctccagcaacgagcggcgtcccaaggattccagcgctaacacccgccccagctccttctacagtgcccgggcagcgccacggtccccaccaccccacgctgggttctttgtgcactctcccaacgccgcccactgcgagcagctgttgctgttgtccgtgcaattgcctggcgtgtgatagaccttgtcgaacgaggccacgcggatccattttgttgccgaccatttctccccttgatgacctcg

SEQ ID NO: 30954 - DNA, 612 bp, Triticum aestivum
  Clone ID: PAT_TA_30954
gaactatacaagctgcaccacaaggactacccagctcaataatcatcattattccttaatacacttgcattaaattccaagcatgacagtgtaaaaatgaaatagagttgacaacagaggcacaatgatagcccggcataacaaggctgccgtcgtcgggctaccagagtgtacagatctgtgaatctaagtcccaagcgcaacaaatcaaagttgtaaacaatatacatttctgtggtgcggctgtgcatgggtcgagagcgttctcacggcggcataccactcaaccctcctcaccgaactccttggtgaacttctcgtgcacttccaggtccttcttgccaacggttggtctctgcctcgcaaggaccttctcgaaatcattcttcgagatcgggggtggaagaatctgtgaggcaaggcctttggatgcaagctcctgcatcgtggtctgcacagcacctggttgcttcgatccacagggcatccacatgtcaccatctgtcttgaagaagtacatagcatcctgtgttttgcgcacaggctcgaacaacacatctttcacacagacagcaacatcggaaccagagaacccttctgtacgacgaccca

SEQ ID NO: 30955 - DNA, 1561 bp, Triticum aestivum
  unsure (1)..(1561): unsure at all n locations
  Clone ID: PAT_TA_30955
agggtttttttttttttttttttttttttttttttttttttttttttttttttttttttttttttttttttttttttttttttttttttttttttttttttgcaccacaaggactacccaccttaataatcattattattccttaatattacacttgcagaaaattccaagcacaacagtgtgtaaaaattaaatagatttgacaatagaggcgcactgatagcacggcctaactaagcaaccgtcattactacttaatacacttggtaaaaactccaagaatgtaaagtgtaacagagaaaactacttggcaacacaaacacaatgatagcccggcataaaattgtttccgtcgtcggtgtatgagaggaaacagaatctgtgaatggaggtgtcatgcgcaaccattcaaagcgatcaacattgtacatttctgtggtgagcttctggttcggtttgagaacgttctcacggcggcttgccactcaatccccatcaccttcttccatggtgaacttgtaatgctctgtgaggcaattcctgccgacgggcgatctctgctgcatcgtggtcttgcacagcgcctggcttgcttcggtccacagggcatccacatgtcaccatctatcttgaagaagtacatagcatcctgtgttttgcgcacaggctcaaacaacacatctttcacacagacagcaacatcggaaccagagaatccttctgtacgacgacccaagacctcaaaatcactttccgataagctgtgcggtgtatccccaagatgcaccttaaacatatgctgcctagctttcgcgtcaggtagcggaatgtagatacgcttgtcaaaccgccgccgcacagcctggtccagagcatatggcgtattcgtcgcagcaagaacaagaactttatcatcattatggccaacaccctgcatctgtacaagaagttcggtttttattctcctggaagcttcactttcattgccttctccacgtgtaccgcacaaggaatcaatttcatcaatgaagataattgacggggcattttcgcgagccatttggaaaagattagcaactagtttctcgctctctcccatccatttcgaaacaaggtctgatgaagatatgctgaagaatgtcgaatcagcctcggttgcaacagctttagccaaataagactttcctgttcctggtggaccgtacagaagaaaagccctccatggcctccgcttacctgtgaagaactgggggaacttgacgggcaatatgacggcctcctgcagcgcctgcttggcgctctcgagcccggcgacgtcgttccacttgatgttgggcttctcggtgatgatggccgagttgaggccggccctcagcttggactgatcggagtcgtccccgccggcgccgtcgcctccttgatcttggggttcttctcgtacttgaggtgggtcttgaagtactcgagcgcgttcatgtagagcgggaacgccttgacgtagttgccggcattgtcctcctggacggcctgcttcacgtactcgatcgcctgctcctnaagc

SEQ ID NO: 30956 - DNA, 443 bp, Triticum aestivum
  unsure (1)..(443): unsure at all n locations
  Clone ID: PAT_TA_30956
tnaactaaaacaaatctagtattaatgataataatccaaaccaattacatcaattgctgaggtgagaccaccagactaggactaaagtagaatcaggagatctctagaatcatctcagactctgatactgatggctagcacgagcaacaccaacagctgagctacactggattctgaatctcagtctcatgccatggctcgttcgctcatttggtcctggtccacacgaagctataccatggccggcgtccagttgccgcccccaaagaagcggttggcttgcaccggcaccacgccacctctggtcgccaccccgcagtagcacaagcacgtcacggaggagccaccgcaggggcttatgtgaccctgcggcagctgctgctgctgaatcgccggcaaaagcggtggcgccgatgagccaccgtaaggccatgagtgaggcg

SEQ ID NO: 30957 - DNA, 308 bp, Triticum aestivum
  Clone ID: PAT_TA_30957
ggtttagaccgagggtgcagacccggacaagcgcatcatgggcagtacacatacaggtacgcaaacatacagcacccacccacacgacacagatcacacgacacctccatcaatcccacgggaacgcaacacacaacccacagacacacaccacggaacagcccgtataaactcactcacagggaccccgcgcctccgagcacgggggggcgccacaaaacagctacagatttctggcaactccgttacaacattaccactacatgttttttcttttttggggtacagtacagtacaaacggggttgg

SEQ ID NO: 30958 - DNA, 771 bp, Triticum aestivum
  Clone ID: PAT_TA_30958
gctcgccagcagcttcttgatattcctcagaaacttgagcttgccatgcccggcccgatgctcgggcgcggccgcggccggcgacggcacgaccgggctccgccctggctcgtcgtgatctccaacgcgccgctggtgactttcgccgtcgccgtatgtcgactcgttgagcggcgagaagagcgcggggtcgtagccgtcgaggccgaggctgccatactggagcatgagctccttggccttctcgctggagcggtagctcatgctcttgctcaggtccatggccgacggcatggcgctgccagccccgtcctgatcttgctcggcggaggaggggtggtggtcgccgccacggaggtcgtggcggaggcaggcgttgacccacttgaggtagacgagctcctcgacgtgcgcgcagtggtcgctgtgtagctgctcgatctgcctcgtcagccgatcgttcgcctccctcaggtagcttgcctcatcaaccatgtcgtcctcatgaaccagactaacagcggtggaaacctgctccgcatcctgcaacctccgagcaagctccctgttctcctcctccagcgcggccttggccctccgtagctccgccgcctccgccgccagcaccctctccctcttctcgccggtcttttccagctccattaccttgtcccggagcgccgccgcctcgctctgaaactcctcccgctccacctgcacccgctccttgagcgcccgcagcttctccttggcgcgacccagctgggcccg

SEQ ID NO: 30959 - DNA, 618 bp, Triticum aestivum
  unsure (1)..(618): unsure at all n locations
  Clone ID: PAT_TA_30959
tcattgggactaaggcttntgctcttggtattgatgttgcatttgacactgcctctggtgacttcaccaagtacaatgctggattgagccacactaatcaagatcttactgcttcgttgaatctgaacaacaaaggcaaacaccctggctgcttcctactaccaccaggtgcagcgcaccactgctgtgggagcagagatcgctcacagcttctcgagcaacgagaacaccatcaccgtcgggacgcagcacgagctggaccccctgaccaccgtgaaggggcgctacaacaacttcggcatcgcaaatgcgctcatccagcacgcgtggaggcccaagtctctcatcaccttatccaccgaggtcgacaccaaggccattgagaagagccccaagttcgggctggccctgtcactcaagccctgatgtgggattggcgggtgcgttaggatgctagcattttggtactatcagctcttggtccagcgaacaaagcttggacagacagaacttgtaatgcccaactttggtgatgcgacaaacttatctgtcgttttttagcctgttctacctgagggggttttctacccagttgatctgtgctactggtcgttatgc

SEQ ID NO: 30960 - DNA, 1184 bp, Triticum aestivum
  Clone ID: PAT_TA_30960
cgcgccgcgcacgccgcgtgaaagcaacttcacccgcattttacgacaacatcggcaagaaggccgggagatctcctcaacagggactacaccaccggccagaagttttcccttaacagccgcctccgcctaggaaggctgaactccaatacttgcatccccatctagggaacaacggcagtgttaggcctgaatccaaaccctcttgtaaacttttctggggtcattgggactaaggtttttgctcaagggtattaatgttacatttgacactgcctctggtgacttcagccaagaacaatgctggattgagccacactaatcaagatcttactgcttcgttgaatctgaacaacaaggcaaacaccctggctgcttcctactaccaccaggtgcagcgcaccactgctgtggggagcagagatcgctcacagcttctcgagcaacgagaacaccatcaccgtccgggacgcagcacgagctgggccccctgaccaccgtgaaggggcgctacaacaacttcggcatcgcaaatgcgctcatccaacacgcgtggaggcccaagtctctcatcaccttatccaccgaggttgacaccaaggccattgagaagagccccaagttcgggctggccctgtcactcaagccctgatgtgggattcgggggtgcgttaggatgctagcattttgttaccacaacttcgtggtcgcaagagcgctgctccagcacgcgtagatgcccatgtctctcatcaccttctccaccgaggttgacaccaaggccattgagaagagccccaagtttgggctggccctgtcactcaagccctgatttgggattcgcgggtgcgttaggatgctagcatttcggtactatcagctcttggtccagcgaacaaagctttggacagacagaacttgtaatgcccaactttggtgatgcgacaaacttatctgtcgttttttagcctgttctacctgagggggttttctaccctgttgatctgtgctactggtcgttatgcacgggcgtattgcgaatttgcgatgtcgtgaaatctgaatgccacttggatgtgctatgtgtttgtgtttgctttgttatgcaaaatgcttcccaagaaaaaaaaaaaaaaaaaaaaaaaaaaaaaaaaaaaaaaaaaaaaaaaaaaaaaaaaaaaacc

SEQ ID NO: 30961 - DNA, 1297 bp, Triticum aestivum
  Clone ID: PAT_TA_30961
attccagccgccgcttcctcctggccccatcaccaacctccacccgtgccccgtcgccaacacacgcttcctccctcaccgccgcggtgtttcctcccccgccgcccggtgcttccttccccgccgctgtggcccttcctcccccgcacccccaccatcgccggcatcctcgctcccctgctccaccatcgccgcggcaacctccccagatctctacaaccgccacagccgcaccccgcctcctccaccctcgccgtagttccacctccccagccgccaaagcgccacctcccaaggcgcctctctcctccagccctgacgcgcgcgacccaccgggcgccgcacgtgcatcttcgctgctccgcttcccggctgccggcgatcatccgccacgctcccccgacaccagcgagcatccgccccggcccggtccccagtcgaaacccaggacccccgtttctcctccctccatccggccttccgtctgctcgtggccgggcgcctctgtcctcctgtccggctgctgtaggggaagatttcagatgctgatattcagcgtattgccaaaagagttgggtgaacaaatgcactctccaaatgacatccaagaaaatattttcaagaggcggaacaaaatatggttggccatgctcgatccgaccaagaggagcagcagtagtaggtactggtgcagattagggtgtgtggtgatgcgaggagaagcctgtgcaccattgccactggcctcctctagctccgtcgatggctacttccttcttattgctagtacagaaaagaatgaactacgggttgcttctgcctcatgaccaaagtgcatgcatttttctctaaaccgcttcctttcttcttgcagactccttcctctgaaccaagtactgctattcttgcctttatgtactcaccaaaaacaaaatcaaaagtgagagaatagtgctcggttgtgatacgataagaaatgtgcagtggtgagaggatagaggaaaaaggacacacactgctatagagaaaccaacttgtggtgaatacttgtttgattatgtttgctagtacgtaacaaaatagtagttcacacttcagggcgaggtggatttggacttcagcggcagtacaaagagcacttcgggagcacgtggtgggctcagaaaaactcgtccccgaccacaacggcgcgaggaggccgagcttctctaccatggtcgtgctctttttttggttgagcttccatgctctttaacaaataaattcaaatataatgaatcatatgtgttcctctccc

SEQ ID NO: 30962 - DNA, 761 bp, Triticum aestivum
  Clone ID: PAT_TA_30962
agatcgttcgccacttgtacgagtacgtactcggacgtgatggctaactcgggcgccttgatccttctcatctcattggtcctgctagccggggctgcctacatccgccgtgagccaggccacgcggacggaagcttcgccgacacacacctccacttcttcatgcacgacgcttacgacggcccgcgccccacggccgcgctcatcgtcaccggaagggagccgctcccactaccgtctgacgacggcgccaccggcgggcaggcaacctcctcctccccgcggaggttcggcgacatcgccgtgatgaacaacgcgctcacggaggggcccgagcgcggcagcgtacgagtcggcacggcgcaggggttcaccgtgcgcgtcgccgagcacggcgccgtgaacgacctgagcctgcacctcgtgctcgaggccggcgagtacgggggaagctcgctggcggtgaagggcagggtggacacgggcgccgcggtgcgcgagtccataatcgtcggcggcaccggccgcttccgcttcgcgacgggctacgcgctgagcaggagctacgactacgacgtcgccaacggaggagtcgtggagatcgatgtgtacatgcagcttcgactagtttaattatatgctgcatgcatgtctggccggcgtatgcgtcgagtgagcatactgaattttaaccggtgacatccaggggacaaaatgaaataaagagataattgcgtgaacaacctcacaaaaaaaaaaaa

SEQ ID NO: 30963 - DNA, 1149 bp, Triticum aestivum
  Clone ID: PAT_TA_30963
gggacaaccaagatccaaatcttggccagcgactcgatcggatctccagccgacgccggcgaccatggctcgccgtcaccacctcctcgtcctcctccctctcctcgcgcttgccgtctccttcgtcgccgccgcccctgagggacatggagatgccgccgccgccttcatcgacggcgcgccgcaccgctacctgcgggatcagcaggacgaccaggccacgtcgatgtcacttgatgaagtttctgcagctgtttccgtcttgcttggttttgcaccacctgccatgcttcccgcgccttcttctgcaaagttaaacaagctgctactcccaaagccatttgacaggcctcgtgctgttttcttgatgcaaattgatggatcccatgactctgtcgatagcttcatatctgatgccggtagtatttacaaaaccaagattgagggtgcacaaaatgctgctacagggcttacagataaggatgaattgattgtcattcgttcacatgaatcttctggatcagatgttcttgataatgaactcaccgacttggcaacctggttggagggatcctaccagaaggctgatggcaaattaaacatccccttgaagaggaaacagtcttactttgctcctcaataaggaagtagacgttgaatttgcatccagcttgatctcgcttctcaaaaccatcaaaggggtattcaggttcatgaagatttttcaggaggcatcgtgagccctgcagagttattagtatgccgcttcacgggcattaaggctctggaagatgaatatggttctgcagaaattgttaagcagggagctgaagtagttcggacagctctgaccaaagcatttgatcaattgcagggagcatataacgggaaaattgttgggctggtaatatccactgaggaggcttcaacatccttggcatccatcatcgatggaccgtcttcattgcatatctcgagacggcttgcagaagcatcgaaaactaatgctacagcttctatagctgctatatatcttgttagattgagtcttgcatggattacagggatcatccttcttgtctcaactctcattgggatttgcctgctcatgaacatgccgcttaccagggacacactcctatattcaaa

SEQ ID NO: 30964 - DNA, 1602 bp, Triticum aestivum
  Clone ID: PAT_TA_30964
tgcttcccctatatattttcttagacgcccccggggggggagaggggggcagccagcgtcctccacttcccaaccgactcgaccggacctgctcccgacgccggccaacatcccccgccgtccccgcctcgccctcccctcccctccccccgcctccgccccctccctcgccccctctcctccgccgcccccgcgccgttgccgccgccttcttcctcgacgcatcgcaccgctgccggcgtgctcagcggtgcgacgaagccacatctcagccacttgatagaggttccgcaggcgttcctgtctcccgttgattttgcttcacctgcttctgccttgcttcgtcttcctccccctgcttagactacgccgctactccctccgacattcctcaaggggctagtctctattctctttgactcccaatcgctgtgttctcatgacgctaattattgcatcgcatatgtatgtggtattctttatatctgatgacggctggatgtagaaaaccaaaatgtacttacaaaaaagtgatactaaaggggataaatagaaggatgaatggactgacattcgttcggatgaatattttggattagatgttcttgataacgaactcgcctacttggaaacctggttgccgaggatcctaacagaaagcttctagcaaattaaacattcccttgatagtgcggaaacagtcttactttatgtcctcactaagtatgcatacagctagttttcctccagcttgacctccaatcttaaaaccatcgtacaggataatcaggctgaagaagatgtctcacgaggcaagttgtgacctgcagagttattaggtatgccacttcaggggcattaaggctctggaagatgaatatggtaccgcaggaaattgttaagcaaggagctgaagtagtaaaggatttgttcaattgaagggatggcatataatgggaaagtttttgggctggtaatatccaggcatggagacttctacattcattggcatccatcatcgatgcaccgccttcattgcatatctcaagacggcttgcagaagcatctaaaactaatgctacagcttctatagctgctatatatcttgttagattgagtcttgcatggattacagggatcatctttcttgtctcaactctcattgggatttgcctgctcatgaacatgccgcttaccagggacacgctcctttattcgaatgtcaagatggattagtttgtgctacatatgaattttcgcacgatgtcattgaagttgtcgaacagtcatgcttggtttttttctttggaccttgggtttacaatagggacgctgagtgtgggcttgctgttcacccagtgcagcataaaaatactctgttgctatgtggacccttcatttagaattgtactgccactgcctgcatgggcttctctcgtttccccgtaaataaataaaaaacaatcgagaggagtgtattttgttaatatcagcgaagattgtactatattgttgtaaaaacccagtatctgaataaattcgccacttggatattcattgggaaagctgttgtcttcatatgactaaatgatttattgagtt

SEQ ID NO: 30965 - DNA, 649 bp, Triticum aestivum
  Clone ID: PAT_TA_30965
gagctggcctgtccaattccaaatgtggcaaacagaagacctcatcctcgtcgccgtctcgctctctgtctctgtcctggcgtgcacggtggcgggcgacggcggtggcaggccgctggtgacggccgtcacaagggacgcggccacctccctctacaccatccccgtcaagtccggcagcccgctggtcgtcgacctctccggccccatcgtctggtccacctgcgacgacgccgcctcccacgacacgctcgagtgcaacagcatcgactgcatgcgcgcgcaccgcttccacccgcccaactgccagcataccggctacggcatgcccgaccccggcaacccctaccgctgcaaatgcaccacgcacccgcacaaccccgtctccggcgacactgcgtcgggggacatgacccgcgtggcgctctccgccaacgccaccgacggcaggaacccgttgggcccggtatcgttcaccgccgtggcgtcttgcgcgccggactccctgttagcggggctgccggcgggggctgtcggcgtcgcggggctcgcgcactcgggcctctcgttccccgctcaggtcgcgcgcacgcaaggcgtcctaactcgttcgcgctctgcctcccaagcggcccaggaaacggcgtcg

SEQ ID NO: 30966 - DNA, 1013 bp, Triticum aestivum
  Clone ID: PAT_TA_30966
ttttttttttttttttctctgcagatcctgttagatatgaacaattcatcctcttctgaggagtcgggctaccttttattcttcttttcatttacgggacgaccaatttggtcggaaacacacactcacaacccaatccctagtatgcatcaaactgccagccctatctgcttctttacattctggtaacttgtctgaaattaccggcatttcccttcggccattgcgcctatgagctaagaacttcatgttctctcacagtccatggttcttcattcaacaagtgtttcatctctccaataacagatgatcctcaacctctacattggtgaatgttacagccttctgaaactttctgtggcataaaacttcaacctcggccatgtagacagcggacaccgggcggtgatccgaaagattaagctccacccttctgtaagaatccaacctgatgccctttccgtatgaaagaatccgctcgcaccatgcaggtcttcttctcgccgatattggctcgtcccccgcatacttatctgaattaaattcgtatttatatgttggggggaagctcatcacccctttgatccaaccgtaaaatgcacccccggtcatcagttcccattttagctgatcattgtcaaacaataaatcccattcctgtctggagataagctcatgtgttctttcatatgataggttgattcggtagttgagatccccaaaccatataatcttttcatggtcatgtattcccttaggcatgctgactctatgaactgggttaaatatcgttcttcgaaggatttcttcaacatctgcatttctctttgttagatttccatccttttcaccagatgtcaggtggcaacatacaaaacaaaagggtgtctgatatatagacatgctgactgatattgatcccttgttaccgatgtaacccatcgcgcctacacctacagttgatactctcaaattgtgaatgtgcctcctaaggcctctctgaacccacaccg

SEQ ID NO: 30967 - DNA, 833 bp, Triticum aestivum
  unsure (1)..(833): unsure at all n locations
  Clone ID: PAT_TA_30967
ncccccccttggagnttttttttttttttttgggccggcaacaaaattgacatcccanttagatcnntgcaaggtttacattggcgttattgggcaaacgaaacaaatgaaaattctaggtatgagaaaagtatatcttgtagaggcaaaggaaaggccatgtgccatattttctcaaggacttttggtggtaacatttcttacaccggctgcaggggctggatcatcaacaacatacatgatcaccaaggctacagcatctaaggattctttaccgcggatttgcatcagagcaccgtcagctaggatagctgttttgctcatctctaagagcagtcagctgtgcggtctaattctggtctcctcgtttgattttccaagaattcttggccgcttcagctgatgaattaccagaatctgcacccttgtctttgggcttgggcttcgagaagaatggatcccactcatgaggtccaactgtccgctgtccttctaacagttcatacttccagctattctcttcaataaaatctttatcttcgctgccagagatgatatctcttctcaattgtgtcactttgttgatgattgccgaaaccgaaacatcaaacgcgtcctttagcgtttccagtttcgaccttggatcagcatatatcacctttggtatgagatttataacctcttctctcatctgcttgacaacgtctggatggatacttctcagtatctcctcaacactgacatttccatcacggacgccaccttcagggatgaagaccgagtaactcgtataattcttcggaagatgccatgtatactggacatatgctgaa

SEQ ID NO: 30968 - DNA, 701 bp, Triticum aestivum
  unsure (1)..(701): unsure at all n locations
  Clone ID: PAT_TA_30968
ggggccacggcgaacaaggaaaggagcggcaggggtgcagctgtgtgagggcactggtctcgcgcgtgaggagcgcctctcctcgggaggaccggaanggagcgagtcaaactcatatccacttcagagcaaggtgggtctacaactgctaatttaaagggattcgattgtccctcgtctgagcataagcatgataaagtgcagcaactgacttggcttattgttttggaaatcgcaaccggtgctctcctgcttgttttcttgatcactggtgcaattactgcctccagaagctgtaatctaaagccttctataagaatatcatcatggagtagatcaaaaagttggagcgacgagataacagtactcattgattctgatatgctgaaaagtttgccaaagttgagtcgccaggaacttgaagtagcatgtgaggattttagcaacattattggctcaactccggagactgtagtctacaaaggaacaatgaaggatgggcctgaggtttctgtcatatcattatgcgcctttgaaggtcattggactagccagcatgagctcttttaccaaagcaaggttattgatctggcaaggctgaatcatgagaacatagcaaagtttctgggctattgcagagagagtgacccattctccaggatgttagtctttgagtacgcatcaaacgggaccctgtacga

SEQ ID NO: 30969 - DNA, 1295 bp, Triticum aestivum
  Clone ID: PAT_TA_30969
cggaatcgtatttcagggtacatgagaggctgctcgaccgcagcttctggatcaggtcaacgcggctgctcgagaggctggggacgacgcatctgctcggtgcagaatggcggtggcgggatccagcgggcgcgggagaatgagggatccggcgccgtgggcgaagtccttgcagctggaggcgggcctccatggctggcagggagagccccaaggtcatggcggggctttgatttttctggtagaaaagagagacagaggaggatccagggaggaggagaggtaggagaagaaggaagggtgcggcaaaccaggggtgcagcggtccgacggcactggtctcccgcgtgaggagcgcctctccttgggaggatctggagggagtgagtgaaactcaaatccacgcaagcaagctgtacaagtagtacaacgacgatgaagcaagccaaccagatgtgcacggaccgcatacatcatgcctgatgagcctcctcttgcaacgtggcctgcgactctatgaatcgcttggagtgctccaatgtcagttctgctcatcgctttttctgttattgcctccagaaactgcaatctaaagccttctataagaatatcatcacagagtagagcaaagagttggagcgacgagagaagagcactgatactttgaggaaactcatccgagttcccaacgtgaaatcaaattggccagctacgtttcaaagtatgagatgtggttgggcattgaattgcttccccgatgccaggcctcccgagttcactaaagcaacaagcaggggatcaccttgatgcatatcgccatcacattcagccccaaagatccgggcgctgcagcctgggcatgattaactgggcagtgccagcgtcaagcttccggatggtggcgacaacaatggtggctggaggcgacgggattagcagcgtggcaaacagtagcgcgcagcgtttcactgtagggcgtgtggccagtgcttgcggcggttgtggatgatgaagtactggacctgcggtggacgaccatccgcaagatctacatcatcatctttgggtcagttcgccatgaaggccattctgcgaacgaggttgttcatgtccctcctcatgtacagttgtacttctattctagggtttcaactctgcactccattccgcgtcctgtatattcagagtctcgagtttgcatgagtctcgatttgattaaatgaacaggtcactaagatagatttttggtcgaggatagatttttgatcgtgtgtgggatgagagggaatacttat

SEQ ID NO: 30970 - DNA, 973 bp, Triticum aestivum
  Clone ID: PAT_TA_30970
gaaggttgatgaactgaaaaaatgaacagaaggggtgagcaggatgctacatgcaggtacaggatcagaacaccttggcagcttgcagatacgggatgctacctgcatgtaaatgaaattgtgcggttcgatggtgcggctgaaggccttgtagttcacccccggagcgcgcgcctggtgctggtcgtggcggcgagcagcacctcggtcacgtcctcgtcactggcctcgttcacattcgagcactgcgcctggtgctggccacagtggcgacgaccacgcgaatagaggcagacccgacgccggccacgtcggcgtgggcgagcagccgcgctcggcgtctgcccatggcggcaccttgaccggttcagggacgagcttgtggaggaaggggtaccctggagcgggtcggaggccggatggtcagcgtcggcgaaggtctcgcggagggggacggcctcgacgcccgccgcgacggcgcaagtgagcaggccgcgctcggcccccgcccacgaccgcacctccagccggtcgcgcggaccagaaatcacggcggcatgggctcacgccagtgaggagcacgcgtagggattcaacccgccgccagggacctgtcgtgctcctccgccccgccgaggccacacacgagctcctccgccgcggggacgagctccccgcgccgctggggcatccaccgtacaagctcctcccggccgcggccacgcaagaacttctccgccgggggcgtccaccgcgcgagctcctcccgccgcggtctcgagctcctccgccgcgggcacgacctcatccgcacaccaccgaggcctccatcgcgcgagctcctccccgccgacgaggcgtccaccgcgcgagctcatccccgcgccgccgaggcgtccaccgcgcgagctcctcccgccgcggtctccggtgacacttgcagggcagccaccccacaggagctcgtctccgc

SEQ ID NO: 30971 - DNA, 881 bp, Triticum aestivum
  Clone ID: PAT_TA_30971
tatagaacttataaaacttaaccatggaaaattattcgaatacatatgaaaaaacaacgatgaataggttgccgtcatggcaaacatatgctttagttgccatggcaacatcatctataaaacttaacaaaagttcacatgattttggttgccatggcaaatatgcttttcaatcgccatgcgtttactagtacggttactcaagaaacaaaagtgagagtgtaattacgaaattgtgatgtgtctatactcggacaaagacatggcaattttgaaggttgatgaactgaaaaatgaacagaaggggtgagcaggatgctacgtgcaggtacaggatcagaacaccttggcagcctacagatacgggatgctacctgcatgtaaatgaagttgtgcggctcgatggtgcggctgaaggccttgtagttcacccccggagcgcgcgcctggtgctggtcgcggcggcgagcagcacctcggtcacgtcctcgtcactggcttcgttcacattcgagcactgcgcctggtgctggccacaacggcgaggaccacgcgaatagaggcagacccgacgctggccgcgtcggcgtgggcgagcaggcgcgctcggcgtctgcacatggcggcaccttgaccggttcacggacgagcttgcgcaggaaggagtaccttcgagccgctcgccgctggggcatccaccgtacaagctcctcccggccgcggccacgcaagaactcctccgccgggggcgtccaccgcgcgagctcctcccgccgcgggctcgacctcctcccccgcgcccccgacccctcccgcgcgcaaccgccgcatcccgcccgcgagctcctccccgcgccgacgaggcgtccacctcgtgcagt

SEQ ID NO: 30972 - DNA, 683 bp, Triticum aestivum
  Clone ID: PAT_TA_30972
ctcgaaaaggcaaaaccaaaccttttgattaacgaaacccagatgttccgatcacattgctaaccaacgaaatgattgaactagacagtgagccaaatgcttgcctatggcaaggcagaattcagagtggtgaaccaacacgtttcagggttcaggacgcactgttagctagcatgttcctccttgatctcgtcggcgcggacgacagccaccacgtcgccgtgatcatcacggctgtcaccggtgtcgtcggagcagtggacgcccttcttggatggcctgcagcctggcccggcggggtacttgcgagcgttgaggtcgatcttgcgcagcgcggccttgcccaggtcaacaccgcacatttttgccacccgggcagccccttgggcacctcccctttccactggaatatctcagagagctctcccacctccccccccgggccgcccagggggctcctccccctgccgctcggctccctgtccctccccccccccctgtcggccatcttcttcctcagctcctccagggtcaccgcccccccccccgcccccgcgcccgccccctcccgcccatctgcttcctccgcccctccagcacccccgcccccgcccccgccgcccccgcgccgcctccctcgcccgtctccggcgacgtcgcggcggccttcgtccccctcgtgc

SEQ ID NO: 30973 - DNA, 1208 bp, Triticum aestivum
  Clone ID: PAT_TA_30973
ggccgcgtcgaccgcgatctctctcccgctctcttctccccaccaccacccaagtcgtcgtctccgtcgccggccgccatggctccgggcctctacaccgacatcggcaagaagaccagagatctgctctacagggactactgcacgcaccagaagttcaccctcaccacatgcacccccgagggcgtcgcaatcacagctgcaggaactaggaaaaacgagtctatctttggcgagcttcagacccagcttaagaacaagaacttgacagttgatatcaaagcaaactcagagtcagatcttctgctggtgtattcggaagcaaagaactgtcagttggtgttgacgtttcatttgacacggcaactagcaatttcaccaagtacaacgctgctttaagcctcacgtatccggatcttattgcttcactccacctgaacaatcacggtgacaccttgactgcgcctttctggtgtattcggaagcaaagaactgtcagttggtgttgatgtttcatttgacacggcaactagcaatttcaccaagtacaacgctgctttaagcctcacgtatccggatcttattgcctcactccacctgaacaatcacggtgacaccttgactgcgtcttactaccacttagtaaagtcacattctagcaccgctgttggagcagagctgtcccacaacttcccaaggaacgagagcacattgatatttggatcacagcactcattggacccgcacaccagtgtgaaggcacgcttcaacaactatggcatggctagtgcccttgtccagcatgaatggcgagccaagtcactcgttaccatctccggcgaggttgacaccaaggcaattgagaagagcacaaaagttggtctgtcattggtgctaaagccttgagatgcacagctgggaccctatgttttgaaaaaaaaggttcagttctgctggattggaataacatggccccaggtcatctcttcgtgctttcattttgatcttgaattcctcctttgtccacataatctgtttcctaggcaaatgttagccttgacctcctcgttattttgatttgatcatcagcgcctgtcaataatttctggtgattaagacctattgtgaatcttgtcaaatgtgacagattggcggttaaagacagtgtgttcaatcccaaaaaaaaaaaaaaaaaaaaaaaaaaaaaa

SEQ ID NO: 30974 - DNA, 848 bp, Triticum aestivum
  unsure (1)..(848): unsure at all n locations
  Clone ID: PAT_TA_30974
ggcacgagccgactctgcatcgtcacgctccgccccgcctcaccgcgcgccgccagccgcttcctgccacgccccgacccgccccacctcaccgggcgccgccggccacctcctgcctcccaccccggagaacggcgacaggcggctgccaacggagggatccaggcggaggagggttagagaggcgtgcggaaggcctacgaggtttgggggcgccagatctagagttcgcggtccggcggcgtcaaagctcgggccggatcgagaggactggccatggcgaggtggcagtgaccatggcgtcggcaatgatggcaagactcggctacgggtcctaatcagagggggaaacaaagggaaaagttgcggcgactcacggtgaactcgacggcgaggtcggggaggcagcaacggcaaggtaatcgacgatgaaggacggtgccggacttggagttggaggatgatggcgacggcttcagggcgaatccggccgagtccttgcgcggggaaggagatttcaaggttgcggacctcctggacaaggttgtttcctgcggggaggccggtagccgtgcttgtggtggtcctcctgtgggctgcaatttgcaccgtgagtccgtcggtcctagctccagctgcaccgtggcatcacggcgctggagcggcgcggctcaagatggcaatggggccccgaaacccgcgtccccgcgggtttttaccctattangggacggggatgggcgtctttttaaccccatggggctgctgctgggtaaattataaaacccaacatgtttcacgggtttaaacccgtttgagcaatacccgaacccgaaacccgccatccc

SEQ ID NO: 30975 - DNA, 883 bp, Triticum aestivum
  unsure (1)..(883): unsure at all n locations
  Clone ID: PAT_TA_30975
gaacatgaaaacaacaaataatttcttgaccactttagctcccaattttccatgatcccagcaactggtatataaatgaactaaaaggagacatcttactttaccaatttaaaactaacactttcaattcaattcactagtattaacaccataaacatctatatatgttacaaagacagtcgatcagtctaaacaagaactcatgagaaaaagcaatttcgccattttgcacatggaatcctttatacacacaccggtatcccgatgaagacctgatatgcaccataaaaccagctgtgatccacaaactgataacagtgataaaaggccgccacaaaatagatatctagccttggcgtttcagagcatatatcaattccagatcaccattaccagaggcaaatgaagggtgaaggtccaacagaagcttgtcttccctcaatctttccaagccatcaaagagagacagttttgtctcagcagaaccagagtccttcactgcaacacttctattgtggaggtccacccttatatacatctcaagttcttcaacttgccgagacaactgaagagcaatgaactgtagaagatgtcgaatggacacccttggtcgacaacttagatagggcttttccaagttaggcattgtttgtccatcaagaggaagaagaacaagatacaagttgaactccttgttttcatcagttgcacggaggtggtccaccaacttcgcgaaacgcccacccttccccagcctgccgtttgttccaccaacattgttgtaccgagtttggcttcttgtgccattttttccccatgcgagcatctcaccccgcaaggagaggtggtgaaaccttctttccctcgtgccgaattncctgca

SEQ ID NO: 30976 - DNA, 543 bp, Triticum aestivum
  Clone ID: PAT_TA_30976
ttatggaagtcatcgctatctcagaaacaaatatgattgcacatacaatctcttacagattgcaagaaagatttgtatcagaccgataaaacagcagtttggtaccgtggtagctgcagaaactaaatttgactctggtaaacaacgaagcagcgccatgtctctctcgataacaagaccacaacaaagtacagttatcaccaatttatctacgtccatgtggagcttgataagcaccactggtgttaggtgctgcttgcgcggatccatagccctgaggctgtgcagacaacccgtacggtgaccccccctgggttggggcgaagtgtgatgatgcctgtgctagtccataggatggtggcatctgtgtgtgtgcataagatggagcctgtgtttgtccatatgatggtagcccctgagctgagccatgaggtcgcgctgttgttgcgccgtatgatgaagacgggactggcccagaagcatatgatggtggcacctgtgcagatccatatgtgggtgcagcacctggtgccggacgcgtgg

SEQ ID NO: 30977 - DNA, 1326 bp, Triticum aestivum
  Clone ID: PAT_TA_30977
gatggttactggtcgcgatctatgtttcagatttgggtccacctgctatctcttacagattgcacgtgcgactcgtttggcacccactgaacagcacctgggtaccgtggtgcaaaataaacagtatacaactagctgaaatttacagtattgttacttcttgcctaacctcaagacatcaccatctcatagaaaatgctttaaaaccatcacaacacaaatttatggaaatcatcgccatctcagaaacaaatgtgcttgcacatataatctcttacagattgcaagaaagatttgtatcagaccgataaaacagcagtttggtaccgtggtagctgcagaaactaaatttgactctggtaaacaaggaagcagcgccatgtctctcgcgccaactagatcacaacaaagtacggttatcaccaatttatctgcgtccatgtggagcttgataagcaccaccgatgttaggtgctgcttgcgcggatccatagccctgaggctgtgcagacaacccgtacggtgaccccccctgggttggggcaaaatgtgatgatgcctgtgctagtccataggatggtggcatctgtgtgtgtgcataagatggagcctgtatttgtccatatgatggtagtccctgagctgttgttgcgccgtatgatgaagtttggactagcccagaagcatatgatggcggcacctgtgcagatccataggtgggtgcacctggtgcccgtgcatgcgaaggtggtgtgacctgacttgatccatagtaaccagcactactcccatgagcagttggagccgctgcctgagctccaagtgcaggcattctagaagtatcatatccagcaactttcagagagtcgtaaccagtagcaccccttgatgcatcatggactctagcaagacgagaagtctcatatgaattccctcttgatggatcatatccagaacgaggagcagttccagctgggcttccgcttaaagggtctggcataccagggggcgtcctagcctgtgcaaccccatagccaccatcataagcagaatggtggctagatgtaccgccatccttctgagcaaaattaggattgtacaaagtaccacttctgtcaatattagttgtgtttgtcaactcagcacgaagcttctctaactctgtaaccatggagtcataatttttcttcattccctgcagcgactcggagtggtccaccttcagtttcctttcatactcatatgcggccctgaggtgctgatattcctgtcaagcagcatcaagatcagccgtgagtcctggccgcgcctgtgcctcgccaaagc

SEQ ID NO: 30978 - DNA, 1330 bp, Triticum aestivum
  unsure (1)..(1330): unsure at all n locations
  Clone ID: PAT_TA_30978
ttgcgtggtcgcggccgaggtacgggctcgtgacttcgatagatttcacaatagtcttgtacgtgttcatctattcttcaaattgaccagtaatgccaagaacgaacggtcacgcgacgagaacaacgacggggctcctcacagcgtggctcctcatacgctgcactctgttgccccacgtgcaagaatatttcctctttcagacgtccgacttctgttcccccgtcgcttcgatctttatcgtgaagctcttcttctccccggtacgtgcgaaggcgaggctcgtcggcgagaccttcacggagaagcccatgggctcgaccacggcgaccctgtaatgagccccgtgctcgccgacgttggtcaccgtccggtgcacggtggtggacccattgaggccgtggatggcgacggaagggtagttgagctcgtacggacgcggcgggctcgccgggcacgggaacgagcggtcaagctgagcgccgccgctcgcgcaggcgtagaggaggtagtcctggaaggacgcgtcgtacaccaggcccgggtccagcgcgtgcctgggcctgatgtggcccgagccgtagcccatggcccccgccaccgttccgtccgcgttcattattggcgccgccttccgcgttgtttgctgttgcggtggtcatgcatggctgatcggattgcggcggcgctccagtcggggtgggctgacttggaggagaacggcggtggcggagacgtgcgggcacgacatggatgtcccggagatgatgttgttcttctcctcccgctcctcgccgtcgtccccgtcgggccgtcggcgcctcgcccccccccgccacgccgcccggccctgccgccccggcgccgtcacgtcaggcttgagaatgctgggctcgagggcgttgggtccacgcgacgagaactgtgccataaccggcgacggcttcacgtcccacgactgtcctagagcgatccaggtaagcggttgggttcgcgctggagttgatgtacttgaggatggtgttgacgccggccatggagactgccgttccggggagcacgtgcgcgtcgacgggcacctcgctgccgtacatcggcgggttgccgagcacgattgccccgccgcccgcccgcttcacctccaggcctttgcccaccctcaggccgctccccctcaagcacaccacgattttgcctcgcaccttnttcggcgagagcgaattcggcaggcattggttggtaacgttggcgggagtgccaggaaccacggcgtgtgctgcataaaccattcgatacgtncctgttcgccggcagctgatnatggtgttac

SEQ ID NO: 30979 - DNA, 799 bp, Triticum aestivum
  Clone ID: PAT_TA_30979
agtcgaaataatagatgcaagcaaattcgaaatccacacagcacgatcacaaactttgaccaagcaacactagatccatgcatgtaactaaaacgaaccactaggcgggcacggtaaaattgaagttgctgcagaagagccccctcccgttgatctgcccggtgaaggccatggtctgcttctcttcgttgaacaccaccaggttctcctccatctgcaaccctccgagcaccaccgctggcgccgcaccgccgccatacccggcattgtctccctccttcatctccacgaaaccgaagcacgccgtggggcgtccgatcaccagcgccatggagttgatgccctgcaccgcccagcccgagccgccctccagcccaaagccgaccgtcggcacgaagtagccgaaccgcgtcagtgacagcctcgaagagttgtagcacagctcgaacggcgacccggccggggaggggaccctcgctccggcggtaatcgcaccgtcgcgttccatggcctggtcgaacgcgtcgatgagcgggcggtacacgtcgcggcgtaccagcgcgtacggggtcgtcgtggagaagccaatggtgagcggtgcgtacgtgtccacgggcaccttcactccgtcgacgaagacgccccggctggccgagacgtagtagccgggggattccccgtgcttgcggagcggggtgtcgccgcccagcatctccgtgatggaccgcccgttcgccgcgaagagcgggcccccgccgaagatggcgacgccgtcgcgttcgcggttccctcgtgccga

SEQ ID NO: 30980 - DNA, 1246 bp, Triticum aestivum
  Clone ID: PAT_TA_30980
cccacgcgtccgcccacgcgcccgggaagcagaagctccagcttcaggttcagcttcttcccatagcaatggctggcaccggcagcacctggctcctgctggagcagaagggagctgggccgggagcaaggagctcccacgccatcaccctcgtcggcggcacggcctactccttcggcggcgagttcacgccgcgcctgcccgtggacaacaccatgtacgccttcgacctcaaggcccagtcctggtccgccctcgacgcggccggcgaggtgcccccgccgcgcgtcggcgtcaccatggcctccgtcggcgccacggtgttcgtcttcggcggccgcgacaaggaccacacggagctcaacgagctctactccttcgacacggccaccagcacctggaccctgctctcctccggcgacgacggcccgccgcaccggagctaccactccatggtggccgacggcgaggggagccgcgtgtacgtctttggtggctgcggcaacgccggcaggctgaacgacctgtgggcctacgacgtcgccgccgggcgctgggaggagctgccttcgccgggggcggcgtgccctccccgcggcgggcccgggctggcgttcgccggcgggaaggtgtgggtggtgtacgggttctccggggacgcggagctcgacgacgtgcactcctacgacccggccaccggcaagtgggccgtggtcgacaccaccggcgacaagcccaccccgcggagcgtgctctgcgccgccggggtcgggaagcacgtggtggtgttcggcggcgaggtggaccccagcgatctcggccatctaggcgccggcaaattctccgccgaggccttcgtgctggacaccgacaccggcgcgtgggtcaggctggatgacgccgggtccggtcaccaccccggtcctcggggttggtgcgcgttctcggcgggggcgctcgacggccggcgaggcatgcttgtctacggcggcaactcgccgacgaacgaccggcttggtgacatgttcctcttcactccgcttctagcttgagtcagcacgccagctaggcggtgcccgcagctctgtgtgcaattggagtgggtctgcgacgaacttgctgctttgttaatgctgtgtgtcatagtagatgatttgcatcttgtgtttatgttgtgtatgtaataaatgaagaataatagtactcgtagtagtaatgatgaattgggtgttttacaaaaaaaaaa

SEQ ID NO: 30981 - DNA, 838 bp, Triticum aestivum
  Clone ID: PAT_TA_30981
aagatgaaaagcttgcatcgaattaataattaggataacaggaccgcagcatgcatagaccaagctcaagggtaaccctggcgatcacatctggcgcaactccagcatttggaaagcatcatatatgcatatctactaggctagctagctactaattaattaagtgtatctgaaggagttaattagtcaggggttgttgggcattgtggaagtggagaggtcttgcaatagcgcgtagtcagtgaaatggtactgctggagagttcccgccattggatgagaggttggatgatgatggggaggcggtggcacgctcagcaggtgcatgttagggcttgggtagggcatgcgcatcatgctcatcagctctgggtggaacacccccggcggtatgaggtgcggcggcgggagcccgtggagtccggggggcataaagaggtgcgcggcgcttccccggaggctggcggggctgtggtgcgtgtgctgcccttcgtacgtggtgatcaccgtcgacgggtcctggtacgaccgctccacccgcttcttcacgccgcacttgggcgtagtgcaccggtagtagctccttggataagggctgttcttgacggccttctggccgtatttgcgccagcggtagccgtcctcgaggtgatcgacctcgctcttggtgaggaaggagacgcggggcagccgcggcctcttctcggctttctttttgggtttgttattcctgcagcggcaaagtaaccaatcagttaggttcatcggaaaacaaaagaaaataagcacagaacaggcactgatccaacagggcctagcttaattagctaggtcaatc

SEQ ID NO: 30982 - DNA, 671 bp, Triticum aestivum
  Clone ID: PAT_TA_30982
gcacctctttcggtcgttcttgaagttcgtcaatcggcgaactaacagttcatccgacgtccctggctccgagagaacactatgccgccgaagatcgatccttctcagaaggtcgaaattttcgtccgatgcgtcggaggtgaggcctccggtgtatcgtcgctggccccgaaggtcggccccctcggtctgtcacccaagaagatttcggacgacatcgccaaggcgaccggcgattggaaagggctgaaaattacgtgcaagctcactgtgcagaaccgccaagccgctgtggaggtcgtgcctagcgctgcggcgctggtcatccgcgcgctcaaggagccggcgcgcgaccgaaagaaggagaagaacgtcaagcacaacggcaacttgacgctcgacgaggtgatcaaggtcgcccgcgcgatgcgccaccgctcgatggcgaagaccttctccggcaccgtcaaggagatcctcggcacgtgcgtgtcggtgggctgctcggtcgacggccagagcccgcgccccgcccaggcgaagatcgacgctggcgagatcgagctccccgacgcctaagcgcgtttccgtttccggtcgagcgcgccgcgtacccctgtgtagcggacgtgtgttggcattgggattcggtcgggagaatacacattctg

SEQ ID NO: 30983 - DNA, 1159 bp, Triticum aestivum
  unsure (1)..(1159): unsure at all n locations
  Clone ID: PAT_TA_30983
gcccacttccgccgcctcccaccgaatgggccgcaagaggagggctagggtttccagcgacagcgacggcgacgacgtcgagatgaacggcgatgagcccgcccccgccgccgcggagagcaagagcctctacgagatattaggggttgcgagcacagcttcacaacaggagataaaaaaggcatatcacaagttggccttgcgtcttcacccagataagaatcctggagatgaggaagccaacgaaaaatttcagcagctgcaaaaggtgatatctattcttggagatcaggagaaaagggcattgtatgatgagactggaattactgatgatgatgcactggttggagaagctgcagacaatctccaagcgtacttcagaacagtgtacagaaaggtcacagaggctgacattgaagaatttgaagctaagtatagagggtcagactctgagaaaaaggatttaaaggaactgtacacaaaatttaagggcaacatgaacagactcttctgctcaatgatttgctcagatgccaagcttgattctcaccgcttcaaagatataattgatcaggcaattgctgaaggcgaggtgaagtccaccaaagtgtatgcgaaatgggctaaaaagatctctgagatagaaccaccccacaaacccattggagaggagagtgaagaaaaagaagagccaggagagcgacctcatcctggcgatctcgcagcgcagggaacagaggaaggagcggtttgactctgttctgtcatctataatgtccaagtgtgatgacaacaaggcgggcagctcagagcccacggaggaggagtttgagcgcgctcggcagaggcttgagaagaagcgcaccaaggggcgcaaatggtatgaatcttgacatgcatgcgcaaatgatatgaatcttgacatgcatgcaggcccttcgagaaaagatgggtgttgagtggagtggagtggaggggttgtgtcgcaactgtagtgtcgctttgttttatgagtgggcgtgtgtataagtaactgaatgcaagtgtggtgtggttttagatgtgaacaactgtggaagtgtcctgtcccatgaatgaaatgaaatccccggcatgcccaggtgatagtctgttctctgtttattcgcgtanatcaaag

SEQ ID NO: 30984 - DNA, 1065 bp, Triticum aestivum
  Clone ID: PAT_TA_30984
ggcggacaaggctcgcaacatcgcgcgcgcccgcgccgccatcgagtccgccgcggccgacggcgccaagctcgtgctcctcccggagatatggaacggtccatattcaaatgacagctttccggagtatgctgaggacattgaggctggtggcgatgcagctccttcattttcaatgatgtctgatgttgctcgcagcttgcaaattactcttgttggtggatccatatcagaacgttctggtaacagcttgtacaatacatgctgcgtctttggttcagatggcaagcttaagggtaaacatagaaaggtccatctttttgatattgatattccaggaaagattacattccaggaatcaaaaacccttactgctgggcaggatcttactgttgttgacacagatgtaggccgaattggtataggcatttgctatgacattcgtttccaggaattggcaatgttgtatgctgcaagaggtgctcatttgctatgctatcctggtgctttcaacatgactactgggccattgcactgggagttgcttcaacgggcaagggctgctgacaaccagctttttgtggcaacctgtgctccagctcgagatactagttcaagctatgttgcttggggacattccactcttgttggaccgtttggtgaggtgatcgccacaactgagcatgacgaatcaactataatagctgagattgattattcattgattgagcagaggaggcaatttcttcctctgcgacatcaacggcgtggagatctttatcagttggtagatgtccaggggtcgggttccaagtagactgcctgaattgctcgggtaggcatgatccatgaagcaagaatcgctgattgagaaggcaggctcatatgctttgattcgtgagatgtatgtgccacatcttcatctgtaatttgcactcctggcacatgatgtgtgaaaaggggacaaaaccaataagagacatgtaacatgtacaattgcctgagttgcgaaataatcaaaccccttggcgggaacaaaaatcgaaaactgtactcaaaaaaaac

SEQ ID NO: 30985 - DNA, 560 bp, Triticum aestivum
  unsure (1)..(560): unsure at all n locations
  Clone ID: PAT_TA_30985
accagtagccgacaccaccgatagctatgccgcgcnacagaaggcccaaccggagacgtcgccggcggccgcatctaccggcgcctccgcggcgccgagtccgcggccggggaccttgatggctggcccttccccccccccgcgcgcgccagtgcctcccttgccccagtcgctggcagccagcacaaccgacagttatgctgcgccgaagacttcccagccagagacaccagcggccgaaacaactgatgcctatgccgcgccgagaccgaggctgtggaacaagaagattggccatctccccctgccgcactaagtccaacagtttacccagtttctgagcgatcaaccaaaaaaacttcccctctcatctcacttgaggagctactatgactctatgaccggattttataccccaattttcattgtgtaaccgcttatccacaatgtaccacttatgcaactccgtttgcagtgttattgtattgctatgtaaagagaactcatgtacctgtcatgtaagaaaaaagaaaacaccaaaaaacaaaaaaaagcggccg

SEQ ID NO: 30986 - DNA, 529 bp, Triticum aestivum
  Clone ID: PAT_TA_30986
gaggaattcggcacgaggagatttggcgccggcagtatactagtccgactctactactggctctgatctgtagctgcgtcgcggtcgcccatggtggtcgtcttccccccgactccccgccccagccaaatcccgacccccgccgcgccgcagatcccccggcgcccccggtcctcctagtccgcgcccccgcccggatcaaccccccacccagctctgctcagctcgatgcggccggccgcggcgtggtagcggatgcccgctcgagctagggttagggtttcgaggggtttgcgctagggtttggtccgcgatgggccggtcccgcggggtgcccaattccggcgacgacgacaccaaccacaggtccaagcggaggagggttgcctcgaccggggatgcgtcggactcgctatccgccgcgtgcgggggagccggcgatgggaagaaggcgctgtaccactgcaattactgcaacaaggacctgttcgggaagatccggtttaagtgctccaagtgcccctgactt

SEQ ID NO: 30987 - DNA, 1352 bp, Triticum aestivum
  Clone ID: PAT_TA_30987
gaaacatataatctgcttctttatttatatcaccaattcactcatccctgtaacgtaaccgttacatataatctgcttctttatttatatcatcaattcaatcatcccctgtaacgtaaccggaaaactttgggctccgacaacaaacccaaaaacgtggtacaagcgtgcgccatggaagcatggcgttgcctactttacatcacgccgcagcccatctctgcgtgtgcgacgagccgacgacagaggcgatcgagatcaggagaagaagatcagccggtggtgctcctagccggcctactcctcgtcctcctccctctccctgggccacggcccccgaaccgctccaccaaggaggtcggcgacgagggggaccacggtcctcgcacggcaccgccttcttgtacaccccggtgagggtgcgaggtcggctgaccgacgcaggccgccgacgaagatgtccgccgcctcgacgatcttgccgctgctgttcttggtgaggcagcccatgaagccgatgtcggccacctgcacctgcgcgcagctgttggggcaccccgtccagtgcatgcgcaccgccctgggcacggacacgcgcgcctccacgtcgcgcgtcacctgcagcgcccgcgccttggtctcgatgatggcctgcccgcagaactggttgcccgtgcacgccaccagccccttcatcagcagcgacgggtgcgccgagaacttctgcagcagcggctcggcgagcagagcttccaccttctcgttcttgacgttggggaggacgatgttctgctccacggtgaggcggagctcgccggagccgtactcgtcggcgaggcgggccagctcgaacatgtcggcggcctgcagccggccgacgggcacgtgcaggcccacgaaggagagcccctcctgcttctgcgggtgcacgccgaggtagtcgcgccgctcccacttcttgtcgatcaggtcctcggccgccgcgcgctccagcacgccgttcggcatcctcttctcgatctccgaccggaacgcctccatcccgagctcgtcgatgagccacatcatgcgcgtcttctggcggttgcccctggtgccgaggtcgcggaaagcctcgaggacggccttgcagaccgggatgatgtcgtcgccgggcacccaggcgtcgagcggcagggcctcgccccacctcttggggctgatgaacccgcccaccagcaggttgaacccgaacttgccgtccttctcggcccgcgtgcccgcctcgtcgttgatgtgcgggtgctcgtacagatcgtgggtgccgatcacgcacacgttccacttcctaggaaggttggtgatctcgtgcc

SEQ ID NO: 30988 - DNA, 654 bp, Triticum aestivum
  unsure (1)..(654): unsure at all n locations
  Clone ID: PAT_TA_30988
ggggggggggagcggaaaaaaaaaaaaaaaaaaaaagaaaaaaagcccaccccaccccnccacaaaaaaaaaaaaaaaaaaaaaaaaaaaacaaaaaaaaagngcggcccccccaaaagtagatagattttacaaaacggcgtccttgacgaaggtgcacactgctggcgaactgaacatacgcagtacacgtacgtactggattacacatcaaaacagctctacgcatggatcatgttcagcatgtatgtaatgtagatacaggcggggcggagatattaggcatggggaagggaagaaaaatcgtagtacgatcctcgaatcgatcgatcagctagaggttctggatgatcttgagggtctcgccgatgtgcttctcgggctggaactggttgttgtagatgtactgcaccacgcccttcttgtccagcacgtaggtctgcctccccgggagcgtcccgaagaggtccgacggcaccccccactccttgcgcaccttgttcccctcgtcgctcagcagcgtgaagggcagccggtacttcttggcgaacgccttgtgcgacgccgcgtcgtccccgctgatcccgatcacctccgcccccgccttcttgtacttcttatacgagtcccgggacgcgcacgcttgttttgtgc

SEQ ID NO: 30989 - DNA, 988 bp, Triticum aestivum
  Clone ID: PAT_TA_30989
tggtctaatatgtgtcacctttttattactctcaaaatcatgcatgtttcgtccaagatcagccagacatactacgtacaaataccctaactagctatttagagctactgctcgtacatgtagacgaagtcagagttgccggccatggcgttgatgacctggaccgtcagcacggcgccgccggccatgaccacgatgatcagcacggcggtgatggggttgcgcagcagctcgtagatgggctgcaccagcgcccacgcgaaccccgtgctcaccgtcagcgcgtacagcccgtaccgccgcatgttgtcccagaactcctccagcagcggcccctccggccccagcgccatcgccgggcccgcgtccaccgacagcgccagcgccagcgccacgcccaccgtgatgccgccgatcagcgcccacgtcggcagctcgcacgtccggccatctccgttggcgacggcctcctcatcgatgggctgctgcctcctcggcgtcgctgcctcggtgatttcttgggacggtatggtcatggcgacgtgtttttgttgccgtggagtggggttaggggaggagaggctagcttggatggtggtggagccatggcgtttggaaaggaagggagacccaagtggtgagctagctccggctgaaccaagaggagtgaatgtcttctggcgaatgatttgtttggtgcagcctggcgtctcatcggcggggtagaagtagaggacgacgggcttgcccttgaacttggagagcgacaccgtcttgccgtcctggtccttgagtgtgaagttgggcggcacgctgcccttgctcaccttgccgcagacgatgcccgcggaggccgcgcggcggcgcggcgcaggcgcgagggcgaaggccgacgccggcgccctgaggccgtggaacgcggccgaggtcccacgcgtccgcccacgcgtccgcccacgcgtccgcccacgcgtccgcggacgcgtgg

SEQ ID NO: 30990 - DNA, 497 bp, Triticum aestivum
  Clone ID: PAT_TA_30990
tgaccgtgggacgagttccggagaacgccgccccgtcgcaacagtttttggggtgcacgctcggttggaaaaaaaggacgggaacctggtggtcacggacatggacagcaccaacggcacctacgtcaacgagaggaagctggtaccgggattcccggtcgccgtccaacccgggagcctcctcatcttcggtgacatccacttggcaatgtttcgggtgaggaagacaatcgtcgatgtggcagccgaggccaccaaagatgaccagcaggaagctgagactgtgctggcaagtgcagttcaagaaacaagctagtctaccttacctttcaaaataagagtgcaaaatagtgcatcatggtaatatgcagtccccgtctcaggatcaacgaaatatgtagctaggcagaaatagcatgtacgagtaaagagtaacttgcaacatgtcatgctcaaggaacaggtcattcaaacaaacacacgctaaatttcacgcc

SEQ ID NO: 30991 - DNA, 1006 bp, Triticum aestivum
  Clone ID: PAT_TA_30991
aactgtaagaaggtgcgcactgctggcgaactgaacactctggtgggttacgaccgtagaaaatagatggacactgcattacacagcactacagctctttgctttactcaatagtacactgcattacacatcaaaacagctctacgcatggatcatgttcacgagtagtagcatatcatacgattacagcggcagagatcgatcgatcgatatacgggaaaagaatcttcgagagaaagttgttcagattcagaggttctggatgatcttgagggtctcgccgatgtgcttctcgggctggaactggttgttgtagatgtactgcaccacgcccttcttgtccagcacgtaggtctgcctcccggggagcgtcccgaagaggtccgacggcaccccccactccttgcgcaccttgttcccctcgtcgctcagcagcgtgaagggcagccggtacttcttggcgaacgccttgtgcgacgccgcgtcgtccccgctgatcccgatcacctccgcccccgccttcttgtacttctcgtacgagtcccggaacgcgcacgcctgtttggtgcagcctggcgtctcatcggcggggtagaagtagaggacgacgggcttgcccttgaacttggagagcgataccgtcttgccgtcctggtccttgagggtgaagttgggcggcacgctgcccttgctcaccttgccgcagacgatgcccgtggaggccgcgcggcggcgcggcgctggcgtgagggcgaatgccgacgccggcgccctgaggccgtggaacgcggccgaggtggacggcctgcagaggcgcgcctgggacgacgacaaggaggaggcgcgaggggccagcagcacggacggcttgcagcaggccgtggaggcggcgaatgccatcttggctggatcgaggtgaaggactcgcctcagccgctcctctgcttcccgggatcaatcgggaaacccgaggcccgtggggtgggcggacgcgtgggcccccggc

SEQ ID NO: 30992 - DNA, 968 bp, Triticum aestivum
  Clone ID: PAT_TA_30992
gccggccgcctgagcaacacaagaattttatccgcttaactgctgcccgtcgcaaatggaggcagcggcagcagcggctagctcctctgtcctgctgtcgttttccagcccggggagatcaacggcggctaccttcctccgcctctccacggcgtcgcctcgcatcacgtgctccgccacacagcagcttcccctcgctgcgccatggttgttaacctccgacaagagcagcagcagaagaagaagcatcttgtcgctgaggtgctcctccgcttccaccggcagcccgtcggccgtcgtctcttcggaacgatggattcttgagcccgcaggagacggcgactggaaacacatcggctaccgcgtcgctcggcccggcgccatggagatcgcctccgaagcgataaccgtgggacgagttccggagaacgccgacgtcgtcatccccgtcgcgacagtttctggggtgcacgctcggctggagaagaaggacgggaacctggtggtcacggacatggacagcaccaacggcacctacgtcaacgagaggaagctggtgcccggattcccggttgccgtccaacccgggagcctcctcatcttcggtgacatccacttggcaatgtttcgggtgaggaaggagattgtcgatgtgccagccaaggccaccaaagatgaccagcaggaatctgagactgtgctggcaagtgcagttcaagaaacaagctagtgtaccttacctttcaaaataagggtgcaaaatagtgcatcatggtaatatacagtctccgtctctggatcgacaaaatatgtagctaggcagaaatagcttgcgagtaaacccatacaatttttgcaaagcataggcagattgtttctgctttatcaatgtccaacaaccatggaatggcaaacgggacagagccaatacaagctgtgttggaaagcatttcaagcaattcgttttc

SEQ ID NO: 30993 - DNA, 329 bp, Triticum aestivum
  Clone ID: PAT_TA_30993
accgtcaccgtgcccaaggaggaggccaagaagcccgacgtcaagtccatccagatctccggctaggcgtctgcgtgctcgctgcgcatgaggtggactgcagagcgcaaggtgtggagggtcttggccccgggcgtagtgatgaaattaaaaaaaaccagagtccggctgtccgtgcgtgcgctgtgtgtcttgtgctctagtgttgtgtgcggatggtccgatgttgcagccagtgttttgagtctctcgcgtctgtgttttgagcccagtttgctcatcagtctgtattccatcagcaactgagtaaatccattaccttctctgcc

SEQ ID NO: 30994 - DNA, 737 bp, Triticum aestivum
  Clone ID: PAT_TA_30994
gggggccacgcgtccgcccacgcgtccgaaatcaccgatcaaagaacgatccctcccaaatcaatagctcacccttccgcttccaacaaatcatcgtcgattccttccaccagcagcttgaatccccaccgacaatgtcgctgatccgccgcagcaacgtgttcgaccccttctccctcgacttcttcgaccccttcgacggcttccccttcggctccggcagcagcaacagcagcggcagcctcatcccgcgcacctcctccgacacggcggccttcgcgggcgcgcgcatcgactggaaggagacgcccgaggcgcacgtgttcaaggcggacgtgccggggctgaagaaggaggaggtgaaggtggaggtggaggacggcaacatcctccagatcagcggcgagcggaacaaggagcaggaggagaagaccgacacctggcaccgcgtggagcgcagcagcggcaagttcctccgcaggttccggctgccggagaacgccaaggcggagcaggtgaaggcgtccatggagaacggcgtgctcaccgtcaccgtgcccaaggaggaggccaagaagcccgaggtcaagtccatccagatctccggctagagcgatgaagtggagtgcagagcagtggcgtggagtctcgccccggtcgtcgtgataaaataaaatcaagaagagtccggccgtctgtgcgtgcgaatggtccaatgttgcagtcagtgttttgag

SEQ ID NO: 30995 - DNA, 821 bp, Triticum aestivum
  Clone ID: PAT_TA_30995
ttcacgcgtccggccacgcgtccgaaagcatccatccgctgagttggagagcttgctaatcgcagttcgtcctcgcccaaatcgagcagccatgtcgctgattccccgcggcaacgccttcgaccccttctccctctgacctctgggaccccttcgacggcttccccttcggctccggcggcagcagcagcggtggcagcctcttcccctcgttcccgcgcatcagctccgagaccgcggccttcgccggcgcgcggatcgactggaaggagacgcccgaggcgcacgtgttcaaggcggacgtgccggggctgaagaaggaggaagtgaaggtggaggtggaggacggcaacgtgctccagatcagcggcgagcgcaacaaggagcaggaggagaagacggacacctggcacagggtggagcgcagcagcggcaagttcctgcgcaagttcaggctcccggaggacgccaaggcggaccagatcaaggcggccatggagaacggcgtgctcactgttaccgtgcccaaggcggaggccaagaagcccgaggtcaagtcaatccagatctccggctaggctgcttgagattaaggttaaggttcaattcgctggtgtgaggttcaactcgctcttttgtgccttttgctcgtgtggatttgggtccgtgttgagtgtcgagtgtgcccttgtcagtgccgtgttcaacgcccgtctcccttgttaagtcatgtagtaatgcgagcatcgagtccaaagtgtgctgtactgctgtgatcaacttctgtgctgatttgaacgagcgagtcacagttccctctt

SEQ ID NO: 30996 - DNA, 1019 bp, Triticum aestivum
  Clone ID: PAT_TA_30996
ttccagcacggaagcacccctcaaagaacgatccctcccaaatcatatacctcacacatcccctaccaacaaatcaccccgacaacaaccaccgagcaccccgcccccagagctcccatgaaaccaattgcccacccttccggcttccaacaccaccccaactcctccatccatccccccgcgcacgctcccatccccccccttacgcccgacaatctcgctgatccgcccccgcgccccgtgtctgcccccttccccctgggacttcttcgggcccatcgcgcaagcggcgtccccttcggcgctccggccaacgggctgggcagggggcacgccgcggccgcggaagcaggcggacgcggcggagacggggggggcggacggcccggggcagctgcaggaggccgagctgggaagggaagacgcccagaaggcgcagcacgtgcaagggcgggacgtcgccggggctggcaaggaaggacggaggggaggcgtgtgccggggggaaggagcggcaaggtcctccaggatcaggggggcgaagcggggcaacaatggaagccgacgggcggagaaagactgacacctggacaaccgcgatggaggccgcacgcatgtgggtaagttgcctgcggcaggttccggctcccggagaacgccaaggcggagcaggtggaaggcgtccatggaagaacggcgtgctcaccgtcaccgtgcccaaggtggaggccaagaagcccgaggtcaagtccatccatatctccggctagagcgatgaagtggagtgcagagcagtggtgtggagtctcgccccggtcgtcgtgatgaaataaaaccaagaagtccggccgtctgtgcgtgcgaatggtccaatgttgcagtcagtgttttgagtctctcgtgtcagtgttttgagtccggtttgttgtttgttcatcagtctgtactggctctgtactccatctgcaaccgagtaaatccattaccttctctgctaaaaaaaaaaaaaaaaaaaaaaa

SEQ ID NO: 30997 - DNA, 891 bp, Triticum aestivum
  Clone ID: PAT_TA_30997
ggactaatattcttcatattaaaaatttactacacaaaccaaacttttttattctgatacacaccgataagacatgatcccaaacatacactataaaacaacaacaaacggtcggacatggatctttggattgatggaatatcacgagctagaaatccatggattatttgaaaatgaaaacattgacaagctcattgcaaagctccttccacagctacccatcgtggttgtccacgtagttttcaaacatattactggattgtggggccagctatagtgccagctggtttgacgtagaatgcatgaatattgagttctttaatactttggcccggaggggggttggcgagtgctctgtacttgatggtcccacgtgccatagcaaactctccagtcccaccaataatggccatctcgccttcttgagctcggttcatccccattacttcaaatgacgatccacggcgcctggcgtcctcaaacaccatgctgaagtagttgaaccagcctggaccgcctacatcagcctgcacatgcatgcctttggtacgggcaacaatggtcgcagtaccggggtttggaccatcaatcacagtccagtcgttaacagcggtcgtaccaaacccggctggttggctcgaggcgacaattgctacctggttggtgcccgatccagcagcgatttggtgcaagtataagcgcaagtttatctcagactcacaaggaataacgcaagaaagggatggactggccatggatagaatgaaatgcaggaccaaaatgatgggcaggacacggctaggactgcccatggctaggattttggctcccacaaagatggtaggaggtgtctacaataaattgactctttgctttgttgcctcgtgccga

SEQ ID NO: 30998 - DNA, 1673 bp, Triticum aestivum
  Clone ID: PAT_TA_30998
ggtttttcttggcatctgatatatatacaaaaatctaatgcctttggttaaatcagtgataaatgcagatggtaatagttttcctctcgtcacacagttcacatttcagaggtgacaacgaaaacaaatgctacgacgcataataagcatgtactctctctaactgagaatacaccaaaaccttgaactaaggtgctaggcaccactttattgcaggtatccaaacaaacaaaaaaagtactagtacagtgctaaattttccttgcacatgaagtcagtcgtctgtgggtaacagccacatcggtggacgtggcggtggcagcaggcaaccatttttgtgtctaaaaggacgttgcacttcttcagtccctttctccaggttgaaaatgtgcaggtaattctcctcggcagcgatgttgttcagaaagtagatacagttgctagacaaaccatgttcactggccgaacatgatgctccaaagttggaagctccgatgctgtctccacccaagaggaacaccctatcaccaatcctgtccaccttgcaccattccggcctcgagaagtccatcttatacacgtcgaccttgtcgattttgtgcacgttgtgtccaagaaagacaacgaccaccataaagaggtcaccacatgattcaaccaagtaagttgaagtaaacggcatggtgtcgggcagttcaaccatatcaacttcaaactcggtgaggctgagctcagggctgaactccactactccaagggcgtgtcccgtgaacgtgtagtagaccttgcccccaacagcagcaatgcctttaagtttggccatatgtatctcccggggcttgtcatctgcgaggaacatggtgagctcatagttgtaagagtcccattggcttcctccgattcggcacaccaacagattaggctggtcaagatcgaggaccagaacagtgcaagacgatgtcgagctaggcttgtcggaaagcaggcacttgcacctcctgggaaattcttgttttggggatggaaggctgatcctctggccgtcctgaggacgccacaggaacgtgtgcagggaagcaggttccagcgcgagcacccagccctgtggagactcgaagcacctgtagtccttgagttcatggatggctgcggtgctcacggcctggttggagatgctgaaccgcgtctggcagtcatctgtacggttcccaagatcatgcacaagcaatgggaaggggccttccatctgctgcagcctgcaggctaggaatttcctcaagtatttctagcactagtattcagcaacagcaagcaaaaaaagactcagcacccggatctctggctgcgccttggcccttgggtgttcttggccccctttatttatagcgattgatgtcgtccttcttggtgatctctgccgtctcccacctggaatcgggctcccaactccgctgctaggtcgaattcgtctccctccgggaatccggctatcaactccagttaccaccaacacggatctcttcccgattcctctgctcttgttccccccggatgcggattcgcctcctgtgcccacggccgccgtctccttggtcgtccacggcgatttgaaggtgggcaggttttcggataaggtccggctcgtcttgtgccctgcccgggcggcccctcga

SEQ ID NO: 30999 - DNA, 713 bp, Triticum aestivum
  Clone ID: PAT_TA_30999
agttgaattctgaatcatttaccttcatctctgcaagtatgtccattctagattttttccgggcatctgaatcagactgctctttgttcaacttgcagcacagcgtcttcagtgaccgttttgtaaatgggacattatcaactgatccaaaaaaactaccaactatgctaaaaacctttccaagactaacattgttttctctaagctgcctaacaagatccttagtataccggtcaatcagcctgtgtgaaagccagtgcatcttttcaccacaagtgcttgacaaagagtggttgtggggcgcccggtgctctgagatataccacccattgtcgtcaaacctcaatagcctgatcctggccgcttcaggttgccctgttgatcttgtgttctccctctgatctttaccctgcgtgtccatccgctcgtagcctccgaacaaacttgcaagagcgggtcctcgccaagaaatccggcatttccaccaccgctacggaggtcccctgcacggcgaatgtcagcctcggcgacgctgatagaatcctgggactctataggccgggcagcaccagtatcgcccgcatgcccgcggccaatcctctgttcggaatcgccctccgtttcccatggactaggtccatggagctaggctccaaggtctcgatccccgaggaggaagacgatactggcgccctcttcggacgcggggtcga

SEQ ID NO: 31000 - DNA, 673 bp, Triticum aestivum
  unsure (1)..(673): unsure at all n locations
  Clone ID: PAT_TA_31000
caacggatactagcattttaaaaagatttttcagtggtatacagagagagcaccagtaagcagtagtacgggcatcattctacatggctggcttctcacagcctgagaaccatccaaataatacatgatatctggggtgaataagaatattacaaatcgctactctacaagtgtagcgatcccagttattatatcctcgcggggttcatgcatcagcacactataaccctgcaatatgataccccatcctggagatccagatctgaactagccaagacccacggtccaggatggcaatgtgagcccgaaaaaatgggagccttggctcgcattgtcagtgccgggagttgcggcgggccgcctttccacctcgccgtcgccgatcttccctgcgccacggtcccgcgggcgcccgccgccggcagtcccggcccggagctccggggcgggctgcccgatccgccgccacccggcttccgccgatctggccgggtcctcccccgcggaccggtgcccggcgctgtgcccaggcaggccatccccgacgggatgtggagcgtgggcccccagcgcttggggccggggcgcgcgtcgccgcactccgtgggtgcatataatcagtgctgtccggngaattgtccatgacctgacaagatactccgaaacagcacca

SEQ ID NO: 31001 - DNA, 985 bp, Triticum aestivum
  Clone ID: PAT_TA_31001
tttttttttttttttgcaaacccagacaagctctacacactagattctgaaggactgccaaattacagcggttcttacggcccccctcctcgactacacactagcctacaggtcagcggtctctgaagcagcacgagaaaggaaactagcaggtcaatcaagcacaggtctggtccatcatcggtttacaatagagcaaattatatgtacaaagcaggcaggccggtggaatgccgctgactccttgatcctcctcaccaggggccggtcaacgttcttcgcaagcactgccgcttcttccgtccgaactgatccttcatctcaggggcctctcttttctgcatttccagtatctctttctctgccctccccggttccccgtccgggtccccgcccttctgaacttcggcttccaactccattgtataagcctgcttgcgggcacgggacctggcggcggactccctgttcttgatcatcctcctctgcctcctctccaccaccttctccacgccgccgccagtcctcctccccctcacaatcccctcgaacgagtacggcattggttccgacggcgatgacagatcctcgctccccttgctgccggaatcaaccgggttgaccgcagtttgcacaaccaggggggcgcctcccatacccactgccctcggcatgagcccattggccaaggccagatcccccatggcgaccggcgggaaccccagcgccgccgcaccggcgtcgttggcgctcgggaagttcccgtagaaggaagggcctttagggacaacagggaccggccgcgggtgcatgggcgggggcggcaccgcaggagcggtggggatctctcgcaccacgccggctttgaccaggaactcctccagggtcatctccccgagcgtcgcctgccgatggggctgcggctcggcaccctccggccccaccggaagcgggtcatcgcgcacgagggttgcctcgtgccgaa

SEQ ID NO: 31002 - DNA, 779 bp, Triticum aestivum
  Clone ID: PAT_TA_31002
gaccaccaaacttgtcttcgtcaatgtattttcgtgttaccattggtaaggtaactaacaaatgatgacggtgatcagtttgctaaaaagcaccggccgccgggcggcgggtggtggtacagaggggagagtgtcgccgccggccagcccgcgcgcgcgtccgtccgtgcgggggcgcgcccaggccaggggtcctcgtcgtccgtgcgggttgcggctctactctaggcttgcacctccggctccggctcggcgttgaggtccaggccgcgggggacgggccgccgcggcggggacgcgttctcggccacgcgctcgtcggcgggcagcagctgctcctgctgcgaaggagcaggcggcggtgtcggggcgggcggcgcgaagtcctcccaggagaagctggggcaccaggccggcgcgcgcggggccggggcggcgcgggccgtggccgcggcgaccccgccgggagacgagccggcgcgaggcgtcgcgcatgcggcgcaggatggcgtagaactcctcgacctctgcgtcggatacgtcgtccacgctgacgggggccggcgcggcggcggcgggggaggagcgcttgcgcttggcggtggcgctcggcgcgtccatggtcaccaccgcgagcgcccggggcaggcagtcgttgcgcgcttgcgcgtgtgtttctttgcttggtgggtgagcggtgggtgcttccgcggctggtctggacgagtgcctcggaagaaaagaagccccggaagccgacgcttatatgatcctcgtgc

SEQ ID NO: 31003 - DNA, 543 bp, Triticum aestivum
  unsure (1)..(543): unsure at all n locations
  Clone ID: PAT_TA_31003
tttttnttttttttttttttttttttttttttttttttttttttttttttttttttttttgacccaagagcccgaagctcgcctcaacagaacagggtcatgagcatgcatagtagcaggccggagaccacacgtaggacagccgaagagaaacaactgaagaagaacacaccaccctcggtcctgagcaggccccaccaccaaatgcaccacccacaaccacacacaacaacaacaaccgtcgtttgggtctccaagacgacccctccaaggaggtagtgttgccgagcacacaacaccgccatccgatccggcaagcccgatcttgagtttttacccggagaccacaaacaaaaactgtaggtgttggagccccacgacgacacctcctgcaaggaaaacagcgtccgtagacgtcgttgccgccagcatcaatagagccgacgtagggttctcacccggagtttgagcacatccctacagcaagacgggagccgaccaccaacgccgtcgaaccctccattgatgaagaagcacgaccaa

SEQ ID NO: 31004 - DNA, 1148 bp, Triticum aestivum
  unsure (1)..(1148): unsure at all n locations
  Clone ID: PAT_TA_31004
gcaaatagcaaaacaacatcatgaaaagcttaacacaggagacaacagggcagccgaaggtactggtgttcagttaaaacctggaaatgctagtttacttgggtgggccatgagttctattactcagaagggaaaaccttccgaccatggtccagtatctactgcaaatgccagtaactctcaagtttcagcacccccaagtaccacatcagatactcactctgccccagcagcatatgcaccagcagccacttccaactcttttgatcaaactgcaccagcatcagcaagctcatctatggatggatggggtgagctcgagaacggtaaccaggaagagaatggtagtgataacgaaggatgggatgatgtagatccatttgaagaaaagtcaccgccatctcttctttctaacatacaagctgcccagaaacgtccggtggtgcaaccgaagcaaccaattccaagttcatcaagatcaaatcagccagcggcaccaaaagcagaggaggatgctctatggggccctacggctgttccggcacccaaaatcgcaccgaagtctgcaggcatcaaaccctcggtatcgcacaatgatgatgatgatctctggggttcaatagctgcacctcagccgaaatcatctgggaaggctttgaaaccagcagcagcgaataatgacgacctatggggtgccattgcagcacccccgccggcaaccaaagctaggcctctggcatcatccggtaggggccgaggagcaaagccagcacaaccaaaacttggtgctcaaagaataggaaggacctcctcaactggcatgtagagtgccatgatacagttgttgtacaaggatgcaactttttttccttttcttttgtctttgatgtgtctaggagatcctctttgtaaactagcccaatcatttatacgacatgaacattgcttgaactctgcccgttgtataatatcacaattgtgtaatatggtggtagctcaggaaatttatgtacatcacaggtacagtgcttgaactgtgccatcaatatatgattttgccttaaaatccaaaaaanaaaaanaaanactcnagggggggcccggtaccaattncccataanggntcgtattacnccgctcacnggcgt

SEQ ID NO: 31005 - DNA, 1632 bp, Triticum aestivum
  Clone ID: PAT_TA_31005
gttgcaccctccactgcgatggctgttgcttcttcctccacggaatcccatgtcctccctcacatagcaatcttccccttcatggccaagggccacaccatcccgctcatccagcttgttcaccacctccgtcgtcgcggcctcgccaccgtcaccttcttcacaactcatggcaacgcggcctttgtccgcgagggactgtccggggccgacgacacggccatcatcgagctcgcgttccccgccgacgtttcgggcgtcccgccgggcgtggagagcgccgaggcggtcacgtccatggcctcctttctggccttcgcacacggcgtgttgctgctccagccacagctcgaggcgtcgctcgccgccatggaacctccggccagcctcctcgtcgccgacgcgttcctgtactggacgaacgcgtcggcggccacgctcggcgtcccgaaggtgtcgttctttggcatctcggcgttcgcacaggtcatgcgggagctgcgcatcacccacgacccgtgcccggcgctgcagcacgccgacttcgacggcgacggcaatccggcgacgttcacggtgcctgagttcccgcacatcaagctcaccttcgaggacttgatggcgcccttcggcgacccgtcgtcggtcgcgccgatgatggagctggacagcaagctggggaaggccatagtggagagccatggcctgatcgtcaacaccttccaaggcctagagaaaccgtacatggagttctggaacaagcactataggcccacggcctgggccatcggcccgctctgcctctcccagaccgcgtcttcttcgtcgggtgacgccggccggccatcatggatggagtggctggacgagaaggcagccgccggccgggccgtgctgtacgtcgcgctcgggacgctggccgcgataccagaggtgcagctgaaggaagttgcagacgggctggagcgggccgaggtagatttcatatgggccgtgaggcccgataatatcgatcttggtgcagggttcgaggagcgtaccaaggacagaggcttggtggtgagggagtgggtggatcaattggggattttgcagcacgagagcgtgagagggtttctcagtcactgcgggtggaactcggtgctggagagcgtcacggctgctgtgccactggcagtttggcccatgcatgccgatcaacctttcaacgcagcgtttgtagtcgatgagctcaagatcgcggttagggtccacacgagtgatagaacgatgcggggtttggtcacgagccaggaaatatcagaagtggtcaggaagcttatgctcggagaggtcggaacggaagcggcaaagaatgttgccgagttatcgatggtagctatggagtccgtattggagagagggtcttcttggagagcagtggaggagatgatcggtgagctgtgtgcacccaacatgcatgcgaatgttgagccaagcaaggaggagtcttgaaatgtttaattgtcatcgtttttcttttcaacaaataatgtggtgttgtgctctgtagctataccaaacatttatgttggtcactggcatttacttctcaggtcttggatggaaatatttatatgaaattgattgaac

SEQ ID NO: 31006 - DNA, 587 bp, Triticum aestivum
  Clone ID: PAT_TA_31006
ggagatggacaccttctccagccgtagaagacgctcctccggatccagacgatcagcgccgatcttgctgggactaaggagcaggcggaggtgaggccgaaggaactcggcgcagtgcgacccgaggttgcaggccgggaaggcggactcgcagccgagctggtagaaggggcagttggcgagcttcatggggcagacggtgacgcagtgccggtccatctggcgccgggcgacggcgaggccgcagcgctgctcgcaggggaggagcttgaaggcgcacgcctcgtcgtgcgcgtcggcgcggcaggcggagacctcggcccggcagccctgggcctggttccggcaccgcacgggcctgaatcggcagcgcgcggcgacgtggtcggcgagctcctcatgggtctccagctcgtcgcggcagcagaaccgcccgccgcagtcgtccaggccgcggaggaggtcccgcgcgacggcctcccgcctctcgaccggccagaagcggctcgcctccatctcctcgacgaggtcctcgatccggtcgtcgcggccgtcgtcgccgccgcccaggtacggcagccagccgg

SEQ ID NO: 31007 - DNA, 1099 bp, Triticum aestivum
  Clone ID: PAT_TA_31007
gattcggcacgaggctactctcctatcataatctcgcctaccccggccggccctttgacttcctctgcctcccttcctgcatagaacaccacaagctcccatcgccggagcttccttgcatcgatcgatgaacaagatcaaggtgcaccccaacgtcgcagctgcttctccggcggtatccgcagcggagggggagaagggagaggcggtgtcgctcaccgtgtggcggcggtcgctgctgttcaacggcaaggggttcacggtgtttgacaccaacggcaacctcgtcttccgcgtcgagacctactcccgcggctcgccccgcgaggtcgtcctcatggacgcccacggcctcgccctcctcaccgtccgccgcaagaagctgagtctggcggaggagtggctcgtctacgacggcgacggcgacgagccggcgccgaggcggttcacggcccggcggaacaggagcctgctccggaccaagtccctcgctcgcctgtcgccgccgcgatcattggacggtactggggatgcgcctggctgccggtacgatgtggagggctcgtacgctggccgtagcctcgacatgttcgcttgcacttcctgggcctccggcggcaatcagcggcggcgcgtggccacggtgtgtcggaaggaggccgctgttggcctggacgtgttccggctgatagtggagcccgacttcgagccggcgctggccatggccatggtcatactcctcgatcagatgaacgcgtcctgaagcctcgatccgttccaggcatgaaccatgcatgcttgcagcaccctgctgtgccaaggctgccgtgtacagagaacagaaaaagagagggtaggaagcaatttgtggttgcttcattgctcaatgcacccacttttttgcttcatggttcttaatggcctcatcaccgatgagccatagttgaccagctgaagcatttctaccgagtggtgccatgttgtgatgttttggattctggatgtaggggctggagatcacatttagaggtgttttagatagccaggttctagtatgtttctgtcgggtcaaaataaattccctccgttccatattaag

SEQ ID NO: 31008 - DNA, 549 bp, Triticum aestivum
  Clone ID: PAT_TA_31008
atgggagtttgtgttagaggaacttatcgatgaggctgttttcgatttgtggatttgaagctctgatcaggtcccctgtcggtggtgctttgtgaggggtatgtacactaggtataactgtagaggttttcatgctgacaataacaccattttacgtggcagaataacacgggctgttttgtttggcccgttcgagtaaagtaatgagagtgtgaacttcgacggcgttttgctcgtcgaagtgtgtataactgcagcggaagaaacttctctgatgcatgacagcggaagtttcgacctgcaaacctcccagccgtgcagcttgtctagactagatgaagtttgggtaactgtcacagccatgcctcttggacagctaaattgcacagcagtctgaaaggctttgcggattttcctcttgtacattgtgatcagaggtgatcacacatgtatattgtttttttccttttctttgtgtttgtgtgtacatgtgtaatagtttttcgagaatcacacatgtgtaacagttaccataatatatgacagatc

SEQ ID NO: 31009 - DNA, 672 bp, Triticum aestivum
  Clone ID: PAT_TA_31009
ccgtagttgtcaaagttctcgaggtcttcctccagacatggttttccaagttcggtcgtgcatgcactttcggtcgatgtcggagggcggccttggggggacatgcgggcgtgggctggaggtaccgttcgggggggctgggtgcgtgtggtggactagcgtggtcgcggccgaggtttcgatttgtggatttgaagctctgatcaggtcccctgtcggtggtgctttgtgaggggcatatacagtaggtataactgtagatgttttcatgctgacaataacaccattttacgtggcggaataacactggctgttttgtttggcccgtgcgagtaaagtaatgagagtgtgaacttcaacgacgttttgctcgtcgaagtgtgtataactgcagcggaagaaactcctctgatgcatgacagcggaagtttcaacctgcaaacctcccagccgtgcagcttgtctagactagatgaagtttgggcagcctgtcacagccatgcctcttggacagctaaaatgcacagcagtctgaaggctttgcggattttcctcttgtacctgcccgggcggccgctcgaaatcagtatattttttctcgttgtgtttgtgtgtacatgtgtaatagtttttcgagaatcacacatgtgtaacagttaccataatactata

SEQ ID NO: 31010 - DNA, 2499 bp, Triticum aestivum
  Clone ID: PAT_TA_31010
gaggctgtcggcacgggggccaacctccccgctgctccatccgcataaccccctgctctcgtagctagggtttgagtctgctccccgcgcagcctccccatggctaccacgccggcgctccacgacgcgctgctcgactttacttcgcgggagaactgggacaagttctttgccctccgcggcgatggcgacagcttcgagtggtacgcggagtggccgcaaatcaaggccccgctcctgtcgctcctccttggggaagaggggacggagatccttgtcccggggtgcgggagctcgtcgctctcggagcagctgtacgacctggggttccgccgcatcaccaacgtcgactgctcccgtttcttcgtggccgactggctccgccggcacgcccgtctgcgccctcagatgcgttggcccgtcattgacatgaccaacttgcagtttccagatggttcgtttgatttcatacttgataagggaggattggatgctcttatggagccggaggttggcacaaaactggggatgaaatatctagacgaggccaagagggttttgaagtcaggcgggaaatttgcgtgctttactctagcagaatcccatgttttagacctacttttgtctgagttcaggtttggatgggatatgactattcaagctatagctagtgaaccctctagcaagtctgcctttcagaccttcatggtggtcatggtaaaagggaagatgggtgttgtacgcacaataaaatcactagtaggttctttcttctgaatactgtaacatgcaacaggcaaatgcagtaattcatgctctgctaaatgagaactaaatccggcattcacagaattcaagtaaagatatacaataaaatgcccaatatcttcagcatggcgctattggagatctaatgagaattcttactgttgatgttgattcgtctgatctcggtgctcgggggtcctccccccctgcctaccttgctcgtttatgcgttccctaggtccgcaacgaggcacctgtctacctcgggggcgcttcttctgcgcccaaggcacgcgctcagcagtcgttatgggcttcggccggtgggcagtcgcttgtcggtcttagtgcacaggctgcccctctaatcatggtatgcctcgatcgcagacatgcaagtgctgacattgatgttgttaagaaggatttatctcctcttgttatggatctagaacctgaatatcctgaagagacagaccctatgccattcatgatggctagtgatggcgtgaaacaaagagatattctgcaggaggtaacatcagaaataacaggtcctatggttgtggaagatgttctttatgaaaatgttgatggagatcaaagctgcatgtctgaaaaaatgttccgacgacttatttttaaaagaagttctggcttagtgcaatctgaagcattgttaatcagagaatcaccaagtgacgagacggacagtaagaccaagaactcatctgcatcatcaaaaaagaagagccagaaaaagggactcactggatccaaggacagtctcagggtcgaccatagctatcttggtagctcttatcacagtagtatcatatgtgggctttctttagttgcatctgctctgagtgctgcggcatcatctggagaaagggtgagtaccactattgtaggccttggggccgggagtttaccaatgtttcttcgtggatgcctccctcatcttaatattgaggttgttgagttggaccccatgatggaggaggtagcgacgaaatattttggcttttcaatggatgagcaattgaaggtgcatttgggggacggaatcaaattcattgaagaaaatgcccattctgaaccaaatggcaaagacagtgatgcagttagaattcttattgttgatgttgattcatctgatctaagttctgggttgtcttgccccccagcaaactttgtcgaagatgctttccttatgtcagcaaaaaagttcctttcagctgggggcctcctcatcatcaatctagtcgcgcgatcatctgcagtcagggaaatggtcatttcacgattgaaagcggtctttgaaaacctatactcactgcaactcgaagaagatgtgaacgaagtcctgtttgcatccccaagcaaaagatacctggaaatcgatcaccttgatgaggctgcaactaaactgaaggctatgctgaaattcccggtggatgtggaatcagatatgaagaatttgcagaggctgcagtagtataggcatctgtgcttgtgaggcaccatccattactcccggcactcagatatgaagaatctgcagaggatgcagtagcaggtaggtgtaggcttctgtattttgcagagaatgcagtatatgtggaatctagcttttccaagcatgatgaatttaattttgttttctttattataaaggtgtcctcccttaatttgggatgaaaaaaaaaaaaaaaaaaaaaaaaaaaa

SEQ ID NO: 31011 - DNA, 1173 bp, Triticum aestivum
  unsure (1)..(1173): unsure at all n locations
  Clone ID: PAT_TA_31011
angagtttattgtagctatcaaaggttcataaatttatcataaccaccggttaaactcgacgacgacgacgacacgacgataatccgacacattaatccacgacatccatccgggctaacaacaatccacgactgacacacattaaacagttcaacgcctaaacaaacagtctcgaccacgaaattacgctaagacgacggtgacatctagttcaggtttttttttcttcttcttctgcttcagagttctacgtcaagctggtcactgacgacgatggcatgcagagctcacttccagggcatgctggacaggccgctgttgctgggggtggccgccgccgggactccctggttcatggggctgccggaggactcgctgagcgtgcccctggacggcgggctgttctgggccatccccacgctgatgggagcggtcgcaagcggcggcacggcgatcggcgccggcacgaagttcggcgtcatcctcggtggcgcggatgcgggctcatgtgcagcagcagcagcttggtgcttcggtgccttcttcttctcggccacggtgttgaaggtaccccaccacaacctgaataggtgtgcaggcaatcagaagtccagcaattccgccacccaagcacgcggccatcaggacttgcaagtgaaacactcagcccaccggttcggctacgatggcctcccagtctcttgcacggtgaatgatccagacagtgacagtatttcaaatcggccctcgtatgtgaccgtcccacctgaagtggcagattgccgaagggtaacgtttgaaatggcgccatttgctgaaagaacaacaactgcacgaactccatgctgcgcaaatgacaggatctttgcagccacatcctctccagcttgaacagcaattacatgtggagtaaagccagctcctgcagtcccgatgaaagcaagcgcagacatgaccttgtcctgcttcttcaccttgttggtggagccctttgggcgaccccgcttcttcatccccaccggcggcaccgccagcacgccgcccgccgccggtttgacggccggcgccgagaaagccccggaatcaccgggcgccactgcagtaggctcctcgggcatgggcacgggcaccaatgccagggacgtggagccgtcgtcgccgtacttcattgc

SEQ ID NO: 31012 - DNA, 909 bp, Triticum aestivum
  unsure (1)..(909): unsure at all n locations
  Clone ID: PAT_TA_31012
acgtcttcatcaccggcgggtccagtggcatcgggctcgccctcgccacggccgccgcgcgggagggcgcgcgggtctccatcctcgcgcgcaacgccgcccgcctcgacgacgcgcgcgccgccatcaggcttgccacgggacaggacgtcggggtccaccaggccgacgtgcgggatgccgccgccgtggcacgcgcactcgacgaggccgggccagtcgacgtgctcgtctgcaaccacggcgtgttcgtgccgcaggagctggagaagcaggacatggaggaggtcaagtggatggtggacatcaacctcatggggaccttccacctcatcaaggccgcgctccctgccatgaaggcacgcacccgcgagaccagtctcccggcgtccattgccatcatgtcatcgcaggctggtcaggttggtgtttatgggtatactgcttactccgcgagcaagttcgcactaactggacttgcagagtcgctgcagcatgaggtcgtttcggacgatattcatgtgtcgctgatcttccctcctgacacagagacaccgggtcttgtcgaggagaagaaaaagaggccagagcttaccactatcatagcagattcatctggtggaatgaaggctgatgatgttgctatgaaggctctaaacggcatcaaatctgggaggtttattgtcccctgcaatttcgagggagcaatgttagctatagccacttctggtctaaccccccagagttccccgttaattgcattcgtggaggtgatcggtgctggactgatgcgatttgtagcactatgtttccagtggaattggttctctactattgagaactggtatgccaagaacaagaaacatgggtgaaagcccaaactagccctgggattcccagatttcaaan

SEQ ID NO: 31013 - DNA, 627 bp, Triticum aestivum
  Clone ID: PAT_TA_31013
ctcccgttcccctccgcccttgccctcatcgaggcgaccggccgaccgatcggtccgaccccaaacccctccgccgccgcccgcctccccatggccggccgccgcgcgccgcacgtcatgagcctccacgactccggcccgccgctgctcggccgcgcgccgcagcacccgcagcccggcgacgaccgcgacgagcccccgcacggcgccctcctccaccacccgcgcgggggccccgcgcagcaccccgccgtggcggccctcgaggaccgcatcgtcgcccgggaccgggacatccaggagttcctcgtcgacaaccagcggttcgccgccacccacgtcgcgctccagcagcagctcatctccgcgcagcacgagctccgggccgtcttcatcgccggcaccagggcccgcatggagcgcgaggccgacgtctgcgacatcgccgaccaggccgcgcgcatcgaggccgaagcgcgctccgtcgccggcgcgcgcgtggagatcgagcaggtccatgccgatgtgcgggtgctcgctggcgcgcgcaacgaactcatggaccggctcaaaagcctccgggagcaactagggcgcgcgcagtcccaattccgcccagtcggagaa

SEQ ID NO: 31014 - DNA, 1173 bp, Triticum aestivum
  unsure (1)..(1173): unsure at all n locations
  Clone ID: PAT_TA_31014
cgggaaccacagcacgttacatgctttgcatctgttggaacggcagtgtgttgtgttgcaagatgctgagggattgccngagcagttcntatgctaggaaaggcatggctatggagatgtcccgtgatcacaggccaacatatgaagcagagcgccaaagggtcactgagtgtgggggatacattgaagatggctacctcaacggagtattgtcggttactcgtgctctaggggattgggacatgaaaatgcctcaaggctcgcagtcacctctgatcgccgagccagagttccagcagaccgtcctcacggaggatgacgagttcctcatcataggctgcgacgggatatgggacgtcatgaccagccagcaggcggtgaccctggtccggaaggggctccgacggcacgatgaccccgagaggtgcgcgagggagctcgccatggaggcgaagaggctccagacctttgacaacctcacggtgatcgtcatttgctttgcctccgagctcggcgggtgcctgcggtcttcggaggaggcatcatcgaggaggataagatcttgcaagagcctgtctgctgaggccctttgcaaccttaggagactgctggagtctgatcagtagacgattgccgtagggcttattgagttattgtgccgacgggtgttagatgcctcgtacggctgcgcttgcgcagccagcaattttgtagggcatccgtcgtttgttcgttgcagttcttcctttttttttgtttcttttgtgttgactactgcagtatttggtgtacatactccattggttcatgtaccggtgatcagttcgttagtgatgatttatgtcagtgagaaacctcctccaagattggtaggattattttctaggcaggagttctgacttgcaatagctataggagtgcaatatatatatatatagacagaaggtctggggtccgacgtacaggcaaagcccccaagaggagttcatctttgtcccgagcctgatgaggtgcggaggctttatacgtacaggcaaagcccccaagaggagtatttggtaaaagaaagtttcaatctaaatctatgtatcagtggcttgaatgtgatggcctggatctcactacaagtgggtgggaaagctaaaattccacttaattttcttgtatgtcctg

SEQ ID NO: 31015 - DNA, 1156 bp, Triticum aestivum
  Clone ID: PAT_TA_31015
ctcatccccaccgtcccacctccctctctctcgctcctgccgtgctttctctctctaactacaagcgtgcccgccggccatggggttcccctcagtgtgctactgcgtcatcctgccgcagccgctcatcctggttctgcagctgctcgacttcctccgccacgcggtcctgctctgcctctcctcgctcggcctcgcggcgccgccggcggctgacgaccacccggcctacgcgccgccgccagacctctgggccgtggcggagtcggcggcgccctcgtcctctttatccctggcgaccgggccggcgcccgcgccggcggccatcaaggcgcgcctccccgccgtccggtacgccgatctcaggagccgccgctgcgccgctggggccgcggcggcgtcgacctgctgcgccgtgtgcctgggcgcgctcgaggcacggcaccgcgtccgggagctcggcaactgcgcgcacgccttccacaaggcctgcatagacaagtgggtcgacaagggtcaggccacttgccccctctgccgcgcgctcctcctccccacagacgccgacgccggcaagctgcccactttttccttctgacctcacgctccaaggagcgacccttctgccgctgcagtctcgccgccagagataggtcagtccgtatagctagctagctaggcccttctccatccacccgcccatctctccacggatccatgctttcacgagagaagtcaaaaggggatgagagagaaagagacatagcgagaagaagaggtgtgcgtgcgtgtgtgtacgtttgtgtggtggagtattattggtaggtgaggcactaattatgaggaggacagggatggctacctgcattggatctggtgaatgagcactatgcatagcacttgcagatccatatgctcttctctctctttttcagctcctcttcaacctcacccacttcacttttttaatcttcttctttgtaatttccttccccttctctttttcttttctccttttctattaacttattttgtgagggcaactaagagagagatatcaagaaagagagatgtacataggtgcctccacttgacaatatcgaagaatgaataagaattgtctcacattactcaaaataaagggggggaaaaaaaa

SEQ ID NO: 31016 - DNA, 1152 bp, Triticum aestivum
  unsure (1)..(1152): unsure at all n locations
  Clone ID: PAT_TA_31016
cctaccgactgctcgcacccctcgcatgaagacagactgggacgagtcggtgatccagtctccgtggcatggttcaaacagcccttgcggggtcaacgcctccccgcccccccccggcccctatctgccgcctccgcgggcatcatacaatgcaagccctacttcctcttcattccccagcggcgcatcgtcgcccttcctcccgcattccaacaacatggtaaacggcgtcgatgcaactcccatcctaccatggctccagacgttctccaattcgacggcgtcgagcaagcgggcgcatcttcgcctgctgctgattcacggtggctccatcagcgccccggtgactcctccactgagctcaccgaccgctcgcacccctcgcatgaagacggactgggacgagtcggtgatccagccaccatggcacggttcaaacagtccgtgcgtggtgaactccaccccgccgagccccgggcgtcaaatggttcctgacccggcatggctggccggtatccagatctcgtcaacgagcccttcatcgcccaccttcagtctcatgtcgtcaaacccattcagcgtcttcaaagaagcgattccgggcggtggttcgtcgaggatgtgcacgccagggcagagcggcacctgctcgccggtgattcccggcatggcgcggcacccggacgttcacatgatggacgtggtttctgacgagtttgcgtttggaagcagcaccaacggcggcgctcagcaggccaccgccggattggtgagggcgtgggagggcgagaggatccacgaggactccggatcggacgagctggagctcactctcggaagctccaggacgaggagctgatgctaacaacacctaactcgggcgggattctttcttgttgtagcttatttcttcttcttcttcttcttcttcttcttcttcttcttcttagtctgccccttcttattggtgttccattagtttctgaaagagagaccaagcgtgtggttccttcagatagctttcacttgatgtggtggtaaattgtgttatttatttgtgcgaattacaagactanananggagcaaaccagctggcgacctnctttcgcgtatgtagcnatgtncntgtncacagactaattgagtagaat

SEQ ID NO: 31017 - DNA, 606 bp, Triticum aestivum
  Clone ID: PAT_TA_31017
aaatacaaaaaggggggaaaaaaaaaaaaaaatttcccaaaaaaaaaaaaaaaaaaaaacctctctccatctctggcgaccggatccggcgaccgtcccaactccggccgccggatccgcttccccggccagttgccagcccaacaacgacggattcatggtcggacgacctcgtcttcaacagagaaccagcgaggcaggttggcggcgatgacgtggctttccctggccggcgtgaggctcccgtcctccttcgtccttgttgcccgtccgctggtgtcgccatgagtggatctcgcagcgcggcccccacgacgcgtcccttcgcgcggttgccgccggatccggcgactccaagcatagccgccgccagatcccttcccctttctctctcccgcggacctggctgcatccctctgatggcctcccatgctccttgccgtggattcagtttcagttcttcttatgtgaagataattagttattgttttctggaggtgaaatgagaattcagtagttgtatttgatgtgaattgtgaaacaatacaacttgggcactttcagtgcaattacaatatattttaattgtgaatcaagtttcttacc

SEQ ID NO: 31018 - DNA, 760 bp, Triticum aestivum
  Clone ID: PAT_TA_31018
cgacaggctccagtggctggacgccaccaacgcgctcatggtggccacgctgttccccaagacggacaactgttccatcggcctcctggatttccgggacaagagcgtggcctggtcgtggtccgacgccggcacggccgcgtcgctcgaggagaagcgcgtgctccacgccatcgccatggaggacgagcggtccgtgtgcgtgatcaaccagtacgacgacctcgggttcctggacctgaggagcaaccccggcgccgtgcggtggagctcccggagcaagctgatgaaccggaaggcgcccggcgaggagagctgctacccgaagctggcgacgcacggcgggcagctcttctcgtcgatgaacgacagcatctccgtgttcagcgggcccgagcacgtgctgacgtcgacgctgaggcggagctacggcggcgccatctgcgacttctccatcggaggcgaccgcctcttcgccctgcacaacgaggagaacgtgttcgacgtctgggagacgccgccgccgccgatcatctgaccgccagcctgctctgcgttgctctgctcagctcgccgtgacttgagccgcactgcacttgttgtgctcactcagcagaagaaaagagatactgctacagtagtattcagaaggaatggttacacctaactgatgatgatgggtactcatcacagtacactgtagctctcgatcaatcttaactggagcactagagtgtacgcaagctttggtttctaaccc

SEQ ID NO: 31019 - DNA, 594 bp, Triticum aestivum
  Clone ID: PAT_TA_31019
agaaagaagagggtaaccaaatcggaattgtaggaaattacaagaaatacaccttacattgcagaattttagcaaaaaaaaaagcaaatagaaattatataatgtggaattttggcaacataagaaacaaatacacctttatataaggaataaagggagtagtaaatagataaataaaaggcaaaggcggcacaacacaaaacatactcatatagaacaacaattttttgaagattacagaagcttacctaaatggaccaaaccaaagtattgtattacgttttttacaaaaaaaaactaataattggttgtcctgaagacttcatttcctgcttctctaaacgattctaccacgcacttcagctcttctcagttttctaactttgccttgtccacattccatcaagcaccttcaagttgagggtgcacctggttgtctatcaaagaaggaggccatgccatgatgtagggatgggcatggccgtcaaatctcctctgaaagagggggcccagctcctccgtctccatgcatagagacatgaaccaactaggattatgcccatcaagggacggtttcatggtagagaagtacac

SEQ ID NO: 31020 - DNA, 306 bp, Triticum aestivum
  Clone ID: PAT_TA_31020
cacccccaacctctatgcacaaaatgttctctatgatcatgatgacaagagtgctcctcatatcatgttctttgcctgcgaagatattccacccggtcaagagctagtataccactacaactatgccatagatcaggttcatgatgagaatggtaacatcaagaagaagaaatgcctttgtggctctgtggagtgtgatggctggttgtattaggtttagactgtgatgcctttgtggctctgttgaagttatgtcattgccattaattcttcttctgaccttttcagtgtccaataagtatgatc

SEQ ID NO: 31021 - DNA, 520 bp, Triticum aestivum
  Clone ID: PAT_TA_31021
caggtagcggtggtgagaccagttacaacagctagcaacagtaataatggcgatagcttgttgcctagtagtgctggccaagtgatctccgaaggcatttccaaaggagatacaagagaaacgggaacaagaaacacttgcatttatcgttttcattcagcttcagcaccaacacctacatgcagctcgtgccggtgcagaattggcgccgcatccaacttgttggcacaattcttgagatcccaatgagcaaattaaagcttcagcgccaagaccaacaggcaactggtgttgcgcagtatcggcgccatgactgacttgtttgcgcttgttttgagaccacaatgaaaagaaattaaagttttagatgtactataatccagtgatttgtttgttattgtgaaattaaaggtgtgtccacctaggcacatctacttgttctatgtgcaactcccatcatataacatccttttgtccgcctatttacgagagtcggctttgaaaatcaagttgtattttc

SEQ ID NO: 31022 - DNA, 713 bp, Triticum aestivum
  Clone ID: PAT_TA_31022
tgatcgaatgccgctaatcattttggaggtttgttgtagggtgctctaccaggttttttgttcagatatgctctttctctgcctgccattttagccatcagttgagaattatattcaggtcataatatgcacccacacaattcaagttcatattctggaaggacattgaccaacgaaccttgtagtaatgttacaggtcataaaattgtgtattcctactaaccatcattgcatgtgtgcagtggttagagattttgtagtggataatcaattatctttatcttcttctaactcaaggaatcatactgcaacatttcctccagtgcaggcaaactcgaatgatagttagtaaacttggttagtaatattttttgttttcttaccttgcatttgtgatacgtcactgaacatgtttattagtttgtcacgtcactcctgcttgacatgccaattcacaaagggcagcctggtgcacatcgctcccgcttgcgcagggtccggggaacggtccgaccacttgacatgccaattcacaaaaatgaaagaaatccagatgacctgtgaacctccctgttgacataaaattaatggttgttttatgtctaagcctcatctattatatacatgtacagttaccggggtggatttcaattcctgtaacttagttttcttacgagatgtgactcatctactaatatatagtagtatgtata

SEQ ID NO: 31023 - DNA, 540 bp, Triticum aestivum
  Clone ID: PAT_TA_31023
atctgataatgttgcggcaggacggatctttaacaacattggtttttaagcaatacatttagaaggaccacaacagaaaagaagcacatccaacacatcgacttatttccattaaagacaacactgactgcaagtagatttctataacaaaattgatggcaccagccagcagtgatccactaccgcttgcacttcgctttcgccattttcttcctcttcttcttatcggccttggggatcttcgtcttgcgagtttccctcttttcctccttcactttcttcttgttttccttgcgagcagccttcctttcctcgggccccatctttgtggactcgtgccacgaaccgtcttcgtcggatctaaagcaggactcactgtcacccgattcatcttccttcttgttctccaacgagcacttattttgcaggtccaagggttcttcccgtgttttctgtgccggctgtgcttcctggttttcggtaggctcatttttagcccgcacaaatcctaacagtggctggtcataaagcttatctgct

SEQ ID NO: 31024 - DNA, 487 bp, Triticum aestivum
  Clone ID: PAT_TA_31024
gaaaccatgggctagatcaaatcccttactgttctcgcctcactagttgctagtagttggttttgtttatgtacactgatgatataatcgagaggatcatattcattcattcataccgatctcctaagccaaaaaacaagacggacacttgatctactgacagctgcaaaaaagatctgggtaggggctaatgtaatcaatcattggcgcggatgctgcaggctgacgagggtatcgagggggaatccgattccacgtcttacatatcgtcccgctcctccgcggcggcggtgagatcaagcgaggcgacgaacttgagctccacgggctggtccgggtcgtggcagccgtcgccgagccgcgggtccaccagcccttgcaccacgccgtccttcaggtaaggcttggcccaggcgaggaggctcatgtgggagccgcgacgggttcggcggagatgagtccaggaggaagacgcgaaggcgaacac

SEQ ID NO: 31025 - DNA, 640 bp, Triticum aestivum
  unsure (1)..(640): unsure at all n locations
  Clone ID: PAT_TA_31025
ttttttttttttggttcgtcttctttttttttttcgagaagcaaagccacgggagttttatgtactgcaattgcaggagagatacactttggcacgcgtgcgactgcagagtgcggactgatacgcccccaaaatcaggaccccaagctcagtcgcttgcacacatgaacagagcgagggagcaaatctactgcgacatgcgcgggcgaacaaacatacacatgcgcgcacgcgcgtactcccctgcatgcatcgaccaaccaaccactgagttacaagtgacacacgcacgcacacacataacaactaccaaggacacacactgggagtgggagatccatccggtccggcggcggcaggatcagacggggatgtggtcgagctcgtcgtcgtcggcggccacggactggctctgcagccgccggagcttgaaggaggagagcttctgggggccgtccttgggcgggtcctcgaagcggatgtaggtgtaggtccaggccccggagagcgtgccgaggacggggccgaggaagtagaagcccagaggccgggggtgcccgggcggcccggcgcccggcccggccccctcgccccgctccccggtccacccggcttcagccntgaaaaccnccccctggtg

SEQ ID NO: 31026 - DNA, 2423 bp, Triticum aestivum
  Clone ID: PAT_TA_31026
catgcccggcttctgaaagctcctccaagaactccaaatccagcttccccgtagaagtgatctggtctcgcagcttgtagatctcggcgagcagctcctcctctgtctccgccacgaagagggtcccgccggccaacatctctgccatgatgcacccaagcgcccacatgtccacggcctggccctagtaccggttgccttccagctgctccggcgatgtgtaaatcagggtgccgacacagcactcctcatagggcactctggccggcttcgcccgaatcgccgacccaaagtcaccaaccttgagcccgccgaagaagccgaccatgacgttctccggcttgaagtcccgatggatgatgccggctccatgtatcttctttgccgcatccaggagctgctccatcatcacgcgggtcacgtcctcggatacaggcctccagagcgactcgcggagggtgcggccgtcggcgacgagctccatgacgaggaacacgtcccctgtctcggcatccgtcgccacatccaagatctcgataatcgactcgtgaccccgacacgcgccgaggcagccggcctcgcgggtgatcgcgcggatgtcgggcgggccgtgtccgccggccccgttgccgcggacccacttcacggcgaccttcttgccggtgcggcggtcgcgcgccttgaacacctcgccgtaggtgcttctccgagcacctcaagcttctcgtagtcggtgatgctcccgaacgcgtatcggggcttcttgccgccatggacgcgcggttcttgtaaacaaaaacctgcaacttttattgattgattgataatctccgacaaaatgacaaaatatccgaatatacaacaacatatgactgaccatgtttcacaccgacaagcgaaaaaaaggcaatgatagggcccatggaggaaagtaacaagaggaagaaaaattccagagccctcctacttttggccttgattttgaacccaatccaacttgatgttgataatattatgatctcccacaccatgagtaaattgggcagatctaacagcgtattttccaccaggttacaaacaaagaaccagaatatacccttcattagtgcccatactcaaaattacagagtcattgtaagtttggccttaagtttaaccccaacccagttatattctggctatttccacacccaacgatacccaggggagtacagccagtcaatcctgcgcaatgcgtgaaccgaacaaatccttgacggcctgaaacctcgcccccttgtcagcaaacttcgtgccctggtagtagtccacgtagtcgtcgaacctgaaccgcgcggggttcagctgaatcgtcgtctctgcgtggtttctctcctccgccagaaccgggccggcggcggcgccatggtggctccccgcccgccctcgacggagccggcggcagccacccagaagcgatggggcgttcccccccccgaacagctggtccctcggcccgctgcccagcgacccgatgatctgtggtatgacaatagataaattaagaatgcccattgctaaaccttggcctagcccaagattttcaacacgacttgcagccatcgcatatggtatactgtacgtgaccgacagaggtgctcctaggattgtgaacacaatgagggaagcggcgacaatgccggttggaggtgctccactaggtccataatccaggttctgcgcaacgtatgttataataagcatcgccacgaagcacagagccatgatgatattggagacaccccatacaagtccagctccccacttcctacacaacttctccattccaatagatgtgatcccgagaacaaccgagttgagcatgagaccaaaagagcccattctcacaccgtcatgatacttttgggtgtcggcgacgatctccgggcttccccggtagatctctcggcccatccagtcggtgtcaaagaggatgaaagggaaccagccgatccaggtaagcgaggtgacgatcaagaccacccaaagaggcagcgggaagtgcgggtgatcgccgggatgcccggcgggccgtgccccccggccccgttgccacggacccgcttcccggcgaccttcttgccggtgcggcggtcgcgcgccttgaacacctcgccataggtgccttctccgagcacctcaagcttctcgtagtcggtgatgctcccgaacgcgtatcggggcctcttgccgccatggacgcgcggttcttgtcccgccgccgggcgcttgcggatggccgtcggcatgatctgagcttagaacgcgcgccgagagcagatcagggcagaggggcggggattcgtgtgcgtcgggagcagaggagatcgaggtggatgagaggagcgatcgaggatgaagggccggcgccgtgccgagcggcg

SEQ ID NO: 31027 - DNA, 2048 bp, Triticum aestivum
  unsure (1)..(2048): unsure at all n locations
  Clone ID: PAT_TA_31027
ttttcagtatttccaaagctttgttttcccacaaatacacgataagaaattacatgcagagaggagaacaagtattttctgttgtttaggacaaacaggtctataatgcagaatcaatcgacagaatgacatcaaccttagttaagttgctgctaacacatagccaaatgtgtttcttcagtggatcacgtacttaggcacatgatacaatctaactctagtgtacacgctgcggcgcatttccatgttcggccgctcaaggcggcgggccggccggccggtaaaaggcctcccacaccccccccctcctcggccatcctcatctcgcctgtgctctccacacgaccacaccaaaaaatccagacctgcccgcccgcctcgcctcgcctcctcgtctgcctcctctcctgcgcttcagtttccaggctaggttgctgttgttgttcacatggattcctttttccaaagagctttcggcgacccaatgtgctcggaagacagtaatgttgtccaacaaggaattgataaatgcccattcctgaggaacatcaacgagcctacaagtttttccttgacatccattaatttccccgctccggcaaccggagccaagggtccaatttttgaagacgggcccaactttgacacggcgtttcgagttttccatggcagagacggggttgttccactttcagaaggagcctttgcacatattgagaagcctctgccaaagcccactcctgaatttaaccccttggcagccaaagcagctaccatcagtctctcgggattcggaggctttttcagcttcggtgatttctcaaacaagcgcaataagcagaactccaacaagaagaatcccaacaacctcccccagaataaaggccagtctaataacaatcatgaagcgatgagcaatgactggctggaaaatggtcaatgccctcttgcaaagtcatatagagcaattggtggagtcgtgcctcttgtcgcaaagctgctgacacccccagctggtatgaaactgacgtgccctcctgcgattgttgctgcccgtgcagcaatatcccgcacggcgtttgcaaaggggcttcgccctcagcccctaccgacaaaagtagtggtgatcgcactgctcggtatggcagcaaatgttcctcttggcatctggagggagcacactacgaagttttcagtgcagtggtttgcggcggtccatgctgcagtgcctttcatagggatgctgaggaagtccatcctgatgccgaagagcgccatggcccttaccatagctgcctcgatattgggtcagacaattggttcaagagctgaacgtatcagattgaagagggcaaaattagcagcagagggccatggccatgaacatgctacccggattgaagctccggtgaacctgaaaactgggagctcaggtgctgtccagctctgggacccgcttggcctcagagtcaaaggcgccgtgtccccagccctggttccgactgtcggtgccatgtattgatgagatgatcgtgcttcattgcggcggttgtgagaattgtatcagagttccagaaattgtttcttgtattcattgttattgtgtcttgtaaaggattactggctacattggattcttctccccactatcatgagttgggtgcagtcaataaatttcaccatgttggatccgctaaaaaaaaaaaaaaaaagcggcccttctccaaccctggttccgactgttggtgccatgtattgatgagatgatcatgcttcgttgcggcggctgtgataattgtatcaagagtttcagaaattgtttcttgtattcattgttattgtgtcttgtaaaggattactggctcctttggtttcttctcccccaattgggttgggatcatatcattaagtttcccctggcccatgggttcctaaaaaacccagggggggccgtacaattcnccanaggntctattanccgnantggcntctttnactcggacngaaacntgggtnccaantacgcttgaaancccttccagtggtnt

SEQ ID NO: 31028 - DNA, 591 bp, Triticum aestivum
  unsure (1)..(591): unsure at all n locations
  Clone ID: PAT_TA_31028
ttttttttttttgaatcggggattgttanggtacggtacataactatttgatataactttcttctacataaaagtttgtacatcgtttgtcatgtactacatgctataaacactaaattgaccgaatatacacgtgcttcagtttgtacaacgtggacgaagcaccttttggcttcacctgacctcgtcgctcttgatcatgttcgagaatactccgctcagggacattccgtctaggtcacccaagttggtggtcatggcagcagcgtcagtcgccacggtagcggcggacaggcgacgctgaacctcaggcgttttcacgggcacgggcggcgccggcggcaacatggtgtcgacgtccgagctgtctgacgaccccacctgcagctgcagcgcgaactcgaggcaccagagcacgtcccccatggtgggccgctccaccccgtactcggcgaggcacttctcggccgtgtccgcgagcttcttgagcgaccccggccgtatcgtgccggcgatcctctggtcgacgatctggtcgagctggccgtttctgagacacggtgttcatccactccgccaggctcaccatct

SEQ ID NO: 31029 - DNA, 724 bp, Triticum aestivum
  Clone ID: PAT_TA_31029
gtccgcggcgccgatttcttccttacccgcctccccgccgacgacgacaccttcccggggtgggccatagaaggctgctgcgacggcaaagtcctcctccagaacttcagcctggagcaactcgccgtctacaaccccctcacgcgggctctggatctcatccccgtgccgcccgacaagatcttcgacgacgcccgcggcgacgccaagtaccttggatgctacatcctctcctccgaagagggcagcgagccgctgcgccttgtctacacctgccatgacaagtcgcgggcgcgtgccgccgtcttctcgtcggagagcagggagtggcagatcttcccgtggtcggaggctgtgacgccactgcctgaagacgaacactggcttaaagttggcacgatggtgaatgggttcgtctactggatacacacaaatgaagcctacatccttgtgctgaacacatcgacactacatttctcccagatggatttgccgccgacattggtggcgcgagaattcaccttctgggtcggcgagagcaaggatgggaagccttgcattgtgtgcccagtttactttgagctttttgtttgggtctggagagccgagtatgacggcatgggagagatggatgctagacaagaagtttcagttggagtttaagtccgaggttgaggccactgggcgttcactagaagatgtttagctgcatatcgtggatacg

SEQ ID NO: 31030 - DNA, 382 bp, Triticum aestivum
  Clone ID: PAT_TA_31030
acgccaaggacgaccagaccagcaccgtcaccgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccatattatatactccgtatataatgtcacatatgtgcgtgcgtgcatggccggtgcgtgccattcagcgaataaatgtataaataaaatggaagtgtaatttctacggttatgtggagtgcaactctgttttattttcttatctttttatgccatgaatatgctacatctatggaaaattcttacgcacagattccctgaaaaaaaaaaaa

SEQ ID NO: 31031 - DNA, 205 bp, Triticum aestivum
  Clone ID: PAT_TA_31031
cagttctgttcttacattgctgaaacgtgtcttggccttgcagctgccaagattcagtctttcgttgtatttcctagttgtcacaaaatgttacatcctctgtttctaaatgtttaagaaggtttttgcagttcaatttgaactgcaaaaacgccttacattagtgaacagagcgagttggtgttccattaaagccttttagttt

SEQ ID NO: 31032 - DNA, 623 bp, Triticum aestivum
  Clone ID: PAT_TA_31032
cacaccactgccaccatctcactctcgatctcagctgcgagccatggccgtgaacgacaccaagctggccgacgccgagaacccgggcgtgatgtgccgcggcggcggcatcgactccgactccgacgtggacttcgcgggccgcgccaactggctgcgcgcggcggtgctgggcgccaacgacgggctggtgtccacggcgtcgctcatgctgggcgtgggcgcggtgaagcatgaggtgcgcgccatggtgatctccgggttcgcgggcctgctggcgggggcctgcagcatggccatcggggagttcgtgtccgtctgctcccagcgcgacgtggagatcgcgcagctcgaccgcgacggcaagcgcggcggcgacgaggagagggcgctgcccagcccggtgcaggccgcggcggcctcggccctcgccttctccgtcggcgcgctgctgccgctgctggcggcggggttcatcgtgggctacaagctgcgggtggccgtggtggtggccgtggcgacgctggcgctggcggcgttcggggtcgacggggccgtgctggggagggcgcccgtggtgaggtcctccgccgggtcgacaagggcggactggccgacatggg

SEQ ID NO: 31033 - DNA, 969 bp, Triticum aestivum
  unsure (1)..(969): unsure at all n locations
  Clone ID: PAT_TA_31033
ttcacatgatccattattcatggcgcacgccaccgtccatggcgcgcccatgacacgcccgtgcccgcgtccgtcagcccccctgatcgtcttcctcgtcctgctcgcttcctgctacctcgccctcacgcgcctcccctccgcggccccgctagccgccctgatcgccccctccgcgggccatggctccggccacggcgctgtcgacagctgtgccgggttctaccgcggcgccggcgcggcggggaggcgcgcggtaacagcctcggtggaggagttcggggccgtgggcgatggggtcacgtccaacacggcggcgttccggcgtgccgtggctgcgctggaggagaggggtgctggcggcggcgccaggctggaggtgccggcagggaggtggctcacggggagcttcaacctcaccagccgcttcacgctcttcctgcaccatggcgcggtcatcctcggctcccaggatccagaagagtggcctctcattgcacctttgccttcttacgggcgcggaagggaaagattaggaccgcgccacattagcctcatacatgggcaagatctaaatgatgttgttattactgggtagcaatgggaccataaatgggcaaggcaagatgtntgtgggagctatggtggaaccggactttgaaccacacaagangcatctcatccgagctcatgaattcaaaccaacgtcctgatctccatgtcaccctacgcaactccccattttggacagtgcatccggtcnactgnanaaactngtgattaaggtttggnctataacgatccccctggaatgcccaaacactgganggattgatccaaacccaattcaaaatttgtatttaggacgctatatcgaaagtggnnatncctggttgctgcaaaatggttgggttantangggatancgtagnaaaccaacnaaaattacaccacgggttcagnaccaan

SEQ ID NO: 31034 - DNA, 852 bp, Triticum aestivum
  Clone ID: PAT_TA_31034
gcacgagggtgtgttaaaaaggcatcgtcctgcactgcgtaaaagcgtcggccggctacggctttcagttatgtcttcatggttttgctcttcgctcttcgttcatccctcgccctcgcctgctccatgcaaacttcgtattagttcctgcagacgacccctctgcgtcgcgtgttcttcgttgaagatactgctcgtcaaaaagcagtaacgacctttcatcttttgcaaattggtaaggtttgattgtgctgataaatgcagcttctggaagtattagaagcgcaaatttctttgtaggacgagtctccagaagctgcatctgcttgcttctctgggactgacggcaaggtatttagttgaatggcctgcacccttgcctccgagccccatgccaggtgatgaggtcatctgaggggcaattatacctgggtaagtattgcaggaggtgcaagcctgtctagactgcgatgcagagttgggcagttggcgtcgttcttcatgctcttcgttctcaacttatccccgacatgctgcctgctgttcttctccacattctgctttcttcactgtgcatacggttgagctcctcggtagcttatatcttccagtcacattctgttgctgttggatgcaacatattcgtcaataggtttattctaataatttggttgagcctgcacttgtgaacctgaattttcagatcctagattgttctgacattgaagtgtcagacatgttacataaccttgatctgctttctgttttcaatttgtgcggaatgttcccttggtcggtatgctttgctggcctccttgcagcccttgcagcatgaaaaaaaaaaaaaaaaaa

SEQ ID NO: 31035 - DNA, 754 bp, Triticum aestivum
  unsure (1)..(754): unsure at all n locations
  Clone ID: PAT_TA_31035
tggtgccaggnacttnctntattgctcctnnggnggttgccgcttcgccgcncgagcgtcggcgttccccggggtacgtcattacgtgcccagaaacctcaaccaccatcgccgatcatgcgcgccnacggtggagctccacgacggcgttccacccggcgagtaccgcgacctccctgaccctctggagctccccgggggcgtgtcgctgcgccgcgccgacctgccgccctcgttccggagatgcggcgagccggtctacgcgcacctactggaggagggccggcggtaccgccgcgctgacggcttcctggtgaacaccttctacgaggtggagcccgccaccgtggaagagttcaagctggcaacggagcgaggcgcgttcccgcccgtgttcccagttgggccgttcgtccggccgggcacaatctccgacgaagccgccggtgcgtccgcgtgcctagactggctggatctccagccgaccggatccgtggtgtacgtctccttcgggagcggcgggtcgctgaccgtgcagcagacggccgagctcgccgctgggctggaagcgagcggccaccagttcctctgggtcgtgaggatgccaaatctggacggtggcaacgacggccgtgaccgtgaagacgacaacgcgaacccgttggcgtggctgccggagggctttctggagaggacggcggtcaaggggctggccgtggtggtatggacacctcaagtgcgcgttctgtgccat

SEQ ID NO: 31036 - DNA, 651 bp, Triticum aestivum
  Clone ID: PAT_TA_31036
ctggcactggcagtcgcttccctttcccaccacgttgacatctcttccgctccgggaaggaggcaggcacgtagacgtagcgatggcgccgcgtttcctggcgtgcttcggcaggggcggcgcgacggcctcggcgccggagcctgtggaggacctggccccgggcccggtgctggtggagctcttctcctcgcaggggtgcgcggcgtcgcctgaggcggacgccctggtggcgcggctggcgcaggagtcctcggagaccggcggcggcgagcgagcgatggtggtgctggggttccacgtggactactgggactaccgcgggtggaaggaccccttcgcgtccagcgcctggaccgtgcggcagaaggcgtacgtggaggcgctccggctggacacgctcttcacgccgcaggtcgtcgtgcagggccgcgcggactgcgtcggcaccgagcaggacaagctcgcccaggccgtccgcgacgcgccccgctacccctcgcccgccatgaaggtgaagttccagcggccgaacccgagcacgctgcaagcgtccttcacgggcgcgctccactcccgcgtggacggcggcgggagcgtgctggtggcgctgtacgagagcggcgtggtcaccgactggcggcggggcga

SEQ ID NO: 31037 - DNA, 727 bp, Triticum aestivum
  Clone ID: PAT_TA_31037
gctgtgtgcgcgggcccggtcacgacgggcgaagggcccatccccggcttgagcacctatttcctccgctccaccaacggcaagggggaggaggccaccgtggtgcctgtctgcctgcccaaggacgccatggacaagttccgcctcgaggtccaagccctcaccgccggcgaccaactctagcctctacctacctgcggccggccggggccaaccgcctccatgggggatggggggcggttgtgttctccgggccgatgagtataggcgacctccctaccctaggcttgacctcacattttctccgctccacctatgacttgggtgaaaatgccaccgtggtgcctgtctgcctgcccaaggacgccatggacaagttccggctcgaggtcgaaggtctcaccggcggcgcccagctctagctatgcccggccggggcaatccgttcgtcatatatgatgctatgtatacgtcacctacatgtgtttcctccgttccataattcttctggtggtttttggtttagtttaaatttaaattaaatccaaatccaagacttaggaccggaaggaagtagtgtacggcacagtaagtatgtgtaccttatttaatttttattttgagaaattgtgtatcttataatatatttggcgatattttattgtcacaacagggctgtaattatggactttttttgagggagtaattacggatattttaatattgt

SEQ ID NO: 31038 - DNA, 1398 bp, Triticum aestivum
  unsure (1)..(1398): unsure at all n locations
  Clone ID: PAT_TA_31038
gccgggtctcgttccattccccaatctcgccgccgccgccgccgccgcttcgtcgagtcccgctgcagttcgtccggatccggaagaaagaagaggaggagcaaattcggacagatgaaggcacggcagttggtgaacgtggtgatgcggaggtacggcatgggcagcagcctctatgcggtgagccgcatcaagcccgaggagcagctcttctacccatctaccaaggaggcgcaagcatccagcacgggggagatggagaccatctccatctccaggatgcccgcgcccagcctgaggctggagctctccgtctccaaggaggacaagaggctggatttcctgcctttctacgagcgcggcagcggcgggcacagcaagatcctctgcgtcgacgccgagggccgcaccgtcctgtacgacaccgacgccggcctcctccactcgatgccctgcctcggcacccccaaggggcccaaccctgtctccttctccatcctggacagggagccccgggatcccgggcgggcggacgccttgtacgtcatgggcaggtgctgcgactactttgacttcgaggccctcatgtattgcgacccctccagcggcaggaaaggctggcggtggcatcagctcccgccgccgcctgtgcctcgcgccgccgcctccgccgtcgggtgccacgcgctcatccacgacgaaggcgaccccatcctcgtcgtctcgtccgccaagacgagcggcgttggcacccactgcttcaacacgtccaccaataggtggttcaaggctggacgctggacgctgcctctcgtcggccgcgccgagcgtgttagcgagctcgacaacctctggtttggcatcggcggcggctggccctacgacctgtgcgcgatggacctctactccctccgcgccgccggcgccgaggctccggggctggcgtacagctggggagaccttagcctgccggacgactgggtgatgatggactgcagcatggtgtacctgggcggcggcaagttctgcgtcgcgaaaatctttgagttctgcgtcggcgatgaccgattggggatgggtgctgtcatctctggcttggaggtggtgcgccgcggcgagccatccaaactcgtgatggtcaagcacaagtccaagttctacaagtttaccagggatgagatcgagtgtatcctctagaacaatgctaagtagtactagcaggggagcaaacaatttctagacgagtgctatgtgatgtgaggattgactagtttcttgtacagcagcacttgtgtgcgatttgatttggttgtaatgtaaatttcctcctgctcgacantatgggggngctcccnnngngttggntccctcccttccctcttctctcctctcccctcc

SEQ ID NO: 31039 - DNA, 1074 bp, Triticum aestivum
  unsure (1)..(1074): unsure at all n locations
  Clone ID: PAT_TA_31039
gatgtgctccgggttggccgagctgtcctgccaattgctaactctctcatatctatgtcccgagtgatcttctctggtgatccatccatgactctgaaagtaagccttacattttgattccacgctctgttttcttcagagtacacacattttctttaagcaattctgaggcctctgattccttaagtatcaggtgtttcctattcttctatttggtgctaagtatggccatctgttcacagtatggaggcttctagcaacaggtatgattgcatggcaaagagcagtcaaacgtttgcatgacttcacctttgtatcatcttgtgttgaatgaaaatttacaggattctttggttgttttacactcccaaaactctatagctgctattcaagtcatattcatgaaaaagttgaaggtttgaatgcccggattctgaatgcatggaagtcctgtccccgcaagaaacttgttgcagctgctgcagtgacgaccttctggaacttggttagtgtgaagacacgtgtaatggctgccttcgtatctgcggtagcgctgcgctaccactatcagtatggacgaagtagcaggaattcagagggggtaatacggcggcaggagcagcaacaagcaatggttctcgaagactgacaagctgtctcatgagcacggcaggtgccgacatatctgagcatttctgtggtttcaaagcaaaagcaaaatagagaaaatgctgcaaaattgcatcctcatatctcggtggcaggcgcaatggctgtgatgtattggtattggtacatcttgttgccaatatggtactgttggggaatattttcgatcaagcatgaggcgatcttgttgcacgcgtgactgcttgacacccatatacgttgaggggccctatatgttgatgctgtgttcatgtcaagctcgatgtgcctgtgatggtgttntgcttgntgtgtaaagcgccaactcttttttgtgcttttgagaatctcgtctgacgacgggggtgaatatgccctgtctaaatgggccaggtgagacatctgtggagaacgccttcatttgca

SEQ ID NO: 31040 - DNA, 1384 bp, Triticum aestivum
  unsure (1)..(1384): unsure at all n locations
  Clone ID: PAT_TA_31040
atatttgccagaatttaatattgctctccccatgcctccatatgctaccgaaccagagaactgggcgttgcactgctgttgctggcaagacaacaagagcaaaagctggtgctgattgctgggttccaggaataggaaggaacactgaagcttatgttttaaaggaccaggaaactcgctaccgccagagatatctcgacctcatggtaaaccatcaagtgagacatatctttagaacacgatccagggtcatttccttcatcagaaggttcctcgacgaacgcaactttttggaggttgagactccaatgatgagcttgattcctgngggagcatctgcaaaaccttttgttacacatcacaacgaactaaacatggatctctacatgagaattgctcctgaactccatctgaagcagttggttgtgggtggcttggaccgtgtttatgagattggaaagcaattcaggaatgaagggtttgatttaactcacagtcctgaatttacaggatgtgaattctatatggcttatgcagactacaatgacctgatggagcttactgaaaccattttgtcgggtatggtgatggagctgactggtagtactaagataaaataccatgcgaatggagctgataaccctcccatagagatcgatttcacacctccttacagaaggatagatatgatgcaggcactgaaatctatcgctgggcttgacattccatcagatttgtcaagcgacgaggctaacaaatacctcgcggcaacgtgtgagaagtatggaatcagatgctcgccgcctcaaacaacagcacggttgcttgacaagattactgggcatttcctggaggccacatgtgtgaacccaacttttatcatcaatcatccagagataatgagcccactggccaagtggcacaggactcagtcaggactgacagaaagattcgagttattcatcaacaagcatgaggtatgcaatgcctacaccgagttgaatgatccattggtgcaaagacaacgatttgaagagcagctgaggagccggcaatcgggagacgatgagcgatggcgctcgatgaggcgttcggcactgctctcgagtatggtttgccgccaacaggcggttgggggatgggaattgatcagatcgcaatgcttctgacggactcgcagaacatcaaggaggttcttctattccctacgatgaagccccaactacctgggtagtaggaaaccgctatttcaactgaagagggacaacacacaacagtattatatgtacataattaagaaacatgcatggtttcacacgagtgttgtatcattgttgaagactgctacttggagtgtttgatatttgtggatttgtgtttcatc

SEQ ID NO: 31041 - DNA, 956 bp, Triticum aestivum
  unsure (1)..(956): unsure at all n locations
  Clone ID: PAT_TA_31041
cgggctgcaggnaattcggtcacgaggncacaagncacaaaccgcagtggaagnagtagaaggatggaaccagcagacacgctgaacccacaagcacaaatgacagtggaagagagaaggatggaaccagcagatgtgttgaacccgcaagcacaaattgcagtggaagagacaaggatagaaccagcagatgcgttgaacccacaagcacaaattgcagtggaagagaggacagaaccaggggatacgttgagcccacaagaacaagttacagtggaagagagaaggatggaaccagcagacattgttaacccacaagcgcaaattgcagtggaagaaagaagaatggaaccggcagagacgtcgaaccgacaagcacagattgcactggaagagagaaggatggaaccattgagtgatgctgaaggctcgcctcccagcttgaatgatgacaggcgtaacaaagggaattcgaaaacaagggctgaaaagatattttctcctccgcggcagcctcgatccgtcaggcctcgactaacgacacagcagtgacgttgagtagttcttctttcttactttggatagctgtcatgatgtacttgtggcccatgtaaagaagaaccaagatgaatgtttttcatagtttaacctgatgtacaaactacagaagtttcaagtgctggaaatgagggtgtgcctgaaggacatctgacgacataacaggaagtgagcaaggaaggcttgataggttttgtggcagtctgcagcatattgtacatttgaccaccagacttatataaatatatatgtgccgtgccgaaatggaagaaggaaaccaatagagatgtgggggtttgtgtatcgttaaattgtaattaggggttggcttgtgtgttgctaattgagtgagatgccctagtatacttngtactctttccggaaattaaatatttttt

SEQ ID NO: 31042 - DNA, 717 bp, Triticum aestivum
  unsure (1)..(717): unsure at all n locations
  Clone ID: PAT_TA_31042
acaaaagatgcaatctattgttgaaagaccaacttgtccgcaaaataccttgcaaactgcggcacgttgagctaggaggtctgtgcgagttagaggttatatgagacaagggcttggtcctattgaagttacatttgagaattttccctactaccttagcgagaatacgaaggatgtgctcttatcatgttcattcctacatttggaaaagaagggattcattgagcagttctcggaagtttcttcaataaaccagcgaatttatcatctggtccatcaagtaaattattttttgtcattgcatattgtctccgttgaatggaatttatgtccttgaggcatgtcagattacatgctttttgtgaacaccattacttataagtatccatctcattatgtatcaggttctgagatttattaggaaacattgatgaaggcacttgccaaacattttggtgctatactacttgatgttgatttgtttctattgctagacatacttagaactacatgaataacttaaatagtgatatttctgttttgatgattcttggaactatattgtatgtggctgtccatgcattaacgttattcaattttttatatagtgtacatacatcgtggaagttaaagcatctgtgactgcatgtggatatatttngtcaanccatgtaacattgcctttaaacatgatttaggattttcattatgtgcaac

SEQ ID NO: 31043 - DNA, 1124 bp, Triticum aestivum
  Clone ID: PAT_TA_31043
ctctcccatcatctttgctccgcatgccccagccactactggcgtcgaccgccccagccgaccgccccggccaactcccagtgccgcccgcccggatccagcccacaccaagccgccattccgcgccgccgaggcctctgagccccgtcacgctacccacccactcctctcttcatcccccaggctcaccatcctcccccgattggatccggcggctccctgttcaacgctaccttgagcaggggagctcgcacggcggaggcggggcggcgggcgggaagccgaggctgccgcacagcgggcaggtgcttccctcccctacctacctccttccacggcaccacgagttcttcccaaaaattgcagcaccaccccaagcccgtcccgcatctgatccactcatcagcggcgcaccccacccccctccgccccgcgacggtgtgcagtacgacactcgcgttggtgcagcccgatggctgcacctacgaacgacgaccgcaaagtccctaggatgaagacgccggggagcgtggcgtgcagtacgacactcgcgttggtgcagcccgatggctgcacctacgcacgacgaccgcgaactccccaggatgaagacgccggggagagtggcgtgcagctcattttggctcaccatgcagctcatcgcggctaaggttgcagctcggcatgctgcgacctctgcttgtgtgagcgcgtggcgtgcagctcggcgcgtggcgtgcagctcattttggctcatcgtgcagctcatcgcggctaaggttgcagctcggcatgccgcggcctgcagtctgcttgcgtgagcgcgtggcgtgcagctcattttggctcatcgtgcagctcgtcgcggctaaggttgcagctcggcatgtcgcggcctgcagtctgcttgcgtgagcgtacagttcgtcactgggtgggtgcaggagactgccggccagccgagcttgcggttcttttgtctttttttcttccgatttggagggctgtgtgtctcggtttgcaccatgcatggtgcagttcagcagctctttccacaccatttacagtctggtgcgacaattcgttcaattaaacagcgaaaaacaaaatgcagttggccggcc

SEQ ID NO: 31044 - DNA, 1062 bp, Triticum aestivum
  unsure (1)..(1062): unsure at all n locations
  Clone ID: PAT_TA_31044
gaaagatagatcattttagcgggagtaagaaagagggagcatggggaagaagggggttgccctggtggcgctgctgctggtgatggtcagcatggcggtcgtgatgactgccgacggccagggtgccggcagcgagttcggcaaagcggccgaaggagccgggacaggcgccgccaccgctgctgagggcgcgggagccgccgtgaagtcggcggcccagggagcaggccaggcagctagtggcgccggcgaaggtgctggtaaatcttactccggcggcggccgtcgttgagcctgccgtgtaccgcgggatcgtcgccgccgtggctgaggaatgatacccaaccatgccactgcgaataataaaaatcaagctgcttaattagcatgctgtcaactgaaaccatgttaacatgccgctcgatgtatgtcacgcttaacgccaccgggatgttagtactggttccggtgggagccaggcagcccagggcgcccgtcaaggtgctggtagctcttactccggcggcggcggcggccgtcgttgagcctgccgtgtaccgcgggatcatcgccgccgtgactgaggaatgatacccaaccatgccactgcgaataaaatcaagctgcttaattatcatgctgtcaactgaacccatgttaacatgccgctcgatgtatcacgctaaacggaatgttgtacgacgctacgaagctccgcccctggccacagccccccataagcacacatagctccgtcattcatgtacgacgctgataagatgcgaccttgcgtaacggctttgtccatttggatgcggccgtcttcgatgatagaaccaataagacgcgtcgcctccgtcaatggtacaactcctatatatgataaaggaaaaaaagaactcgttctctcttgttcgcacactcccaaaagagccgataccccctcccgccccgcttcactctcctcggaaccccggcctccacgctgccttccccttcccggccggcggntatacnaagcccncgtnccttcaaatttcacnatgcatgaacccntcggnt

SEQ ID NO: 31045 - DNA, 586 bp, Triticum aestivum
  Clone ID: PAT_TA_31045
agcaggcggtggtgcacggtctgggcggcggtgacctgcgcggccctgatgctgcaccgacgcctccttcctccgtcgcccaggtccaaggcggctctcttctagccaacctccagccatgcatcgtccctttctccttggcggactctctcctcctctagagaagtagcacggggctcgttgctgtgcctgagccgccacaaggacgtcgggtggaggggatcctgaagttgctgcaggtagaaaacggcggaacatttgatgtggtgaactagctgaaggaagagctatggtggacagaaccaagacttgcaatggatgtgcagaaatagctataggaggagctatgggtgacagatccaagacatgagattctaaccatcttcttgcgaaggctttcttgcaaatcagtggatgtaaccatgtcatagtttgatttaagtgacatggaaccttgacagtagtcacatgctcttttatcctttttattgctagcatttttatcactctagatattcggtttctaatgtcatttgaattaagatctttttgtcactcatccatggatcctttgcatatgagaggt

SEQ ID NO: 31046 - DNA, 870 bp, Triticum aestivum
  Clone ID: PAT_TA_31046
gccctctagacgttttacaaaacaaagaatacaagttttcagtgttgaatctgcctgtaagttctatccttgtccttctctaaacacaagtatagacaccccatttcacccataaaaaacttacaagttctgtatagttgctcagggaaggccacaccaagaagaagaagatccattattcctcaattcttcacaaggtgcagggaaaacttcatgcgcctctccgtacacagattcgcattgccaccgtatctgacgccttatcgctgtcaggctaacgtttctgaagcatatcccctcgtaaaccgcgccgtgcaccgcctccagcatcggtgcgcgctgcacatccacaccaacaatgtcaacaatatgaatgtcactgatcatcggtagcgctgttcggtcatacttgtcgtccgagtggtcatctgaaccccgggtgaaccttattggcaccttggccttctccatcgtcacattggcgatggtgatgttggttatgtacccgccacgccccacatcggtctttagcctcaccgcggaagcagagttccatatgtgcaggtcgcggacaagcacgtttgatatcccacccgacatctcacttccgaaacccacaccggagcacgtaggtgtggtgcctgaaacccgctggatgataatgtttgagctgggtttgcctacagatatcccatactgatcccaaccactcttgacagcaaccaggtcatctccactttcgatatagcagtcctcgatacaaacttctgaacttgagtctggatcaatgccatcagtgtttggagcattcaggggagctagtatagtcaaatcctttatcaccacgttctgcaatagaccggatgcact

SEQ ID NO: 31047 - DNA, 894 bp, Triticum aestivum
  Clone ID: PAT_TA_31047
ttttttcctgttgtacagacagaatgcatcaatccattttttttttttttttagtatcaaaccacgactgcttccattttctagatagtgatatcagtttgcaaaagcaacaagttcacctctaacaaccaaggagccaacgaagcgttggcaatcatctaccactaccactactcgcagagagacaggcagagtcaacagcagccaactagtactacattaggaacaacaaggcgacgcattcagattcaagtgaaggaggaggtggtcttggtgcctgcagtgctcccctacgacacgcagtgcttggcgggctcgccggggaggacgaggcggacggaggaccggatctcccgggaggtgacggtgggcttcttgttgtacctcgctagcttggccgactccccggcgaagctcctcgaagatgtcgttgatgaaggagttcatgatggacatggccttggaggagatgccgatgtccgggtgcacctgcttcagcaccttgaagatgtagatcttgtacgtctccacgcccttcttcgccttgccgcccttcttccggcccctcgtcttgccctcgccgccggcgccctccgggtgcgcctgcttgcccgccggaaaccgcttctcggtgttgggcttcttgcccgccggggtcttctccgccgccttcctcgaccttgctctcggcggccggctgcttgtctgctttgggggccatggctgctgctgacccgtctctcggccttgggcttcttgcctgccggggtcttctccgccgccttctcgaccttgctctcggcggccggcttcttgtctgccttgggggccatggctgctgctgcttcggaggtgggagagggagcgggggtgtttcgcccgccggccgcgtgg

SEQ ID NO: 31048 - DNA, 787 bp, Triticum aestivum
  Clone ID: PAT_TA_31048
agagtggcagaataatccacattcttcccatagatattatcacaactgagaagttcagaactactacatctgaataattcagagaaataacctacacctggtgctgtccaatgaatgggtgggtatacacaatggaggggaatggatgcatgcaccggatccaattatacacagggaaacaactacaaatctgcacacatacatactactacacagcgcacacgatcatatacgctagaaatcagcaatgacattgtagctctagtgtatcacttggcgaggatggtggcgccgcaggcggccccggcgtgcttcccttcggcgaacaccaggttccccctcacgaacgtcgacaggaccttgcccgatagctccttccctatgtacgccgagatgttccggtgcttgtggtatacggcatgggtgtcgtcgaggtggaactgcacctcgggtttccacaccacgatgtcggcgtggtaccccggcagaatagaccccttgttcttctgccccgcgagctcggcgggcttctcgctccaccacgaggctagctggttcagcgtgatgccatacttcttcccatgtgaccatgttactgggagcacaaactgcagagatgagatacctcccctcgccctctcgctctcgccctccccctctagcttgagatcaggagtcgagggcgagtggtctgaactgagcatgtcgatgtgaccatcgagcagggcctcccagaggttttccttgttggcggcgtcacgtatgggaggaaagcacttgaaacgag

SEQ ID NO: 31049 - DNA, 1807 bp, Triticum aestivum
  unsure (1)..(1807): unsure at all n locations
  Clone ID: PAT_TA_31049
tcggcacgaggcccgctcccgttggcctccgcgcttcgtctccgcgtgcgctccccatcccccgccccccccccccgcccccgcccgctcccggacgtgctctgcttctccagatccgccgccgacgctgctgctgccgcgtcctgagaaaatggcgatgatggtggatcccccgaatggcatgggaaaccacgggaagcactactacaccatgtggcagaccatgttcgagatcgacaccaagtacgtgccgatcaagcccatcgggagaggagcctacgggatagtttgctcctcgatcaaccaggagaccaacgagaaggtcgccatcaagaagataaacaacgtctttgacaaccgcgtggatgcgctgaggacgctgcgcgagctgaagctccttcggcacctgcgccatgagaatgtcattgccttgaaggatataatgatgccgatacataggaggagcttcaaggatgtctacttggtctccgagctcatggacacggatctgcatcagatagtcaagtcgtctcagccgctgtccaatgaccactgccagtatttcctttttcagctgctccgaggactgaagtaccttcattcagcggggatactccatagagacctgaagcctgggaaccttctggtcaatgcgaactgtgacctgaagatctgtgactttggtctggctcgcacaaataacactaaaggtcagtttatgaccgaatacgttgtcacccgctggtacagagctcccgagctgctcctctgctgcgacaactatggcacctccatagatgtctggtctgttggctgcatctttgctgagctacttggccgcaagccgatctttccaggaaccgagtgccttaatcagcttaagcttatagtcaatgttcttggcaccatgagcgaaactgaccttgcgttcattgacaacccaaaagctcgcaactacattaaatcccttccatacaccccggggatgcccctcagtatcatgtacccgcacgcccatcctcttgccattgatctgttgcagaagatgcttgtctttgacccttccaagaggatcagtgtcacccaggctctggagcacccctacatgtccccgctgtatgatcccagcgcaaaccctcctgctcaggtgcccatcgatctcgacatagatgaaaacattggcacagatatgatccgagaaatgttgtggcaggagatgctccagtatcaccctgaggccgccaggatggtgaatatgtgacaagcaggaatgaacatgtgagagcagtgtgccacaccagggtcttcacatgttcgttcttcgtataaagctttaatgcaattatcgcaatgccgtcgagtgacctgtttatgtaaatatgtgcacaataaacggcgtatggatttctctagctgtgggtcagtacttgctagtatatatagactactgtgttgtagaaacggaattcggttatcaagaatctggttatgaagaagcttgtgtaagttgtaatcttctctcttttttccctgattgtaagtttgtaatcttagacactgctctatgtatatggactactgtgttgtagaagcggaattcggtttattaagaattgggttatgaagaagcttgtgtaagttgtaatattcccttttccccatgattgtaagttgtaattttagaagctgctctatgtaaggaggtctaaactttcactnaaaaaaaaaaaanaaaccagggggccggncaatcccaaanatcttnccgcacggcnntttaactcntangaaactggttcaattacct

SEQ ID NO: 31050 - DNA, 907 bp, Triticum aestivum
  Clone ID: PAT_TA_31050
aagctaggaagcaatcacggtgagcaagtgctcgccggtgatggtccgcccgtcgacagagccggtgctggggaagacggcggcgacgcaagtggtgcagctctcgtcgtgggacaggggctacgtgggcttcctggcggcggtgctcctggtcttcgacggcccggttcaccagcccgtggaagccatccgggagggcctctcccgggcgctcccccactaccacaccctcgccggccgccttcccccgccccatgacgacgacgacagcgttctccacgtcgcgtgcacaggcgagggtgtgcccttcgtggccgcgtcggccggttgtgccctgcaggaccacggcctcctggacgcgcccttctcgacgagcctgctggaccgcctcgccgtggcttaccctgccgcggagggctgccggcgcacggacccgctgctgctcatgcaggtcaccgagttcgcctgcggcgggttcaccgtgggcgtgacgtggaaccacacgctggcggacggcgccggcatggcgcagttcctccaggccgtccgcgagctcgcccgcgctgaagccgatgttgtcttggtgccgtccgttgcaccggtgagggacggtagggcggtgtccctgccgctgctctcgccgcacgtggtcgccgggaagcagtggctgatgctggaccgcggaggcacgggactcgtgtacctggacatcaccgtcccggtcaagctcatcaaccgcatcaagtccgagtacaaggccgcccacgccgacgacggagggtactgcacgacgttcgaggcggcggtggctgtcctgtggcggtgccgcacacgcgcgatcatcggcgacgacccggactacgacatgtccacgccggcgccactggccttcttcgtgaacgttcgc

SEQ ID NO: 31051 - DNA, 723 bp, Triticum aestivum
  Clone ID: PAT_TA_31051
aggcctgtctcagggcctctcctcgtctcacagcccgttgcgtgcgcccccttccctcgcggctgtcagcccgatgctccggaggcgtgcacccccttccctcgtggctgtcggcctggtgcttcggaggtccggtggcgcgtctctcgctggcctgccggccgacggagtggcccctggtggaagatccggggcggctgctcccatggccgcgccctacggtcgacggagtggcccctggtggcagatccagggcggctgcttcaatggctgcaccctcccgtgacttcccgcgcagcgcgcctcgccgctcctccccttccgccgccaccgacacagttgcccggtgtcggcgcgcgtccttgttctgcaggatccggctccaccctacccttcctctcctcgaccactggcagctccgacctctcgaggacaacggctcggcccggtcttttgttggtctggttgtggccccatggccatggcgcgtcgccaccgccggccttcgcgcagccgcgctggatcccgacttcatccccctcgccccgacgtccgccgcttccccgcctcccggagccctgccaccgtcgtcctgcatcatgtcacgatcggatcgggttttctcttcactcatcaagaattgtggccatcctctgcacccgagaccgctactcacatagcggcgctcttcagccatcgagaattgcgggttaaattagacag

SEQ ID NO: 31052 - DNA, 1145 bp, Triticum aestivum
  unsure (1)..(1145): unsure at all n locations
  Clone ID: PAT_TA_31052
agacgagatctgaagccgccgggcagcaggngctcccccaagtaccaggagaagatatgtttgcagcctgtgctcatctattaaagcttgataccagctttcatagatccggatggttttgaagtgatagctggcttgactttgcttttcttcaaagcatcttgacagaccaaaatccgtaatttttggcaccatgttttcgtctagcaatatatttgcaggttttaggtctaagtgaaaagtatcgatctctgtgaatatattgtaaaccttcacaaattcccttgattatttcatagcgctattttaaaataaatgatttgtattggaaaaaccaagttgtccaatatacatattcatgacttgaaaaagtaaaaaaatacagtcattgtatattgtgtttgacttagaaagaaagatgaaaaagttaaacaaaaagatgtgaaggcagatgaatgctttgcttatgcatgaattcatattgataaagcgctattgaatgatcaaggaatttgtgaggtttacattatctttgcaaaagttgtattgttcagttagacctagacatgcaagtatatttttaggcgaaaatatattgttaaaaattgcggatttttgtctctcaagttgcttggaggaaaaacaaagccaggctatcgcttcaaaacagtttggatctatgtatgaaaaaagggacattgatgaactgggttggatttactttgacttgcaaacttgtttgcatgttaacatcagctagtgtacatctttaggtactttgagctggtggaggaggtcaagtgtcatcagttgtccaagagaaatgttccaatgagctactaaatatttggaggaagcctttatagtttcttgcacaaagagtgtaatgtgttggacctcatcatgtattaagtattattttggaggatatactatgctctctgtgttgttatatcgggcatgcacattataaagtagagtgtggcgcaatatatagatcataattggtgttaaggggctgaattccatttagcttagtagtgggtgctatgatagctgagactgggatttatgctgggtctgaccatctgaattcaggtgtttggaaaaagttgcgtactggggatgttgtgtgctggtggcgg

SEQ ID NO: 31053 - DNA, 752 bp, Triticum aestivum
  Clone ID: PAT_TA_31053
tctggcacacaggcgtggtggttcatggcaaagagtacttcttcgggggaggcgtccagcaagaccggcctggaaggacgccatacgggactcctgcccgagtagagcattttggggtcacgcatgtcggcaaggaggactttgaagactttctgcacgagatcagcccgcgctacacaccagaaacctacaacctcctcagcaacaactgcaaccacttcagcaatgaggtggtcaagttcctcgttggttccacggttccgagctacatcctcgaccagcccaaggaggcaatgaagagcccgattggcgcgctgataatgccgatgattcaggggctggagacaaccatgaaagccggagctgctccacaacagcctccacaattcgtgcctgctcctgcagcgggggcgcagatgcagtcgagatcagtcaccgccgatgaaccaggtgctgacaagacggcggaccatgacagtggaatcatacctgctcccaaagaagcagggcaggtgcagccttccgcaagtagcactcaggatgaaattgccacggatgagacggtgagcaatgacggtgggatcatcccgcctgtggtggtgctacccactcccaagggagtggggcagacgcagccctccacgaacaacgatcagatagagtcaagatcagtcaccgccaatgaaaccggggctgatgaaatggtcaacagtgatggtgggatcatcccgcctccggcaaaaccagctgct

SEQ ID NO: 31054 - DNA, 681 bp, Triticum aestivum
  unsure (1)..(681): unsure at all n locations
  Clone ID: PAT_TA_31054
taccggtccggaattttcggtcgacccatcgtcaaacacttgacagacgcacgaattgccttaccatcgtcaacatccgcgaggcgaggatgatgctaatctcgtcacgtactgtacttgtctttgtgaaggttggcggctccatccctggaccagaggcacagcggccgaggaagatcagcgagaactctggccggcatctcgccaccgcggcggcgggatgcaggcacagacgcgccaccgcgggagatgccctggagatgttcgaggcgtgggcccaggccaccgactaagaggaggagagatcagatacggtgcgtcgctggtggctccggcggttggaccacgggcggcggcggcggcggcgatcacgagtcgaactcggattgcgtggtttctacgcggcggggcatcgggggtcgatctatatcagccgggctgcggggatagatcgcacttttcctttgatcgacgagcaaaccgtcccctagatagatcacgcgcgacgttctcctggcgagctaacaacccggcgagcttctctcgacggcggcgagcaaagaatccggcgagtttcctctttcttctccggtcatcatctgaatttcagcatcgcaattgttccgtttacttgtttcgcttgtgcaatcacttggtctctctgttctttgctnnnnnnnn

SEQ ID NO: 31055 - DNA, 655 bp, Triticum aestivum
  Clone ID: PAT_TA_31055
cgccgatgagatcggccgcaagattggcagacttgagggagacgccctgcgcttcgacatcgacctccacttgccgtcactgctggtatgtttggttttcagccatccacaggccctaatccgcgcgtgcaaagaggccgacgctgctgcaggagctctcgcggcaccaggaatgcgcaatttgccatttggacttggagactggtgacgaggagatcgtcaggctgccgtgcttccacgcccatgccttccataccccgtgcatcaaacagtggttctatcaacagtcaaagtgcccaatttgtcggcgtgaggtgccggattacttcggctttagattctgtgatgaaatatataccagatcccgccgaacaaatttatataaattctttagatgaagatggattaaatcagtactagtccatagatcttgcattcctatcaaagatgagctgaaagatttagatgaaggttctatcaaagacgagctgttaatagattacatagccgatcgatgacaattcatatattttatattctgtagctgaagatggattcacagtgagcatattagtctatagatcgaaaatgaacattcctgtgtaacatatgcgaaaatgagcaattgaattgtccttccgagggataacatggt

SEQ ID NO: 31056 - DNA, 1094 bp, Triticum aestivum
  unsure (1)..(1094): unsure at all n locations
  Clone ID: PAT_TA_31056
gcagaacagatgacaccggcggcgatccgaggcacgccggctatggcggtgcggcagccccgttcgtcggagcagcgtgcctggctcaaggccgcacgctcctccaccgaatggtgctagccgtgtcaacctcatggtgcgcagggagctagtccgtgccggcgacgcgcacgaggcgctcgacggcgaggcggggaggcgaccgccggcgcctgatctctggtagtcgatgacgacgacgtgcgcggcataggggccgcgcaacgttcgcgtccataaggcgtcgccgccggccatttctttccgcgcgtcgtcccgtgagacagcggcgtcgccggtgttgggaccccgaaggagagcaccggcacggcgtcattaggaatcagcaagagatagcccatggctccaccttggggtctccggcagtgaagacatgcccggngaagaagggcagcaccacctgggtgacgtagatggcagcaggcgcttgtggagatgcagcagctggtccaggagcctcgctggtggcagcaggaaaccgccggcactgccttcacggcggccgatggtggtcgatggtcttcacatacctcaccacacgtttaggatcgacagttggggggctttgatcgtggttctcttggtttgtttaccgtgagatcaattccaacacggtgaggttctggaggccgacctcctcctgcccgccgcaatccctggcccagctgaggccgaggccgagggcggcgccctcccagtcccacatgctgagggcggggatcttcctgccgcggctgaggtcgacctgcccccgcccgccgacgccgagggcggtgatcttcctccggtggagcgcctaccggtcaagctggtggacacctacatcgagatgaccggcgtccgcgcgcaggcgcaggttgtctaccaggggtggcagcaggcgcgcgcagacacgcaggatcctgtggcctggaagaccctcggggcaaagctcgggaaggttcagcgggatcaggagaggctgctcgaccgctacgacacgctggacgcgcttgcgcgtcgactccgcctcgagatcgccgcccgccgcggcc

SEQ ID NO: 31057 - DNA, 883 bp, Triticum aestivum
  Clone ID: PAT_TA_31057
ctatgtactacacctgatttgcaggagagcgagctaggccgagacgatgagctccccagcggcggccgtgaaggtgatcggcgcattggacagcccgttcagccaccgcgccgagatcgccctgcgcctgaaaggaatcccttacgagctcatcccagaagacctgagaaacaaaagcgagctgcttctggccaacaaccccgtccacaagaaagttcccgtgctcctccacggcgaccgcgccgtctgcgagtccctccttatcgtcgagtacgtcgacgaggccttccccggcccacccctcctccccgccgacccatatgagagggccatggcccgcttctgggccagcttcatcgacggcaagtgctcgaaggcgtactggctggcgctgtgggcggagggcgaggcgcaggaggggtttatgaaggagaccaaggagaacttcgcgctgctggaggcgcagctggaggggaggcggttcttcggcggcgacgccatcggtcttgtcgacatcgcggcatgcgggttagcgcactggctgggcgtcttcgaggaggtcgccgaggtgagactggccaccgaggacgagttccctcgcctctgccgctgggccaaggagtacgtgtccgacgagaaggtgagggcgtgcctgccggacaggccgcagctgctcgcccgcttcgctgccaacaaggggatgttcatggccatcgccaagtccatgctgccgcccaagtagctagccggtgtgtctatgtccatgcatggatgtgcacgtgggcgcgcatgggtgtgtgtgtctatgcccagccagcgatcgctgttgtgtcagcttgtgctgttttgctggacagaataaaaaagacgaacgtattggacg

SEQ ID NO: 31058 - DNA, 276 bp, Triticum aestivum
  Clone ID: PAT_TA_31058
accgtcaccgtgcccaaggccgaggtcaagaagcccgaggtgaaggccatcgagatctccggctgagtatcgggtcagagcctgtctggttcatgtgtgtgcgagctctgccacctaaaagtatgctatagttgtgtcttgttcttgctgatcgagtgtggcgaggcatctgtacttgtattgcgtttcttctccctgttgtgtctgtacttgtgtaatcgtcaaacagatttggcgatgaataaatgagaaataaacccttctgtttttaagtgc

SEQ ID NO: 31059 - DNA, 1238 bp, Triticum aestivum
  Clone ID: PAT_TA_31059
tggttagcgtcaaacaacgtgaccggcaagatcgtcctgtgctacgcaccaaggctggcgcccagcgtgctgcctcgagtagagctgtccctcaccatcaatcgtactgtgggtgccggagccaagggcctcatctttgcgcagtacaccacgaacctcctgccgatatgcaagggcggcatgccctgtattgtagtagactacgaaattgcacagagaattgaatcatacttggcgatcacagagagtccaatcgtgaaggtgtcacctgccatgaccgttgtcggagacggggtgttgtcgccaagggttgcttcattctcgtccagaggcccgagtcctctattcccaggcatactcaagcccgacataactgcaccaggcgtcggcatcttggcagctatgcgcggcttctatgtgttaatggatggtacatcaatggcatgcccacatgtctctgcagttaccgcacttcttaagtcggttcaccctgactggtcgcctgctatgatcaagtctgcaatcgtcaccacggcatcagcgaccgatcaattcggtgagccaatcgaagcggagtcggtgccgaggaaggtggctgatcccttcgacttcggtagtggccacatggatcctgacagagccgctaaccctggcttggtttacgatgtggatgcaagagagtacaagaagttttttaattgcacccttggatcgttccatggttgcgagtcctaccaactcaatctcaatctcccgtcgatcgctattccagacctcaaggaccacgtcacggttcaacgcactgtcacaaatgtgggggcagtcggaacaacttatcatgcggtacttgaagctccagcaggggtgatcatgtccgtggagccatctgtgatcacattcgccaaaggaggtagcacaagcatgacattcagagtgtcgttcgctacaaagcggagagtgcaaggtgggtttacctttgggagcttgacatggtcagatggaaatacgcactcggttagaattcccgtcgcagtaaggactgtgatacaagactttgttgcggatatatcttaaatacatcaactcaatagtgtgtcattgttcatgcactcatgtacttggcatcgaaaaatgtagggaacactaaaaatcattttcttacaatagtatgaaataaacatggtagtcctccatgattactgagatgtattgatccttttatatgtctatatactagc

SEQ ID NO: 31060 - DNA, 737 bp, Triticum aestivum
  unsure (1)..(737): unsure at all n locations
  Clone ID: PAT_TA_31060
cagtttcatcgtgtaccctctcgtactacgtacttgtctaccttcccggcgagatccagaccagagcaactcccgacactgacgaccgccgagcgaggacggacggcgaggcgcgccttccccgcacccgcagcgaccacggcgacggaggcgtagaagctcctctcctgtctcctctgcatacggttcgggctaacgccgacgaggaggaggcgattggcggttgaatctggtggaatggcgcgccggagtcagaccgcgatggagcagcacgcgctccggggtctcagcgccggcggggagggatcaaagtgcagatcctcttctagcgtcaggttcccagattccccgagttctctgatccagttcttgcttgcaacttcgctggccgccctacggtgttctcggatctggtttgcttgagatttccctggaggagatggacgaggacgagtactcgtgggtgcggcgcaccaacttctcgcactccatcgtcaagtctagctcccgaatgtgctccgtcgccgagcactaaatccgccgcgccgtgtcaatacagaaagattttgattcatagctcaagagcctgccccggacggccaaatcaaaccggtaaaacgcgtccaaggnaaatcgnggtngcaagaaacgaaccnaaattgtgtttaaatgtaacnaanaaatgggcgttggaggnataanaatcatatcaantgcaagttgccaggaangttatt

SEQ ID NO: 31061 - DNA, 1336 bp, Triticum aestivum
  Clone ID: PAT_TA_31061
ccaagagtacgggcgaaggagctccctcgctggtgcggacgacggtgcaggagctggcggcggccgtcgaggagccgccgcgggagtacgtggtgcacgagcgggacgcggacgagctgctggccgccgacgagatgccggaccccatccctctcatcgaccttggccggctcatggccgccgacgaggcccacaagctccgcgacgccgtcgagacctggggcctcttcctggtcaccaagcatggaattcaggagtctcttaccaacgacatgatggacgcgtcgatggacgtcttcatgaagccgtctgagggaaagctcaaatgtagcaacctgaaagatggcggcaagcacttggagttggaaggctatggcgaatgacaaagtgggaaccaccgagtatcaaggccacagcgggaacgaacgatggcatttgagagtggagccggaagctgcgtgtagagtgtggaggtagaagacccaaaagatttctctaagtggcaccctaatcgagcacgcatcaagaatgcattccatgagtgtgcttcattggcgaacacgatcaaagaaccagtgagtataagagacctcgtccttctagcgatttccaaacgactggaccttgatccagatgacttacaagaacccagtgtcaaccaggtacacctgctttcctccgtgccaccaaccccccctgtgtcctgaggcctgaacgcgtccctcgtgtggcgcgtcactctgatcctcgtctctttcccaccctgaccgccgtgcccggcgtgttgagattgctaggtgagggtgaaatgttccggcccaaccttatgcgttggtgatcaacttggctgaactgcttggcagataatgtgcaacggattcttaaaggaacccgcttgacagggtggtagacgaaggcggcgaaagcgaggatttcactggccctgttttatgcttgtgggtggaggaagcggtgctggtacccagcccctcggtttggcttggttgatgaggaggcccccggaggatatgggaaattcaaggccaaagagttctggctttctttcgacggaacataacatttcagccaaggcaagagattcatcgagaccctaaaaatacaagctcggcggtctgaattagtttatttacggatttgtagcggtgatttaatacctatggagtataaataaagagatggtctctcttctgtgagtggggattttatgtacgtataatataatcgcctttctttcttataagcaactcgcgacctgcccgggcggccgctcgaaccacttgccggttccgtgcaaaaaaaaaaaaaaaaaaaaaac

SEQ ID NO: 31062 - DNA, 935 bp, Triticum aestivum
  Clone ID: PAT_TA_31062
aacaacaacagcaccaacttccactcctgcaaacccgacccaacccaacccaacccaccaccgagcacaagaaaaggagagtcatcggcggcggcagaccatctacagagatagtgagatggggaggtcgccgtgctgcgagaaggcgcacaccaacaagggcgcctggaccaaggaggaggacgaccggctcaccgcctacatcaaggcgcacggcgagggctgctggcgctccctgcccaaggccgcggggttgctccgctgcggcaagagctgccgcctccgctggatcaactacctccgccccgacctcaagcgcggcaacttcagcgacgaggaggacgagctcatcatcaagctccacagcctcctgggcaacaaatggtctctgatagccgggagactgccggggaggacggacaacgagatcaagaactactggaacacgcacatcaggaggaagctcacgagccgggggatcgacccggtgacccaccgggcgatcaacagcgaccacgccgcgtccaacatcaccatatcgtttgaggcggcgcagagggacgacaagggcgccgtgttccggcgagacgccgagcccaccaaggtagcggcagcggcagcggcgatcacccacgtcgaccaccatcaccgtagcaacccccaccaccagatggagtggggccaggggaagccgctcaagtgcccggacctgaacctggacctctgcatcagccccccgtcccacgaggaccccatggtggacaccaagcccgtggtgaagagggagggcgtcgtcgccctctgcttcagctgcagcatggtcctcccttgaagcgtgagatgcagtgcagcagctttaacgggctccagatgcaacagctcgacttcagaagcatcgagatgaaatgagcagagcagagcacccccttctccct

SEQ ID NO: 31063 - DNA, 1417 bp, Triticum aestivum
  Clone ID: PAT_TA_31063
gcccccgcccacctgcgacctcgcccacggccgctgggtcttcgacaacgaatccctccccctctaccgggagaaagagtgcaacttcctcaccaagcagctcacctgcctcgccaacggccgcaacgacgatttatggcagtactggcaatggcagcccaacaactgctccctccccacgttcgacgccaggaggttcatggagaggatgagggggaagcggctcatgttcgtgggggactcgctcaacaggaaccagttttactcgctggtgtgcatggtgcagtccatcttgagcaaggggaggaagaaggtggtcaaacggggatcaaacaccatcttccacgccaaggagtaccgcgccacgctcgagttctactgggcgccattccttgtcgagtccaactctgacgacccaaatatccacagcatcgagcaccggatcatacggcccgagaggatcgagggacacgcccagtattggaggggtgtggactacctcatcttcgacacctacatctggtggatgaacaccgccgacatcaaagttcggaggccagattcaaggtcttggtccgagcacgacgaggtgccgaggatcgaggcatatggccgggtgctcaaaacgtggtcggactggctgaatgagaatatcgatccggcgcggacatccgtcttcttcatgacaatttctcctattcacatcagcccagataaatggggaaacccccacgggatcaaatgcgcgaaggagacgctcccggtgctcaactacacggagcccctggacctcaaccacgacatgcgcttgtacgacatggtggcgagcacggccaggtccatgaagaaagtgccggtcacgctcatcgacatcaccaggatgtcggactaccggaaggacgcccacacgtccgtctactccgtccggcggggctacctgctgaccccgaagcagaagaacgaccctgagaagtttgccgactgcatccactggtgccttcccggcgtgcccgacgtctggaacaccgtgctctacacgaggatcttctcgaaatcgcccccttcttcgccgccggctctcgccctcccgcctccccagtgagagagacgcagagctcctccataggaagtgtcttcttgttcaatcttttctttctttggtggtagtccgggtaaaggctagtagaggagaagaatgtggtgggctgtttactgatggcatgtaaaatcgttcaattgaactgtaaattagttttgacctaaccagttgagcaggcttcgttatactagtaaacagctgcacttgtgttgaatccatataagaggcgtcaaacaacaaactgtgtcgtatacaaagaaagattgtaactgcaaaaaaaaaaggtgtccattttttgctgcttctctctgcttctat

SEQ ID NO: 31064 - DNA, 1165 bp, Triticum aestivum
  Clone ID: PAT_TA_31064
ccacgcgtccgagtcccgtcgcggaacccaacgcgcgcgcaccctctctccccccgaatggagcggcagcctcggccgcagctggccgtggcggaggaggccatcgcgctctacgacacctactggttccaccgcctcgtcctcaacgcctactcccctcccgcgccccagccgccgccgccggcgcctgagcgcgagcagccggagcaggcgccggcggaggagagcaagagcgagctgcggcgggccccgtccgggctgcagcggcaccgcaggacgcggagcgacgaggccaaggccgccgcgttccacggccagctggagccgctcaagatccccaacggccaccgcgcgaggctcgagaccatcctgtccgggaaggacggcctggccgcgccggagccgctgcccgagcgccggaggccggaggcgcggcggcccggcgggaggaggcggaggagccgccgcgggcggagcctgtcggagctggagttcgaggaggtcaagggcctgcaggacctcggcttcaccttctccgagaccgacgtcgacgccgagctcgcgtccatcgtgccggggctcaggcggctgcgcgcggaggaagaagccagaagagccaaggcggcggaggcggcggcctgcgccgaggaggaagcctgtaggaacagggccgccgcggaggcctccgacgcggcgccgaggaggccgtacttgtcggaggcgtgggaggacgaggagacggaggtgaggcgggtgctgagcaacttcaggatcccggccgccgccgacggcgctgacctcaaggagaacctccggctctgggcgcacaccgtggcctccgccgtccggtgactgctttgaccaagagcccaccttttttcccttatgccgtgcagtgggtggaatgatgaactgtaaatattttttgccatgtgcatgcgcatcttttcaagatattctagcagcagcctgcgttagtttagtcacgacagtgtaaaatgtattcaacgttcaaattcacgaacatgtaactgaatataggctcttgcaagcaacaaagaggaaatgtgaacgagggggcgcagaaatttttgatccgattgacaggctgatctgatatcattgtttcggtgtcagtggcaagaaagcatttccggttggtttg

SEQ ID NO: 31065 - DNA, 1223 bp, Triticum aestivum
  Clone ID: PAT_TA_31065
cccccccccccccccacgcgtccggccaaacgaaccagcgccgcagcccgcagcgcacccatcccaccaaacaaacagctagcaggcgaggcgacccgctccgacctcgagccgatgccgacgccgtacagcgcggcggcgctgcagcagcaccagcgtctggtctcctcctccggcggcctggcggcgacgggggcccacaggtgcggcgagcacgacgggacggtgccgccggaggtggcgcggcaccacgagcacgcggcgccgggggggcgctgctgctgctcggcggtggtgcagcgcgtggcggcgccggcggcggacgtgtgggccgtggtccggcgcttcgaccagccgcaggcgtacaagagcttcgtgcgcagctgcgcgctgctggacggcgacggcggcgtgggcacgctgcgcgaggtgcgcgtggtgtcgggcctccccgcggcgtccagccgggagcggctggagatcctggacgacgagcggcacgtgctgagcttcagcgtggtgggcggcgagcaccggctccgcaactaccggtcggtgaccacggtgcacccggcgccgggggggagcgcgtcggcgacgctggtggtggagtcgtacgtggtggacgtgccccccgggaacacccccgaggacacccgcgtgttcgtggacaccatcgtcaagtgcaacctccagtccctcgcccgcaccgccgagaagctcgccggccgaggggcggcctacggcgcgctgccgtgatcgaatcgaatcagaatcgcaaccgcaaccgcaatcgccggcccgtgcctcccctccggtggtcaactcaagccccagcctcggccgcaggggcgtttcggtaaaatcgcgctccgatttcccgattaatgaatccaaatccatggtggtggtgcgcgggtggtggcggtcgattatttttctcttgttctttctggcgtgaaggcgaggggtcggtgggtcggttcggttcggtcggcgcgctttcgcagctggcccctcgctgtttctccttatcgcgagacaccccccttgtagtagtgctcctagctctagtcttcgttcgttccccttcgttgttctcggtaagatgataagatttgacaggaattgaggagtaaaaactagcttggaccgatgcaagactcatcaacatctctgtatatattctttcagtttctcgttgcaaaaaaaaaaaaaaaaaa

SEQ ID NO: 31066 - DNA, 554 bp, Triticum aestivum
  Clone ID: PAT_TA_31066
ggtcataggtgatcctctatccatccacaactgagcacagtaataaccagataaatgtatttgatggatgtaaccagtgattacatcttgagcatgctgttctgcatacaaagggcacacatgttctaccctcgctgcgtgggaactgcggtgcgccgtagctcgtgccgctccatgacccttctcatcgcgagggcagccgcatcaccagcctgcacagtccctgtcgccatgatggctgcaaactcctgctttatctcctcctgtgctcggctcttcgcccctccgagggggtctgaagctgctgccgctggcagagtcaccttggccaccgtcgctgctggagcagcaggttgcacggctggcggggtgaccatcctagtgccctcgtccactgtctggagctcaatgctatttagggaggtctctgtctgcgtcgctgctgctggagcagctggttttgccggaggcgggatgatgccaccatcactgttgaccattttatcagcccccgttttatttgcggggactgatcttgactctatctgatcgtt

SEQ ID NO: 31067 - DNA, 969 bp, Triticum aestivum
  Clone ID: PAT_TA_31067
gaaaacaacaggttggtttcagttaagttcagttagccagcagctgtacacaaaacaaacaaacaaacaagcaaccagctgcaccaattgaatcatatcttcttctatatacgaataaacacaacaagaacaaacgaccaaaaaacttccggtgaacaacagccagggcgattcgttagccatctatatatcctacggtcgatcgagcccgccgatcggcctctacgtcaagtaccggcgccgagctactgctgccgccgtccggctctgcatatgtcaccatgccccattgtgttcctcggcgcttcaggcaccgccatgtccgacactcgtctgtgcaccggcaattcagcaggatgcagctcttctaccaccaccagttccgaagcctgacagcatgaccatcgatttgttattttttttacacggcgcggtgtatggaaacccctcaggcagctcggcgccgtgctgccccgttgcttagctcagggattggccgccactgctgctgtgctgctgagatgcacaggtagccgagactgcctcctcttgattcacaccacagtttccttgctccttctccggtatggtctgtgaacagatggccggccatccaatcctcaacgcctattattctcaattcaacaaggtgaggtatcatcatgtctgagcctgcctcggacctgctcggcatcaaaggatggggagtgcatcagctgaaagcctgccaccaaaatcgagccacggccatgcacactacagttccgatctgaatcaccagggtcagttttctttgcactgacataggcctgtgtccaattgtagcagcaaacacagaccatgcaagctacggaacactactgccactctctccggcgactcgagctttctcctcctcagcgcgaaggttgagctccttataagtattcgaggaagcagcagtgaaggtctccatcgcttcaaaaatac

SEQ ID NO: 31068 - DNA, 886 bp, Triticum aestivum
  Clone ID: PAT_TA_31068
ttttttttcttctaaaacagagtccagcaaaatatttattgtgatctataatgtaaagaaaaagaaaggtgtgtctcgtgtagtttgtttttatatacaacgaaaaattgatttacagagttgtgatctactccacataacacgttctgggaggaagagggcacacaatcacagcagcttcggcggcgggggccctgaaaaatccggtgggctatatgagagctttaggatccagttggcaagcctgttcttgttttgctcctgagctgcttcctggcagctggtcttctcaatggttccatctctatcaagagtcgccttgagattttcaagggttttaactatctgagtaaactcaggcctcttctcgggttgagcggaccagcattgctccatcaattgttgcaatggtgtcgggcagctcgaaggaacaactggtctcaagttcttattaacaactgcataagctgcttggagaggagtcatctcttcataagggatggaacccactaaccagttcccacaagacgagcccaaaactatagacatcgactttcggaccatatggcttgcgcttacacatctctggcgccatccatctatatgtgcctgggtcgtcttccatcgtgttgcagtaaacgtcttcaaaagctactccgaaatcaacgacctttgcgcaacattctgcgtcgaatagaatgttctcaggcttcacgtcacggtggattactccttgcgaatgcacgtattccagaccacgtgcaatgtccagggcaacggagataatcttctccaaaggaagttgcttgccctccagcttgcgcagataggctctcaaagagcccccaggcaggaactcagtgatgacacagaagacaggtgcaga

SEQ ID NO: 31069 - DNA, 654 bp, Triticum aestivum
  Clone ID: PAT_TA_31069
gcggagactgcgagacgaaaggcgagttctccctgtttccaccggcgagaccaacggtcctcctcatctccgatggccatcttggtcagtggaggtggggcgggcctcgggcactcgttggttgggtaggttatatcccccttttgggagttgtaatgtccgggaggcgaggtttgggcggcgaagacctcgtcgtcatggaataaggtcctcccaggcccttcctcgtcatggcagtgttctctcccactatgcttttgggcgtgtggaggtcgtcctctccggatctagccatgtggatctggatgggtgctgtacaggagaatcccttcgtccgtggcttcggcttcctttgacagcggtgatggctgagcctgaaaaaataaatttgtccgagctttcaagtccagatgcgccaaggttcgacggttgctgctcctactttcgttaggcttgaagttggagttcctccttttctccggtccttcgatggtggatctgcagggagctttgtttggggcgtggccccagccggtggactttcactgatggttttgccctgccttcagaggcgggcttctactgcggcatctgtagccatgtttggcgagttggtgttcccgcagctggggaagctgtctacagtgcttttct

SEQ ID NO: 31070 - DNA, 532 bp, Triticum aestivum
  unsure (1)..(532): unsure at all n locations
  Clone ID: PAT_TA_31070
cagcaccacagcctcttccgtttctctcctctcgtcgtattcttctaacacgcccacgatggcagccgctcgccgggacctccgtcgccggtctggcctcgtgctcgccggagtcctgcacttcagacgtcaagattccacggccagtcctgccgtttcttggccggatctcacctgttaggcatcatcccgatgcatggtgctgtctgttcgccggacggggcacgccggcgggtcttgcggcagtggctggcgcctcccagcggcggccagccgttcctgcggcaagacaagatgaggctgaccagacggggcggcgtgcacccagcaggaacagagccgtgcagctcgcggcgtcggcggtgccgatccgaggtgtcctgccggcgtgcgcccagcgggaactgacggatctggttgcagctcgcggcgtcggcggtgcagatccggcgtgcaacaggcggagctcgcggagtcggcggtgcaaatccgacgtggccggcgggaagcgctgccggncgggtcggtccgg

SEQ ID NO: 31071 - DNA, 616 bp, Triticum aestivum
  unsure (1)..(616): unsure at all n locations
  Clone ID: PAT_TA_31071
ctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtgggttgacattgttgacaccttccgtcttcaaggagcaacctgcttttgacaagaagcatttatctctcacatgaagcgctacatcaagaactctctgccaanttntaaggggatgactagatttttcaagaagaatgttgatccgccacaaatacctcttaacaactcaangacttnattctttgttgcaanacatcatgatgatgcggctggtgttcncctactacaaggnggacgcnatcaacttcnngtacttncananggctaaaagnnaatgtaacccacgttccaaaatctatggggcctatatttgccgcccaaggttncancnccccatgtnt

SEQ ID NO: 31072 - DNA, 1139 bp, Triticum aestivum
  unsure (1)..(1139): unsure at all n locations
  Clone ID: PAT_TA_31072
cgtccgcccacgcgtccggtgaagtgcgacttccttttgaggaaaatggatcctcaaaaatcggagtcagttttgacaaaccaattcctgggggcattgatctaggaggcaattgtgaggttgatcatggtttcttctgttcagttgattctctcgtcctcgatggtccaggatgggaagacagagctaaacatccatttgatgtaatatttgagtttgtttctgaagaaagtgcgcatggaccccttatcctatttttgaaggacgttgagaaagtgtgtggaaacacttactcttatcatggtctaaagagcaagctcgaaatttttccagcaggtgtttttgttattgggtctcagacccaggcagacagtcggaaagataagctaaacgggtctcctttcctgtcgaagttcccatacgggcaagcagcaatacttgaccttgcgttccaggatagctttgctttactggggaatagtgacaatacagcagccacaggatgacttggaactcccaaagtggaaacagaatttcaatatatgatcaatagctgtttcgactttgagagttccaagtggaaacagctattggatcgtgatattgaaattctgaaagtgaaggctaacatttcaaaagtccagtcttttctaactcgcaatggtctggaatgtgctgatgtacagaccacagtatgtgttaaagatcgaactcttacaaatgaatgtggcgataaaatagttggttatgctttgagtcatcaagttatgaattctactgttccaactcctggaaaggatgtgttacttgctctttctggtgaaagccttcancatggggttgatttgtcggaaaggatgcaaaatgaccataagaaaaagagcacaaagaaatcactcaaggatgttgccacggagaatgaatttgaaaagaggcttcttagtgatgttatccctccagatgagataggtgtttcctttgatgacattggagcactagagaatgtcaaggaaactttgaaggaattagtgatgcttccattgcaaaggccanagttgttctccaagggacaacttatgaagccatgtaaggaatattgcttttttgtccacctggtacggggaagaccatgcttgcta

SEQ ID NO: 31073 - DNA, 2795 bp, Triticum aestivum
  unsure (1)..(2795): unsure at all n locations
  Clone ID: PAT_TA_31073
gcgaccctcgcggccgtgtgtgctgcgccctttgctttggccagtggcggccccccagcggctcctcatgatgccgtgttaggcagcagtgcttgttggtccaccggggaccgggaccacctcgcttccgaaggctgtggcccctgtgcccggcgctaacttcttcaacatgtcctggtcaagcctgggctcggtgcgggtgggcgagcggggtcatttggtggttgccctgttttcccgtgcgagcatacctgctccccgcgcctgtctcctgcacgtggttgtcggcatgctgggtagacgtgaaaacccaggggaacatgaagccatgcgtaagatgaaaaatgaatttatggtgaactgggatggtctgagaacaaaagacaaagaacgtgtattagtacttgctgccactaataggccgtttgatcttgatgaggctgttattaggaggctcccaaggaggttgatggtgaatttaccagacgcaaccaataggaaaataattattagtgtaatactagccaaagaagatttggcagaagatgtagatctggaagcagtggccagcttgactgaggggtattcaggcagtgatctgaagaatctgtgtattactgctgcacatcgtcccataagggaactccttgaaaaagagaagaaggagagatccttagcagaagcagaaaacaaatcattgcctcctaagtattctagcagtgatgtccgtcccctaaatatgagtgatctcaaacaggcacacgagcaggtatgtgcaagtatatcatctgattcgacaaatatgaacgagcttgttcagtggaacgagctttacggcgaaggcggatctagaaagaagacgcctctaagctacttcatgtagcttatgtgtagcctgtacatagagcagaagcattagagtgaagcgactgagaagatagataatgaatagctctgttggttcttcatttataggcaatttttttgagtcaattgttttgtaatgtcagttgggagttccgacagatagcgtaggacctggttggtcaaccatcctccgaccgagccgcttggcactctgcgcttccccattcaggtcacgggtcctccgccccagggtgactccgttctcgccttgtggacacatccagtgcaccgtgctttggagatgctgcttatggtggattacattgcattagtccactcttttctaactcgcaatggtctggaagtgctgatgtagagaccacagtatgtgttaaagatcgaactcttacaaatgaatgtgtcgataaaatagttggttatgctttgagtcatcaagttatgaattcaactgttccaactcctggaaaggatgtgttacttgctctttctggtgaaagccttcagcatggggttgatttgtcggaaaggatgcaaaatgaccataagaaaaagagcacaaagaaatcactcaaggatgttgccacggagaatgaatttgaaaagaggcttcttggtgatgttatccctccagatgagataggtgtttcctttgatgacattggagcgctagagaatgtcaaggaaactttgaaggaattagtgatgcttccattgcaaaggccagagttgttctccaagggacaacttatgaagccatgtaaaggaatattgctttttggtccacctggtacggggaagaccatgcttgctaaagctgttgcaacagaggctggtgctaacttcatcaacatatcaatgtcaagcattggctcgaagtggtttggcgagcccacgcgtccggtgaaagctgtgttttcacttgcaagcaaaattgctcccagtgtcatttttgtggatgaggttgacggcatgctgggtagacgtgaaaacccaggggaacatgaagccatgcgtaaaatgaaaaatgaatttatggtgaactgggatggtctgagaacaaaagacaaagaacgtgtattagtacttgctgccactaataggccgtttgatcttgatgaggctgtcattaggaggctcccaaggaggttgatggtgaatttaccagacgcaaccaataggaaaaagattattagtgtaatactagccaaagaagatttggcagaagatgtagatctggaagcagtggctagcttgactgaggggtattcaggcagtgatctgaagaatctgtgtattactgctgcacatagtcccataagggaaatccttgaaaaagagaagaaggagagatccttggcagaagcagaaaacaaaccattgcctcccaagtattctagcagtgatgtccgtcccctaaatatgagtgatctcaaacaggcacacgagcaggtgtgtgcaagtatatcatctgattcgacaaatatgaacgagcttgttcagtggaacgagctttatggtgaaggcggatctagaaagaagacacctctaagctacttcatgtagcttatttgtagcctgtacatagagcagaagcattagagtgaagcgactgagaagatagataatgaatagctctgttggttcttcatttataggcaatttttttgagtcaattgttttgtaatgccagttcggagtttcgttaattgatgttccagccagtgtgaacccatttaggtcttgtatacagtgcatggtgcttggaagaggtgcatatagtagaataatctgagtttttctcaagcactagtgcttgtctctgtaaagggtgccgtacttagcccctacgcttttcaactagtcaccctgcagtgcacatcccctanaagggtgctaaaaaaaaaaaa

SEQ ID NO: 31074 - DNA, 929 bp, Triticum aestivum
  unsure (1)..(929): unsure at all n locations
  Clone ID: PAT_TA_31074
ccacgcgtccgctcctacgccccgcccgtttgactccctccatctccttccgttcccctctcccttccctttcctttcctttccttcccttcgtctcctaggtttagcgccccacgcgaaccccaccgtaccaacccaccagcgggcgtccctcccgcagcggttgctctgtcggcttcctgctgcccccgctcccttcatggtggccgcccaatcgtgaggctgcgctcaacgatcagaagatgaggcgctctgccgctgtgctgagggtcgctgtggtgggcctgttggtgctcggcctcgccctccctccgctggccgcggcgctgcggcctctcagggagcgcgtcgcgtccgccggagccgcggcctcctccggatcgtgggccgatgagcatgcattctacaagagggatgataatgacatgagcccatattcatggaatattacaggaacatataaaggaagttggagctttgctggtgctacaaatggttcttctaggtttcttgagttcatgacatctaaaggcgactcggttttggaattactgagtacaccaacaaagataagcggggtacactatgttcagggaacaataacattccatgatgttattgacaaatctcatgatcgtggggctgctcaaataaggttagaaggcgtgtatatatggccttttagacaacttcgtatggtggcaaacagcggtgcagatggtgaaccgcttcaagaagaggattacttcttgtcaaatccataccatctgctgcggattttctcctctcaagttttccaagattcttctgangagaagaaccgaagaagaactctctcacacatgacatggagaaacactgtaacataaaaatagccgctaaagtggtccgggtgtcatctaaccaaaatgagggagagcatgagaagt

SEQ ID NO: 31075 - DNA, 548 bp, Triticum aestivum
  Clone ID: PAT_TA_31075
ccccgtcccgcccgtacgttgcgcagagtgctgccattgctgcggcggcattgctgggatattcagaaccatcgacatagcagcaatgaaacatcatcgggaatggagcgtgagctggatcatgatgatggtcatgtgcctgccgtccccgggcggcggcgcttgtggcgaggtgagcgacgacgtcagctgcgcgaggtgcccgaagatggagagcgtcgtccgggggcgcgcggccgccgggcgggaggcggagctgcggatgggcgcccgactgctacggccgcacctccacgactgctccgttaacacgtgtgctgggtccatgggcgtggacggggtggatacttctgggcgggccccaacttcgaacaagctgggggggcccaaggctcaactccgctgaaggggggacgacctcatcgacgccaccgggggccgcgctccgcgcgccggggccgtcgcgctcgcctccaaaccctactattgagtccccggagacgcccgcctcaacgttcccgtcggtttttggacgggtccgtttggaa

SEQ ID NO: 31076 - DNA, 1056 bp, Triticum aestivum
  Clone ID: PAT_TA_31076
ttcgggacgacgctagagatactcccataattgcctgcccaatcagcctgccaattctcgtttgttataatctggtcgttttgtttaggcgtgataatccttctatttttatattcattcagatctaacctagtaatggagtagtaacgtaaatctccttggcgtgccgagagccgatcagcccacacgcatctgccttccttcccggctagcagctatatatcgaccgaccaatcgatcgtgttcaagacctcgcaacctctgctccctggttccgttcgtttggttccaaacttccaattcagcccaaagggcagagggcagggcgatgaagtacagcaaggaggccaagcccgagagggcgggcggcggcggcggcggcgccagggccgtgccggtggcgctcatgctcctcctcctctgcggcttctccttctacctcggcggcatgtacagcaccggccgcaccttcaccttctcctccaccaccaccagcatcatccccatcgtctccacggcgaagcaggagggctccgcgatcgcgctcgccattgccaggaacggcaacggcgacgacgaggtcgagttttcagagtgccccgctgattaccaggactacaccccctgcaccgaccccaagcgctggaggaggtacgggaactaccggctcagcttcatggagcggcactgcccgccgccgccggagcgcgccgtctgcctggtgcccccgccgcggggctacaagccgcccatccgctggcccaagagcaaggaccagtgctggtaccgcatcgtgccctacgactggatcaacagccagaagtccaaccagcactggctccgcaaggacggcgaccgcttcaccttccccggcggcggcaccatgttccccaacggcgtcggcgcgtacgtcgacctcatggccgacctgatccccggcatgaaggacggcagcgtgcgcaccgcgctcgacacgggctgcggcgtcgccagctggggcggcgacctgctggcccgcaacatcctgaccgtgtcgctggcgcccagggacaacca

SEQ ID NO: 31077 - DNA, 670 bp, Triticum aestivum
  unsure (1)..(670): unsure at all n locations
  Clone ID: PAT_TA_31077
gcacgaggacaaccaacaccaccgcttacctggaatcaatctacccaagctagctagctgatctgatcgagatggagcggcgaggaggagcggcggcgccgtcgctggagctgccggggttccggttccaccccacggaggaggagctgctcgagttctacctcaagcaccacgtcaccagaaacagcaagcagcagcacctcagggcggcgccgttcgacatcatccccacggtgcacctgtaccggcacgacccctgggacctcccggggctcgccgccatcgccagcgagcgcgagtggtacttcttcgtgccccgcgacggcgcccggaagcacgcgtccggcgttgccgggggcgggcgccccagccgcaccacggagcgcgggttctggaaggccacggggtccgaccgcgccgtccgctgcgccgccgagcccaagcgcctcgtcgggctcaagaagacgctcctctactaccacggccgcgcgccccggggcaccaagacggacggggtcataaccgcgccccgcccgcccccgcgccggggcgcccgagccgccgggctcccaagcgtcgcgcgccgctccgtgtgccgcacaangtccatgaggagtcccccgcgtctcccgcaaaagctcaatcatcatcaagaagctgtcccagtttc

SEQ ID NO: 31078 - DNA, 571 bp, Triticum aestivum
  unsure (1)..(571): unsure at all n locations
  Clone ID: PAT_TA_31078
cactgggcatggcgactctcggctcaccaccatggagcctgctctgcgtcttcggggcgctgctgaccgcgctgtggtgcgccgggcgggcgctggccggcgcctggctcggcccgcggagggtggcccgggccctgcggtcccagggcgtccgcggcacgcgctaccgcttcccctccggcgacatgaaggagtacgtgcggctcctcgcggcggcgtgctcccagcccatgccgctctcctcgcacgccgtcgccgcccgcgcggtgccgttcgaccatgccatcatcaagcaacacggcaaagtggctctgacatggttcggcccggagccgagggtggtggtgagcgaccctcagctgttccgggagatcctgtcgaacaagcagggccggttcgggaagcaaaggctatccttcggatcgaacggtcgttgcaacgccggctgacacacgcacaatgggtccccaccggagcccataacaccctcatctcccacgctatgagatttacggcttccaggggtcagtaactgtcttgtgggagattccancgaacttttgcgaagatg

SEQ ID NO: 31079 - DNA, 963 bp, Triticum aestivum
  Clone ID: PAT_TA_31079
gattcctgcacccatccatcccttcccacccgccaccatttccaccatccccccatcactcgacccggccctgtactactactaccccctcctcctctgttccctcgccctgatagtacactttgatctccaaggcccagcccacagatatatacgctttcggaaagtgggggttggtttcgctttgagctttttatccggggcagccaggcagccaggcagccgccgggccgggacttccgctctgttacgcgtccagaggctagatagctccgtccgtccgtgtccgattccgccggggccgggcgtggatacctaggctaggctaggcgaggcgccgccgatgtcggactgcagcaccggcacggactcgccgcgggccgactccgtcgacgagcagccgcccgccgacgccgagtcgcccggcgttggccagagcaagcgcgaccacccctcgccgtcgtccccgctgccgccgcccaagcgcagccggagatctgtggagaagagggtggtgtcggtgccgattgccgagtgcggcgagcgggccaagaccaacggcgagggcccgccgccgccggactcgtgggcgtggcgcaagtacggccagaagcccatcaagggatccccctacccgcgggggtactaccgctgcagcagctccaaggggtgcccggcgaggaagcaggtggagcgcagccgcgccgaccccaccgtgctgctcgtcacctactcctacgatcacaaccacccgtggccggcgcccaagaccggctgccaccccaccaagtcctccccgcgcctggtggagcccaagcccgagcccggcacgccggtggagtgccagcccgagcacggacccgaggcgccggagcacgggcctgaggcgccggagcaagagcaggaggaggagcatgagcagaagcctgtcatcggcctgggcgaccccgcggcgatcacgac

SEQ ID NO: 31080 - DNA, 827 bp, Triticum aestivum
  Clone ID: PAT_TA_31080
tccgccgcccaaatcgagcacctccaccagccactccaggtttccagccaagccatccgccgtcgcaaaatcgagccatcttctcccctcctccgccgctgcagccgaacccgatcgacggagatgtggaaacaccaccgggtcttaggatccgtggccgccctgctcctgctactcgccctcgtcctaccgtctattcagacgcagaagcagagcgcacgagagaaggctgccatggcggcggaacccgcgcggcggttggcgggaggcatcgtggactcgctggggcgggagaacgacccctacatcgtcgacctcgcccgcttcgccgtctccgagcacaacaaggagggcaatacccagctggagttggagaaagtggtgaaggtcaaggagcaagctgttgccggcaggctctactacatcacaatccaggtcgatgaaggcggggcaaagaagctgtatgaagccaaggtgttggagcagctgtggctggatgtcaagaagctcgtcgagttcaagcccgcagagggcgcctctcccaacgtttaaggctcgtcagtcccaactgtgcaaggatctggagatatggtgtggatctagctatcatccatggaacctgtctttagcgtgctctcttgtgtaatagtatcaagaacaagtctgcttcttgcgagttgttttaacctgcccattatatatcttgtcgttcgagtttcaaaaaaaaaaaaaaatatgcggttaatttatcttggcctgatggcctctctagttctgactaagctccatatggctagtgatcagaacagaattctggccaaagcaaa

SEQ ID NO: 31081 - DNA, 452 bp, Triticum aestivum
  Clone ID: PAT_TA_31081
cgtccgcccacgcgtccgcccacgcgtccgggcagatgaaacaatgtagtgtatgtgtgtctcaccgggagtagaaagcaaagctagtgtctccacggtgagttgtgtgtgtgtgttcctccgtgtgtgtgcgttttattctcttgatagatagagagagaaggagagttgtgtgaggcagctcaaggtagaagaagaagtggcgctgcgaggtgaggcggcgcgaacaattggtatcagagccttgttgatccgtggcggcgacggtggtgctggcggctatggtggctggcgtggcggtggcgccgactacgcggcggactccatgtgaggtggaggacgtcggcacgaggtgggtggccgtcggcggtgcgatgctgccggtggcccgttgcggtgtgatgccgctagatgatggcggtgcgaagctgccacaagacgactgtgtgacg

SEQ ID NO: 31082 - DNA, 529 bp, Triticum aestivum
  Clone ID: PAT_TA_31082
cgtccgcccacgcgtccgaaaatatgtagcttgtgtgttcgccaaggagaagagcctatggcaaagctttcgtgctcctccttggtccatgcgtgcgtgtgtgtgtgtgttcatgagagagttcttgagagaaaacacaagagaattgtgtgagagggagaagagagttgtgagaggcaactcgaggtagaagaaggagcggcgctgcgaggaggcggcgccaacaattggcatcagagccttgtcgatccgaggcgacgacggcagcgcggcctactccatgtgaggtggaggacggcggcgcaaggtggaggctgtcagtggcgtgatgccgctggtggccggttgcggtgcgatgccgcaagatgttgacggcgtggcgatcggcgccgccatccacgtcaagagatggttgctgcatgtggcaggaggtcgtggtacttggcgccgcgagggcgtcgtccacggcaagacggcatggtgattggcgcgcggaggcgtcatcgatgacaagatggtccatggtgac

SEQ ID NO: 31083 - DNA, 1177 bp, Triticum aestivum
  Clone ID: PAT_TA_31083
cgtccgggcagatgaaacaatgtagtgtatgtgtgtctcaccgggagtagaaagcaaagctagtgtctcgcacggtgagttgtgtgtgtgtgttcctccgtgtgtgtgcgttttattctcttgatagatagagagagaaagagagttttgtgatgcaactcacggtagaagaagaagtgttgctgcgaggtgaggcggcgcgaacaattggtatcaaagccttgttgatccgtggcggcgacggtggtgctggtcgctatggtggctggcgtggcggtggcgcctagcaacaatgatgtgtggtgatcgcgtcgcgaggacgtcatccatgataagatgatccatggtgaccggcgctgcgatggcgtcggtcggtgagtggccggctgtggcgctgcgacggcgtcgacaagtggctgcgggtgatccgtatgatgattgtgatatcaagattaggagggtgaatgttagagctaatcttgatatttgtattagcatgtttgagttttgcatgtagtctagtctagtgtggtgttcgtccgacgaaggcttcaggtgagcgcgccaaggaggtgagatgccaggatgccgtgtgaggcggcgagcacggcgagatgccgatggtgctgcgtgagaagcggcaagacgtatcagaggctggagccgtgatggactgcatcaaattgggtcgggtgaaccggccggtcgttctgtttgttggactagctgttcatgcgtgagttcgtttagtcctagccgagagtatcgttgctagtagttgatgcatgcatgtagttggcctggtcacaagtggttaccgagtcgtgtgcaacgctggagtgattccaggagtggagtacgtgggagttagtggcccatatgggtgctcaagttgttatcctgtactggctatttaagcacaacaaataatagaaagatgaggccaagagggctgagcagaggaggcaactcgacgtagaagaaggagcggcgctgcgaggaggcggcgccaacaattggcatcagagccttgtcgatccgcggaagcgatggcagcgacgacgacgcggcggactccatgttaagtggaagacgtcggcacgatgtgggtggccgtcggcggcgcgatgctaccggtggccggttgcggtgtgatgccgctagattatggcggtgc

SEQ ID NO: 31084 - DNA, 1869 bp, Triticum aestivum
  Clone ID: PAT_TA_31084
gctagccaccagaaaatttgtcgcttgtgtggtggcccaggcagaggcgcaagtggtagctcttgtgttcgccaaggtggcagacgcttttgggtatgcagcggctgtcttcacattggtgtatgggtgtgtgtggaagagtggagtttagggatgagcgagttgtgagagggagcgagagggagaaggagcggcggagatgggggggggagaggccgccacggagcgagaaagcgagggccggcacgggggggtagcgcgaccatgtggactcgggggccacctggagggggggcgacggcggcagggaggcgttggtcttgtcgtgggggggcggttgggtcgagatgttccgttgtgatgccatgtggtcgtgagaagacgatggcgagacaaagccaggagaggagagaggaggttgtgatcagggtacggcgccgtgtcgagagatggacggcgcgtggggcccggccgcgggggggtcctcgccatgaagtgaggggtctgcgctgcaccgcatggtgatgggagtagcgaggctgtcagggtggaccacgtgctctgtgggcggcgcgggggcgttgatgcttttgtggcgtgacgctgccaatgggttggtggcatgcgtgccgtggggggttgtacgtgaccttcacatgcgccgtttggtgctccgcgacgatgttacggtgagtccagcgtgatcctcttccggtgtctactcatgcctgtggtgagatgtttgtgactggcacgccagtttaggtgggtaatgttaagctagcttgatatttgtattagcatgtttggggtttgcttgtagtctagtctagtgtggtgttcgtccgacgaaggcttcagaggcagcaccaaggtagaagaagaagcggcgctgcgaggtgaggcggcgccaacaattggcatcagagccttgtcgatccgaggcgacgacggcagcgcggcctactccatgtgaggtggaggacggcggcgcaaggtggaggctgtcggtggcgtgatgccgctggtggccggttgcggtgcgatgccgcaagatgttgacggcgtggcgatcggcgccgccatccacgtcaagagatggttgctgcatgtggcaggaggtcgtggtacttggcgccgcgagggcgtcgtccacggcaagacggcatggtgattggcgtcgcgaggacgtcatcgatgacaagatggtccatggtgaccggcgctgcgacggcgtcggtggcggcgagtggccggctgcagcgccgcgatggcgtcgccaagtggcagcgggtgaagcggcgtgaagattgaagaatcaagattaagggggaaaatgttagctctaatcttgatttgtatctgcatacttagttttttttgtcatgcatgtgcttagatggcctagggagtgataggcaggtgaaggttcactttgagtcgtagaaaggcgagatgccgaactggtcgtgcgacgcggccggtgtgcaaggtgtgatgccatggggctgtgcgatgcagcaacttcgtgtgaagcgacatggtacgagggaagtgcagcgtgacaacctgtgtgaaagagccctggagccaacgtctacacatgcgtgatccgagtgaacaggttgagtcagtttgcatgcatgtgagtttgttagctgcatgtactgtgcatttgaggccaagtcatggctcctggagagattccaggattaagataaggtcagttagtacatggttagtgcatggagagtttagtggagtagtgggtctaggtattggcgtgagttttgcacggcaagagtgccagcccctgctgtataaatgtgttgctttgagtaatcaaaagaagaggccgtgagggctggg

SEQ ID NO: 31085 - DNA, 851 bp, Triticum aestivum
  Clone ID: PAT_TA_31085
taggggccttttttttttttttttggtttttttttttttttttttttggtcagaaaagtggtttcaaatacaatatttataccggccagtatacatggggaagattaaggtcgcatctgagctcgagctgagatataggcactttggctgggctacctactttttgtcaactatatattgtacaaaggattgttcctctaagctggtggtagagagcgcctgcaagttgggcactccatcttgatgtccatccagcgttgtaaacagcccgagtggaatatatgctcgcacggtgccaccatgtattcacttgttctttgggagagatcaattgcagtcatgcagattacacaatcaatgggctgatttgtgctatcctctaccttcctgtggtaacagtatttctcagggaggatctggcgaggaataaagcagcgagaaccaagatagtgctggagcagcagcacagctgcttggatacccatgaatgttgtcacagctatgcaccatttcttgtcgggctcaatgcgcatgaagttgctaggacaaccaaatatatatagcgggatggcgacccgggtagcagtcatgcctaaaatatactgggggtgcagcggttttcttgtatcccggatgacattcgtgacaatttgaggaatccaaaaggagtacatcaggaaaagaagcgggcgcaagaaattgtgcaactcatacatgagaaggattcctcccaaaagaatgccgtaaaagcggctgtaaagaacagaaagttcccgcctcattatttcccaaccttctccactgttcaatggcctacttgctttccatatagcaagaagatacctcatctc

SEQ ID NO: 31086 - DNA, 651 bp, Triticum aestivum
  Clone ID: PAT_TA_31086
ccggcaaacttaagattccgttgggcatttaactgaacttgcttgctcaagacttcaagtgcacatccattcagggagttagggcacgatggcagacttcgtgcggctgagctccaggattccattattgattatgcgcgctcctatcacgcagccctgataggtacataccactcacccgtcaaccgagacactggctgtcccactgggatgcaactgcagggttcagaggacgagccagcttattactcctagctggagaatcctagctagcttgaacccgaagaaagaaacggtagacaagtggagaggacaacgttccacaggaacgcacacagtacatcatcctcgaccatggtacacgtgcaaagcacgacatgactcttcaccggcccgcggcgtccccgggggcgcgccggctccgttgacggcgctgcatttcttgcggatctggccggcggagccggtgaggggggcgatgttgcccatccggaccatggcgtcgccgaagtcgcagaggaagcgctggctgttgtagctgtaggcctgcacgagggccctggtggcggcggcgccgtcggggctggagacgaggccctggtcggaggagaggaggcccttcttggccagcaggttcttgaagtagtggtt

SEQ ID NO: 31087 - DNA, 1244 bp, Triticum aestivum
  Clone ID: PAT_TA_31087
tttttttttttttttttttgttttaccggggggtgtttctgttctaggcgtctgtcgggtcggccaccgtctcatcagttccccaacttctgcagctggaagcttccctattcatacagaccaaccgaccccaaacgacaacgggaaaggaccccgagcgatccccccctccggctggatgggggcgcgcattgaactttggaaagcatgccgcgtcgagggggttttcttctttttgtccaggcttctttctttggaactttttactcggtgtgacattattttgaatcaggtcttcggcagagagcaggcttccgcgtgatcctgggcgctgccaagttcaggaaggcgtcactcacactagtatgagcacacgaacagaccgagcccgagcacagcgagcgtggatctagcttcttctccagcaaccagccagtaggctaattgagttgaggagcctccaaatcgaatgtccacaccataatacgggtgcatttgtctgcgagcccttccatttgactctagtccttgacaagccgctcaataaatcttgacgcttgcaagccacccctcccacctgaatggagtataatagaccctacggtagggctcttcctatctcttcggatcccaaagcatagtgctgttaaaagcaaatcccgaaaacccgatgggaaatcgacggagcatactgctcgtctggtttgtatgccatcccagtgacctgatcaccctcacaaagggggccttctcaaagccaatttatacttggtcccaacatgcgttgctactaggccgatgtaccaaagcgcctgagttacgtaggctcgtcgcctcgctgaactttggtgtttagcacggcatcggacaccttcacgatgacgtctcaatgcgcgctgtcgttctacccggttcagtccatcctctgccgcccgccgatgtcgatcatgagcaggacattcttagggcagatcctttctccgtacatcatcccacgcgggccctcccttgtacgtggtcgtgtcgccggcgatgccggatgagcgggggctgacgttcccaaaagaaaagaactccagccgcaagacaacagtcatcctctatacttctatcatcacttaactgacattacataaccaacaagcccgggtccgcggtccggtttccctcataaactggaccaaccttctatctattcaatgaatttagcagttcttctgctaacatcaaaaaacaatcacaac

SEQ ID NO: 31088 - DNA, 801 bp, Triticum aestivum
  unsure (1)..(801): unsure at all n locations
  Clone ID: PAT_TA_31088
cggncgcgtgggcggncgcgtggggtagcctctcggagtgtatatgtgctcaccctggggtggtgtgtgtggcggagttcgagctcgccggaaatacaaggggttgttcgtgcggccagagctgtttgtgcgccgggaaacctcgtgccctctctctctctcttgtttcttccttgtctccggtgatcgccgtggttcattgagtaggctaggcaccaacatctttgacctttcctctaaccagagagattattggagttgtcattttcaggacatatttggagctgccactgagaccacatgaactgcggtggagtgggctatgtcagagctattgaacaactctgaagcaatggttaaagcacaacaagaagtccgggaagtgctaggccaaggtcgacatgttatcaaaagtaccgaccttagtgagctccgatacatgtagatggtcatcaaggaggtgttaaggttgcatcctccggctccgctgctcgtcccagagagaggagagaggactgttaaatcatgggctataacatgcctaaaggaactaatatcttcgttaatatctttgtaatttctcgggatcccaaatattgggacaacccagaagagtacaagccggagagctttgagaacagcaacgtcgaatattatgggacacattttgaattcgaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaacaaaaaaaaaaagcggcccctcaaaagg

SEQ ID NO: 31089 - DNA, 1045 bp, Triticum aestivum
  Clone ID: PAT_TA_31089
gcacgagggtggtgtcgttagaaaacatacggaggggtagggcggctgcgtgagcccggcggggggtgggcgccattgaaaaattagggcgttcgtgcgcccgcggcggcgttcgtgcgccggtgcgtctgagcgtcgcttctaactcttggctcctcctaccacctttgtttgggcgagtgtgcggggcctgtggagcgggagcgctggcggcgcgcgccggcggagggagcgcctggcgtccggggcgtgcgtgctgggcctgtgggtcgggcggtgctgtgggcgtcagggcgtgtgccggcgtgggggggcgcggggcgcgtgctaggggcggtggcggagggcgcggaacgcttgggcggtgtcgcggcggctgcggggtgcgggcgggcggggggcggtgcgtgggcgccgtgccggcggccgggggccgcgccagtcgcccgccgggcggggcgggcgcgagccgggggggggacgggggcaccccgggcgggtggcgcgccgagcgagagcgggccgcgtggccgaccgccgccgggaccgtcgggggagccaggaccaggggcgcggcgtggctacgcgccgcgggccggcccgcacgttccagcgcggccgcggcgcacgccaacggcgtgttcccggcatcttgagagtccggtgagtcgccaactttttcacccgaaatttcttgtgtcttgtgtcttcttctacctctagccgagagtgagagagggctgcggttccaacaattggtatcatgagcttggtgtcttgggcgtgcttgccgtgccggaggcgtggcagcgatggcggcgctcgccggcggctgcgcgtaggagctccgggccgtgtgtcggcctatggaggtgggcggcgctgtggctgtcatggcgcgtggcggaggcggcgggcggtgacgtcgtacgtgcagcgaccgcggaggccgccgaggcgctgcgtggtggcgcggcggcgcatcacggcatggcggccatggaggccccagcggtgcatggcaataagacgcggctgcgagcct

SEQ ID NO: 31090 - DNA, 1061 bp, Triticum aestivum
  Clone ID: PAT_TA_31090
gaaatggtgagccgcagcaattttattaataccgagtctgaaaatgcagtttagagattcgacaaagaacaacatgcaacattcagaaattctactagaatcttgagcgtaccagaaacctagctaacagcttggccatattttcaaccaccacggccgagccaatatgcagggagtgctgctacataggaccgcaccattacgctgggcacgctcgtgcttaagccgcctgtagtactggggccgcagactccgagtcggactggctaactctgcagggcctcatgatgacagacctagtttgcctcggaatacttgaacccatacttcttaaaatactcccggaatccatacacgctctggtcatagttgaaaggtaggacttttgcggagtatttcgtgatgctcgggtccacgatctttcctgggttagcagcctgttctgggttgtaaaatacttcaagaaatgggtactcagtcttttgcctcgtgaggcaaaacccaggatactttgggcattccacccgaacaaactttatatgaggataaaatgtagcagcagcttcctccagtactttgtcaagatgttgtgtataagtgcacttaatagtaaaggccacaactacaggccgtccttcatgtaatagctgcacaaactgacgctctgatgtgaaccgtatgattcttgatggacctagatccttgggatatccagtgtagtacttggatgtggaccgaagctgggaaaccatcctatcgaaaaatgacgcctcggccatctccgaggcacacccagcgcgagtgggcgaggcgcagccgggaacacaggcttctgcagtggcggagctacaaacaaattgcttgggggccaagctgtggccgcgtggggtcgtgggttggtcgactccgactcgtcgtgctgctgtgtgctgcagcccccttggccggtgggcggagccgcggcggcctgcggctgcggcgtgacggggggcggcggcagctgagtcgccaggtgctgcgtctctgtgtggcgtgaggcgtgagctcccgggccatgggtt

SEQ ID NO: 31091 - DNA, 849 bp, Triticum aestivum
  Clone ID: PAT_TA_31091
cttccaaatgtggtagtttttttgttaaatactccccaaaatcagaacgtgatcaacagcatttcgccggcagactacacgacgtcaacgcatgcacccttctccactctttatttctatgaaattattgcccgatacatcgatcgatcaaatggaggcacaagaacgagcggcatctcaaatcgaccagcgcgcgcgcacaagtacaagcactactgaggccggatgcggcgcgcctcccaatctagaggcgtgcgcggcggatcctgtcgccgtcggtgacgacgtgggcgcgggtgatgtcccgcagcgacgggcacccgctgagcgccatggccagctccagctcgtcccgcagcatctgcagcaccttccgcacccccgcctcgccgtccaccgccagcgagtacagcaccggcctcccgatgaacactcccgcggctccgagtgccagcgccttgaacacgtcggtgccgcgccggacgccgccgtccaggaacaccggcagccgccccttcgcctctctgaccacctcttccaggcagctgatggttgcagggacgtagtccagctgccgagcgccatggttggacacgatgatgccggccgcgccgtactcgatggcaatcctagtgtcttctgcagtcatgacccctttcaccaagatcggcaatgaggtaattgtctgcaaccacttgacgtcctcccaacaaagagattggtcgacctggctagcaacgtaggaagccagcccggaatcatctgtcttgtccatcttgccgaggtccagcgccgcaaagttctccagcaccaggtgtggaggcaagatgaacctgttcttgatatcgg

SEQ ID NO: 31092 - DNA, 1018 bp, Triticum aestivum
  Clone ID: PAT_TA_31092
ttttgcggccgcccgggcaggtgaaaaattatatttttgagatgtttgaatgtcgccttcgatgagaaaggagcatgtcaccttcggagtaaccttcaggatcaaaaataatatatacatgtctcccatgttaaccaccttattccctgtctaatctcaatttccccctctgtccggagttcgttcgttaattagtagcacatgccaacccttatgacttccgttgaccatgatctgtgaaccctgagggggtcgttggcccgtgtccggagcacggcgattgcctgcatgcccgtgagagagcagagcttcagtgctcctagaatctcgctggtgctcatcgttggctccgggcttccggacttcggcctaacacacacccgcggcccccagccaaacgggaaagaacgccggcgatttcttgggatgcgccggcgatgccatctgctgacctctcccgctccaatcacccgaccccttctcccaacacatctgggtgatgttgaatgcacccgctgggccccccgcataccccgccggctgaaatccatcgacctctcctccccacccccctggatcatggtggatgcacacaattggcagcgcaaatgtaacgccggctggatatgtgacgcctcccagctctgtctctttatacgcctcccggctaagtagcagaatcggtgggtacagcctaagaacctcatgcaatatcattgtcacgactttcagccggtttatgccctcggaatccggctggttctgtccgaagacacgcagaacctcctccctggcgcggtcctgccactcgggatgcatgcttagcaggaccattgcccatgtgagcagcactgcggttgtctccatgcccgcgaaatagaagagcttcagctcccctactatgtcgtcggtggtcatcgtcggcttggagcttccggcttcttggctttcttctatgtttgactccatcatcacgcctagtagatcgtcgttgtcggacatggccatccatcatcgc

SEQ ID NO: 31093 - DNA, 457 bp, Triticum aestivum
  Clone ID: PAT_TA_31093
atcagagcaagcaactaacagacaggcccatgaatttaggtggcatcacacataagacagataacagaatacctcataatcaaaatctcaaacacagctaaatttcgcacaatattgcagaagtctgggaccaagatacattgctgatcgaaatctcaataggccggccaccaaagtgatctaagaagcagcagcctcattaagcttcgctagctccttcactgatagctcctcctctcttgatattggcaaagcatgaccttgaacctgtgaaagtcatcgaggatctccctcttggtatgaaggggtcaagaaatctgataattccgaaccgcaccggcagcacactgatggatgctcgatgtggcacgtatggcacattgaccttgctggcgacttgccaagctgcttatccaccattttctggatgcttttagccttctccaacaattcatta

SEQ ID NO: 31094 - DNA, 360 bp, Triticum aestivum
  Clone ID: PAT_TA_31094
caatagcgcccgccccactgccaaatcctattcccatgcttaaacctgaaacatatatgcataatgttattagcgtgggcatgttgacatagctagggtggaaaacttttctcgtcagtaatataatgcggtgcccacctgtatttctgtgttttgaaggctttgagagttcgatgcagtcattgggaatggtatggttgccaatggttccttgcgggcaatgacaattgaaggacccttgtgtgttggtacattctccgtagcattcggtatcttccgcgggtaagttgcactcgttgatatctatagataacgagccaacacttttagcggttagatgaaaataaatcagttccctcc

SEQ ID NO: 31095 - DNA, 1626 bp, Triticum aestivum
  unsure (1)..(1626): unsure at all n locations
  Clone ID: PAT_TA_31095
gcccagccgcaagggcggtcccagccagcaagcaagcaggcagcaaggggtccgtcgccgcgccgtcttccccgtcgccgtccgtcaccgtcgtcgtcgccacggtccagccctccggtcggcgctggtcgtcgccggcagacaatgtggggcgagagggctcaccacaagcatgggcaccatcacgacaacgtgggttccagggaccggcagcccaagttcatagcagacaactacagctcagtggatgaggtcgttgctgcgttgagggaagctggccttgaatcatcaaatctgattctcggtattgacttcaccaaaagcaatgaatggtcaggtaggcattcctttggaagaaaatctctgcatgccattagtggcaccccaaatccatatgagcaagccatctctataattgggcgaacactatcaccttttgatgatgataacttgataccatgctttgggtttggtgatgcttctacacatgatcattcggtcttcagcttttaccaagaaaaccgtccttgtcgtggttttgaggaggttcttgacagataccgacaaattgttccacatttgaacctttcaggaccaacttcttttgcacctcttatctacgcggcgatgtcagttgtcgaaagcagtaactgccaatatcatgtcctcgtcatcatagctgatgggcaggtgaccacttcaataccgtcttcatgtaaaaagtagcaacaatagcagactatagaagacagtgttgtctcatgctagctaaatctatcctctgggggtggggccataatgcagcaatgactgtattcctgacagagccttcgacaatttccagttcgtgaacttcactggtatcatgtcatcaagcaaggatatgtcaaagaaggaggccgcatttgcgcttgcagcgctgatggaaatacccacccaatacaaagcgactcaaggcctccgacctccagagaggcacgcacaaaacgccaaccctccgaggatccttccccctcccagcaaagttcttgaacgtgacaatattgtcgcagcttctcatactccagccgcaacctcgcagtcaaccgacgttggctacaccgtttcggatgaaaaggtatgtcccatctgcttaacgaatccaaaggacatggctttccaatgcggccatctgacatgcaaggaatgcgggccgacgctatcgacatgccccttgtgccgtgcgccgattactgtccgtgtaaggctcttttcgtaaagatgatgcagccttctggaagtgaaggatcggccattcgtgcattcgtgcaatatggtatcggtactaatcaaggagcaagaagtttggaagggcaaggagatatgtaaatgttcataaagctttactgtatattcagcgtgtccagcgccaactgttttggatgtccgatggataatttccatcacctcttgtacagtttattactgtcatcttgtaaaaagtagtagcagcagcagcagtagtagtagaaaatgatgttttctcgtaaaacctaaatgaatcaatattagcaataattgtggttcaataaaatttgcatcttcgtcaaaccaaaaaannataaaaanaaaccctgccccgggcgg

SEQ ID NO: 31096 - DNA, 1114 bp, Triticum aestivum
  Clone ID: PAT_TA_31096
atttaaaatatataaggttttctgattgtcatttatttcctatttttgattcatggatgacagtaatctacctacaacactcgaatggtttcaagaaattggtgaaaacaagtgatgtgttttcaatctttgatgtgtgaagatgtgcattgtgtgtggatgtaaggagaaatggaaggatttatggcaacatgcaacaattttgttgcttacttgtacatactattttttatttactgatattcgtcgcaatatacctatgtatcacacatactacgaggagacaaagtcttaattaataattggaacctgtaactcatatatgtcctttgttaaggatgcattttttgttttataggtcagactgaattatatgttcctgtccaagccctgttcactggcattgcctcttgattcccttctcagaacagaagatccacgctaaacataacaagttcattagaggagcaaatgttgtttatcaccgcatctcttcacatgttgacaagcccgatatttatgaaggcactatacaaggcgctggcgccatacctgctcggtatggacaggagaagatgcaggggctccgcttcttggcctcggtgacgtcctcgtgcccctccaccgctggtgttgttgctcgggcggcactaccggtctactatggcaggcctgcttgttgctcaggtttaaagaagaatcaaggatcagttcaatggtaattggactgctgatgacacttgtttgaacacatgtgatcctcataatagagttgccgtgagtaccttgcagcctcgctacttcgttttgtcctgtttgatggaatactactacgttgtgtgcccctttcgattttggcatgacgattagagcagatagcgtttctgctgagcatggcatgtttgtttgtctcaggttgtaaattttcttataattttgtaattttagaccttcctcctattaaaagtatcttagaccttcctgtaaatagagaggcaaagttttcttattaaaaatatttgcatttaagtttgaaatatttatgttgcatcagctcacactattattattatttgtataacatgaccctctgattcagttattggggttcatt

SEQ ID NO: 31097 - DNA, 545 bp, Triticum aestivum
  unsure (1)..(545): unsure at all n locations
  Clone ID: PAT_TA_31097
gtcttcgtgtacattttctacggccggacccacagcttgctgacggatgtcgtgtacgtctccctggctcaggcaaacgagatatacggttcttcctcttcgtcagcgtttgtggcctagatagatactgtcgcagagcatccttgagagatcatatatatgatccgggatccatctcacggaaacctcgagcaccaccctgataggagggatcttcccccactgtcgctgctgcatcctgcatggcaaggcagggcatgggatctgaagaattcaacaaattctgaagctgtgtacattgcaatttgtagatatagcatcatcatatatatgtggctcgttggaggaatgtaaatagtaaatttgtgcacatagaagtgtaagacttgcaatatgtgcaatattgcaaggggtgattcagttaagtgtacgggagttcataaaacttcagagatcttggggtgacattgcagcaggaacccatcctgaatcatcgtcagttcttcagtttgcccccnaaaaaaaaaannnnnnaaaaaannnag

SEQ ID NO: 31098 - DNA, 1221 bp, Triticum aestivum
  Clone ID: PAT_TA_31098
atcactttctgccacagccaaggatattgatggccatggctccgatgttagcgagaagacacaggttcctgtcggccgcgccgagagatgggctgttgccatccttcttctctgatgttagcgaaaagacacaagttcctgtcaagagcacaatcataactggcatctgcgcggcttctctggctttcttcatggatgtttcacaactagcaggaatggtcagtgtaggcacgctcctcgcgttcaccatagtcgccgtctccattttgatcctcagatatgttcctccagatgaggtacccctgccatcctctctgcaaacgtcgttccgcttaagccaagaatgtgatgaggaaaaggtggggagtcctcttggagatgggaaccatgaacaggggacgtctgagattaaggatgtgatcgtagtagaatcaatcaatgaccctcttattgagaagcagctatatgcaaacaaattggatgagttaaaccggcggaaaaccgctgctcgcagcatagcatctgtatgcgtaggggtgctaatcctgacggcttcagcttctgtaacgttcctgccattcctggtgatgtgcttattctgcgtgtttggtggcctgctcctcctagctggtctcggaatgctctcctggatcgaccaggtcgacggaaggcactcatttggatactctctcatatttatagggggtggcatgtggatgcgggccgtggtgtggctggtgatggaggccttcttgtacattttctacggccggacccacagctcgctgacggacgtcgtgtacgtctccctggctcaggcaaacgagatatacggttcttcttcttcatcagcgtttgtggcctagatagatactgtcgcagagcatccttgagagattatatgatccggagtccatttcacggaaaccttgagcatcctgattggagggaccttcccccgctgatgctgctgcatcctgcatggcaaggcaggacatggagtctgaagaattcaacaaattctgaagctgtgtacattgtaatttgtagatatatcatcatcatcatcatcatcatcatcatatatatgtgcctcgttggaggaatgtagatagtaaatatgtataaatagaagattaagatttgcaacattgtaaggcaagattcatttaagtgcaccggagttgaaatacttcagagatctgggagacactgcagcag

SEQ ID NO: 31099 - DNA, 528 bp, Triticum aestivum
  Clone ID: PAT_TA_31099
caatgcaactgcaacaagctgtattcatcagcattaaaaaattaatgcgcaacattttgacctcatagttatcagtgcgacccatatcgatcactaccagttcaagcaaaagcagcaaggattgacagataacataaatctttgaactaattcaaagcaaaccataaaaagcacaaattattccatcacatttcatagatacagatacaggcaacagctagaaaacatcaccaggaagagatccatccgagaagaaggaacctagatcagaagtagagccccatctggacgttcttctccacgaatccgcacttggcgtagaaccccctcagctctggggtgcagttcagtatgaccttgtagcaccccctcgccctcgcgtgctccacgaggcggcgcacgacgccctcgccgagcccccggccgcgcgccgcggcgtccaccaccacgtcctcgacgtgccccacggtgccgcagcgccggatgaacttgcgctccacgagcaccgctcccgctgcggcgatgcgg

SEQ ID NO: 31100 - DNA, 663 bp, Triticum aestivum
  Clone ID: PAT_TA_31100
gaattcggcacgagaaaggccgacacgtgggtcctcttcgccggcgccgacatggtcgggaagaggagaatggctgaggcgctctcagtggcgatctttggcgctggccccgtcactgtgcgcctcggctgtgcaacaaccggcgacgtcgacggcggggaagaatccgtcgtgtcgtgccgcggaaggacggcgctggaccgcgtggctgagaccgtacgtgccaacccgttccgcgtcgtggtgctcgatgacctcgaccacgccgacgacgtcgtgcacggtgccatcgtgcacgccatcgagtccggccggctcacggactcgcacggccgagacgtcgccctcggcagcgccatcttcatcgtcatgtcaagctggtcgtcgtccgcgtccggtcagcctaccgactcggcatggaacctggagcttcgggtccggcggcgcacgacgctgaagcgcaggccggagcaagagctcgacggataccggcgcgtgaaaccacgcaagccgctcccgcttgacctgaacttgtccatgtgcgacgatcacatcgacgacggcgacgaggacagcggcggcgaggggtcacgtaactcgtccagcgacctgacggtggagcacgagcaggagtacgcgcaaccgtcctccgacgtcacgcgc

SEQ ID NO: 31101 - DNA, 633 bp, Triticum aestivum
  Clone ID: PAT_TA_31101
cccacgcgtccgcattacttttcatatctgaaagctaaggaggaacttggctacgtgcctgtgacgagtccacaggaaggcctggccgcaacgatctcctattggcaagagcggaagaggagagagctcgatggcccgacgatattcacctgggttgcagtaatagccgggatgctggctgtgttctcggccgctttccttccacccgtcggtccgctcaaatgggtgctcgccatcaatctgttcgttttccgctcgatgctggtgatccggatagtctttgtggccgcggtcgcggcgcacgcgagtgaagccgtctacgcctggttcctggcaaagaaggtcgacccgaggaacgcgacggggtggttttggcagaccttcgccctggggttcctctccctccggtttctgctcaagagggcgagggcggggacgggaccgtgatgtgtgtgttgtacttcagtaacaatggattctagtagaaattccccagaggttctaggtttgtaaccccggtgctgctgctactgctgctgtaagatgtccgtcgccttgcgatgctttacacgagcttggcattgaaccggaggctgcagcacatggacacattgccgtcgggtcgtgcgtgtg

SEQ ID NO: 31102 - DNA, 1011 bp, Triticum aestivum
  Clone ID: PAT_TA_31102
gcgagccagctacacctgccctcctcctcctcctcctcgtcgacagctagccagccagagcagctcaggaaccgagcacagatcgaagcggagccaaacgaaagaagggacctaacctagccagccggcgatcgaccgagagatggcgcggtggtgccagctggcggcggtgctgctcgccgtgtcgatggcggcgtcgacgtcggtggcgcaggactgcgctgcagaccaagtgccaggaggacctgcagaagctgtcggagctgcatggactacgcgacggggcacgaggacacgccgtcggccaagtgctgcgaggacacggcggacacgcagaagtcgcggcccgagtgcctctgctccatcatccagcaggtgcacagcgggcagccacggcgtgcagcagctcggcctccgcttcgaccgcctcccggcccacgcccgccgcctcccagctcccccacgccaccgtttccccagcgcgtcaaccgccttccacctccaccccggcgcctcccccagcctctaacgccccctacgccaacgctcccccgctgcatcaacctactgccgctaacgccgagcagacaacaccacgctctcttcgcaaatccttcgaagcttacgtccgtcccctgcctcggcggcgagagacatcggccacggcttcaacgtctcgccggtcttctgttttcggcgccatcgccagcgtttcgtcccctctcctgtcttctcttccatcttcttattttcggaccttcacacgtccttacataacctcgcttttttctatctttacaactttgtttacttgaccatgcatgtttccacacgacgactatgcgttttatggtcgtaatgtctacttacgttgtaagaccattggttcgtagatggtaatgttatttttctccttattagaagtagaaatagtggagacttggtaatatcctgaaaaaaggtggttttgttcctaatatccccataagagtcgggttccccgagctcaaa

SEQ ID NO: 31103 - DNA, 701 bp, Triticum aestivum
  unsure (1)..(701): unsure at all n locations
  Clone ID: PAT_TA_31103
gtacgcaggtttccngtcaggantcaacgcagcgaacatctctctgctccgacgccgtcagcaggccctttctcgccccaaactccggcgacgatccacaccacgcgctagggttctacagagaggcgatggcgttgaccaacttgatcctgacggtggtgggcgtgggcgcggcggtgatgctgctgcggaaggacgtgaagcagtcgtccgccgtcttccgccgcaacattcgccacatcaagacctggctcgaggaggagtccgccgccaccacatctgctgagcgatcggtacccaaggagctggaggcccaggctgccaagaaggattccacacccaaagtggacaaggattagatgattttacactgtttctattcgatgcaactgcgggtttaggattcacaagaagtacttgtaaatagaagatgtttggtaggatcttcactctaaagaatattggaatcaaataatttgggcatgtatggatagctgcatgtgggttctatatgtcttcaggttggtaatactgaaactctacggttaagatcaatcatcctcttgaatataggttttgtctggcagtaatttgtcagccacttatgtttcttgtggcaccattcacctccattgtttttatgaagttatagtgtgtttcttttcttcatgtatgtggtatttacgttagaaacatgtttg

SEQ ID NO: 31104 - DNA, 821 bp, Triticum aestivum
  Clone ID: PAT_TA_31104
ctcaacacttacgtgtcacctagctagcaagctagatcatccatggcggacatacggtgcgaccaggccaagatgacgccaagcccgtcgcccctcaggatcttcggctacgacgtgcccggcggcgccaccgacgccaccgtcgtgctgactccgccgccgacgccgcctgccgacccgcggaggttcgggtgccagtactgctctcgcgagttcgccaactcgcaggcgctgggcgggcatcagaacgcgcacaaaaaggagcggcagcagctgaagcgcgcgcgcctgcacgtcgacgccaggatgagctacttcgcgccgccgcccgggcacctgatcgccgtgggacacgcagggtcgtcggcctacacgcgggacgccttccaccgatgggtctacctcgcgcaccagtcagcggcgggcctgccgttccatgctctgccagccggtggtgggtgccaagccgagccgcggctgctcgaggacccaagggactgcggcagcgccgccatcagcaccagcagtggtgctcgtgcctgcactccagcggatgacagcaccgaggaagcctcggcgatgggggtggggctcgacctcgatctcagacttgctccggccacttcatcatgaaattggataaatccatcctcacatgcatgagttaaccatgtaatgtaacgagttgtcaagtcccatcttccaaggcttatgaccatgtcacttctttcgttctcttgggaatcctattaatcgttgtccattcattcggactttcatgcgaagaaatgaccggtgaatatacatgataataatatctg

SEQ ID NO: 31105 - DNA, 862 bp, Triticum aestivum
  Clone ID: PAT_TA_31105
gggatacaggcaagcagatcagcaaaagatgcgaccggaaacaggcgtgcgtacgtacagaaaacaaaaaaagagtgccactgctcaactggtctatgatcctaatcattcattcttctaccctacaaaattcacttgtgtccaacattaacttatctgtccgcactaaaacttatcttttgtttaatttcagattggtccttggtgctaccgatgatctctacagcccgactgttcttcaacttcatcaactggtcttccattcatccttcttcttttggtataaatatgtctttgtcttggggaaggcatggagcccgtgggagctctttgccctactgattacgaatctcgataagaaaccatcaggccatgtcatgtctcccgataaaagatgatcccccacaatggatgtcaggcgttggctttataaaatctgattggatccacgctagaggatatgaatgatatgatcccttgctaaatggtctgctagaaatctgaatgatatatacaaattaaacttgaatgggtaataggagttctgcatagggggcattcaggcttctcattgcaccactccattatgcagttccagcagaagacatgtccgcaggttgtgccagtaggattctgccgggtactgagacagagagtgcacttgctcttgctactggatgcctctgaaccagaagccaaatctacagctttgccatgacggatgtcactgataatatttccatcttcattcacaacagggacactccgacctgtagatgaaggatagcttccggacgaaatttgattaatggaactagctattgatgataagttacttcttcggagtctttcggacgcgtgg

SEQ ID NO: 31106 - DNA, 837 bp, Triticum aestivum
  Clone ID: PAT_TA_31106
agaagataaggcggcgcgcgggggagcggcggccacggcgccgaccgacttgctcgtctgcttccccggccggcagcacctggcgctgatgcccaagtcgatgtgcagcccgtccagggccaccctggacaaggcggtggccgcgcgccggaggcagctgcagctcccggccgcgccggccacgcggtacgggggaggaggacgtggtagtactagtagcccgctgttccgcggttctaaggcgaaggagaccgtcggggacgacgagccgcagtcgcccaaggtgacatgcgccgggcagatcaaggtcggccggccaaagaagccgaggcccatggtggagaagcacgtcaagggcgacggcggcagtgggggcaggtgggtcaccgtggcggaggagatcgagcggctgcaggagcggaggaagaaggcgagctggctagagaccgtcgggatcaggagggacgcgctgcccttcctcggcggcgcgctctggagccttcggcacaaggtgaggtgcttcgggtcgtcgctccccgcggcggtggactcttcgacggacgacgacaatgacgtggaggagcgcgagcgcaaatgcgccaccgcgagcgtgttctccaagtggctcatggtgctggaaaggagccatgaaccccacgagcaagacgacacgacgacgagctggaccaagaagacgggcggccgagcaatgaggcgggagacgactgctccaaagcgccgtccgtgcctccgccgtcgaacgcgctgctcctgatgcggtgccggtcggcgccggcgaagggcctgacgaggaaaggagcagaggcggccggcgag

SEQ ID NO: 31107 - DNA, 716 bp, Triticum aestivum
  Clone ID: PAT_TA_31107
ctctcccccactcttctccccattgacctccatcaacatcccggtgagctccacgacggcggagctgcacagaaaagccagagaacctgagttgaaaggagatggagggagggaggagaagtgccacgacatgaggcgctggtggccggctggcgactggggcagagcgaaggagatccggtggaggctcgacatctccttgggtggagatgtgtgcccaagttaggtgtcaaaatctggagagggcggagactatgaggcactgtcgcgcagatgcctctcaacgtgtcggcgacggcggcgagattcgccatttcgaagacgagttgaggacgatggagcagcccggcgaactcttcgacgacgtcgtcgcggaaatcctcttccgcctccccgcccacgctgtcctccgctgccctgcagtttgccggcgctgccgccgcctcgccgacgatccgtctttgctcgccgcccgcgcccgccacctcccgctagaggttcttgcctacaccaccaccaccgtccaagaatcgggcagcaccctctacgtcgcgctggctggaccctgtcttggggagccgtcgcctcgcccggtacctgaagacgattccttgttggcggcattgatccgtaaaggtttacaatttttgatttggtgctagatctaagtgaatgtttatattggaactgcattgaagaagggaacgggctcgatg

SEQ ID NO: 31108 - DNA, 965 bp, Triticum aestivum
  Clone ID: PAT_TA_31108
cccacgcgtccgggaggtcgaatcaatcttacaaggtctaattaataaaagaatgcaagctatggaagaaggtaaaaaatccgaaaatgatctactaggcctgttgctagagtcaaatatgaaggacgtggacgagaatggccaacctaggcaaggaatggcaatggaagatgtcatccaggagtgcaagcaattttacttggcaggaatggagacaacgtccgtattgctgacgtggacaatgattgtactaagcatgcatccagagtggcaagaccttgcgagggaggaggtcctaggtttatttaggaagaacaaacccgagtatgagggccttagccgactcaaaacggtgaccatgatccttcatgaggttcttcggttgtatccatcggctacaacttttagccgaaaaacatataaagatatggacatcggaggcgtaagatacccctcgggcatgttcgtcgaggtgcccgttctattcatcaatcatgatccagacatatggggaagtgatgtcaatgagttcaaaccagagcgatttgcccaggggatttccaaggcatccaagcatccgggcgccttcttgtcatttggttgggggccacgggtgtgcatcggccagaactttgcaatgctcgaagccaagatggcgctaagcatgatccttcaacatttcaagtttgaactcccaccatcgtatacgcatgcaccgcacaccgtgatgacattacaaccgatgcatggtgcgcaaattaagctcagagctatctgactaggtgcacatttaagccaatatttggttgttcttaattatcggtgtaaacaatgttggcttttgtaagatgaactctgtgttttaccttttcatgtaagcaatattggtttgagtaagatgaactatgcatttgacttatcgtgtaaacaatgttagtttttgtaagaagaattatgtacaagtc

SEQ ID NO: 31109 - DNA, 706 bp, Triticum aestivum
  unsure (1)..(706): unsure at all n locations
  Clone ID: PAT_TA_31109
tcgactccatcgaccagtcgagctattacccaagcgccatgggaggtggaaacaagcagtgcggcaacgacaccaacagcagagggcttgggggctactacccaagcgcctactcgtctccgcccatcgcgtaccctgcatacccccctccacaagccgggcatggatgccctcctgcctattaccctccacagccacagggatatgggcatggctatccatcagcaggagcatacgggtgtccaccctccagctatccccaccatcaaggtggctatcacggtcacggaggatctttgcttgttgccggtggtgcggcggctgcggcggcctatggcgcgcatcacttgagccatggccatcacggccacggcggatactaccaccgtcctgcgggttaccatcatcactacggcggcaagttcaagaagcatggacgctacggctatgggtatggcggcaagttcaagcatggcaagcgcatgcgtctctttggagggaagcatggcctctttggtggaaaacacaagtggaagtagtttccttatggttcttcgaagtggatatgtcgagaggagtgaaccgatataatcttgggaataaatccgtctatgtaataatcaactccatgatcgatccataaatataagttctgcgcgcgttggaaatatgccctagaggcaataataanagtattattatttgt

SEQ ID NO: 31110 - DNA, 1761 bp, Triticum aestivum
  unsure (1)..(1761): unsure at all n locations
  Clone ID: PAT_TA_31110
ggagagcaagcaggacggtaagaagggagcagtcgccgtcccggacgccaaggggaatgggacggcgaccgaggaggctgccgggccgatcaaacacgatggcgtgggccataacgaggttgtccccgatcgggacgacggtgtggcatcgacgagcgacaccatcatcgtcgtcgaggagattaggaatggccagcccgtcgaggtgtcgatcgcgcctaccgtcgaggcgggaagagaccgtcggcggggcgaggatgaggaagggtggtcggccgaggcgaatgaagacgaggcggcgtcgtccaacgagaaggacatcgaggagatcaacgtggaggatgacggtagtgtcgccatcgcggatgcctccgtgggcgtagtcaccaaggaggatgacagtatcatctcggccgatgctccggcgatagagaaggaccagatcgacacgttcgtgcctgctccggcagccaaggccaacgaggatgccggtgccaccttcctggctgccccggtggccggtgatgatggcagtgcctccttcgttgctgcgccggcggccaaggaggacgaacttgtatccatctcgtctgctccgttggcgggggagattgagggtatcaccatggcggctgctccggtcgctgacgaggttgatgttgccaccttcccggccgctccggtggccaaggagcaggaaagtgaaactgccgccttggtggatgctccggtcgccgaggaggttaacgttgccaccttcccatccgctccggtggccaaggagcaggaaactgaaactgccgccctcgtggctgctccggtcgccgaggaggttgacgttgcctccttcccggccgctccggtgaccaagcagcaggaaagtgaaactgccgccttggtggatgccccggtggccaaagatgaacaaagtgtacctgtcgccttggtggatgccctggttgccaaggcagatggaagtgcaaccaccgtcgaggctgcgccggtggtcacgcgggagaagcaagaagatgccgtcaccgtagacgcccctgtcccgacgacggccaacgaggtcgaaactgccaccagagcgtctgctcctgcaaccaacgtggacgaaagcgccgcattcccgaccaagccggtgccggaggtggaggtgccagaggcggcagagcaacccacgccttccttgaacaacgacgatctgagaaacgagccagagctgccgaagcctactgtcgtcaaagaggccgcagtcgaatccaatgataagaccgagcaaactaaggaggcaacgacgacggaggaggaggtggtcaccgtcgaggaggtcgatgtcgtgccgcaagaggccgagagcgtctcccgggagccagaacaggaggagacatccgcggccactttgagagacgatgatggggaatcggacggaaaaaaaggcactgatgtgaaggaggccgcaataaggacagaggaaaagggaggggaggataagctgaccgtcgaggaagagaagaaggacggcgaagaacaagaaccagccgtcgctccggtcgagtcatcgtctagttgaaattgagatgtgagatcgtgcatgccaactcggatgtattggtgcgtgtatgaaccactgaatgtacagtttgctctcttcctttttctttttcagccaaaaggatccttccccaatgtaaaaagctttgcgtatcgacgcattcgtagaaacaaattatgcacacgcgggaatgtttggcnnnn

SEQ ID NO: 31111 - DNA, 799 bp, Triticum aestivum
  Clone ID: PAT_TA_31111
cgctcctagcattccaactcccgggcttctctccttccagagcatcccctcccctgtcgctctcactttcatctgcacgcctcctgcttctcggacccgacgcaaaaacaggggatacctctgaggatgagccgcagcaacaggaagagctcatcaaagggccttgacctgaagctgaacctctcgctgcccgcaagaggggactcctccaacagggtgatggctgacgaggagtcgtccccgagctcgtgcctgtcgtcggagaacgagcatggcctgcagtggtccaacagccccgaagcgacgtccatggtgctcgccgcctgccctcgctgcttcatctacgtcatgctcccccaggacgaccctcggtgcccccagtgcaagagccccgtgctccttgacttcctgcaggacagtggcaacaataacaacaacaccaacagcaacagcaggaagagcaggagggggtgaaagaagaggaggagaggctccattcggctgcaccgacatcaagaaaagcgtttatatgaagtcctaggtccagtagttctctttcgtttgatcatttcttcagtgtaaccatgatatgtcagtattaaaattgtgagactggcatatatccatgtgctggtgtcacgattttgacacatcatggatacactggggactatatcccctctcatgtgttcttcttcggtggttctaaatggagtagtttgttaggcataggaccagacttcttctcttctgtttcttactttcaagacaagaaaagattacccctggaaatctcaag

SEQ ID NO: 31112 - DNA, 896 bp, Triticum aestivum
  Clone ID: PAT_TA_31112
ctcccctcctcaccagaagctcgctcaggcagctctggtctgctgcctccacctccatcgtgccggctgatcgagcagccggtgttcttctctgcttgccttcttgttcgtcgtctcccactttcatcgtcttcttgatctgagcgctgagaaccggcgaggaggcaagttggtcggccgaatgcgatggaaatgtctggcgtgagcgcggtggacagccctggaagcggcagcgcgtcgtcggcgctgggagcgccgcggccgagcaggtacgagtcgcagaagcggcgggactggcagacgttcgggcagtacctacggaaccaccgccccccgctggagctggcgcggtgcagcggcgcgcacgtgctggagttcctccggtacctggaccagttcggcaagaccaaggtgcacaccgcggggtgccccttcttcggccacccatcgccgccggccccgtgcccgtgcccgctgaagcaggcgtgggggtccctggacgcgctggtgggccgtctccgcgccgccttcgaggagcacggcggacgcccggaggccaacccgttcggggcgcgcgccgtgaggctctacctccgcgacgtccgcgacggccaggccaaggcgcgcggcatcgcctacgagaagaagcgccggaagaggcacccccagacgtcgtccaagcagaagcagcaggcggcggcggcctccgccgcggccagcccggcgcccgtggacaggcccgacatgcggcatggcatgctggagcagacgcactacctgttccccatgcacgcgcacctgttccagggacacttcctggcgccggcgcccgacggcgaccccgtgggagccctggatggcgtagtccccgccggggatgacatcgtgatggtgat

SEQ ID NO: 31113 - DNA, 657 bp, Triticum aestivum
  unsure (1)..(657): unsure at all n locations
  Clone ID: PAT_TA_31113
gactgtgaaagaaaagggagatctcagtttcattggctgtaccacaaatgcggctcctgtggttcttacaataccagagttatcaaaactgatacggcagattgttctaccccgaactagcgaggggaatattctttcttttttagtttttgtcttttgtaaatatagtcttacagaaccttgtgtagaatagctaccatattttttcatcccatagccagtcatttttgtcaagcatagcgtgcaatttactaggtctggtgctataatctgtaaaaatgggacatgagcctgaccttcatccctgtcaaaggggcatcctgccctgcaactaaaggcttaagcatccatgccaaagtatacagtatacaagtgtacctgtacacaaataccgacagtcctgccttctgtgttcaacggttccgaaagccctctttcgagcccgacccttcgttcctcagcttcccantaaaaagggggcccggaccaattccccnanatganccntatagcngccaacggcgtcnttaaactcctgacnggaaaacctgcgtaccaactaacncttgancaaccccttccaacnggtaaaccaaagcncacntgcctccaaantnccaccaatggaaggncccctnangctnaccggggttggtn

SEQ ID NO: 31114 - DNA, 943 bp, Triticum aestivum
  Clone ID: PAT_TA_31114
cccacgcgtccgggccgcttcacctcaggttccacggtgattccacccgatcagtgccttccctacccttctttcactaggatgagcgcagcaaccatggcggcggatccgcagtgtccgcggttgctccacctcgggcagcgcggatcaaggccagcggcccgatgtaggcgtaccgggtacatgcgcggtctgctgctctgccccgcactccctccatgtatcccctgcgcatccggtggccaggcgcttcttccactccgacctagtggctcacgaagcagcagcttcacaccgccacacctccctaggcttgatttcttccattgcatgaagtgcaattgctgccttggaatgagactatcagaacacaaatgtcgggagaaggggctagagacaaactgtccaatctgctgtgacttcctattcacatcaagcgcggcagttagagctcttccttgtggtcacttcatgcattcagtttgctttcaggcatacacttgcagtcactacacttgtcctatctgctgcaaatccttgggagatatggcggtgtactttggcatgcttgatgcattcttggctgctgaagagcttccaaaggaataccacgataggtgtcagatcatgtctgaagcactagagtgtggttcctgtgtagaggctttcacatacttccatgggtagattgtactttcatgacataggtgtttatttaatatactaagtcatgcatccttgtcccgaaagagtgttagaggcaacaatactcctcccgccggacagccaactctacgccctccacgccctgacagccaactctactattcagttgttatctttttttgttttttattgtctgtcatcaaagagttacgtttatatatgtagattatcttcctacaatttttaaattgcttggtactgtggaagtgtttatttc

SEQ ID NO: 31115 - DNA, 1422 bp, Triticum aestivum
  Clone ID: PAT_TA_31115
tcggcacgaggcgaaagtagcaagctagctgctgaggctgtctccaatctacgcacaatcacggccttctcatcccaggaccgcatcttaggcctcttcaaccaagcacagaacggcccacggaaggaaagcatccggcagtcgtggattgcaggccttggccttggcacttccatgagcctgatgacatgcacatgggccctggatttctggtttggtggccggctcatagcgcagcaccacattactgccaaggcactcttccagaccttcatgattctagtaagcacagggcgtgtgattgctgatgcaggtagcatgacaacagacctagctaagggtgctgatgcaatcgcctcggtgtttgctgttctctaccgggtaacagaaatcgaccctgacaaccctgaaggatacaagccagagaagctcaaaggcgaagtggacatcagaggagtcgactttgcatacccgtcaaggccagatgtgatcatcttcaaagggttctctttaagcatccaatcaggcaagtcaacagccctggttgggcaaagtggctctggcaagtcgaccatcattgggctcatagagcgattctatgacccagtgaggggaatggtgaaaattgatggcagagacatcaaaacatataatcttagagccctgcggcagcacattggactggtcagccaggagccaacgctgtttgccggcacaatcagagagaacattgtgtatggcacagaaacagcaagtgaggcggaaattgagaatgcagcaaggtctgccaatgcacatgacttcatcagcaacctcaaggatggatatgacacatggtgtggcgagagaggtgttcagctgtcaggagggcagaagcagcgtattgcaattgcccgtgccatcctaaagaacccagctatcttgctactggatgaggctaccagtgcactggacagccagtccgaaaaggtggtacaggaggcactggagagagtgatggttggcaggacaagtgtggtggtggcacacaggctcagcacaatccaaaactgtgacctgatcactgtgctcgacaaaggaattgttgtggagaagggcacacactcatccctcatgtcaaagggtccctctggaacatattatagcttggttagtttgcaacaaggaggcaaccagaactaagtatttccatgacaatagagcactcgtatttgaattagaactgtaagcaaggatggcgatcagatcatttaaactttcggcgacaatgggctatttttcctcctgttgcactatcagtatatagaagtgtgccaagcttgtagtttattcatataactgctggatatgtattgcagtgatgcaaaggtcaagaaatctaagataagcagtatagtaggtttctaggttgtatctgtattt

SEQ ID NO: 31116 - DNA, 531 bp, Triticum aestivum
  Clone ID: PAT_TA_31116
gcgctatccatttctaggagaaactttgcaggaaacatacgacaagattgtcaatgatccagcggatatacccagtaacgtgagcccccaacttgttgatttgctggaaaggcttctctgcaaagatcccggagaccgtatcaccctggaagctgcggctgcgcatccttgggttgctggggatgaggggccagtccccgaatacatgtgtagatgtggttttggccgcaggaagagaaatggttcacaagaagcagtacaataacacaaagagtcgttcagaaccggttgttgggtggtttagtgtagtgtagataactgatcaaagcgaaaactggcgagacggacgatgactgatgtgtttctctctttccccttttaacttttgcgttggtttggtggcttggtgctcggctgaattttttgggtacataatagagtgcaatctggttccccgttcagttccttctttctgtatgtacgtacgataaacatcatattgcaaagcttatacgccttacgttgttgtgt

SEQ ID NO: 31117 - DNA, 1265 bp, Triticum aestivum
  Clone ID: PAT_TA_31117
ggctgtgcgagactactggtacgtacacgcattctctctcccggagagcttgagaaagagagagtgagatccatggcgacctaccgtccggacagcaacaccctcctggcggacgactcgatcctggagtacgtgctggagacgacggtgtacccgcgggagcacgagcgcctgcgcgagctccgcctcatcacgcagcagcacgccaagtccttcatggggtcgtcgccggaccagatgcagttcttctccgtcctgctcaagatgatcggcgccagcaacacaatcgaggtcggcgtgttcaccggatactcactgctcaccaccgctctcgccctccccgccggcggcaaggtggtggcgatcgatgcgagccgggagtactacgagctggggcggccggtgatcgagaaggccggcgtcgcgcacaaggtggacttccgcgagggcgacggggtcgccgagctcgacaagatcctgtccgaggacggcggcgccagggccggcacgttcgacttcgcgtacgcggacgcggacaagctgcagtacgcggggtaccacgagcggctgctgcgcctggtgggcgtcggcggcgccatcgcctacgacaacacgctctggggcggctccgtggccatgccccgcgacaagccgggcagctccgaatacgaccgccgggtgcgggacagcttccttgagttcaacgccgccgtcgccgcagacgaccgcgtcgaggcctgcatcgtccccatcgccgacggcgtcacgctgtgccgccgcgtcaaatgaagtgctccgctctaatcatcgatcgagtcagatctcagatgcatctgcgagtcgcgtcatttcgtgacaatgatgtcctacctggtttctcaccgttctgtcgacttgtggaatcgggtgagcttatcttttgaaatttctggcatccatcacgtgaacgtttattgctttcgagtgggcctcgattcccgtcacgctagcaaaccactgcagtactgtacgggtgctgtacagtcactgtcatgtgggacctgaccccacatgtcatctatactacgacaccatacagtactgtagaagatctcaacccaaccaatatggctgctcatctatgtgctcaacaccagtgagtgaggttgtcggaagtgtcttttgttcaactttgttctaagcttcctccctgattgtattgcccgcgaatgtagtattattgagtaattaataaagctcctgaattataaaaaaaaaaaaaaaaa

SEQ ID NO: 31118 - DNA, 955 bp, Triticum aestivum
  Clone ID: PAT_TA_31118
gtggccccttcgcggatccgaccccccctggccgcccagcgcgggctcctccttcctggttccagcttccaacccgacccgcacacacgaatcggaaatccggatagagcgccgatcggaactccgccaagagcgccgcccccgccccgctccgccacccgaggacgggagggagaccaagaccaccatccggagggtctgctgcgacgatatgctccggttctgctgcgacgatctgctccgcttcgcctcggtcaacctcgaccacctcaccgagaccttcaacatgtccttctacatgacgtacctggctcgctggcccgactacttccacaccgccgtcaaccccggcgaccgcgtcatgggatacattatggggaaggttgaaggacaaggtgaatcttggcatggacatgttacggcagtgtccgttgcctcagaatttcgcagacagaaattagccaagacgcttatgcacttgctggaggaaatcaagtgataagatggataaggcctattttgtggatctctttgtaagggcgtccaacatgccggcaataaggatgtatgaaaagctgggctatgtggtttatcgaagggtgcttcggtactactcaggggaagaagatggccttgatatgaggaaggcattatcacaagatgttgacaagaagtccatcataccactcaagagaccaattacaccggacgaacttgaatatgactgatgctaaattctaactagcactcttgcgtggctgtgttcccattgatctgcaaagttattgtctcagctcaacaagttattatctctagtgtttttgaatgagcgatcctgaatttttctattcgcacattcctggtgggcactgatgcgccagctggtgcatgctgaaggagaacaccagtgatttttactagcttgctattttcatcaaaaaaaaaaaaaaaaaaa

SEQ ID NO: 31119 - DNA, 780 bp, Triticum aestivum
  Clone ID: PAT_TA_31119
aaataagatgagcatgctcaaccttgttgcaagccttgtaaagacaggagttcatggaaggatatttgctgcagatactggccgtcctataccgggatcactcatggtgaagggaatcgattcaaagataaatgctagcggaacttttggtgattaccaccggattattgcacctggtcagagttatgaagtcgttgcatcgatggagggcttcaaaccgaaaagaacacgtgtcatgctggggcgtgaagccatgaatctggacttcatcttggacccagacggagccctcaagggaaccaagccgctgcgcaatgactgcggctgcagttgcaacgacgacggtgccagcaacaagccgttcctcctccgggaagcttacctctggctgtatctcctggccctgttctccctgctggccctctaccttctcttcaggaggagaatggcctcgaggctcgcggcacatcgacatcctcctccgaagcggactgttgccgtgtgagatggatctgtacgtgctggtacatgtttcatgtttgtagcgtaaccacaagctttacaaactgttgttcacacgtgggattagatcgtggccatgatgtgccatggaagttttgaatagttttagttggagatatatatgtcgagttaactggatacatacagagatagaggaaggatagagtgaatgagtgacgcaggccgagtctcttagtttcttcatctcatgctaataaaatcgttttactgtcctggttttttacccggaaaaaccac

SEQ ID NO: 31120 - DNA, 1120 bp, Triticum aestivum
  Clone ID: PAT_TA_31120
cctcgtggtcgcgctcgcgacgggggagacggagaaatcagagcaggcaatggagtctaccctaatcacgagattatacccccttctccccgctccccccaaggccaggcccctctcctcatcgcccctcgccggagctcgccgcatcgcctccatttccttctcttccgtcagcatgtgtggcgtcttgcgtcccagcggcggcgttacctcgtcggtcaccgccgcagcagcggcgctcggcgaggcggcagagcccgggtctgaggccatcttgctcagtgttcagggcatgatgtgcgacgggtgcgctgccagtgtgaagcggattctcgagagtcagcctgaggttacttctgctacagttgattataaggaagcaagggctgtcgtgtggacaactcctgaggtcaaggtggcagaagattggcagaaacaatgtggagagaaacttgcaagtcatcttggtacttgtggatttgagtctcgcccacaagggatcgactgcctctaaatataggctgtatacacatcaaccaggaccaaactcgctatggaatgtccttgagcatgttcatatcaacattgttaatgcaccattatatctccagctttctgaaatcacagttatccactgaactaaaatttagtttctatcacagggtaaggtgaagcccgataaagtcaactctgagtcttaactgctgccgcagatgagctataagcccatgatgttaaccagcagagggcacctgatgctccagatttgtgtgactcagtgtgagcgtctctgtgaaagttgtcctctagagttctggaagtgcagattattatgttcatgttcttatctctagtgtgtaagcaatgtagcttgccttgctcgtgaacttcaactggaacattccatcaaacaaattgcaagggtcattactactccctccattcacaaatataagatgttttttacatttttctgaatctgatgtatattagacagttttggtgtgtttgctcattaatttcagtccgtatggtatgtagtccatattgtaatatcaaaaacagcttacattgtgaacagagggagtataaaccaagcagtttgacggcggccgctcga

SEQ ID NO: 31121 - DNA, 1366 bp, Triticum aestivum
  Clone ID: PAT_TA_31121
aaatttccagtcctgtccctccccggcgccggcgacgaccgccgagccgccacctcctccaggagcgccggcgttgcccgtccgcacccggcgacggcagaggcagcgatggcgaggcaggaggccgcgggggccgccacgggggtggacttccacctgcccgacgagatcctggccgtgatccccaccgacccgtacgagcagctggacgtcgcgcgcaagatcacctccatggccatcgcgtcccgcgtctcccgtctcgaggccgacgtcgcgcgcctccgccgggacctcgccgaccgcgaccgcggcgacgccgacctccgcgcccgcctcgccgactctgacgcccgcctcctcgccgcgctcgacgagaacgcgaagctggtgaaggagagggacacgctcgccctgacggccaagaagctgtcgaggaacttggcaaagttagaggcatttaagaagcagttgatgaaatctctgagtgaagataatttattgcaattgtcagaaacaggcgaagatcgtgatgtagatgcagaaaatagtgggaccgctcgaagtccttcctggaaagatgaagtttcaagcagtcacacctcttcaaatacttcaagcagatccacgatcactgaatcagcccaaggataccagttctcaatcacaccatatgtagccccccaaataactcctggttcaacaccaattatttcatcctctggtggttccccattagcatattcaactggtccatccactccgaagttctattctggtccaacgtcgcctacaagatctcgttctgaagaccaatcagcattttcatcatggaatggatcaagtcatcagtattcagcccccgtctctcctcaacgccgctcatttacagggcgacctcgtatagatggaaaggaattcttccgacaagcacggacgcgactttcttatgagcaatttggagcattcttggcaaatatcaaggaatttaatgcgcagaaacaatcgcgagaggacaccctatcgaaagcagaggagatttttggaacagagcacaaagatctatacatttctttccagaatatgcttaatcgcaaccaatcgtgaacctgtcataggctgccgtatttcttcttttgaacaagctggtttcaagatcgtatccttagaaatctgtgcataggccattgtagtttcggcgcggttatcctgaataacatgatgtaaatgggtatggtcatgcatgcaattcaacaagtgaaagttttttttttttgtaacaagtgagagttgagactgtcagatatattggcctgtgtaattgacttgtaaattgaagcttgttttcagcaaaaaaaaaaaaaaaaaa

SEQ ID NO: 31122 - DNA, 925 bp, Triticum aestivum
  unsure (1)..(925): unsure at all n locations
  Clone ID: PAT_TA_31122
cagggtcctcttcgtctgacatctctgttcaccgcacacgatcatcagaggcagccgcacagaagaagcaggggcacggaagaggaggaagacgacgacgacgatgaggccctgcaagggacctgagatggccccgagggtgtggctgatcccccgcgccttgccccccccgtgggagatggtgaccaacaaggaaaccgatgacacctccggggagaccagcttctccatccagtttggcttaacgctgtcacttctccttattgctttcactgcagcctgttccgtgctctcaatcctgatgctctctttcaatgccctcgttcgcttctgtagcaggcttcgcctccctggatcaggccgcggcgttccggcgggggagatcgtgcttgccggcggctgagcggcggcagcggggtagggagggccgacgtgtgctgccgttggggtaggttcgccggtagtgcggtcgtttctgtggcggtgccaccgtgtccgtggcgctgcatcctgccgcgctcctctgtttcgtcgcgcccgccctcgcgcgcgctctccgggtcttgcgctcgtgctactcccctggtgctcatgttctttgctcgggggagtctgactcgaagcatccgcaacaaccggtgaaatttagatgatgatttatgaggagatgttgcacgatggcgaagcgtcgcttgtttgtcaatggttggtgatggtgatggcggtggggaatggtccttagttttctttacgaatgctgatttcggtaggaggaatattataaaataaactttaatgttgttgggaaaaaaaaaaaaaaatgcgacacactgatcacgtgcaatttgcacatatatataggtataagagtgcacgatnctcgacttgcctcctaaactatacactatangaaaagaaaaataca

SEQ ID NO: 31123 - DNA, 1530 bp, Triticum aestivum
  Clone ID: PAT_TA_31123
tttttttttttttagggtaacatttctccttatacagcatactagcatagcgttattgtgcaaccaacaattacttacggggtacagtagatgcaaacgcactacccctcttaaaccctaacaggcccaaccttaaaccacatgaaattactagaaacccgtgaggcacacatgatattacacaaacaagaaagaaaaacacaagatcttgcacaccgatggagacagcacgctcactaggctacaaaataattaaatcaccagcatgcaggtccgacaccaacggacaggcaacagtggcgcaggccgcagcggctggtccggcctcggttcccagctaccggcagagggataatcaatccgtctcaagccgcggtgcactgctcgcgggcgaagccgacgcgtccgttcggcacgtcgaacaggatgcggtggttctgctgctgcatgctcgcgatgacgttgagcaccgtgttcacgccgtcgggcgccgccgccatggccaggcagcttgtggtgccgtacgtgctgtggatcaccaggttgtccgcgggcagcgtcacctgcatgccggtgaacatgaacgtgaccggcggccacttcaccgtcgtgttgtagcacgtgtcgaacccgccgagggaggagagcggggcgccgcggatgcggtggcggacctcgtcgcgcaccgccacgtacgccggcgccaccagcctggtgaacatcgtcccggagtcgagcaccgtgccggcgcccgtcgccgggtcgaacgccagcgcggagggcgggatgggcaccaccttcttgcccacgcggatgccggtcatgcccacgtagtagagcgaggagcggtgcgggttgacgagcagcggcgtcgtcttgatgcgcagcggttggcccttgcggccgagcctgagcgtgccggagaagttgagggacttgaagctcgggaggcagtaggagaaggtgccctcgtacatgtccttggtctgcgacaggaacgacagcggcccgcggccgagcccgaggaggccctgcggcggcgccgccgtgccggtggccttctggagacatccgaaggtgtagctcttcacgacgtcgttggcgacggcgagggagtcctcggacagcgcggcctcgagcgaggagtcggcgtacgtgaggctgaacccgcaggacttgctgttgagcgagcaggacgggttcggcgcccgcgagcacgccggcgagccgcacggcacggcgcggtacgacttagacgcggctggcttgaacggggtggtcgtcgggcagcccgcgcagccggagcaggggatccacgcggcgtcgttgctggtgtcgacggcgaggaggagctgctgcggcggggtgccgaggcgcgcgcgcaccacatacgtcggcgtctgcagcagctgccgcccggacgcgatcggtgcgtacgcgcgcccggccacggcgagagagtcaaggtacagcagccgcgacgcgtcccgggaggactggtccgcgaggaagcccgcccacgacggcgct

SEQ ID NO: 31124 - DNA, 370 bp, Triticum aestivum
  Clone ID: PAT_TA_31124
gaatcgcggagaaacatactaccgtacaacattttcttgcagcccggatttatgctttgcaaagcggaaaataaacattggaaccggcgaggcccaaggaaggtatacgtcgagctctgtacaacggctaccggcgcgcgactagaggtcaccttttccagctccggcttttcgcgagggggtccacgccgccgacgacccacgtttccttggcgatgtcgatggacagcttcaggaagtctggcgccgttctcatgaacaccagctcgtcccttttttcctccatgccccccttttcctggggggcctcctcgccggccggttttgctcctttcctcgccaaccccttcgccggggccgaccgggaccg

SEQ ID NO: 31125 - DNA, 1308 bp, Triticum aestivum
  Clone ID: PAT_TA_31125
ccggccggttcgggaaaaaacccaaaccgctccgctacctccccttcttgattcttgccactgtccggctctcccgcccggccctcgccatggacggcgccgacagcatgcggttccagcggcaggcgtcctgctcctgcgccccctccatgtcccgcggctacgtccgcggcggcttcgacctcgacgacgacgacttcgacgacgggcacttcgacaaggccggcgccgccctgcacgggagggcgccgcccgccgccgcgtcgtcgcgcgggtgcggcacgaagctgaggggcctgtggcggaagatcgtccgggagaagaagaggatactgctctgctccaccggctgcgtgcccgtcgggggctcgtccgcggcggcggcgcgggagccatacgacgcgtacagctacgcgcagaacttcgacgacggcgcggcctgagtggagcccgacaacctctcgcgctccttctccgcgcgcttcgccgtcccctcctttctcgccgccactcactcgcgccgctccctgcgaagaggaagcacctcgggcatcagcagcaatcatggcggacgcgaagacggcgcctgcggtgactctccgcacccgtaagttcatgacgaaccgtctcctctcacgcaagcaattcgtgctcgaggtgatccaccccggccgcgccaacgtgtccaagtcggatctcaaggagcgtctggccaagatttatgaggtgaaggactcgaactgcatctttgtgttcaagttccgcacccactttggaggcggcaagtccaccggcttcggcctcatctacgataacctcgaggctgccaagaagttcgagcccaagtacaggctgatcagaaacgggctagccaccaaggtagagaagtcacgcaagcagatcaaggagaggaagaacaggacgaagaagatccgtggagtcaagaagacaaaggccggggatgccaagaagaaataaggaaatattattctcgaatgttggctgccttcagttctatctgttcacaatcagtgtctgtaccctttaggaaatcttgttgtggcaatgtcgcagtatgcttaatctagtagaaagagaattttgagctttcacatcgaatttcgtacctggtatgctgggtagtattactcacttgattttttctgctagtgttctgctttgtcaagttgagatgagttcattgagtgtggttctgttccaaaattctgctatttttgtttaagttgtggacctatttctgtttttgtgattccatgagtctgagcttgtggaaatttaaaaaaaaaa

SEQ ID NO: 31126 - DNA, 648 bp, Triticum aestivum
  Clone ID: PAT_TA_31126
tccctgctaaagaacgatgaggtagaccgggcaacacatcgccacattgtaaaacgagtgaatgcttttttggagcatgacatggtattccttccagttaacactcagaaaatgccactggtatctatcagtaatcaatgcgaagaaacgagagatacaggtactggactcgcttggagttggaatgagccgaagtgacctcactaagatgttacaaggacttgaccagcatctaaaaatcgcatgcaatatgccagagtttaagagaggtgataggtggcaggacctcgatattacgaattggaaagtcgtagaacagctccaagagccaatccaaacagacgggaggacatgaaagaatttcgacgaaagataatttgattaagcgcaactggacatgatctactaggtgtagtttctgtgatcgggatgaaactatcaagcatcttttctttgattgcccgatggcgagggtgttgtggcgctcggtgcaaattgcctttaacattactccttcaaatttggtcaggtcgttttttggaacgtggctggttggtatagaggctgaaacagctagacaaatttgagtgggagcatgttttattccgggctactgcgctaatccgtacgtggtcattactcactccg

SEQ ID NO: 31127 - DNA, 471 bp, Triticum aestivum
  Clone ID: PAT_TA_31127
tccgataaagctatacacattcgcgtaggagtatgtgctttgttgtgggcaatttggaactgcagaaatgatttggcttttaacaccaattttttttggtaaacagcctattcattttttgcaggttttattccgggctactgcgctaatccgtatgtggtcattactcactccggcggaggccagggcgcgtttggttaccggatctgtccggtgggagatggtagcgcgggatatcttcaactggtttggatgacggtcatgtaataggataggcgcttagtttacctatctttctttattatgccagccggttgtggcttttgagccttgttttactttgctagctctttgtgagctagcatcctttattgcagcactttgcaagacattgttgaactattttatttatttataaatgtggccgtatgcatcgttctgatgcagaggcaggggaatcccccctttcgg

SEQ ID NO: 31128 - DNA, 1290 bp, Triticum aestivum
  Clone ID: PAT_TA_31128
gattcaataaaggcgtgcacacagcttgtcacatcggcacatgcttcgccctactgctccgctctgctccaaccgttcgcatcaccccgctcgtcccccgcgccgcggcccggctcctcttgctcccgccgccgcccgcgtcggtgggacggtggcccggtctggccgccacccccgcggacgacaggaggccgcgcccgcttcccgcccctcctgcgaggcaggttttgctgccggcggacgcgcggcggagtttgtcaacacggcccaaaagaactggggtcgaagcgcactccggcgagcgggaaccgcattggtgcccggggcgtttctggcgccctgctcgtcgagggggatggcggatttcggacgcttattgcatggctacgtgtgacggaccccgccgcgttctcctgcgctggtcttcagcatctggggccaggacttagcctcccgccatcgcgacccagtttggggcaggataaatgcttcggccgttctcctttcccgcgtgaccctcggcgccctggtgctgacgggttgtactatttccctggcggtcctttctcaacacttagccgcggctcgtttcaacgggtatgtatggagccctcgtattgttttatgcgtggaggcttttgattctgtttgaggccagggtgtgttttggcccttgattctttcgatggtagagactagctgccgacatctggatttgttgcttatgaatcacatgggatcgccgcgccaatcagttcacctggctgccgtcaaccagaggtcagtggcgagaccggcgcccacccaggataccgcgcggcggcggcgctccgctgcaacggcaagggattcctcgtcgatgctcgcggcttcgctcactgttgatcggtccggtgaagtcgttgtagaggtcgctgcggcagccttagcaagcgagtcagcaacgacggtggcacgcgacatggctgagtgcagagcgaggaactgctccacggcaagctgcgggttctgctcctccgccgtcgagctcacctcggcgtacgtgcttaaacatcgaagtaagctctctgcagcagaagcttcttgcatggcttcaaccgcagccatttgtgccgcatccctgtattttagaagctcctttcctaacttagcaagtgatggaggaagtgccgtccaggaagtgtttgcatccgtcaattttttgttatttgcagcaatcttcactaaatttgtaatattggggttgcttaaaaccccagacgtccttcttataggaggcccacgcgtccg

SEQ ID NO: 31129 - DNA, 2101 bp, Triticum aestivum
  Clone ID: PAT_TA_31129
aaaacagtggttccgctcgtcgcccccaccctgcgccgccgcagtccagcaaccccccaccccatatgcccccgccatggcagccctcaacctacgccgccggcacgatagtggcagcatccccctgccgctcctcctcaccggccggatttcacgcatccccttattccgatcccctttcttccgtttcagatgaagagaagaccattggagatacttcctcagctgcccctcctatctccctcgatgatgaatttccgaaggccaccgccatgggaccttatgcaagtgcaggctggtcggacctccccatagatctcctcatccggatactgcatctccttgagctccccgaggccctcgccttccatgctgtctgcccatcatggcgttctgcatctgtggctgcaggtggtgtcccacctcgccgcacaccgtggcttgtgtccttggcggaggagcctcttccggcaggggatcaacagcggcctgtgcgtcgtggattatgggatcctactgccacttctgagctccgcaacctcgcgggtgctctgagagctctcctcgtcagctttccctggggccaggccgtggcctgctgcggcgcctcccatggctggttaatcatggcaaacgagctctcggatctcgtcctctataaccctttcaccacggcgtcgctctcgctcccgccaatcaccggttttgcatcgtgcatcgagggggtttacggagatgaagggaacgtcgtgggcgatcgttacagttgttacgagagtgacagtgtctatgatgtgcggtctcttggtgggttcttctatgacaaggttgtgttgtccggttctccatctgctggtcccgcaattgctttgtccatgcacatggacggtaagcgactctcttttgcgagggtcggagatagttcttggcgccacgggtttcggcgagcggaagaaacggagatagttttgcagactgtatctaccaccgcggtaggttctatgcggtgacaatggaagggatattgaagtcatgggactttagtggatcagacaaaccgaggaagaaaacggtcattgccgaggatgacaatgacatgttcgacgacccagttatcactaggtacttgctttcgactccttggggtaatctcctgcaggtgcgtgtctttcttgacacacaccagggaaacaatgtcaggattgaaatagacaggttggacctcaagagtcagacaagggtagcactgagctcagggaaggctctgcggggacatgcggccttcgtcggacagaatagcccaggcattttatccactaaagaattccccaaactaagaccggattgtatctatttcacaactccccgcctcagagagcgccatgcttttgagcatcgccgtaaccaatggagcggcgtgaaggtctatgacctgaaaagacagacacttgaagatgctttcccatctggtggaggtctttacggaaccatctgtccattggaagtctggttcacaccaagtctgatctgatagccacgctgtaacttggtggaaatatgcctcgagttgatgggaattcccttcagaaaatgaatcatctgcctccaggataatttctcttgtttctcttttggctgttttcatgcctgtgtgagttgttgtcgtttagaaacgacggggtttagcatggaagaaggttgccagcgacaattttacaccgtcgctcttggtgttggttttattatataagtgtatgtgttcaattgtttagagaaaaggggttgggatcctctgcagtactgtacggtacagtaaagtcactgacatgtggacctggccccacatgtcatccgcacttacatccccagaaagagtgttgcatgtcgtgtaatatgtgagttctgtgtagctcaggctcagaagccagtgagttgtgtataacttgtgtgaatgctggagacccaagagtttgtactagtacttactattttgtagttgttgcacaggtcctatttcaaaacacatgtatcaggcgacctgaatagagacctggctccagtgtcgctgcctctgtaaaaaaaaaaaaaaaaaaaaaaaaaa

SEQ ID NO: 31130 - DNA, 629 bp, Triticum aestivum
  Clone ID: PAT_TA_31130
ggattttcaggaaactggaatcttcagcaaaaaacaacgcatggcgcattgcaatagcttcacccagctccggattatcaacatgatgaataaaccctctgcttgctgccagcaccagacctagatgatttcggatcacaacaccaatgcccatgcgtttagtctgggcaaaaatcgcagcatcaacattgaccttgaccgactcagccggcggcggagaccacttcgggattgacacctggtgctcacgcctattggagccagtcgacctgaaattgtgcaataagatgaaatcgacataagctctgtgatcctcattgggctggttgagctatccaacaagtttctagctgaggcaatttgaaaagctcgagctccctaaaccagtctacttcgtacgtaggcttgaggagggtggatatgtgtcggtagttgagttttaccccacaaaggagcatttctgcatttcagcagaacgaattgcgctgtcagacccgtatgtaaggatggggtgttatcgatgaatcaggatggggtgttatcgatcaatcacgcggctgttcgagccctcaggttcatggaacggagagagcacaaggtgcttcttgatttcaactatgagcatctgc

SEQ ID NO: 31131 - DNA, 596 bp, Triticum aestivum
  Clone ID: PAT_TA_31131
agatatagtgagttggtaaccggcacaatggaggttgccatctgcggcccatatatagttgtgaaatcacacgagttcatgcccaaatggacgccggctatgcttgcgccattgaagtcatggatcacatgcggtcctaatgtccagattttcagagacacagtcattcttgtgctcatagcttacgtgatattagtggacatcagcttgagcttcgtctggctcgccatctttccagtcatagctcttgttttcatacgagcgctgcacctcaagttcaatcggcgtacagggggcagcagtcgtaaagttaatcaaggatcttctctcgtcgtcgtcgagactaaaatgacaaccatggaggttgggatcatagtggtgatgacactgggggcgctattgggtatggaccagcttcccgaccatgcagctgcccggttcaccatctcacagttcctcctgttcctaagctgcacggtggcggcattgacgcgcatggtgatgaagctaccagctggcgcctctccgggcatagcactggcgacggagatgctccacaagaccctgcttctcctcctgctggcgacggcgcacac

SEQ ID NO: 31132 - DNA, 1190 bp, Triticum aestivum
  Clone ID: PAT_TA_31132
ggagcagcccgcgtttcgcgccgccgggccgccgcgacaagctggccgccacgcctcactccgcccgagctctggcagcaccgggacgagctcctcttcttccgtctcagcccgaggtccttctctaacgccccgactccgacggccgtgctccctgtacacagaaaaatcggagaagaaaggaaaagaaggagagctcgcgcccctccccgccgccgccgcagccatgtctcagaagaagtcgcgcggcggagccgccgcccgagaagatgccgatgagctctcgcgctcgcccctccaggcggtcctcctcgccgacagcttcacgctcaagttccgccccatcaccctcgagcgccccaaggtgcttctgccgctggtgaacgtgcccatgatcgactacacgctgtcctggttggagacctcgggcgtggaggaggtcttcgtcttctgctgtgcgcacgcgcagcaggtcaaggagcacctggaggaggcgggctggactgggaagcccgcggcccgggagatggccgtcatggccgtcgagtcgcatgatgcgatcagcgcaggcgacgctctccgcgtcatgtatggccgtggccttataaatggtgattttgttctcatcagcggtgatacaatcagcaacatgagcttaaaagaggttctccaggaacacaaggacagaaggaaaaacgacccacttgctgttatgactatgattataaagcattcaaaaccttcaatcctgatgcccctggcccgttcgcccactgctgtgactgttatggcgctagcatctgagacaaaggagctactttattatgaggatagggcagatagctcacacctgtgcgtgacaattgataaggatatactggccaataatcctactctccagctgcataataacatggaggattgctatattgatatctgctcgccagacgtccttagtctttttaccgataactttgactatcaacatctccggcgtcattgtgaagggtttacttgttgacgatattatgggatacaaaatctatactcatgaaatacactccagctatgctgcaagaatagataatttcaggagttatgatgctgtgagcaaagatataatacaaagatggacataccctatggtgcctgatgtgttatcctttggtaactgccatgaaatgaaactt

SEQ ID NO: 31133 - DNA, 1430 bp, Triticum aestivum
  Clone ID: PAT_TA_31133
ccacgcgtccgcattctagagctcaccgtccgggagtcttgcttggacctgccactgccattgctactccactgcaaaggcagaagaactagatttttaggttagcccagtatactgtctccctattgtcagacatgcaagactctcagtctgcttttaagaaagaagatccgttgggaatggatgcaatgtcatctgaagaatttgcttcgcagtccaagttgctgcaagaattcaccaatgtcccaagcattgaaagtgcttggcttttcaaaaccaacaatgaagacagatccacagcaatgttttccattagtcagccggacctgctggcaaacaagaagaggaaatatattttgcattcccatatagtgacacatggaaccatgcctctcgagtgtcattggtctcctttcccaattgaaatgaccggagtgtcggctgtcgttccatccccttcggggtcgaagcttctggtggtgcggaacggggagaaaggttcgcgtacgacacttcagattgttaatcaatcacatgtggagaaggagatacatgttgatcagtctatccatggtccactttataccgatgagtggtttcatgggatttcctggaaccatgaagagaccttcatagcatacatcgctgaacagtcgcctcaaccaaaaccaactttcgacaatgctggatatagaaagggaggctcttctgaggaagaactgtatagctggagaggacagggggattgggaagaggactggggtgaaacttactccagaaaggggagaccctcattgtttgttcttgatattgctagtggagaagtacgtgctgctagagacgttacgaaatcaatgagtgttggtcaagttgtttgggctccgccatcttcaagcggtcatcagaagcttttggtcttcgtgggatggttagaacacaacgggtttcagagcaccgctaggaaactcggcatcaagtactgttctaacaggccatgttctctctatgcaattcattccccttttgaagaagaaccaaatgccgataacgcgtcaaatagtggtagtgagtcagtacctgcttcagtagcaacgaacttaaccccaagcataagcagcgctttatttccacggttcagcaaggatggaaaactcctggtgtttctatcttcgaaatgtgcagtagatagtggggcacacaatgccacagattcgctgcatagaatcaactggccttctgactggaaagcagatgaacaactcagcgtggccgatgtggttcctgtcgtaatgtgccctcaagatggatgttttcctggcctatactgctcagccatgctgtctgatccttggctttctgatcattgcacgatggtgttgacatctgcttggagaagtactgaagtcatactgtcaatagatgtgttaagc

SEQ ID NO: 31134 - DNA, 763 bp, Triticum aestivum
  unsure (1)..(763): unsure at all n locations
  Clone ID: PAT_TA_31134
tcgccgacgacgatgacgacggatgtggggtcggaggtggtgtcgggcatctccgagggcagcggcgagtacttcgtccgcgtcggcgtggggtcgccgcccatggagcagtacctggtcgtggactccgggagcgacgtcatctgggtgcagtgccgcccctgcgccgagtgctaccagcaggccgacccgctcttcgaccccgccgcgtcggcgtccttcgccgtcgtgccgtgcggctccggcgtctgcaggacgctgcccggcgggtcctccggatgcgccgactccggagcgtgccggtaccaggtgtcctacggcgacgggtcgttcacccagggcgtgctcgcgatggagacgctcacgttcggggacagcacgccggtgcagggcgtcgcaatcggctgcggccaccgcaaccgcggactcttcgtcggggcggccggcctgctcggcctcggctggggccccatgtcgctcgtcgggcagctgggcggcgctgctggcggcgcgttcagctactgcctcgccagccgcggcgccgacgccggcgccgggtcgctcgtgttcggccgggacgacgccatgccggtgggcgccgtgtgggtgcctctgctgcgcaacgcgcangagccgagcttctactacgtgggcctgacgggcctcggcgtcggcggcgagaggctcccgctgcaggacgggctcttcgacctcatcgaggacggcggcggcggcgtggtgttggacacccgcacggccgtga

SEQ ID NO: 31135 - DNA, 1731 bp, Triticum aestivum
  unsure (1)..(1731): unsure at all n locations
  Clone ID: PAT_TA_31135
gaccccctgtgcctgctgactccaaagtaatgccccatctggctcatactcttggcgcgcttccttacctcccacctcctagcccgcgcaccagcgaggaaccgaaccccatggcaggcggcggcgggaaggtggcatgcgcggcgtggatccggcgccgggaggacaaggccacccgcgtcttcgcggtgcacggccggccctccccgccggccctggaggttctcggcttcgactccgggagctgctcgctctccgaggagcccctggcgaggattgtgctcggggaggacccaggcgacgcgccgctcgccgtcgcggtgcaccccaccggcgacgagctcgtgtgtgccacggccaaggggtgcaggctatttaaactgatttttgaagagttcaccgttcgctttattgaaagtaaagctccagctatcagaatctgttggactgcagaaatgtcttgcctacagcactgatcgtgctgaattcgctatcggtggtgaggatgggcttctaagtagagtccatcggccaagcatgaaggtgctcgctaggttgaacccaacgcccataactctttcagagaccatgggatatcagcttagattcagagtttttagtttcatcgtctactgatggcactgccaagaatttggaagataaatgagggggtaccattggtcaacttgactcgatcttcggacgagaagattgagtgttgccgcttttctagggatggcatgaaaccgttcctgttttgcacagttgcaaaaggtagcaaagctgtgactgttgtttggaacataagtgattggtctagaattgggtacaaaagactactgggaaaacctgcctccacactttcagttagcttggatgggaaatttctggctttaggaaaccaggatggtgatttttgtgttgtggatgtaaaggagatggagatttctcactggagcaagaaggtccatcttggttcccctatatgcggaattgaattttgtcctactgaaagagttgtaatctccacatcgccacagtggggagcagagctgacaagactgaatgtgcctgctgactggaaagaatggcaaatctggctcatactcttggcgctcttccttgcatcagccgtcctgttctacgtattctaccagaactccggttccttctggagcggaacgccccgacgggacgtcatcgacctaccaagccatgcagagttctgaacgacctcctcggtctcctgaaaaccaaaactcctgggtgaaactgttcaccagtatgattccctttcaagcaacccagcactgcagtgttattaatttcattcataccaagacccttttcttactttaatcatgtagtccatgctgtcccaatcccattccgcccccaaccgtctggcggactcatattatcgcgggcacagctatggaacctgacccagaaaatcaaaatggctccaggttgtcggcgagcgtttccccgactttcccgacccccaactgttgtcgcctcctcgtcgctcgttttcccgccggccacttggggtcgggtcatccctgctgatgatgcagcgccataatggctatccagtatatacccagttttaatgcctgtagcactttgaacccgtttaattctgatccttaagatcactgggctgtattggtacaagcctcngtggcngtantggacttctgattggtgccaactagtcatccatga

SEQ ID NO: 31136 - DNA, 1137 bp, Triticum aestivum
  unsure (1)..(1137): unsure at all n locations
  Clone ID: PAT_TA_31136
ttgtcaatgtactgaagcaagcctctacaaacaaagccaacttctgggcagttagtgtcgagatgcacggtggaaaatgcaatttactgctagaaagatggacaagtacattgactaggcagaactcgtacccgcaaggagcgctacaaatctagtcctaccctacatgaagacctatttacagagtgaggcgcacgatcacggacagctcaaaaaagagaaacatgtacactacaaagtacaaaccaaggcggtattcacagaagtggaatttgataatggagaccatcttagcattcgccctcaggtcgacttcagcctgtccagtttgaacttggccagcatggcatggatgtcgtcgagaaagggctggagcagctggacgagcttctcaatctcgaccttgaggaggctgtagctctggttttcccccatgagccagccgacgaagatcgccctctcagggatgagcttcaatgcgatcttgcatgccgcggaagaaatccagccatgccatggcttgagagagaccatgtacgcagcttctacgagctgtgcaagactctgctgatcagaaccctcctccttctcctcctcctccagtctctgtaacagtgcaacagtgaaatccatggatctagtgagccatagaatagctcttgcacagctatcggccttcctcacggtgccgtcgtcagcctctttctcgaccatcgccgtcagaatggagtatttggatgggtcctgcaagtatagctcctgcagcctctcgatgttccgttggacgtcgagccgcagcactgccattgtcggaccaatcttatctgcaagcccgtgcaggcgatgcagtatcagcgacagcaaaggaccacgtccacatggacggaagagcaacaggccaaagatatatgcacagaggcacgtcaagaaaccgatggaaccaaaagaaatgatgaaagaaacggatgccaaatgaacaccaaaacaaatcctcaaccaagagctcgcaggatcagatggaagcatactgctcatttctactcaccgaggagccggaggaggaggtgggagaggccgaggaagggcagcgtgggaggcgaggagcacagcttgccgccgcgccggcnatcggggacc

SEQ ID NO: 31137 - DNA, 1013 bp, Triticum aestivum
  unsure (1)..(1013): unsure at all n locations
  Clone ID: PAT_TA_31137
caaaaaaccccnaatggggatnattgtggnnntttgggggacngattgcaaanactttttaantntcaaagggcaataatnccatgcatttttggnttttcaccaaattttgaaattgnnttaatactatatttggttagtagttttctctgaaactgcggggagatcaaagcccaagatgatggtaagttttctaattctggtaaagggggttgtttagacatgcattggaaagtgtgatattccgtgagaatttttgctaaatataagataatggctgtccagccaagggtaacatgccggctgtgtttggttagcccccgacaggctctgcataactttttggtaaagccacatgtgagaggtacgtcggagcagagagcaaacatagagaagaaaatggcaatcttacactagaatcaacatttgtgaaaataatcttccagcattttaagttgttgtttgggttccactttcaaaacggaatcaaatgggtaaaggagttgaataaaacacaatgtaacgccatcactattgtttttgcaaaccttgttcatagcatggcatccataacagtcatctagcacagcaatggctactataaactgacagggtaaatgggcagcaacaacaacaagcaagagaagaaatatggcttgctaaccacttttgtggtgttcatccctgctacagattcctaacatttgattgtgtacgaatagtaacttggtgctttgtatgagaggcgcattcattcaaattaagaaaaagtatctctatgttttctggcgcccttccacactgcatctacatgaaataagtttactcaaagagatggtaaaaaggagcaatccttaccgcaaacctcagcagcaggcaagacttccccacgcccgagtccccaatgagcagcagcttgaagaggtagtcactgcatagtcacgcaagcatctcatcgcatcgttttgcacatctagacaagctaataatacatgctactaacaagtggaagt

SEQ ID NO: 31138 - DNA, 569 bp, Triticum aestivum
  Clone ID: PAT_TA_31138
tttttttttttttttttttactgttaatccatctggtatatttttaaaatattttttctgatttactcttacataaattacaaaagtatcttgatttctgagatcaagcttgccactattttcatgacacaaagttaatctaacttcatcatgaatgaaataacaccttgccacccgcaaaaaagaagaagacataacacattgccatttaccaccactttctccacttttttcctgtgaactttaaaaacaaaaaggcaaagataatgaaaaatcgcactaaatggcccacacatttttctttgtgaaaaagtgagacacacttcttgccccaaccaggcccggcccaacgaaacctccttagtgccaccacgaaatgtgcacagcccaggtcaccccttcctcccgtttgccgccggcgacgtctcgccgagcacggcggcggccgagtcgacgttggtgaggaggtactcgtagatcttcttcctcagccgttctatcgtctgctcgggcacaccgttggatgcagtggcgggcgctgcggcggcgacctcctcgtcgcccgcgtc

SEQ ID NO: 31139 - DNA, 1342 bp, Triticum aestivum
  Clone ID: PAT_TA_31139
ccagaggaactaaaatttattccattagtaattgtgaattattcgttaacacattaattccattgtacatggaatagaaatttagcgcccgtgttggagcactaaattaaatcacaatgaaggggttactgaaagcagtagattgcgcattacatgagtcatggaaacacaagttactactacttgcataaaaaagcacatacagagactactcatgtatcacctggtggcagtgataaccatacaaggagatagataccaaatcatggaccatttatactaaattacatcacaacaggttgcacataagcaagtcaggggaacacaagttactataatacattcatgcataacaggcacaaccagagactaacctacctgagcgtagattcaatgttaagacacgacgcaaggtaactagacaagcacaaacagagattacgcatcactgaaatttggacctctggtgatagcacccaactatgcatcagctcttcatccgacgcgcaggctcgacttgagaaggtcagccaacaccgaagggcagcttgccgccaggtacttgtacccctccgtcgccaacacagcatcaagaacttcacgatttctaatgatgaactgaacgcacttcgccttgagccgtggacagttgtgctgctcggctagagccagagacgtcgctgcagtgtcaacattgatgccatcagagagcttgccttcgcagatcagcttgagcctgtccagcccgtatctgtcagcagctgcaagcaagtgctgagctaacattgtcacctcctcacccttctcgtcgaattcagacacagtatcagtgtagatatagtgaagcagggccttgaacaccgcagcctccatgtcctcgatcaccacactctgcgagcatttctccttcatgtctccaaagaactgggccatgaaaaccggagacctcgcggccagtatgctcttatgcgcggcaaaggactcgccggacacgaggaacgtgacgtccgccccggcctcgctctgcaggagtagagccaggtgccggcccaagtttgagcatggcaccggcacctcttcgacagggtctgtcaccgtatcaggcagctccttcagaacctcaatggtgcattccatagtgaaggaatcgccccggagaaacgccgatgccgccagcgcgcgccgcccgacgacagccgccttggtcgagcattcctgggggcgactgaacacctttgagatactgatttcattggacggtttgagtatccctctcgggtcgaccagccggcagcctatggccgccctcacgctgccttgcggggcttgctgaggaaggcca

SEQ ID NO: 31140 - DNA, 981 bp, Triticum aestivum
  Clone ID: PAT_TA_31140
gttactcctcgccaaagacgcatgatagagcgaatggtgcaactcaacaagacctgggacaagctcaatgaagattatctggaacgatttggatgtcctgatacacctgtttcaaatcggagttttgtagagaagccatttggttatgcggcttctgatgattcgttgttgacttccagtgttgtctcacttgctttatatgatggagataagatgttatttgcatgttcgggcgtagctttagggcgtaagggaagggcgtatccagtagtatcaagatttgtgacttcaaaacgtttggttacagaatttgagaaaaacagaaacagagctgataatttgaggattaatgtgcgccttcatgacaaagaaagtttcgatgggttcttgggactatatgatagtcatattgctattgtcacgtccttttggttcgcaaatgtacctcctgtagatctgcattcccatattggttggcagaatgatctagtagcttatgggcgagccttcagctcgggtattttgatggccacttctaatgccccaacacagctgctaggtgcagatcatctgatcaagcatgatctgatccctttcccttgtcctgtcacagaggctggacttggagggccagttattaatgaagctggggatgttgtgggattgagcattaaggttgatgtcgacgaggagactacctatttcctacaccgtgtggcgcttcttgcacgcttggaatatttggagaagttaatgccaaactctaccaacttccgtgaatataccttgcctgatggtgtaaacagcatagtcccatcagggtttatggcacatgttaactatttaaaatcatgcggatatcctcagccaccaccacttgtgctcgaagttaatgggagattgcttaatacatttgaagaggattttggtcaattatatggttatgaggactgtgatagcaatttctatgatcgtagctct

SEQ ID NO: 31141 - DNA, 963 bp, Triticum aestivum
  Clone ID: PAT_TA_31141
agtagaacttggcgtataggcctagtagaacttcaccgtaacaggcacttaaagtgcagaacacacacacagaaaacgccaatagcaattaggaagcaatggctaagatagaagagcacggatacgccaaaaaacttctactggtgcactgaggcattttagcaaacacgacgtgtacacacaaacaactgctgaattaaagaagcagagggcgcaatgggttggaaggtgcacggggcaagagtcgcacgcaggcgacgggctggccaggacgcgtgtagctggtagtcggacctcactgtggcagcgctatgagctgagagacagaactcgccacggcagggaaggcttgagctgcgacgacggcttgcttggtaggcatgtctgcaacgggggattagtagggagtttgaatccagctcacctcgcacggtagcggcgaacggctacagctagacacactggactgcgaccaaggagtggagctggagcattcaccgcggcactcggcgaggcccaccggagctgtgatgtagctccctgctcacacgctgtggcaaggtagctggttgccatgccggacgggcgggatttccatgcagaagacgcgctggaggagagctttctcatggcgggatgggaggacgggggtgcgctggagggttgcgcggcaggttgcgtcagaaccaagtgaagttcgggacggaggggagggcatgtcgtgttggagtgaaggggggcgggtggctgctgaggtgattggggcagtgggtcgcagcataggtggtcggcgcggcggagggcggcggaggacgtggtcgggacgaagggtggcaacggaggtggttggggcggaggttgcgcggggcgatctggaagggagccggccagcttgtggtggcggcgaaagcggggaggcaccggtggttggggaggaggcggcgtcatgtgggggcgaggcgg

SEQ ID NO: 31142 - DNA, 1013 bp, Triticum aestivum
  Clone ID: PAT_TA_31142
gttcggcacgagcgaggccaaggacaaacgtgcccaaatagaaggtgtgccacaccgtcaaggcagctccaacttatatcagttcgggcgcaactgggctcgccccttgtccgcgcactcgcccccagagctgggcgccccggtcgccctccccccctgtgcctcggcctcgtgagtcgccgctccctctcgccctcaccgcggcgatgcagactgcgtcacctacatcgccgcccccttcggccgcggcggaggtggggcagcgagagttggaggagaagacgacaaagatgttggaggaggagagggcacggaatgacatgcggggaaggtccatgttggagctccttgtgtctgcttcttagaagtcggagatggacttatccgttgtcctagcactctcccggaggagcacgcgcgccagtcgagctccgctcctgagataaggcctcgtgaacggccagtgcaactcgccttcaaggctgctatacagagtgagagagctagaacggagaaacttgtgacggaggcggcggagaggcagcgggaggtggaggagaggacaagaaagatgttggaggaggagagggcacggaatgacatgcaggcaagggctatgtaccagctccttgtgtctgtgtgcgagaagaccggtcaatccgctccgccgatgccagtgattgctcctgggagcacgcttaactccagaaacgcatcgcacgatccttctccagctaccggcgcgagccagcctgctccttctccagctaccggcgcgagccagcccgctcctacacctttctgatcacggtttcattcacttcacggaagccagcttcctatgatggattgcttgctttttcctgttttttcctttgatgcacttcttgtattctactcgcttgctatgatgaaactttgcatattgtaatatgtatggatcgatggaactatgtgcaacctactatgtatggatggatggatatatatgtgctggatatttattatgttgg

SEQ ID NO: 31143 - DNA, 731 bp, Triticum aestivum
  Clone ID: PAT_TA_31143
ggaggcataaccacccccgattggaacgtagttgaccgcgacgaggaggacgcaacatcaacgggggtgaggcaccgacgaccgtcaccttaattgcggccaagatgggggcgagacgccggccactcgttcgcttctcctccaaccggtgatcgaggtggatgattccaggtgcgggcactaggatctctgctgttggatcgaggtgcgggagattaaactcagtctctaacctcccgatcgagactcagactctgctgttgtatcatgttggatcttgttcggggatgagaccgaggttcgagttcgatcctggccgacggggtgagacgcatgctctctagcctcccgcaggttccactcattcgatcctgctgtcggccatcctccaagcggcgttgggcatcaagttcggcttcaacacccgcaccatccagatacactattgcgagccaactgcccccatcaaattcgtccaaggtcatcctgtctcctctcagatctcgttggtctctccattcttggtgcctgattaagcacaagattattaatagacaccatcgctctgacgggatatatggtattgttggttcgagcgcgtctctcggtctttggttcagtgtcatctatgacaccatcgctcggccgggctatctggtgcgaggaagcgccatcggagaacccagtccgcacgagtagccatggaagcggctggcgggagtgatcgtctg

SEQ ID NO: 31144 - DNA, 1008 bp, Triticum aestivum
  unsure (1)..(1008): unsure at all n locations
  Clone ID: PAT_TA_31144
cccctcccgtggcggcgccgccctcctcgtcttgccccttcgccggcgacgagcatccaaccacctgcgtacgggcctcaggatgcaatctttgctccggaatgtctgccgagccggaaaccgcggggctgcggcgaggctcctggaatttgctgctcctgtagccactcagccgggggctaccccgccatcctcggccatcaaatacctcaggccttgcgggttcactcctccaactgggaattggttcatttcccgtgatggtgttcctgcctcctctggtttctgcgcaaaggttctcatgacgaggagtttgtcgacggtgggaactgttgaggttgcctcggacgaggacgattccagctcccctgcggttgagcaccccccacgcatcaagttcaagaggcccgacaagactgccaggcacattatgaatatcttgaacaaagaggcggttgaaaaggtccgttcggagagggagattcctgatgtgcagcctggatgcatcattcagatgagattgcaagttcctgagaacaaacggcgagagtctacattgaaagggattgtgatagcaaggcgcaatgctgggataaatacaaccttcagattgcgtagattagtagctggtgtgggagtcgagtccgtctttccactttactcaccaaacatcaaagaaatgaagatcttggacaggaagaaagtcaggagagctaagctgtattacctgagagacaggatgaatgcacttaaaaaatgaggctttcggctaggatttttgccagcatggtttctgacggagcgacggttgcagtctgagaatcacacctatttggtcccatctttgtaaagccatagtttgtctgtacttctcatagtgcggatgaggtctcttgcttgccattatttacctagtatttgcctttatcataacaaagctggaatatttgacgcatcaaagtgaaactattattataacatgctcctgccanccnaattaccgttccc

SEQ ID NO: 31145 - DNA, 1999 bp, Triticum aestivum
  Clone ID: PAT_TA_31145
atgtaaaggcccagttgaagaggttatttgacattgatccaagtgaagctctgctcacttctgccaaaactggtcaaggccttagccaggtgttacctgctgttatcgagcgtataccttgcccacctgggaattgtgattcacctgtacgaatgctgctcttagattcatactacgatgaatacaaaggggtgatatgtcatgttgctattgttgatggtgcaatgcgcaagggagataagatttcatcagctgcgactggtcgcacatatgaagtctttgatgttggcattatgcatcctgagcttacccctacgggagtgctttacactggacaagttggatatgttataactggaatgcgttcaactaaagaagcacggattggtgatactcttcatcaggctaagataatcgttgaaccatttcctggtttcaagcctgtgagacacatggtcttctctggtgtatacccagctgatggttctgactttgaggctcttagccatgcaattgagaattctacatgtaatgatatacttgtgtctgttacaaaagagacaagcactgcacttggcatgggcttcagatgtggtttcctagaattgctgcacatggatgtgtttcatcaacggcttgaacaagaatatggagctcaagtcatatccaccataccaactgtaccatatatctttgaatatggcgatgaaagcaaagtgcaaattgagaaccctgcggccttgtctttcaatgctggaaaacgtataacggcctgctgggagccaacagtcattgcaacaattattattcctagtgagtatgttgggcctgtaattatgctttgttcggaaaggaggggtgaacagcaagaatatacattcattgatgctaatagagctttattgaagtaccgattacctttgagggagatcattgtggacttctacaatgagttgaaaagcataacatctggctatgctacttttgactgggcggcccccgcgtcccaaaaatctgatcttgttaagatggatattctacttaacggccagcctgttgatgctatggctactataatccataaccaaaaagctcagaaggttggaagagaattagtggacaagctgaagaaatttatagaaaggcaaatgtttgagatcactatacaagcagcaattggttcaaaggttattgcaagggaaactctgtcagcaatgagaaagaatgttctggccaagtgctatggtggtgatatcacccgcaaaaagaagttgctagagaagcagatgcggcgcgaggagcgcatgaaacgtgtcggatccgttgacatcccccaagaagcgttccatgagctactaaaggtctccagttcaaagtagacgagctgtactttagtgtcgtagcctcgtgtagtcatcttccttcctgaaaggccttcatcccttgttcaccgagtacatactgacgttttgtgctgagcagcgtagcaccactgctgtcgatgctcctgtgcccgagggttaaaccgccggtccataggggtcctgcggtgctgcgaaccttggtgttccaggatgttttggtggtgctaaaacatggactcgcaccggtgttccaggatgttttggtggtgctaaaacatggactcgcaccctggtgtgagaagaaaaaaaaacccgtactgccacaccctgttaagctagtcttgctggaaagcggacagcatacggtggcggcgcttgcttgtttcgtactttcatagttgccacgatcatatacgcagaatgttgtgcctcactgcactatatttttttggaggaaaagcgccgaagaattctacaagtagagttatacttggttttgttttggagacgtttttccattgttctccgttgtattcttctgaaaaaaacatacactctggaataagtgaaactgccccaaggttctgtacctgcattcccccactatctattggacaattaatttgattttcttg

SEQ ID NO: 31146 - DNA, 889 bp, Triticum aestivum
  Clone ID: PAT_TA_31146
cgattgcaatcgcgccgctacactggatgttgctgaaggccagctcctccggtcccctctcgtgctcgcgccttcctccctctcaactgagagtgagtctttatgcagaccacgctgcactgttcgtagccccaacagcaagagatattgaggtcacaaggcaaattccatgtgcttttggtgatgctagtggtcttcgggccaacctggccaagagtggaatatacccaattgggtgcttgaacatctctcgccccatcatcctgcagcagtttcccatacctgtgtgcaattccgctgcaaatacttgggcctacctctgcacttcaagaaaattacaatagctgacctgcaaccgattttggataagatagcatctaagctccaggtttggcgaggtaagcttatgtccagcgatgccaggctgcggttactcaactcagtcctgtcagccatacccacatacctcatctcgctcaccaaaggtcgatgtcggggctgcaccgcatcaacactcttccccagctatgccagttcaccaagctatggtccttgattcaataattccagctgcagcccaactcttcggacttgatcagctggaatgactccattaccggctcctactccgttcgttctgcatatctgactcagttttgtggatcctagtgcaacatcaacttcagcaggctttggaaatcaaaggttgagcctcaatgccgctcttcggctggctcatgcttcggggcaggatcctaaccaacgacaacctctctctcagcaacattcagtacaacgttgacatgtgcagcctgtgtgaccaggaggagacgccgctgcacctcatcctcaagtgttcatatgctaaccaggtctggttcctcgttgc

SEQ ID NO: 31147 - DNA, 647 bp, Triticum aestivum
  Clone ID: PAT_TA_31147
catggcatggcattgcagagtacgcgtacacgctcaaggtggacgagaagagcgacgtgtacagcttcggcgtggtcttgctggagctcatcacggggcaccgcccggtgggcccgcacctgggagaggacggcagcctggacctggtgcagtgggtgcgcgcccgggtggacgccgtcggccatggtggcggagtggaggcggttctggacccgcggctgggcggcgacgtgccggcgtgggaggcggcgcaggcgctgttcgtggggatgctgtgcgtgcaggagcagagcgtggagcgccccaccatgcgcgaggtcgtccacatgctccagcaggccaagctgccgcctccgtctcttgtgctcgaccctcgaggccgcgccatgcctatgcctcctgctgctgctgctgctcgtgtccacgtcgtccacgacgacgaggaggctgctgccggaggaggatcggacagtgaatgtgaaggccgatgaatggatgaatggatgatcgcacgagctgtgatggggacgggacgtcacctcgccggtcggcttggaccaggaccagctccggctccggctccggccatatgtattcatgcatgcatgcatgcccctgtaccgtacgatgaggatgcatgcatgccc

SEQ ID NO: 31148 - DNA, 759 bp, Triticum aestivum
  unsure (1)..(759): unsure at all n locations
  Clone ID: PAT_TA_31148
gccggctcgagggcggccgggccggngaattgcccgaccaaccaaagctcccaatccacgccgccgccgccgccgctgccgacgaaacaggtcataattctcggcgaccggcgaacgagggcaagatgcagatcttcgtgaagacgctgacggggaagacgatcacgctggaggtggagtcgtcggacacgatcgacaacgtcaaggccaagatccaggacgaggaggggatcccgccggaccagcagcggctcatcttcgccgggaagcagctggaggacgggcgcacgctggccgactacaacatccagaaggagtcgacgctgcacctggtcctccgcctgcgcggcggcgccaagaagcgcaagaagaagacctactcgacgcccaagaaggtcaagcacgagcgcgagaagaccccgctcgccgtgctcggctactacagggtggacgacgccacgggcaaggtggagaggctgcgcaaggagtgccccaacccggactgcggcggcggcaccttcatggcggcgcacgccgaccgccactcacgcgcccagtgcggcctcacctacgcctacgcagaggcccagagcccagagatcgacagtgattgatcaggtggtctgattcgatgacggagttgattagcgccatgaattccgtgtacgtctggtaatgattttttcaatggatatttgtggttagaacattattctggatatttttcctcattagtcatcagtaagcatgttttggtcc

SEQ ID NO: 31149 - DNA, 1313 bp, Triticum aestivum
  Clone ID: PAT_TA_31149
gacgtcgcccccgagttctgtctccgggcgcctctccctcctcgccagctcttctgctctgaagaaaacgaacgcgcgatggacctcctcctcccgctcctcagcccctcctccctcccgtcgctcgcctccccctgcgaccgctacgcgcaccggtccagcgcggcctactacccctgcgccgccagcctcgccgccgctgcctgcgggggcggcccgccggccctgtccggcaacggcggctgccgcgccgcgggggccgcggccctggtcggccgccgcgtcggcctccgggcccccgccccggggcgccgcacggcccacgagatccgcggctcccccgggataagcagcgttgacacggaccgcacgaggacgaaggccaacggcacggatctggtcatccgcgaggcggcggccgcagcccagggccctcgggctcgggcagcgggcctcgccaaacatggccccgtctacgaagaacacaagagggtccagtgcgagtacaagggcaagagcctctacgctgcgggtggagcagaggagccgcgcgcccaacgagctggccgtcacgatcctctaccagggcggccagaccgacatcgtcgccgtcgacgtcgcgcaggtcggatcgtcgtcgagctggaggtccctgacgcgtgaccacgggccgacgtggagcacgagcctggcgccgccggggccgctgcagctcagggcggtggtgaccggcgggtacgacgggaagtgggtgtgggccgaccgggaggtcctgccgcgccagtggcgcgccggcgaggtctacgacaccggcgtgcagatcaccgacatcgcccaagaagcctgcttcccctgcgacacgcaggagtggagttgaccgccgacgaggcaagcagagagccaagaggaagagctaagctcccaaaatcgtgggctgggcgtcgaaccaacggtcagaggctcctcgtcaccgccggtgccactttcggctgggcatggaattggaaggatagatagagattagtaactgacgcagcggcacgtagagccctcgttgcttatccaactcttgtggacaaacttgcatgagctgcagctgacgtgtgagatactacttgtatgtacagtagcaaccatgaagcgataatgggtagcggacggcggcgaggccgtggcctgaatccccggacaaaatacaaaatccggtgacttttctcctataagaactaggaacgagcccacgtatgcatcacagcacaaggccacaccacaccagagatgattagtttagtctaacagttaacaccagatga

SEQ ID NO: 31150 - DNA, 773 bp, Triticum aestivum
  unsure (1)..(773): unsure at all n locations
  Clone ID: PAT_TA_31150
cgcccggtccggcctcccccagtcgagtcgacgcgccgccgccccggtccacggcctcctcctccgcctccaaaggaaaatcacccgcacgcacgcacgcgcacttccacgaccttccccccactttccccgcccccctccgccagtccaccgccgatgccgccggcctcgccgcccacctgacgccatgccgccccactaccgccggatcctcttctcggacgactgcgatccttggtacggctgccccacgcctcccgcccctcccttcttcaccccttccccatccccctcgccttcctctccgccgccgatcatatcgcctcctcctcctccttcgccttccttttctttctatttcccttcccccccggaccttgctccgtccccttcgcccgtccatgacggcggcggtggttggagtgaccagggaggaggaacttacgggtacggcgccgtcgatgaccgccgccgccgcttcgtcacctacgtcctctgcgccgccgcggcgctcgcgttcctctccctcatcctcctcggcgcctcgatcgccgtccgtcgtcggcagctgcggcggcggcgggaggcgctcctcgcccagccgccggccgccgcgaccaacgtcgggaacgacgacccggagggcggcggcagcggcggcgtggtgcaccacgtctggtacantccgaccgtcgggctcgacgaggcggcgatcgactcgatcgcggtgacgcggtaccgcgcggggtctgggctcctcggcgccgccgact

SEQ ID NO: 31151 - DNA, 644 bp, Triticum aestivum
  Clone ID: PAT_TA_31151
cggacgcgtgggcggacgcgtgggcggacgcgtgggtagctttgctctagcagccacgccgtcgaatccgctgtgggagaggctgtgacggcgagcagccacgccagaggacacccctgtggttgtgctctgcgtgtcgcgtcggacctggcaaccgcggagggcgccgttggccaccgggccttgtgcgagcagcacttacaggggtgccccgctcgggccggccgctgtggttgtgtgcagaggctccgacagtcggtcgccgcggacgcgcgttcgagggctggggagccttgcctgacgtcaccgccttgcttcagcaccgggctgaaccatgcaccgcgcagccgccgtgcggaggggtgccgaccgctgcgctatgagcggccatggcgtgtggagatgggccgggcgctgccgcaagctgggcatcgttggctgtaagccaccgccgtcgcctctgccgttggcgagaaatcgcgattctggcccgggggaagcagcgatggaacgccgtgcgacgccgcactgctgctactgtgcgtaggcacaccgtaactgagggccatgacggcgttgagactcaaggccggccgtcgcagaggagggcaccgtgcgccggggctatttcgccggctctgttc

SEQ ID NO: 31152 - DNA, 752 bp, Triticum aestivum
  Clone ID: PAT_TA_31152
cgctcgagcgcgggcgggaccactcggtccaactctccctcagaagcatccgagcgacaatatggtgtcctcacgcgtcctcctcctcgtcgtcgcgatcctcctgtgcatggcttctgtccaggcaagtggccaaagcctgacgcctccagcggaaggggcaccagcaccggcaccatctgcctgcggtggcgatcactgcacattgagcgacatagtcaagctcgaagtgtgcctcgacctccagctgggaaggatgagcccgggcgccaaggaccggtgctgtcggcgtatacgtgcgatgccgaacgccgccggctgtctgagagtcgcgttcatccgggccgatcttcgtttccacgccaatatcgacaaccgcgtcaatgccgtgctcactgcctgcggcacggctacggtcttagaccgcgcttgtcttgtacccttatttgggagacgtcacctcggcctcgctggtgaccctcagtgagtgcaggaatgcggctgaggctgagaggtgcattagcacacgtcacctactaaatatacgtgctgcctaaataaatctttcatactagtatgtaccggtttcgacctagcttatccatcgatgcacacgtgtatcatagctgctgctgctactggtggtcgtctaaataagttgtggcatctacctgctattgttaatgatgtgttcgcgtccccttttgtatgagtgaattgcaaaataaaaaaaataactaccacattttaat

SEQ ID NO: 31153 - DNA, 703 bp, Triticum aestivum
  unsure (1)..(703): unsure at all n locations
  Clone ID: PAT_TA_31153
aaccacaccggcccaactcatccactcaagcagcatctgcgataatagccaccaccaacctggaaaccatggtgtcctcccccgtcctcctcctcgccaccatcctcctggccgtggcgtctgtccgcgcaagtggccagggcctgccgcctccaccggcaacggctccagcaccatccgcctgtggaggcgaccattgcccgttgagcgacgtggtcaagctcgacgtgtgcgtcgacctccagctgggaaggatgggcctggccaacaaagagcgatgctgccggcagatacgtgggatgccgaacgccgccgactgtctgagcgtcaccttaagccgggcacatgtccgtgttcgcgcaaacatcgccgacgaagtcaatgccgtgctcactgcctgcggcgtggctcgcgtcttcgacctcgcttgtatcatcatattttgatggtgcaggagcaggaatgcggctgagaggtgcattagcacacgttacctactaaatatacgtgatgcctaaataaatctgtcatgctagtatgtactggtttcgacctagcttatccatcgatgcacacgtgtatcatggctgctggctgctgctactgctggtcgtctaaataagttgtggtatctacctgctattgtaagtgatgtgttcgctggcccttttctttggtctgaccaaaaaaaaaaaaaaaaana

SEQ ID NO: 31154 - DNA, 736 bp, Triticum aestivum
  Clone ID: PAT_TA_31154
gccggccgggtcgggctatagacatcgactcatccactgaagcagcatctcggacaatagccaccaccaacccggaaaccatggtgtcctcccgcatccttctcctcgccaccatcctcctggccgtggcttctgtccgagcaagtggccaggacctgccgcctccaccggcaacggcaccagcaccatccgcctgtggaggcgaccattgctcgttggacgacgtagtcaagctcgacgtgtgcgtcgacctccagctgggaaggatgggcctggccaacaaagaccgatgctgccggcagatacgtgggatgccgaacgctgccgactgtctgagcgtcgccttcagtcgggctgatcttcgtatccgcttcaatatcggcaaccacgtcaatgccgtgctcactgcctgcggcgtggctcacgtcttagaccacgtttgtgtcgcaatacattgatggtgctggtcgtctcggcctcgctggtgaccctcagtgagcgcaggaatgcggctgagaggtgcattagcatacgtcacctactaaatatatgtgctgcctaaataaatctgtcatactagtatgtactggtttcgacctagcttatccatcgaagcacgcgtgtatcatggctgctgctactggtggtcgtctaaataacttgtggtatctacctgctattgtaagtgatgtgttggcttgcccttctctttggtctgatcatgatttatgaaaaa

SEQ ID NO: 31155 - DNA, 475 bp, Triticum aestivum
  unsure (1)..(475): unsure at all n locations
  Clone ID: PAT_TA_31155
atttgccaggctgacccacgcgtccgcccacgcgtccgcccacgcgtccggaaacgttctactcttgtttgctggtcatgttcttctgcacggaagcggactattgatcctgcaaaacatactcggtacattacaaatcaaactgatgttgatgtgaaaactgaaaaaaacgacactgaagcggctggatgcagagttagtcccaattccttttggggagtttaaaccttcgaaccatttagataatgaaagataccgacaaggaggacatcaatcacctcccggaaaatttcaagcgaaagccaagtcaagaatcccttacaccaacaagcaatggggccgtcaacgtcaaccttctggaaattccctcccaactatacctcccaggaagatactgcacatggttcattgccaactgcaagaaganccaacacaaagtgacaaggtaccagaagagttgtcaccctgtncgaaa

SEQ ID NO: 31156 - DNA, 425 bp, Triticum aestivum
  Clone ID: PAT_TA_31156
cgggttacgtcaatctattactaacacttattaccaagttgcacttgcttttcaaaagaaattgaaactataacgcctgagactatccaatagaagaaagagccacaagcaagccatagcagcatcctttttcttcgctttcttcaacaatttatctacctcactcctcatcataactcaaatgctcgtcttgactctatcatatcttccttgcatatgcatcacatcataatttcaagctttatcagatggagtgaagagtacacttttagtggtcctcttagtgagttggtttatgtcaaacaacctcccggttttgaaaaaccccgatacatttaacaactccatgaggcgctctatggactcaaacaagcatctggtgcttggtatgatcaccttaagacgtatctaaacgagaagggggt

SEQ ID NO: 31157 - DNA, 591 bp, Triticum aestivum
  Clone ID: PAT_TA_31157
cccacgcgtccggcattatctcgacattcatgtatcaagactcccgagaacagtgccgagaagaggaacgtggtgtgggagccatccaaggatttgaagcacctgaacttgagggtgctgctgatccaagggtgcgaggatgaagacaaggtgactaactatgcaaggctagtcatggaacgagctgtggggctgaagagaatcctcttgtgtgatcaactcccatgcgaggactgcaatgccatcaacccagagccttccctgagaagatcccaggttgatgaagctagcaggcatcggattaaggagcgactcacacgtggatcctcctcttccgtggacataataatctgttgatgggtatagtcatggaatggtcaatcgcacaacgcctgcagctgctagagtgatgactctgtatgaggcggagtcggtcgtaatcttaacttttagttatctgtaatgaggaaatacttaattcgcagtttaggttaattatgtgtgcactgcaatcttgatgcatgcttttcgttatcaatgtactgggaaattgcctagtgtatgctgatctgtttacctactgtgggcatc

SEQ ID NO: 31158 - DNA, 260 bp, Triticum aestivum
  Clone ID: PAT_TA_31158
cccacgcgtccgcccacgcgtccgactagaggagccactctgttggtgttcactggattagtgcagtttttgtgcagtcgaatggcatgatggcactagtcagtacttagtcactagtgtgaatcctgtatgatttgtgctcctcccaaagtcgcgaagtcgatggcactagcttagtctgtgtcgtagggaagagacgcgaggagtttcctactacttcctctgttccgaaatgtaagtcgtttaagggtttgacgtgt

SEQ ID NO: 31159 - DNA, 1117 bp, Triticum aestivum
  unsure (1)..(1117): unsure at all n locations
  Clone ID: PAT_TA_31159
ccacgcgtccgccgccggttcccgctcccgtccggccacgtcgccgtccgacgccaccaccgccggctctggatagagcatgccgacaccgtgtccggcgtcgccgcgtccacggacggccgcctcctctcctccgtctcctgggacaagacgctcaaggtctgggccatcccgtccctccgctgcttgcagtccttgccggcgcacgacgatgccgtcaacgcggtcgccgtcgcccccgacggcacggtgtacaccggctccgccgacaggcgcgttcgtgtctgggcgcccaggcccgcgtccgacaagaccaccaagcgtcagagcaagaagccggtttactacctggcggccaccctctcccgccacacggcggcggtgaacgccgtggccgtcgggtgcggggggcaggtgctctactccggcggcaacgatcgctgcgtggtggtgtgggagcgggaggacagcgcgagccacatggtcgcgatcggggcgcttcgggggcaccgcaaggcggtgctctccatcgcgagcacggggggcgggctggttgtgagcgggtcggcggatcacacggttcgggcctggcggcgcgagacggacggacgtggccacacgtgcgtcgccgtgatcgacgggcacggcagcgccgtccgttcggtggcggtggctctcgttccgggcaagaagcagctgcaggggggagaagacggcgatgacggcggcgaggaatggagggtgtgcagcgccagctttgacggcgaggtgcgggtctggtcgttgcgggtgacgacgggtttgtagtaggttggatttgctacgatttttgacgttggaaagagtgttttcctgatttttgatctgatcttgatagctgagatagagatacgtacggtcgtgtacatacaggaaagaggtaatttatctacctgtattttttggacttcggcgaacttcttgtggtgaatccaatgcaagtcgcctgattcttccatggcacatatgaaattataaaacaaaaccccccacgggattccccactcaaaccggatgaacttaaaccaatcctgatcnatgctatattccataaatgtttgtgtngaaaaaaaaaaaa

SEQ ID NO: 31160 - DNA, 701 bp, Triticum aestivum
  unsure (1)..(701): unsure at all n locations
  Clone ID: PAT_TA_31160
ccgagacaacgccgccgcgtccgcggcggcggcggaggcggaggcgagcaccggcaagtacgcgcactcaaactcgttctccggcaacctccggttcccgcgtcagaagcggtgcgcggcgagctgcccgtcgtcgatgcggtcgtcgccgaaccactccgggatgctctccttcggcggagcaggcggagtcggcttccccgacgtgccggccgcagcagcggcggccatgacaagcagcattggcatgcggcccgtgtcgctgtcggcggcgtcgtcgtcttcgatggaggagctccagagcgccatcgagggcgccatcgcgcactgcaagaacacaatgggcggcgtcgtgtccctgtgcccgcgcaaggtgccggcgtcggcggcggccggcgagatcaccgcgttctgagcgcgcgggtgcatgcatgcatgcactaggattcgtgcgaggagctgagtaaggctgattaatcagtggtatccatccatgtgttaatttttgttcgtttaattagctttgtgtcctttgggcaagactttaagatgatgttggtaaataagggtagttcgaaggggtaaaatgagactctaatcctccttctttggactctttctccgcagtgtgaattgctcgtgtccccaaatatgccncaaaactaatcataaatcatcaagaagattaaagtnaaanaaaa

SEQ ID NO: 31161 - DNA, 397 bp, Triticum aestivum
  Clone ID: PAT_TA_31161
cccacgcgtccgcccacgcgtccggcaccgtgtctcgaatcgtggcagcgattttgctgtctcccttcatttgtacactcctcccaacgtagccaagaaagggtgccatatttttgatgagaatacaggacgaagaagccatgtgcctggttgccactactactcagcatatgggcggctactcaaagaatagttgatgagtgtacggtttggatagtggaacatgttatgagaaacgaccttgacttgatgttgtctgctggtggttcatccagattgtttttcagtaaccaggtaatgatagttgatatgggggagagcatctttggtgagcaggcatttgcgttagtagtatagcgttgtatagcataatctagaatggacagccttgaacttg

SEQ ID NO: 31162 - DNA, 1180 bp, Triticum aestivum
  Clone ID: PAT_TA_31162
gtccgtgatcatgttatgataaacaaccgtgctgtacgagttcataagtttcatgcaaagggtgcttctgggttgagtaatgttcttcaaaatcagcagatactgaattatggtcagcacagtaggtttcaaggagacttcttgcctagtcaaggacttgaatcaaaggagagattctgttctttccagcaagcaactgatgcttcagtggatatgtcaagatttctgcagggtcagacttccaatgatgttagccatcaaatagtcacccaacaaattacaccatatgatccaagccaaggaactttcttacctcgaccaagaatcacacagctacgtataccaaatattgaaagaacagattttggtccagatgctgaaacttctgctattgctcattacaacattcaggcaggtcaggttgttatgcaatttggtcagcatggacagaaccattctcatttctctgaacaatcatacagtagcttccctgtcggtagtttaacgtctatggatacagccatggattctatgcagcctcactcccagcttacaagcaacagggagagtttcagcaagcaacctgacctactatgcaatggccaaacactacatcaatcaaatcaagtttttgctggcttacagccatcaagaacaaacagctttgactcggtggaaaatgatcagctcatacaacgcttcatttttcagttttttagcagtgaaggggcagcgacacctttgtcgccacgtaagtgggttaagatcaaggcagcattgaagctagcatctgtagggcgactctccagagcctcgagaaggggtctgcatagtcccccgggaagggcaaggctggtaccaacaacatgaccctgctgaatagtgtggataacagttgtgacagaacaatgtgcggatcaaggatccatcttgatgtttgtactccataatattgatgaagtatataatctaataatctagttagttaaaaatagcagtattgtgacagaacaatgtgtggagcttgtattctgatctgttagcaacagtatacacaagtaaatttatctggatcttagttgtgacagaacaatgtgtggagcttgtattgtgatttgttagcaacagatatataaataaatatttctatatcttagttattaaaaaaaaaaaaaaaaaa

SEQ ID NO: 31163 - DNA, 426 bp, Triticum aestivum
  unsure (1)..(426): unsure at all n locations
  Clone ID: PAT_TA_31163
cccacgcgtccgcgagagcagagagctagtagctttgagccgcgcgagcgagggagagagatgaaggggggagaggcgccggcggcgacggtggtggtgggggaggagcactgcgagacggaggacagggagctgacggtgcgcaagaccacgctcttctcgccgggggacgggctggaggcctacgaccaccgcacgggcgcgctggccttccgcctcgagacctacggccggggaggcgcctgcggcgggggcgcggcggccggggacctggcgctgctgggcgccgcgggggaccccgtgctcaccgtccgcaggcgccgccccagcctgcaccaccgctgggacggcttcctgggcgacgggggcggcgccaagccgctcttctccgcgcgccgctcctccatcctcggcgccgnggccnng

SEQ ID NO: 31164 - DNA, 835 bp, Triticum aestivum
  unsure (1)..(835): unsure at all n locations
  Clone ID: PAT_TA_31164
ttntgcaggcaacgggtgagtagctatngctcaatcggtgtacagggagttgcctaatatggctcataactgtgttaacgtttcactaagattagaaaactatccccagtcaggttgataaattctctttacaggagaataaaaaggtacagactcaacttgtaaagaggaatgaaaattcatttatatcaaggcccaacacaggctgcagtcgtccatccagcagaggcttcaataacagccatcgctctacctccttttcaagccacagagtttcttctgtagatcaacaacctatttcagagaactcagaattaatgcaatcatcgcacaatttctggcagcatattaatcagttccaggcagagggtacgtaagacgccaattaagatgtgcacacccatttctattatgatacaaaacaactttttggtcacttcctcctgtggagatgtattcatcattgggggctacagcaacagcgttggcacatcgattatgagtgacgatatgtctgacacaaggcttgcctagagtaacatcccacattccaacgctgccatcaccgcttgcagtaacaaggacaggttgattatgcaaccactgtgtggcgtttaccccctgatcaccctcgtcgacatgacctggtagttggctcgtatattctgcagttggcatctgcttgccatggctcaagcaatgcaaaggccggaaaaaacgccccactttgcttcgcaaagcatccctggtgtgacttagtggaactagtcttgtatcccaaaccaaagtgttattgagtgctagagcagaaaaataggtacccgacccggccggc

SEQ ID NO: 31165 - DNA, 916 bp, Triticum aestivum
  unsure (1)..(916): unsure at all n locations
  Clone ID: PAT_TA_31165
gaatataactgctaacattaatttttgcagcttccccttttggaaatgctgaaacagtacatgttaacactgaaggaaaaggaagaagagagatgcaggcaacgggtgagtagctattgctcaatcggtgttacagtgagttgcctaatatggctcataactgtgttaatgtttcactaggattagaaaactatcaccagtcaggttgataaattctctttacaggagaataaaaaggtacagactcaacttgttaagaggaatgaaaacttgaaacgcgcggagcgtgctagaattatagctaacaaaacttccaggcttggtagagcttctaattgctaagacacctttctgggaacatgggagtaaaaagatcttctactacgatgagcttccccttttggaaatgctgaaacagtacatgttaacactgaaggaaaaggaagaagagagatgcaggcaacgggagaatacaatggtacagactcaacttgttaagaggaatgaaaattcatttatatcaaggcccaacacaggctgcagtcgtccatccagcagaggcttcaataccagccatcgctctacctccttttcaagccacagagtttcttctgtagatcaacaacctatttcagacaactcagctgaaaaagatatgcatataagaaaagttagggacagaagtatgcagagtaaggtggggaataacagaagctgtacagtccatgatgaagataaaacatcaggggtctccacaaaacaaggcctttcatcaatttaattatccctttctttcctggtctcattagatgtngaaattaacaatactactccaaagctattgcagaagtggttcagtagattcatatgtattgatacaacattcatgtatttattattataccccgagtaaagc

SEQ ID NO: 31166 - DNA, 764 bp, Triticum aestivum
  Clone ID: PAT_TA_31166
agacaagaatacaagaacatcttcctgcacctctattctctattcttgttctgggttgatctctgttcttaattgcacttgaagtagaaccagacaacataacatatttcgcgtttctttgctgcatttcgcgtttgaactcgcaatcatcggttttgagattacaagcgacaggtatcacacacatttggggcgttgatcgggtaacacattattggcgactaggatcaaaattcagctcggggtctcggcaccgtcacagcggcagcacagagctccgggcacggcagtgccgcgcgaagaaggacctcgggagaccgccgggcgcgggcctctcggtgctcggatggccggtcgcaccgctttgatgcttctctctgccattccgctcctccccttcgggggccgcgtcaggcagccggtccagcgcggccacgtctgccgccgttgagaccatcgccgcgttcatcgacgccgcgcgccgcacattccgcggcagcgggcccgggagctgcggcaatggctctggctctggcgaattgggttgctgctgctcgtgctgttcttcttccacgcgcggcgcttcctggtcctcctcgtcgtcttcatgctccagcgttgaatcgctcccggcagccgcttgctcggctgcggcgttggcgttcacatctggatcagccgatgggttcgagtcggactcgatgccggctccggcggtcgtggcggcggggtcgatcacgtcggagcggcagagcgggcagtta

SEQ ID NO: 31167 - DNA, 971 bp, Triticum aestivum
  Clone ID: PAT_TA_31167
aggtcccaaaaatccgcaccggatcacttggatatataggaggttgaataaccacacaaagcttctaaataggtattcaactaaactgtacatatatgatgaatacaatgattacagaaatcgagctaaagaaagcagacagtatgaaatgcatcacacacgatgaacaaccatcgaacaccgaaaaaaacaagatctgaaacagattcagacaaattgatggatcttaaacagcttcagaaccaaataccttctgaacaaacggcatgggttagccaatctaacttatagatgaatattcacagccaaaagcaacaacactgctgaattaccgaaatcatcactaggcttctgctcttcgagctgatcctgttgatggcacatcaacagaacaaagtcatacagcttctggatgctaaggtgctagcaaacagaagcagatgcactctcttcccgtgatctgtacaacaactattctgtacatcaatgatcagtcactgctacaacaagtccagttggtcactgtccatgtcctccttcgcaagcttctcaatcaacagctccattgtcctgatgtacttgggcatgtaatgttcccctaccatggacctccccagacgaatcttgctgtagagatgtcgaggtgtctcgtacagggtgacaacctcctcctggctaccttgctcacttgtgttggactcttctgcagctggcaatgcaaccatgtgcagtattcttcctggagggtatagctggaggggatcttcagaagggcttgacgatgacggctccatctgcttgttggttaaggattctctgacctgtccttcgcttgaacttttcagaggtgatttgatgtcctccttgtcggtatcttcattatctaatggttgaaggtttaactccccaaaagaaattgagactaactctgcatcagccgcttcagtgtcgtttttttcagttttcacatc

SEQ ID NO: 31168 - DNA, 1076 bp, Triticum aestivum
  Clone ID: PAT_TA_31168
tacgacgggtgatctgttcaggagcccgtctgttgttgctgttgacctcaggcaagaaatggtggactacattacacaaagaagtgaaacgttcatagctgatactctcattgaatcggaggtggaacaaaacgctgacaatcaaatgccagatgacccttatgaggtcatatcaatcttcatggatgatttcagtcgcacgaaaaggaacatcattggccatgtctctgggtggttgttgagcgacagccgcgaagataagatcgatgattttgtccaggaaatggatatgacccgcttctggccactagaaaggagagaagggatcgccgaggtcctcctcaagaatgtggacattaaaactaagtttccactgccctgagaaatatgaaaacgaggaacgtcttgctgatcacaaagcacagtgtagcttcaggcctgtcacttgcccaaacgagggatgccgagcaaaagtctctgttcgttgcatgcaggatcatgatgcaacttgccttttcaagatccttcagtgtgagcaaaactgtgagaaacggcttctgcggcgtgatatggatagacattgtgtcactgtctgccccatgaggcccatgaagtgccctttcgggtgtgatgattcgttcagtgaacacgacctcgaggagcactgttcagagagtctccagcaacacttgcttaaggtccttcaggtgattcacaagaataattttacagctgatgagctaaaggaaactgctctacgactggagaagtctgaagatcgtggtaaactggctaaagctcgggatgcaagatctcttgctactattgtgaaggatcttgaagcaaagcaatttcaatgttctggtgtagtatctcatataaaccttggtggttgacacgtgaggtgtggagatggagataaccacaggataacaccgtacatggagatggagatcaccatgggaccgccgtgtacatagagatgaagtttatcatcggttgccaaaaaggggctataccgtatcatacttgtataaactgtttgtaaagtttatcccttatatatatatgcaccc

SEQ ID NO: 31169 - DNA, 1308 bp, Triticum aestivum
  unsure (1)..(1308): unsure at all n locations
  Clone ID: PAT_TA_31169
tggatccgacacggactgataatgtttgttacaaacactttcacaccacaaggggcaaaagagaacattttcaatctgttacaaacactttcacaccaaagggaagaagagaacattttcaatccaaatcaagagttcatgagttcaaaggggggaagaaaatatcatgtaaatgaaaattcatagataagacaccaaattccagcagagcgccatatagttagattcaataacaactagaccaagtacataaccatcgagccatcccaaacagctccagagtccagacaacaatgaggaaagataactatcatttacccatcgcaaataactccaggcaacaacaaaaatggtaactacagcgccaacagtgcttcgacttttgcaatctgctcttcttcagtcatcggagctggggtactgttcgtctcatcataaaggtcatgcttccatttttctgtctgatgatcaccggtctcctcgtgcatgttgcttcttccaccatactggtagtcaaacctgtctctgccccttccccctctgccagcaaaacgccctcttggatcatagccatttctctgaccaacactccggtaatcagaatatcccctcctggtatctcgatcatcaggccttatgaattcccgtgaatggtagtttatcctttcttctcccattccagaggtccacccaggttgatcaggtatacgtgatcttgaattcggttctgtaacagcatgagctgattcttgcccctccagtggcattctcatctcctttaaatcctngacctccttttgtgcaaccnggagcctcttacctcgcaacttngaaaaacccnatcggtgcttcccatagtgagaatccaacatcactcgtgttngttagaggctcgccccaaacttttcctcgcaaacccatagtccctccatacttggtgtctcatctctctcaccgcggtgctccttgccccggtgcggcccgctccgaaaatctgaatttccccgctggcccgcccataggcggcgggggnaagcaatgcngacagtccggggccccaattaccgcccntcataagttggagtcagtgatttacaaattnctactcgggccngtccgttttttacnaacngtccgtggactnggggnaaaaaccctngggcggtttaccccaaactttaaatgcggccttttgcnagcnacgattcccccctttttccgccnagctnggggcgtgaantaagcngaaagaaggccccgctacccgntnccgccctttcccccaaccaagttagcgccnccttggaa

SEQ ID NO: 31170 - DNA, 1149 bp, Triticum aestivum
  Clone ID: PAT_TA_31170
taggggcctttttttttttttttttcgattttttggtagtaaatttattttatctgaaaactcgtgttacgtacttgtacaagataacatctgtgtacacacagtagcactattcaattctcaaagagaaaaaagaaaagacattatttttttctgccaccctctcaatgaatgaactaatgtatgcctcactgtttcttcgacaaattaacagttaggccacctactccatggaatagcagcattctttgaacgcctggaggttctcttggaataggggtacgaaggcatcgacgctgccgtcgccgaagttggacggcacgaggaaaagcatcccctccgtggggaagtaggccggcatgaagtagcttgggctccccgtgccgaagtccagctcgtagaacgggaacgtcaaccagctatccacctccacgtccgggcactgcgcgtccttgcacacggcgctccgagccagcccctccttctcggcggcgccggagcttgcgaagtctacgaacgactggaagtatgcaccgtccaccttcgccacctcgtcatggatcacctgagccgcgtgcttcagcggccggttcaggaggtcacccaccgtggagcgcgggaaagcccaaagcaccatgttgccgaagtactccgccggctggccgagccggtgtcgcccgtccacggacagccggatcttggtggtctcctcggggctcaggtcgcgcgcgcgtgtcatggtgcgccagaggtgggcgaggatggtctcgaaccggctgaacggccggccgcgcccttctgacgccttgactcggagaccggcgatgaagtccttggagaagtgcgccttatggatgacgatgttgtcggcggcatcgccgtggtgaccgacgacgtcggtgggcgacggcaggtagtactccctgtcgccgccgcggtgctcgaagttgacgactggcgggtcgcgcggcgggaagagatcggggtggctgtgcggcggtggcgtcggcgacgggccggagatgtccagccctcgcgcggcgcggccccacgcgaccaggaagtcgctggtggcgtggccgtcagcaacggcatggttggccgcgaacccgacggccagcgagccgcacgcgaaccgcgtgagcagca

SEQ ID NO: 31171 - DNA, 763 bp, Triticum aestivum
  Clone ID: PAT_TA_31171
gggagggggggggggtggcgatgctggggttgaagaagaggaggaggatagtgccgcggaggaggcggatggtgacggcagtgaggaggagatgcaggtggatgatggaaatgctgcgaatgcttctgatgatttggggtgtgagatggagacccacaacgaaccaaagaaaagccaagccgacgcatgggagttatccaacaagctaaacgagaacgcacagcatattcatatgatactaagtggagaggctgatgaagatggtggccaccacaatgctcctgcctatgccatctcacctgatgcaatggagaccactcggcagaaagccgacgagctgatcaagtcgctaggtgggctcgtgagctacttgaaccagttcactgatctgatcaaggaaaacgggatcgaggatgccgtcggtgtgaactggctgaaagccctctagcctttgaaggcgcgaatcatgctcgcctgatcctccgtctctgtccctctccatgtcatgtaaatctgtgtaaatatgagggttattttgaacgcatctaataaattgatgtctgattgttgcagacacggtagctgcattgtcggtatccccccctctacctgcctccttggtgcgtacagagacggtcaatgtatcagtttatctgttgtacgatgtaggtttgtagcagacatctgtatgtgcgttggcgccactatctgtttcaccccctgcctgatgcttacagagacatggctggatcagtttatctgc

SEQ ID NO: 31172 - DNA, 601 bp, Triticum aestivum
  Clone ID: PAT_TA_31172
gtggagttgttcttcttgatagttagctccgttcatccttctttccggctcctcatcatcagagctccgggttcaaccagacaaataaagctactactatttcaatcaaaccaaagtagttctgattgtcacaatgtctcccctcgtttcgcgtgtcgtccgctccaccgtcgcctttcgacctctccccgcggctcagcgaagcctccgcacctcgagcatcctccgcgataccgaaccttaccaatcgaagccaccacagcagagtcgtgaccacaacaagcttctcggcgctggcgctgtcctcatcggtgccactttcttctggttctacagaggaggcaaacccgcggcctttgatgcctctggcgagtctacaggcatgaagtcggctacaaagtagatcacaatggtgccaatatttaagcattgagctgtggtgatactcgatcgaaggaacaaaatgttgatcggcaacgagtgggcagacatacatgcatctttgattttatgtccgaattagcctctgacgttgcaacatgaattgatggaaattgatggaaaaaaaaaaaaaaaaaagaacctaaaaaaaaggccccta

SEQ ID NO: 31173 - DNA, 633 bp, Triticum aestivum
  Clone ID: PAT_TA_31173
gtggagttgttcttcttgatagccgcgagggccgggatttagctccgttcatccttctttccagctcctcatcatcagagctccgggttcaaccagacaaataaagctactactatttcaatcaaaccaaagtagttctgattgtcacaatgtctcccctcgtttcgcgtgtcgtccgctccaccgtcgcctttcgacctctccccgcggctcagcgaagcctccgcacctcgagcatcctccgcgataccgaaccttaccaatcgaagccaccacagcagagtcgtgaccacaacaagcttctcggcgctggcgctgtcctcatcggtgccactttcttctggttctacagaggaggcaaacccgcggcctttgatgcctctggcgagtctacaggcatgaagtcggctacaaagtagatcacaatggtgccaatatttaagcattgagctgtggtgatactcgatcgaaggaacaaaatgttgatcggcaacgagtgggcagacatacatgcatctttgattttatgtccgaattagcctctgacgttgcaacatgaattgatggaaattgatggaaattgatgaaaaacttccattctatatagaaaaaaaaaaaaaaaaaaggccccta

SEQ ID NO: 31174 - DNA, 959 bp, Triticum aestivum
  unsure (1)..(959): unsure at all n locations
  Clone ID: PAT_TA_31174
gccggccggcatcggccgagcatgggcatgggcatggagaacaagagcgtggccatcatcggcgctggcgtgagtgggctggcggcgtgcaagcacctgctggagcgcgggtgccggccggtggtattcgaggcggacaccgtcgttggcggcgtgtgggcgcacaccccggactgcaccaggctccagaccgagcggaccatgtaccagtacacggacttcccgtggccggattccgtcacggaggagttcccgaacaaccgccaggtcgccgcctacctcaatgcctacgcgcgccgcttcggggtgctcgaatgcatccgattcgggcaccgcgttgccgggatggagtacgtcggtgtcgccgaggaggaggtggcggcgtgggacgagtgggctggctgcgctgacgcatttggctctggcaacggcaagtggcgcctcacggtggccgacgcccagggtcaggtgcaggtacacacggcagactttgtgattctttgtattggaaggttcagcaatgttcccaacatacctaaattgcctcctggaaaaggcccggaagcatttgatggaaaagtgatccactccatggactattcgtgaatgggtagttcagaaagctaaggagatggtcaagcgctgcgcgtgtaagtgtaagttgtgaatggtatccgagaaaccgtgtcacaatggaatgtccaagcttgaacgatgctgagtaccagactccataggtgtcgggtgtcgacatatccaattacaacactactccgctccgctgatcgccttatccacaaacctgctgaagnttccccttacttgttagctacatcttgacccactgangttgattttccaaatcnctgagactactanccattatatgaanaacatacatggtcccgacaaagttaattnaggganatggggtgttgctnaactncacaaanatattc

SEQ ID NO: 31175 - DNA, 546 bp, Triticum aestivum
  Clone ID: PAT_TA_31175
cccacgcgtccgcccacgcgtccgcccacgcgtccgggaagctgcacgagatttcgtaaggaatggaggactgattgttgatcctgaagcaaaggttgcatctgtaagcaagatcttacgatggtataacacagacttcggtaagaatgagacagaagtactgaagcatgcagcaaattatctggagcctgcagcgtcagagcagttcttggagttgcttgcaaacactcaactgaaggtctcgtatcagccttatgactggagcttgaacatctagctgcagccaggattatacaaacgttttttttcccttatagctagaatacatgttgcccaaagatttgtggaaggatgctacccgtgtacccagtttcttttttgcgaagtcaggtgcactaaggaattttcatgtattatggatctgtggcgaactggatggctgccaatcaaccatgttccgttcatttgactaaatgggcgccttccatgttgattatcgatctctgttcctgggactgctcataaaaaaaaaaaaaaaaaaaaaaa

SEQ ID NO: 31176 - DNA, 874 bp, Triticum aestivum
  unsure (1)..(874): unsure at all n locations
  Clone ID: PAT_TA_31176
cgaggggacgatcttgacccaaccgcaacattctcttctgccgttnggggaaaactgccaaagaattaagcaagaggacccctttttgcacttgactggcccatctcgtgctattgtggctgacgagcctgttttctttcaaattgaattaaaattgaaatatggagcacagttcaaagatacagcattgttcactgcctatcaaaggtaccgccccatgaagaagtatgacatcatgctgatcaatagccgctgttgtacagcagagataagtcttgagcgatttgctccatcaatccaggccacaattgttggtgttcgtgtggttgaaggggagtcttttaactatggatgcaaagtttcttgcttcttttttcgtgttgaagcaatgttgggaagcgccgtggaagttgttttgcttgactgcagtggtgaaaggatgcatgctggattagacgggtatcttagtttgtcaagaaatgtgatgtcagtgggattgcagggcacactccgagttgtcataggagcatactcaaagtccaaacccagtatctctcgaataaatcacgttgactttcctgtccagcagtgtcaaacaactatgcttaagtgtcatgttggcggctccaaagtggagatagttgtcgcttggtctcgtcttgtcatggacaatcataatcttgtactcgacggctattgaaggtgtgtggagtggcagtgacttagtcttttacctcgatttgtgagcttagcttagacttgattaatagagtgccatttttatgttgcttaatatgcatttttaatgtgcgggtactagcgggtgatctaaggaggaaaggtagtatgttattatttggtccattttctatcg

SEQ ID NO: 31177 - DNA, 783 bp, Triticum aestivum
  Clone ID: PAT_TA_31177
tctgccgcggtggccgctcccggcgtctcgtttgcccctcctctgctagcattcgtcactgcccacgtcggggctccccgcgtcttcgtgcctgcccccggtcggaacatgaaagtttgtgtggcgatgggagtggttcaaattgtcgcatgggcaatctgggctggtgtgacccatcatccgtcacggttgaagctttgggtcgttgtgtttggaggagctctagctatgcttcttgaggtgtttgactttctttgggtcgttgtgttcgcaggagctctagctatgcttcttgaggtgtttgactttcctccatacaaggggtatgccgatgcgcactcgctgtggcacgcgagcaccgttcccctcacctatctttggtggagcttcattaaagatgacgcagagttccgttcggttctccccacactggttaagaaggccaggtgaattaaaggtcattatgttgttcggttctctcaaggcaacacaagcaaaagctcggtatgctcggtattcctgggatcgatcagcatcttgtttctgtggctctagccctcctgacttttgttttgatctatatgaggaatagttgtgtagtagaaaaagtgacattatctttttcccttgccgttgagactgttgagcctgtgagtaataatagatgctaatatgaaaagcattattgcacaatgagccaaaagagatgatgagaaatttgtagggaatgtgtgctgatttctacataggactgcttgtttctatgacacttttatatctgac

SEQ ID NO: 31178 - DNA, 684 bp, Triticum aestivum
  Clone ID: PAT_TA_31178
ggcacgagaaacctgaaactaatttctatttaacataaaactctaatatctataccgtacatacattttagaaatgtatatttgttcaccaaccatttattttctgctgaaatgaatggtaatacttggttttcaatttcctaaatctatattattcttgtgttgcaatataatataacgaggcatggtcagcaggaaacctaattcgcagtgaacatgcgcaaaagagttaaattttagttcttccataatttttgttcttttcttagagttcctgagaattatttgtagacggtgttgtgatgctccaatacttgtgtgatgatattgttctgactgtgcaatgtcctatgatgacaaatataaatgctctgctctatttgatgctataattgttcatcttctcatgagggagctgacagttgattagtcatcttctcatgagggagctgacaagatgtcggaaaggcgcagcctgctactcaagcccctctccttcgctccttgcagaggagaggcacgggtgccaccacactcgagagacagatgaggacatgaagctttcgtggagacgacgaggtggccaccgctgcacccccacgccgtggatgcgaagattcccatctcctctgccctcgataaccacttcggcggcgccgtgaacagcagcaatggcctcttcac

SEQ ID NO: 31179 - DNA, 933 bp, Triticum aestivum
  Clone ID: PAT_TA_31179
ttcggcacgagggcaacggttggccgtctgcccgcccgtgccggcggcgttcggcggtggtgcctggccggtcgttggtgccggggcgggctctccgctcatgcccgtgcgcgagcgcgacccctgcctgctcacgcgcttcgccgagccccccctccccggccccctgcccgggcgcactttcgccgtgttcccgccggacgtctcgcccaataacaggtctgtgatgcccttagatgttctgggccgcacgcgcgctacactgatgtattcaacgagcagctgagtacaacaaatatatcttccgtgaggttagttccgggtcaggcacaccgctcatgccaaagcggaagttcgagacgtacatattcaccctcttcaacgaggacctcaagcccgggcccgtggccgagcgaaatttcgggatgttccagccagacttcacgccgatgtatgacattggcatcatgaaagatccggtcaaaacaacaccggcgccagcgtcggtcgtcccagcgacatcgccgaaagtggcagcaacgcctatactcgccactgctgatgcgttggatgctgcagtgcctgcaaaggccaacggctcgaacaacgcctaggcgtccgcgtcaggatagtcgtcaggcaacaattccttgactaatgacagggcgcatgtgcgagcccagacgctagttgacgcctgacggcccacttctcttggattttgacaggacacttcgagcatcttcaatagaagatgcaaatttaaagatgtaaaacagaagatgtaaaaaattatatctctaaaagtgattttttacttctctaaaaaagaggcaactccaacagaagatgtacattggagatgtaaaacagcaactccaataggagatgcaaatggagcatgtaaaactatacttcaactagtacttcatt

SEQ ID NO: 31180 - DNA, 667 bp, Triticum aestivum
  Clone ID: PAT_TA_31180
tccgcggacgcgtggggccgtcatgttcggcaagtgggagttcgaccccatggcgctgccggagccgccgtgcccggtgcacctgtggcagggcgacgaggacggcctcgtgcccgtcgcgctgcagcggcacgtcgccgggaggctcggctgggtcaactaccacgagcttcccggcaccggccacttcctgtccgccgttcccgggctcggagacaccgttctccggacacttttcggttgatcgaccaataccagacaagtagttttagtacaagaaaacgcggagaagtgttggcctttagctagcttggcgtacgaggcgggacagtatgtctatttcttgattaatttataccactactgtacatgggaacatgaggcagcatgtagattttgtatttatactccttttttcattcgtttgtaatgaaaactatgccgacaaaaagcttactagtgacatttttaccaaaaattcaaaggcacggaggcaccgttctccggacactcctcggttgatcgaccaataccagacaagttagtttttagtccaagaaaacgtggagaagtgtttggcctttagctagcttggcgtacgaggcaaactggcaaagtgcaggacagtatgtctatttcttgattaatttatactactgtacatggg

SEQ ID NO: 31181 - DNA, 753 bp, Triticum aestivum
  Clone ID: PAT_TA_31181
gccccccccccccttttccgctccctccctccattcatccccccttcttcccgccgccgccaactccccaccaccacctcatccgttggcctcctctctcccccttcccgccgccgcctcctcctcctccaaacccctactcccgccgaccaatcgatcgagccagtgctccgctctggtggttggccgtagtatagcccgtgggttccccagctcagcagagatctgtggcggcggagcggatcgggccggctcgcagcccctaaacccacgccccccgatcccccgatccgcgacgaggagcgggtgcggtggccggacccgcggatcgccggagctcagagggggtgcctgtcgcagatctgccgatcctggcgccggacatgagctcctcggtcgagaaggggaacggatcgctggatcccggcgagcgctccggacccatgtcgcagcgcaacgcgtgcgggatccggtacacgacgaagccgagggaggcgatgggcctcgaggacccccccaagaagaggcagccggcggcggccgccgcgcctgcggcggcggcggtggcgtgctcggaggccggcggcgagagcgcggatccggagcagcagcagcagccgccgcagcagcagcccaagaagaagacgacgacgaccaagaggggtcgcgaggtggagctccgcgtggtggggttcggcaaggaggtggtgctgaagcagcggcggcggatgcggcgcaggccgcggctgggcg

SEQ ID NO: 31182 - DNA, 633 bp, Triticum aestivum
  Clone ID: PAT_TA_31182
aaaagggcccctcagattatgctatgctcaagatccatacattgccagcgactggtggtgatacgctctgggcatcaggatacgaggtctacgataggctctcagaccccatgaagaaattcctcgaaggtctcacagcaacccacgacgcgacattcttccacgatgaagcacgccgcctcggcaaccctatccgcaagggcatccgtggctctcctctgaaccagggcgagcaactcacatccgttcatcctctgatcagaacaaacccagtaacaggctggaagtcggtgtttgtcaacaagggttttaccaagcgcatcaacggactttccaaggatgagagcgatactctcctcgcctatctcttcaacctggtcacacagaatcatgatgcccaggtccgatacagatggagcaagaatgactgcgccatctgggataatagatcgacgtttcattgcgcaacctatgattacgaggcagcacgagcaggtgatagagtgtgcagcttgggcgaggcgccgtatcttgataccaacagtaagagccgtagggaagcgctgggtatttgaaacgcagacgtagttaggaataaatgagacaaaggaatgtgtgattattttgattctg

SEQ ID NO: 31183 - DNA, 1471 bp, Triticum aestivum
  Clone ID: PAT_TA_31183
gcgttccgtgccggccgccggagatggagaacgggcacgcaggcaggcaccgggtggccgtcatcggcagcggcaactggggcagcgtcgcctctcgcctcctcgcctccaacaccgccaagctgccctccttccacgatgaagtgagaatgtgggtgtttgaagaaacattgccaacaggcgagaagctatccgagtccattaaccaagcacatgagaactgcaagtacttacctggtattaagcttggagccaatgttattgctgaccccgacttagagagtgcagtcaaagacgccgatatgctggtctttgtgactccccatcaatttgtggagggtatatgtaagaaacttgtgggcaaactaagaccaggagttgaggctatatccctcatcaagggcatggaggtcaagatggaaggaccatgcatgatatcaaaactaattaccgatacacttggaatcaactgttgtgtcctcatgggtgctaacattgcaaatgagatcgctgttgagaagttcagtgaagcaacaattggatatagggaagataaagaagcagcaaaccgatgggctaaacttttcaccactccttacttcctagttgctattgtggaagatattgagggagttgaactatgtgggacactgaaaaatgttgtggcgattgctgcagccctcgcgtccggcttggatatgggaaacaacaccaaggctgcgataatgcggattggtttgcgggaaatgcgtgctttctctaaacttctgttcccttcagtcagagacaacactttctttgagagctgtggtgtggctgaccttataactacatgccttggtgggagaaacaggagagtggcagaagcctttgcaagaaatggcggcaaaaggtcttttgatgagctagaggcagaaatgttgcatgggcaaaaactgcagggggtatccactgcaagagaagtctatgaagtattgacttatcatggatggcaggaactgtttccgcttttatccactgtacatgagatctgtatcggacaactacctcctacatcaatagttgaatacaggctcgctgaaggtcaatcttgaagatgccatcaagaacaatttgggctttgtaaagttttcgaagaccaagcattccattaccttccaattcctggcaaagcaaggcccaggaagttgtagatgctagatgctagctcattttgtttattcatttgtggcatcatgtgtcacatcttacatatgtgctggcttcagcaagaccaagcaaggtgtcatcacctgtttgtaacagtttataaactctatggaggctgttaaatgttttttaggaggtaacatttgcatcagcagccatgactgggaatctttgcctgcatgataattcctcactgggaatctttgcctgcatgctggttctcaaaaaaaaaaaaaaaaaaaaaaaaaaaaactcagactag

SEQ ID NO: 31184 - DNA, 784 bp, Triticum aestivum
  Clone ID: PAT_TA_31184
ggccaacattctcctcaactcaaggaaccgggcaatctaacatgggtacaggtttcagtccgatgcatcagccacagccagaaacgaagggggggaaaacggggggccactgggggccagcagatacaacatgcttggtcatcagcacggggggagaaacctaatgctccccagtcgctatgacacactagtagtagaaaggagcaacccaatcccagcccgaagatactacactattactagcctagcttctgggggatgaccccctggatggagccgacgagcgcgaaggcgctgacgagcaggcagacggtgctgaagccctggaggacgagccaccggggggaccagcggggcaccttccgctggatgaagtacatctccacggggaagtagatggccagcggccaaaagttgagcgcgcccagcagcgccaggatctcgttgaagtaggggaagaagatggccacggccgtcgtgctcgccacgtacgccgtccggaagcacacccgcagcaggttcaccctgtaggccggcagcagcggcaccttcaccgtgtggaagtcgttcacgaacccgctccccgggtaccgctccgcgaagtgcctgtccgcgaactggtagatcggctggctgtacacctggtagccgccgagcaggtggaggatgatgcaggcgttggcgaagtcgatgagccagtagggctcgtagaagccgaagccggtgaggaggttccccggcgcgtcgttcccgaaggcggcgtagccgaactcgtgccgaattc

SEQ ID NO: 31185 - DNA, 711 bp, Triticum aestivum
  Clone ID: PAT_TA_31185
ttttttttttttttttttaacaaatgaaagaattctattaatgatgataatctcgcgcatgtgtagcgcaacacggcggtgttacatataactcactccccagctcaacaaagagaaccgaaaaagaatctcgtcggagtataaacaacgttggaacagactcggagccacacggcggcggcacatcgaagatcagctcgacgatcctccgtccatctagaacatgatggcggcggcgaccgcgccggcgacggcgacgaagctggcggcggacgagtacacggcggagctcgcgggggtggcggtgggggcgccggtgggcgtggcggagaccgcggacggcgtcatcgccgagggagcgtcggtcggcgcgtcggtgggcggggccgggggagaggccatcggggacggcgacgcggcggtgggcggggtggcgaccggcgcaggggcggtggccggggacctcgccggcggtgcggggagcggggccatcctgggcgccggcatggggccctgagcggcggcggcgacggcgaggaccgcgatgacggcggcgaccacggcgaagcgagccatctggctgctgttggttgcggaaaacttcactgagatcgagagaggagatgggacgatgggtatagcgaacgcttgggctctggtgtggagagtgggaggctgggaggtttgccgccgccggcccgcgcgccgcac

SEQ ID NO: 31186 - DNA, 1517 bp, Triticum aestivum
  unsure (1)..(1517): unsure at all n locations
  Clone ID: PAT_TA_31186
cttgtctcgtgttttttttttttttttttttttacgctacaccctttgtatttctatataaattctgtactgtacacctttgctttttctggactcaaatatgttccaggcatcaacgatatatactcagcagtggaacatcaaagacgtggcaaaatgctcgcccgcccttctattcgtgatatacacttacagaactttacacgcaaacaaattacaaatatatgcatccaatttggcaagaagaataccccgtcttgaaggaaaataaatagttgagagtgtactccagcacttagaagcagaacctcttcttccggaatttgtttttgtcctgtttttcaatatatgcaagcagctcgtcctgccttatcaatgtctcatagagcaccttctttgtagaaatcagctcagcttccaatgcatcgacacggcaaacagctgtattgagcacttcctctttctcaactggcatttgagatggctttgtttcaagtacaaccaccttctcctccagttcacgaagctgtcttaatacatacggtaccttaaactccaaattttggggaaattccccacaattgtgatcacaggcaatggactgtcttgagaacctttcagatattctgctttgggcagaacggatcaccataaagaggctcataattaaaactgtcagacaagtaacaatctgagttcgtagcattcccaatgccatacgtatatttctcaaggagaatgaacctgaggtagaagccactgaagtggctcttggactgttgcacacatcatccacaagcttgtcaacaacagtggggacgctttcctctacgacaggagcagtaccagaagttgaagcatgtcctgaagattttggctcatgaagggtcaaatcagggttcacaatgacatccagtggagcatcaggagacgtaatatcttctacatcagatgtagattcggctgaggcatcactggtttttttagctgaggaatgaagcttagtataagaaactgtattcccatcagtgcttgatatggcaagaattcgttgaccataatttgcttcaccattaaggaccctctctattatgttaggatccttccaaggacctttgtctgattttgagcaacctccactctcttcacacctgcatttgcctccaagaaaatctggcagttcactttcatcaattatttcaagcagcttattttggtacttgcttccaagaacatgaatcttcganacagtctgtggatcaagaaatgatttaattgtaccccataacatcttgaagccctgcccagcatttataatgtacaagcagcacaatgtctctggatagttatcattgtcaatcttctgcagtcgcatgattagttcccttgcatcttttgagaagttctttaagcccaccccttgcacatctaaaatagttgtagatgagtctatgtgcctttttgcagctatggaacaagctggaaacctcatctggaaacttctctcgaactccttc

SEQ ID NO: 31187 - DNA, 883 bp, Triticum aestivum
  unsure (1)..(883): unsure at all n locations
  Clone ID: PAT_TA_31187
ggaaggcctaggcccccagcaggggggtcctgcagcgttctttataggagtaattctcataaaataaatatagatctgtctgctgattgtagtttatgcataaacactgctggaacagattctaataacctgctgcatatatttgctatgtagtaagagagctaatttattggtcacaacgctcacacctcgcaaaaattacaataaggtacagtacactattcaccacactaggctaaaggcatgcagccagaaagcacacatgttattcatgccagtttattaatacacaatataccgattaccgcgtagtttttcatcgagtgttcaagggtagagctcaataacagatctaactcccagcactgatagaattttgtaattgctgaacccagcttccataaatatcttcttccactcaaattcctctcgctcaatcccctcagcacccatgataaagagatcatagaaaacctgtgtctctcttgttacaatgtcatctgggccagatccaaccaccatatcaacgattatcacctttccaccaagcatctctgggagggatagcttccttgcaattcttcagtagcttgacacaagtcttcatcacaccaatcgtgaaaaatgcacttcaggaaaagagcatcccgccggtgggatgtactttaaacatatcgcccaagaaataaatgacacatgggcatcaactggggagccccagcaaccacatgagggagatctcaacacagtgcatttcatcctngggggaacgacattgcaattgccctagcagctccaccgtgtcctcccgcaacatcaataagtgagtttatgccaagaaatctcgtgccgaattcggcacggcntgcagcccggggatcca

SEQ ID NO: 31188 - DNA, 715 bp, Triticum aestivum
  Clone ID: PAT_TA_31188
ctcgtgccgaattcggcacgagtttttttttttttttcacccaaaaagtaagatataccactgctgttgaattttgttcatcatatacaggagaacgcatctaatacatgggaaatgcatgctctcctcagaaatcatcttccttctataacatacagacaccatcgtatattcaagtcatatttgaaattgcttgtgcttgctatggcgactattctacgtgtactgctgtgtaggagaaacttcaatgtaactcttcctagctgatacctaataagcacacaatttctaggaaggccacaggtcccattcacagcttggcaacccgtagctcagcggtcggttgatccatgcctccatgctttgaattgaagtgaggcaaactggggatgttgttgcattctgttttcttggttgctccatatgagctgctttggttcaagaggaggttggttgagccaactccctgtaatctttacgtatactccacaggatctctgcgcaccgcctcatgctcggccggttcctcttcttgggagctaggcattgcagggccagctcgtacacccgatcgatcgccaggttcctcgcgtcaaattcgttaagatttggatctgcccttaatatctcatgccacttgcggaacttttcaattccccattcattgggcacacgttcccagacagcccaggttaactctcatgggcgcctccca

SEQ ID NO: 31189 - DNA, 469 bp, Triticum aestivum
  Clone ID: PAT_TA_31189
cgtccgcggacgcgtgggcgctgtgatcttcgcggtcttgtccaagaccttaaaagggtggcgagggctggaatgggactcgaatatgaggacccccatactgtaatcgaagagagcccatcactgagacgagctccggtggcacgaagagtggaggagatgtttgcccagataaaggccaagctacctggagcacccttgttccttttgtgcctcctccctgagaggaagaactgcgaagtttatggtccttggaagaagaagtgtcttgctgatttcggcatagtcacccagtgtctagctccgcaaagagtcaatgaccagtacttgagtaatctgttgctcaagataaatgccaagctcggtggactcaacacactgcttcaaattgaagcagcccgtgcaatacccattgtggggaaggtgcccactatcattctgggcatggatgttttgcatggtcaacctg

SEQ ID NO: 31190 - DNA, 1683 bp, Triticum aestivum
  Clone ID: PAT_TA_31190
cgctgtggcggaaaaacccctccgccctcccaagaacgcggtcttgtacatgaccgcgcaggcggcgggactgggccgagacgggcctacgcggtcccgtattctgcacccggagatcggcgagcgtggggctgagctcctgccgcccgcacacccgctgccctccgtggacatgaggagcaccacagagatagctgcggctgctccgctgggggacccgcccccgccgccaccgcaggggaggccagcaatgccgagatgatgacatgtcggactgatccccgatccctcgtcggggggcacacgtcggaggggagcgctcccgagccgctgctgcctctgctgcaagagatagtgggcagcctcggcttactcaaccgatgtcttgctcctcaaggagtcgatggaagatgatgtctgggagcgcaggttcaaccgtatgtctggatcagacatccctaccgtttctctctgcggactatatatgtattatctctctagaggggaccgtcatctctagctgtctgggttgccggtatacagaacaacagactcggtagagccacccaaacaggagatgcttccctcttgtgttaaaccacgtggaactgaagatgctagcctacttcgagaatgccttattgacttctacactagctctgggaagcggaagccagaccaagttattattttcagggatggagttagcgaaagccagtttactcaggtcataaacatcgagcttgagcagatcattgaggcatgcaaatgccttgacgacaagtgggagcccaagttcacggtcatggttgctcagaaaaaccatcataccaggtttttccagacaaactttcgcgacaacatgttccaagggcttgcaatggggcaacaagtgtgccatcccaagaactttgacttctacatgtgcgcgcatgctgggatgattgggacgtcgaggctcaaggcattacctgcatgataagatgggcttcagtggagatgagcccaggagtttgtgcctcaacactcgctctcctatgtgtaccagaggagcacgacggcgatatcagtagctgctccgatagcgtacgcgcatctggcggcggcgcaggtgggcaccttcatgaagtttgaggacatgtcggacacgtcgtcgagccagggagggggccacacgtctgcgggcagcgccccggtgccggagctgcctcggctgcacgagaaagtgaggagctccatgttcttctgctgatctgatgctgctcttgaacttatgccgctttctgtcagtggaggttgaaccgtgcgtctgtataaataaaacctactagtacctatctatctatgtactatctagatggcacctggaactttagctgttatccagggtgcccgtaagtcggtccgttgtgtcgggtgccgctgggaacgttcccatggatgttaccgtttgtggtgttggcgttgttgaaccaaccaacctgaacctagcttaaccttgcttggattggatgatgtgctagctagctagagctagagctagagttagaccatgcaggctgatggtatgtattgtgatctatctccatcctgacttggtgataatcaagttaagtggatgtgaatttgttgcagatggaagaatcggttggcaacttggtaaaaaaaaaaaaaaaaaaaaaa

SEQ ID NO: 31191 - DNA, 1453 bp, Triticum aestivum
  Clone ID: PAT_TA_31191
gctgtgggggtgcacggcctctcagagggccaactcgccgggggcaccagttcaatgtatcccataagttctagcatcaaagtgacagattatgtcaagttcaagcaccaccggtgcaattgacttgattttctaatcaattgagagttacaaggctgatttgcagtactctactgcttaaccgtgcgtgcatgcatgcacacggccggacttggtcagcgctgcctcatggactcctcgcactggtcgggggccgtccacctacgcccgctgccccttctctccgccggcgctaggctcgtgtagttcttccagtcggcggccatgttggtgaggtcgtgcaccttgttctcgagcccgatgcagcagttggcgtgcatggtgcacacccggtccatctcgtcgtggagctggcagaagccgtcgaagagcgccgtctcgaggaacaccaacctgatgtgcagctcgccgcctgccagctcgcccttaatctcgtcgaacaccgcctggtcgtgggtcggcgggaaccgcgacctcgccgcccgccaccgcctcagcatcgacaccgtgcggttggtggacttgacgtagtagaagcccgtgttgggcgcgttcgtcagggcctcggcgtcgccgttgaaccggtcggtggagacggccatgtcggcgtagaggctgatgtaccggaacgggttgcgcagccacatgatgtccacgtcggtgaagaggtagctgtagccgagctggaggacgcgctgctggagctccagcttggcccagacgagctcgaggtagctcctggtcatgaagcggttggcggagctgacgttggcggaggtgacctcgaggaggtagcagtgcgggtgcacggcctcgcagtgcgccagcgcgccggggtcgacggccacgatgagggtgtggttgaggaggtgcgcgatcccctcgccgttgttgaagcccgcgcggaagaggtcgaggagggagcccgggcgcgaccacgcctcgttcaccgacgtgatgatcaccgtcccgtcgtccgtggccaccctcggcagcagctccgccagccccgggaacaccctctcctccgtcgtgtccgtgtccgtgaggttggcatcatgggtcatctgctcacgatgagctgatgacgatccattattgttgttccccaaggtgtaggtggagatgctggtcagccgctcgccgacccggtcggaggcgaggaagaagagcaggagcgtggggaggagagccccgaggaggaacgaggccgagtggattccgccgccgccgccgccgtgctgctttctcggactgcccaacatgtccaccaccaccaagtacgtacgtaatcgacaggggttcggtacgttgtggcagcagacacaaatggaaactgcgtgccaccgtaccgcaggctaccggggcttagaaggacccggtgacggccggc

SEQ ID NO: 31192 - DNA, 897 bp, Triticum aestivum
  Clone ID: PAT_TA_31192
ttcactgaattcacgccgcattttgcattaaatccacaagagatactacgccactcaaaatcatcaggtgagcgcaacataacatgtgaggatatcactaaataaaaaggctatgtttcgttttggcgcaaaggaatacaatctggtccaacatatctcctcaactccctaaactagaaggtgggaggcaagggaagggagccttggctcaggcaatgtcattttgtaggttccatgctgtctcttttttgatcgaacgaccaaactgactgcatatcaggattagttggaaataagccagcatgtgctccagtcggtgagtggatttgacttgctccctgaggtccattcagcaccagttcctccttgggccaaggatgaccaggaccaggtggcccaaaggggtgtgcgtgggccactttgtttggagatccgaaacccagctcactgtgagcaggagtttctggaaaattgtgtgaaaggaacagactctctgtatcaagaggcaattgctggaagggtgatttctgcagccataaatcactgtcatgcaaaccagcaccgagggggctccttgttccgcccattcaagttactgacaccatggttaaactgatccttatttggtaaaaccactgcatcttgagggcctcgcaggcctaaagtgtcctgcacccaatggtgtgctccacatttgccatgtgccttgctcatcggtagcctccaggtgtcatcgaaccatcaggccctttggaaatagaaaaatgtgatggttttataggcttttcttcaacagtccgtgatcttgacaggggagactcaattggtgacggcttaacatgtggttccttggcgacaccatttaaggtaaacctgttatcccagtctggagggaag

SEQ ID NO: 31193 - DNA, 755 bp, Triticum aestivum
  unsure (1)..(755): unsure at all n locations
  Clone ID: PAT_TA_31193
ttttttttttttgccgtcctacacagcaaccctggcgccgtgtccggacagatgggtatctcagcaaaatttgctttgatgtgctttcgcttccgaacacagcatgtacatttactttgacaacataaggtttagactttttacatacaaacaccgccgattatgagacaggaggggttgagatcttcctcaccagacatacgaccgtctcgaaacaaaaccgtggaagcgaagaaattcttctggatccgcaggtatcctttctcatatcttaaattggagggttttaagaagtatccaaaccggagccatcttttctcactttgggcatttgaataggaatatcaatcccctttctcatattagcaacctatgtacctcaatgagaatgtaatgctatcttttgtaaatcacatggaggcgtagttggtaaaatatcatacgatgcacggaaccgtaggccattgcctgtattgactgatactgggcagagccagcaggtaatgcttcatccaaggcacgaaacaagatgccattgcctgtattgactgatagggggcagagccagcagaatatgctacgcccaagcaccgaaataagattctcatagacaccaaggtcatatggatgatgataaaggtctccacccttttctgccaaccacattgctctaactccttcatggtactcaattgtagttttattctgtaatatgaggtggatatgccagcccattaaantgcttaactgttcat

SEQ ID NO: 31194 - DNA, 748 bp, Triticum aestivum
  Clone ID: PAT_TA_31194
ggtagctaatcaccactagacaccaaatgccaacatatatacgtattggtgctcagtggccttcatgcaaacacaatgcctcatatgcattcccatacatacacactgaacctttaaaaaggataaggctgaacttcctcatgcagaccggaaaggagcacaaaacacaagctcccacacagtgagctcgcgcgcgcgcacacacacacacactaaacaccagacccagcatgcacaccccaggacatgatgctcttttatttgtctttgggtcctccttgaacttctgaatagcgttttacaagattgaggccatcaagtctcagtgcccgaacatttagttatctgagctctgaagaatactactccggttatagcggaacttctctcattcatccatgcgttattttgcagaacatttttttgccccagctagggactacgccgtgcggtcctggcaacagtaggccatggcggtgcgtggtggcatgacacgtcgcagcggcgtgtgttgacggcgaccagaccaggcgcggttgcggttcgatggatggacagatccctgcatggttccttgccagtaacaaaacagccttcctgctttgctccttcaaaacattctcctttgtttgctttcatcactcttttgcagcatttttctgataccatcaagcaacatgccatctgatgcatctgtttttgttaaatcaatgttagaggactgaacttcagaaacattgccatgaaa

SEQ ID NO: 31195 - DNA, 747 bp, Triticum aestivum
  Clone ID: PAT_TA_31195
caacaacccagcagctcaagaactgaataacccatcagatattagccagcagacagagatccaccaagataagagaaaagcaatgatatgtactcatatgcttctagtaagctatgaaaaatgctatttcgctacgctgctgatgaaaggaaaggagagaaatggtcggcttgcaatatgtcatgattgcacccaccaaatcagtgttgtttttgtgataccaagagaatcacaaccctcaaacactgacattttctctcccctgatgacactcatacatcaaaccctcgccgtcgacggtgccaaacttgaggaaccctctcaccttacaaaacttcatgaggtaatacaccccgaggcctgctgcagtgaacatagcgctgatggcatacaccttccaaccagcgatggccatgacgaagacaaggaaccccgaggggacgaggcagaggacaacgatgcctgggagtcgcagcggtacgcggtaggggcgcgacatctctggccgcttgatccgaagccagacaaacgtggcaaactcgaggagcatgccgaggctgtagaggaagttggcagcggccacgatgttgttgaagctgaagaaggacatgccgagggtgatgaggctggtgaccacgatgctgacccaaggagtgttgaaaattggagcgcgcagcgcgaacacgcgaggtaggaggcctaggtccgccattccaagaagctggaatgccgcactgcttagcgtcg

SEQ ID NO: 31196 - DNA, 607 bp, Triticum aestivum
  Clone ID: PAT_TA_31196
ctccacctgctcccggatcccggccatctctccgccgacccacagcaccagcgcgctcacccaccaccgtgaaccagaagatggccatcgccggcagcgggaggggcaaggcgaagcccgccgccagcgccaagtccgtgtcccggtcgtccaaggccggcctgcagttccccgtcggccgcgtcgcccgctacctcaaagtcggcaagtacgcgcagcgcgtcggcgccggcgcccccgtctacctggccgccgttctcgagtacctcgccgcagagaccctggagctcgctgggaacgcggcgcgggacaacaagaagaaccggatcgtgccgcgccacatccagctggcggtgcgcaacgacgaggagctgagccggctgctgggctcggtcaccatcgccgccggcggggtgctgcccagcatccacaccacgctcctccgcaagaaggccggcaagggcaagggcgacatcggctccgcttcccaggagttttagattagattggaaacttggaatgcatctcgcaatcttgttcttgttgtgactgcctgtgacgcccttgtcaatactaatatgaatgaaacggatatgttgctactgtt

SEQ ID NO: 31197 - DNA, 637 bp, Triticum aestivum
  Clone ID: PAT_TA_31197
gtcaaagcgcgcgtccgaagctcgctccagttattaccgccaatggagctgcaggaagacaagcgtgccgcggatgaggagagccagcctcacttcctgatcgtgacgtacccggcgcaggggcacatcaccccggcgcgtcacctcgcgcgccgtctcgtgcgcgcggctgccggcgccggcggtgcgcgcgtcaccatatgcacccctgtctcggcctttcggaagatgttcgctgacgcaacaagcgcggtgggcggcgacgagataagggaagagggcggggtcgcatacgccgcttactccgacggctacgacggtgggttcgaccgcaccgcgggcgactacgcgcactacatgtcgcaggtgaggctggagggagcgcgcacgctgtccgggctgctccggcgcctcggcgatcgcgggcaccccgtcacctgcgcagtgtacacgctgctcatgccgtgggtggccggcgttgcgcgggcgtacggcgtggcggtcgtcgcggtgttctggatccagccggtcaccgcgctcgccgctactaccactactttcgagggagccgagcctcagtcatggtaggtgccgcgtcgcgtgacccgaatgccgaggtgtgtatcccggggcctcc

SEQ ID NO: 31198 - DNA, 428 bp, Triticum aestivum
  Clone ID: PAT_TA_31198
gatgtattttcaggtcaactacactgaaagaaaactaaatgattacattgacccagattatgatacgctcaaggtcaggcttgcaaacagtgatctacaagccaattgccgcatcatgctaggaaccgacaagagagccattgtaacaatcaaccggtctgagttccgttgccttgcaaaaatccatggagacatctctgcctttcgtttcaaggtcaccacaaagcagcgccgggttctcatggtgcatttttgtcgtggtgactactctcagccagatatgtatagactttagtcctcccttgctgtctctatggtgaaaagtagtctacgatctttagattttattgttgtctctatggtcaaaagcggtttaccatctcttattgtatatatgtgaaggactcctcttctactgttgtttccag

SEQ ID NO: 31199 - DNA, 863 bp, Triticum aestivum
  unsure (1)..(863): unsure at all n locations
  Clone ID: PAT_TA_31199
gcgggcctcaggcggcggcaggaagaaagaaacaccacccacaaacgctgaaacacctctctaggaaacaccactcaacataaaaaatccgaatggcctcctcttccagcttccttctggttgctcttatcgcgttggcctcatggcaggccatggcttctgatccaagccctctccaggacttctgtgtggctgacaatagctcacatgtgtttgttaatgggtttgtctgcaaagacccaaaggaggtgactgcggaggacttcttcttagcggccaaacttgacatgcctagggacacaaagatgagcaaggtgggatccattgtcacactgctcaatgtcatgaggatccccggtctcaacacactgggtatctccttagcacgcattgactatgcacctttgggggagaacccaccacacactcatcctcgtgcctctgagatcctcaccgtgcttgaagggacactttatgttggctttgtcacatctaacccagataacaagctcttttggaaggtcctcaacaagggtgatgtgtttgttttcccacaaggactcatccacttccagttcaaccccaacccctacaagccagcagttgcaattgccggacttagcagccaaaaccctggggccataaccattgcgaacgctgtgtttggttcgaagccgccaatctcggacgatgttttgagaaaggcctttcagattgggtccaggctcaagactggctcggcgctcaattctaatctgatgttgggctactaaactagtatttctactaaactatatgttttgtgtaatgatatgatagtttgttgtatgtaaaaaaaaaaaaaaaaaaaccccagggggggn

SEQ ID NO: 31200 - DNA, 1163 bp, Triticum aestivum
  Clone ID: PAT_TA_31200
agtcgagccccgaaatcctagtccttatcgcagtgcggcctaaccccgatctggaaggcgatcccaaggtgtctgcacgcatggttttacttgacaagaccggctcaccagcgccttccatggggacggggacgccgacgaacataggcggctctatccctgggttgattggatgttacaatctgatagcaaggagagataaggttaaggcgaactgtgtggtcgacaactactttgtggtgttgtgctctgttgacatcaactggacatctccaacttcatcgctgaagcaggagctcccgagtttgggtcatgatcttgccatgatgtgggataaacaagatctcaccgatgtttccttcgatgttggtggggagagcttcagtgcacatcgcctcgtgcttgctacccgatcgccagtcttcagagctgagctctatggtgtgatggctgagagcaagatggcatctatcactattcatgacatggaggcctcgaccttcagatcaatgctccattacatatatcatagttcgcttcctgatgctggcaagatagatatttcttcccccatggcacagtaccagcatctgcttgtagccgctgataggtatggggtggaggggctaaagaagatctgtgaggacaaactatgttgcaatggtatcacgacggacactggtttcaatgttggaacttgcggaggcccatgtctgccccaaactcaaagctaggtgctttgatttcctcactgatggtgacaatttgaagatggtcgcgacgtcaagtgagtacctccatttgatgcagaattttccgactctcttggtggaagcgcggaataggttcaagatagagcatggaaaaccgaccatcgtcgaacctggttcacacaagaaagctagagtaaactagagtatattaggcatgataatggaatggtgatacagaaatgtttggttattccaagcctgttatattggcattcccttcgttgactatcctttgtgcttagtattattttgcagtagagtagtcctaacgtagctatcatggcttcaggttaccgttcgatttctagagaagacatgccaacaattgtatcccagttgtatgctgttcttctgtgcctgtttatatctagcctttagtttaagcaacag

SEQ ID NO: 31201 - DNA, 972 bp, Triticum aestivum
  Clone ID: PAT_TA_31201
aggacattggttttgctgcacccatcatatgcaggacaactgttcaaggacggcatttgatatcagatgataacggttatgtatgttctgccctttcgattgatccatggtctcgctgctgcccacaaacaggagaacgcttctcctgtcagggctgcaaccttgattcgcagtgctgcaactcttacgagtattgtgtttcttgctgcttgaatccttctatgaccaaggaagcagatgttctgaagttgaaggtagctaagccagtcactgctggaacttacgccaatatcttcgatttctgcatgggaagatgccgccatagttctgcaagcgtggtccatgaaaatgcatatttgagtgatttccatcattgctttctggtgcagcaaaattcatcgggatcaactgaatctaattttggatcaaggttggatggcattaacgtcattttgggaaggcagggggaatcatgtagttctgcatgcagagcaaaaggacaatcatgtgttccaagcaggctttctgagttgaacaaatgtcagattttgcagaaatatatgagatgcaaaaatggttgctttcccagtcttgggcccgatcaacctgccgaagttgtagacgaagctccaaaaaatttgaatcctggagcgtgcttgtacatgcagatggatgaccgcctcacctgtgatggctcacatcaacatacccggaggctctgcccttgtgcatgaaacgggaaaaaatagcgtcaatagtaagaaagtcacttgccaggaaacaagcggaggtaatccgccgaaagctgacggctcaaaatggcatggccatttctgcaccgagtttccaaatggcgtatcgcataagaacatattttcgctttgtcctgcgcatgcagttcatcttttgcatgtccagatgcaatcatccttgtccagaacaagcagcttctcaaacacttatctttataat

SEQ ID NO: 31202 - DNA, 957 bp, Triticum aestivum
  Clone ID: PAT_TA_31202
ggcgttctttagaccgaccggatcattagccgggaccatgtgatggtatgtgaaacttgagcaaccactgctgggtgtgagccctatgcaacaagccaagtcagaagatcaacactcgcgaccagatatggatactaaacctttaatgcaaaaggagcaacaacacaacaaggtatagaaagatatcagtgtaatgaagtagtcaatatattgcatgatagcagaagaaagtaacacagacaaggagaataatgaacatgggataaatgaatgaataacgatcggtttgagaacaaggaagagaaagcaaacacagtagaggaagatataagtgaatataataaatcagtatcttgcttcacagacgaagagcgtgacgcaagcaaggctaatcatgaacatgggataagtgggacaacaaggatcagcaggcatgcactttgcaaacggacattgcattgcatgcttactgtttataattttctgcatacatcacaaaagtccatcaccaattaggagaacttgtaagggacagcagaagaaagaggacaacctagtttggcttatcgtaagggcatttgtcttttccatctctatgttgttgacaaaatgagtgatgggcgaattgcatcttcatctgtatttgcctggagtatcatcctgcctattaggactcaaagaaccagttcgtacattccaatatccctgatgcatatagatgttcttcttgcgcagcactttgggtgtcttgttatgcttagtttagtttatagcctattttttgtagtccagatgtatcgtttggtcaacttgctctgctgtgtcaagttgacattgccaactctagagaagtactcaggagtttcttattttgtaggagtataagatctgtcttgagctctgaaagaagcagttcgtacattcaccgatttaatcgagcatggatgatttcctgtt

SEQ ID NO: 31203 - DNA, 567 bp, Triticum aestivum
  unsure (1)..(567): unsure at all n locations
  Clone ID: PAT_TA_31203
cggacgcgtgggcaaaatccgaacaagcaccgccgctcccgcatctcgagtagtttccagttcgccggagaaggagaaagatggccggaaggaagggcggcgacaggaagaaggcggtgacccgctccgtcaaggccgggctccagttccccgtcggccgcatcgggcgctacctgaagaagggccgctacgcacagcgcgtcggctccggcgcccccgtctacctcgccgccgtcctcgagtacctcgccgccgaggtcctggagcttgcaggcaacgctgccaaggacaacaagaagacgcgcatcatcccgcgccacctgcttcttgccgtccgcaacgaccaggagctcggcaggctgctcgccggcgtgaccatcgcccacgggggcgttgatccccaacatcaactccgttgctgctccccaagaagtccgccgccgccgagaaggaggcaagtcgcccaagaagaaggccgccaccaagtccccaagaagaaggccgccgccgccaaggagtaggggcccaatagcctaactcacaataaggagaagatgacanactttn

SEQ ID NO: 31204 - DNA, 633 bp, Triticum aestivum
  unsure (1)..(633): unsure at all n locations
  Clone ID: PAT_TA_31204
agccgaccaggctagaaacatggcggcgacaaggagcccgagtgactcggcgagccgtccccgccgacgaggcccgcggggaagaattggcaatgctaaattggtgagaagagagcgagaggaagatgatgaggcgagatggaaaaggttgattttataactggatgctaggcttaaatcagaggacatggtagcggaagaacaagatgtcatattctgaataatactgaaggtactttcagtaaatgttctgcaaataagtgcatccagaacgccaggatgtgtggggacaaaatgtactctattgcttcacatgggaatggcttcagttccgctactgtcacgagcctgaggttctgatcctacacctcggctgctcggccagaagctaagtcataccaacttttgttagttcttgagatttttttgtggctttggatttacagtctgcaaaatgtgtttatgcttttatcattccttctagctctaacatacatatgtttttttctatgatgtactactaaactatgcgtgttaaacagagcatggtgattactaattcctcatgagcttcttattatttgtctctgctcctgggtggcctttgtcctgatccagataactggntttttt

SEQ ID NO: 31205 - DNA, 1199 bp, Triticum aestivum
  Clone ID: PAT_TA_31205
gtggcgtagccgaccaggcacgcggcggcggcgaccaagaagcgagtggcgtagccgaccaggctagaaacatggcggcgacaaggagcccgagtgactcggcgagccgtccccgccgacgaggcccgcggggaagaattggcaatgctaaattggcgagaagagagcgagaggaagatgatgaggcgagatggaaaaggttgattttataactggatgctaggcttaaatcagaggacatggtagcggaagaacatgctgtcatattctgaataatactgaaggttcttcctagttactgttctgccagggagttcgtccaaggtcgcctcgttgcgtgcggtcacatggtgctccgctgcttttgcagggaatggcttcagttccgctactgtcacgagcctgaggttctgatcctacacctcggctgctcggccagaagctaagtcataccaacttttgttagttcttgagatttttttgtggctttggatttacagtctgcaaaatgtgtttatgcttttatcattccttctagctctaacatacatatgtttttttctatgatgtactactaaactatgcgtgttaaacagagcatggtgattactaattcctcatgagcttcttaatatttgtctctgcaccaaggaggcaataaacatgaaccagataactgtatttttttcctgttttcactgtacgcagtacatctccattgtgctttattttatttgccagctctgttgataggaacttgaattgttgtttctggtctgcgtaaattcaagtgactgttgtactcccaattcaattagcacgtttcggtttgataaatatcatgcattgatccttgcattttttgacaaatttatgttcatgacatctccagtttactcctattgtcattctttgtgcttctcagatctgccagctccatggagacatggaacccctcattgttttgtcggactaaatgtgggttatttgtcggaccatcagcaaacacataaagattcccgttgttgtctttgtagtggaaggtaccacctggtggtatgttgctattttcagtttgctctgaataaaggcatgtagagacttcagatttcaattcttatctctctgtcgtaaaaagtaatgtatggtcctgtgttttatctctggtcatatgaaagcaccgagcttgattctgcctt

SEQ ID NO: 31206 - DNA, 1768 bp, Triticum aestivum
  Clone ID: PAT_TA_31206
ccctcgctgccgctcctacccaagctgtaaagcaccaccgtggtacacctacgcggtgtgtgcgtgtgtggccgctctgttcggtcgctccgccgagaggaagctccccccgtcggcggggtcgcccgacgcggcgccggagatggcctagccgtccctgcaggcgccctgccgcgccccccccgcgcccctcggccccccctccttccgcgtcggcgtccgcttcccgcgcctccccaccccccccctccgcctgcccgcgccgcccctccccccctccaccccgccccccatccctcccaactccgcccccacatccgccacctctgctaacgcgaccgccacccacacactaacgacgaccacccacctgcctccgagccctgcaccagccaccgagcaccgccaggtccaccacggtccggtcttcgtcggccgccacgccatccgcgtccgcaagtggccgcacccgaaccccggcgagctcctcaaggcccacagcatcctcgccgccgtccaggaagcacagcgccgcagccgcaaccgcatggccgacccgctcaggcccgtgattgccgtcaccccgaccaccacctccgcgctccaggcgccgtcgctcacgtccctggcgcacaccctccgcctcgtcgacgccccgctgcgctggatcgtcgtcgagcctggccaccgcaccgacgccgtcgccgccgtgctcgcccgctccggcctcgacttcctccacctcgtcgcctccgacggcccctccaccgcgcgcctgcgaatgcacgccctcagggaggtacggaaggagaagatggacggcgtgggtgggtgttcgccgacgagaacggcatcctccggacggagctgttcgacgaggcgcagaaggtcaagtccgtgggcgccgtgcccgtgggcattctgggcgaggacgaaggcaccaaggagtccttcctgcaggcgccggcctgcgacgaggccgggaagctggtgggctaccacgtctcggaggagacgctgctgccggcggcgcggagcgacatgctgctgtccacccggctggagtgggccgggttcgtggtgagcgcgcgggtgctctgggagggcgcggcggaacggcccgagtgggtgcgcgacctggacgccgtggacggcggcgcgcacctggccagccctctggcgctggtcaccgacgccggccaggtggagccgctcgccagatgcgcccaggcggcgctggcgtggtcgctccggtcagacgctctgcatgaagtcaagttcccgcatgagtggaaatttgatgctcctctagtaagcgccgcttcgcgtcagcagagcagcgtagtaaatactgaagatggtcactagagcagcaaaatttttgtgggcaatagaaatcagggcaaaatcagactgctacggctcgtctgatttgtgtgagtctcctctgatgcatccttgtaccaagacatctcaactcttgagtaacataaggcagctcagctcatttgttgggaccctacagaaagtcacagaccatacatctgaatccatgttctgtatcatcctgtaaaaatagataaaaaaaagtttaattatatgcaccattcatggcttctctaataggaagagttctcttaggcgcattgttttcgtgtaatataggtcagagctgatgggctcgccaaattggtctggggttaagacatttgtttgtgtaatggtgtgaaataataacgatccaaaaaaaaaaaaaaaaaggccccta

SEQ ID NO: 31207 - DNA, 688 bp, Triticum aestivum
  Clone ID: PAT_TA_31207
ccacgcgtccgcccacgcgtccggcgcggcgtcgcggcacgctggggagtcgtgggcggacgacggcgagtgggagggggcgtcgtccacgtcggaagacgaccaccaccaccgccaccaccaccatgacgcgtcggaggagcacttgtcggaggtgacgatcaggatcaccaagaggcagctgcacgagctgatggggaggaagacgcccggcggccggggtagcagcactcggcagctgctggcggatatcatggactccggggaggtgcaccaccatgacgtgcaccgggaggagcactggaagcccgcgctacggagcattccggaggccgtcgagtcatgacgagacttggtggtggctacgtacgtacttacgtacgctgcactgccgagctctctgcggacagattaaagttgccatttccctcctagcctcttttctcttttctcttttctcgttcccacggtgtgtttccatgtccttgaatgggagtactcccttgaatggttgtccatgaccatgcatgtacaaagattggatttggatagttcgttcaatttctagggaaatacgtataaaaaatagtcactgatgtacataggatgtaggtgtagggaaataactgtgaataccctatttcgcatgccatttttttctaaaaaaaaaaaaaaaaaaaaggcggcc

SEQ ID NO: 31208 - DNA, 807 bp, Triticum aestivum
  Clone ID: PAT_TA_31208
gccggccgggttcgggcatcttgtctcgcgtctgatttcgatttcttgcctgcgagggatcagaaaaagttgaacgagctagagctcgctagcggcgggccggcagccaggagagaggcagtcgtcagtcgggaagcttatctgatctgatggggaactgcgcggcgtcgcggcacgccggggagtcgtgggccgacgacggcgagtgggaggaggcgtcgtccacgtcggaagacgaccgccaccgacgccacgacgggtcggaggagcacctgtcggaggtgacgatcaggatcaccaagaggcagctgcacgagctgatggagaggaagacgcccggcggccggggtagcagcacccggcagctgctggcagacatcatggactccggggaggtgcaccaccatgacgtgcaccgggaggagcactggaggcccgcgctgcagagcattccggaggccgtcgagtcgtgacgagacttggtggtggctacgtacgtactagtacttacgtacgctgcactgccgagctctctgcgaaacagattaaagttgtcgcactctgccatttccctcctagcctcttttctcttttctcgttcccacggtgtgtttccatgtccttgaatggttatccatgaccatgcatgtacaaagattggatttggatagttcgttcacattgtcactgatgtagtgcataagatgtacgtgtagcgaaatacgtaacaaattgtcactgatgtacatacgatctaggtgtagggaaataactgtgaataccctatttcgcattccatttttttct

SEQ ID NO: 31209 - DNA, 731 bp, Triticum aestivum
  unsure (1)..(731): unsure at all n locations
  Clone ID: PAT_TA_31209
agagcgaaacaacaccgatatgtactcgggatcggcactacgggtggtagagtcttgcctcgtcacgccgagcgatgagacgccgcgggaagggctctggctctccgcgctggacctggtgctggctaacagaggccacacccctctcgtccacgtctacagcgccagcgacgtcgccgccgccgacggcttcttcaacgtggccaagctcaagaagtccatggccaaggcgctggtgcccttctaccctctcgccggccgcctcggtgcggatcgtgacggccgcatcgagatcgactgcaacggggagggcgcgctcttcgtggtagcccgctctgatcgcaccgtcgaggacttcagcggccccacgccgtcgtcggagctgacgaagctgttctgtcctcgcgttcagccgtcgtccatcatgttggccgcgcaggtcaccttcttgaagtgcggcggtgtggtcttagggacagcggtgcaccacgccgccgtggacggctccagcgcgttccatttcattgggacgtgggcaaggtactgcagggacggcgagggcgcccgtgatcgagctcccgtgccacgaccgcgccctcctccgcgcgcgctccccgcccgccatccaccccgaaaccgtctccatgttctgcagcaagcctacgcatgcacgagcacgagtcgtccgtcctcgcgaccaagtcatcaccatggtcctccntcatctccgg

SEQ ID NO: 31210 - DNA, 206 bp, Triticum aestivum
  Clone ID: PAT_TA_31210
ggaacgagctcgctccgatgcccggcgaagtaccagggttcgactaaaccttcataagcagactaaagaactggacgttggtgtctcgggtgtaatttaatctagagcatgaacgctgtttttctcttttcttttgaggacagtttacagcatgttgacctattgccgttttattattgtagagttgttattgtttaaaaaaaaaa

SEQ ID NO: 31211 - DNA, 186 bp, Triticum aestivum
  Clone ID: PAT_TA_31211
aaaaagtttgtttacttgcttatcttgaagatttctaatgggatttttacatacttcctgccctggacaagagcagagcagagccatatgcctgacatagtttgtacaccatgacacatgctactgaatcctctttcaggagctgctatatagcattgcacgtagttccttgcaacatgctgcaac

SEQ ID NO: 31212 - DNA, 1055 bp, Triticum aestivum
  Clone ID: PAT_TA_31212
accggttctcttctccccatgactgcagccccgattacagcgatcgcgacggtggatcgggggaggccgccccaccggctgagctcctatccacgccaacatcctaccccgcgagaagccggccctcttctccccccaattgcagcgaccggctacggaagattggaggaggccgccccaccgcagcaccgccgaacatagatctgccgcatcaacccgccttgcgagcacccggctctcttctcccctgcgatcggcgacgtctctctgtgatttcctcatcccgccaccccttgatgttcaatggttccactatatcctgcttcacacttacagaatgaaaaccgatggtgagaatatcagacttcagttactaaaatcatgccaccagttctggagactgagagagcaagcagggcatatcttgcggaacggaaaataaagggtgaggcatatttgaaagaaaggggaggaaggaaaggagatgaagaggaggccgctcttcctatgtcgaaagcaatggcacctgaaggtctgggagctcttcttcatcagtagaaatccgagttctagaagaaagaattgaatagaaggatagagaggcaaaacatgcaaatgctaggcacaaggacgagttacctgtgagacttgaagcacaagacatagcatttgaagagatgtagaggaaagcatcaagaagaattggaagttgtgaagaagagccaacaagagaagaatgaagcttgggaaaagaagcaacatgagacggataacctgattggtattctctcaagtgctcaagcaactcagcaagcaagtcagcccaaacttgatggtgcatgaaggccatccttttgtgatagaaagatagttgctgaatcatacattgcaataattaggacaacacatgtgatctttcagttatgaaaatattactttttatcttgtctattgtcgtgtcaaacttgagtcagtgttatttttattatcacttctacttggtggatgatttggctgagacgattgaatgtataatatgatttgtctttcatttc

SEQ ID NO: 31213 - DNA, 747 bp, Triticum aestivum
  unsure (1)..(747): unsure at all n locations
  Clone ID: PAT_TA_31213
ataacatatttagatgtgcattagaaaaagcgacattctatcgccggatgacacgattaagaacccacttggagtgcatcaaagtacggctgcatttccaatcttttttagacaaacaaagctagtactagtacataactgctcgcctgccatacggctttgtgcatctccatacatcgccctatcctccgtcttgagaatgaccgaaagagagagacatccggacacgataagcatcgcatcaatcacttcgcttcagcttttgatcctcttatccttccatgggcagggtagtcagaatctcccgcggcattaatacactcacgacagtaactaataaccggaacaaacgtgcagccgcagtaacaatttcaggtactaccgcgtgcaatccgccgcacgaactccatcaggctccggtccgagccgccgccgtcggccacggccaccctcgcctcctccttccacgacgcggcgcgcgacgtcaccgcctccgacgtagcgatctccacgcacctcctcagctccccggtctccaggacgccgtcctccgcgcgcgccgcggncggacacccacgcccagcgccgctcaacagccaagcgttcgtccctggtccgagtactggggcgcaatatgggtagccgnagcangctctcangtcantcaccgatggtacnagcaccnngcggtcanagaacccctgtcnacatcanaaancgcncggtctctctgtgcncaaccttgag

SEQ ID NO: 31214 - DNA, 380 bp, Triticum aestivum
  Clone ID: PAT_TA_31214
taggggccttttttttttttttttttagtatctattcatgattgatatatgtacttttatatcatttgccgtctttttcatccttgacaacagtgacaatctttggtgtgtacttgtccagttcagccttgtcctcttctgttggtgtcaagccgagcgacttctcgagtggatcagtcaacatgagtcctgcagcaccccatgcgatgacagcaacaccgacaccgagtcgggtttttgatgaaagattcttgtaagccttgagcatgtttggagacgaataagtgagttgaaaggatggggcagtctacatgaccttgccagacgggctgatggtgagggatttggtggatgaatgtgacctccggagcccggccggc

SEQ ID NO: 31215 - DNA, 866 bp, Triticum aestivum
  Clone ID: PAT_TA_31215
gaggagaataagatttgtattactcggataataagtactccatccgttccatgttacaaccggttgtaataacatctataatatgggacagagggagcaggttacaatcaatcagctaatgtaagctgtgaaacaaagtcccattaccagtgcaaccaacttggtccggacacacacaaaatcggttctattaaaattcgctaacacatgtatcaaccatactgtgattagggctagctttcttgagcaaaacctcccagattcctaatatcagacacttactctctgtcaatagctgggataacttagatcggtcctcactggtactcatcacgtgccgcatggtaaactgatgcacatttataacattggacgaaaaggaaacaaaagggcgagttcctcttggtgctcgaattctctaccatgccaggattcggcgtattgtacatgaataggttgccctttgcccaccctagttgttttatgtgctgacaacaagaatgggctcgggctatctatatgaatgcctctcgctgttctgtaggcagcttcagttcaggctcgaattctcctagtggggcaaagtaagaatctaccatgtcctcggaaacgaactcgagcgcaggaggatcccactttggggccaagtccttgtcaaccagtcgcgctctcacaccctcacaaaaatatgataaaatggctttgaaatgccattgatggacatgcggtattcacgcacaaggcattcatcaagtgtctgatatctaccttcgcgtatcgatcgtagtgatactttcaaagcaagtggggaggcctctttcaatcttttcagtgccaatgaacaccattcttcattcaactgagcc

SEQ ID NO: 31216 - DNA, 813 bp, Triticum aestivum
  Clone ID: PAT_TA_31216
ttttttttttttatttaaatcccgagttgattagaatgactgtgcgaatctatagtctaagtttggcatcgatttcgtcatggtggtggacttatggtgtttgtatccttcctgcgagcttcatccgaactttggacctccatgacgaagcttcggaggtttctttccgccggccctccgggagccattgcatcccgcgccatccctttccgagactccacttttttcctgacctccacggccctcgcgccgtcgcccatgaccagctcaacgcacctcgccagctccggcccggagaagatgccctcgccgttgcgctctcccctaacgccggcagcccactcctcctctatcaacatcgcgttcgtcggctggtcgaacatgctcggcgcggcgacgacagccacacccagtgccatggcctccagcgtcgagttccacccgcagtgggtgacgaagcaccccacggacgggtgcgagaggacctccggctggtcgcaccactccaccaccatgcccttcctctcctgcacgacgtcctcgaggcagcggctcacgtcctcctgccgcccgtccttgcgcaccacgagcaggtacggccgtccgcaccgccgcagcccgtccgcgatctcctccatctgctgcttgctgtacgtccatatgctgccgaacgagacgtacaccaccgacctctccggctgcgccccgagccactccatgtacctcgtcttgtcggcaccggcgtggttgaacagatggatccgcgcctcggccgacgacccgaccacggggccgacggcgaacacatccaag

SEQ ID NO: 31217 - DNA, 737 bp, Triticum aestivum
  Clone ID: PAT_TA_31217
ttttttttttttcgtagcataatattacaaaagctagttgatacaatagctagtgagagataaaattcttaatgatacagcacaaaccctataacggtagaaagtatgaataactctacagaaggtaaaatgactaaatatctggaaggactatgagatacaaaatttgtgttgatgggaaatggcatcaggattttattaaaaaaatgcctaggtggcatgatgccgatctccctatacaaataggcttgccataacctgtaatcctgtgtgaagataagaaatttagcttagacagcatggaagccctcgtcgtcactatcaccaaacatggttgccattttcatggctatcttggcagccatctccctcctttggaagtcaggaacgagccttaggttggagcgcatgttgccaatctctgacattagtcgctccagatcatctacgccataatgatcatcctcaaacagtgcattgacctctggggtgtcagttcgctggtcctcagaagtatctgctccagtgttatccacatgattactactatcttcagttgtgtgactctgagttacaggattttcttcagcaggttctgtagatctgtcatttggaagagggttgggcgccgaagaacgagcattgccgttcaccccttgctgttcacaactttgcatatgttgtcctgcatacaattagcttcagccacttgatgtactcgattcaccgatgaattc

SEQ ID NO: 31218 - DNA, 852 bp, Triticum aestivum
  unsure (1)..(852): unsure at all n locations
  Clone ID: PAT_TA_31218
attagacatgaccaaattcccaggaaaaataataaacttgtaatatgacaattcttttaaaaaagtgttatcagaaacgagctatcacgtgtggagatcaatggctttcaggcgaaatgatcaatcttatggccacattcatggcatagtttgttcaaatgatctcatattgtgcacaagggtgcatattggaatggcaaacaatgttgcctaaggaagttttcattttgtttggacgaaaaaaccattttccatttttcgagtgcccaaaaggaggtttttttgtgaaggacctcccaaataattgttgcaaaattggaccaaatcatttttctaaaatactaggccatatttaatgcacaattgacaaaatggttgggtgtaaaatttttgatccacctctccgtgaaaaagacaaatttccgccgattcaccttggatgcggggcaaatttgggccgcacccgtctcccagtttgctagcattttgtcccaaatgcctttcctaggtgcataatttccttctccaccggagatacatggtttcgccggccattcgcccgggctgggcgctggcccacccccggctccattacgcctaaccccctcaccgacgcgttggcacgcctnaccctggcatgcagtttcctnancgcaaagatntcaatggtnggcatcccaagtagngctagaagaatncacatagatccacaagngacgatgatgccaacataataacaacaatgttgntacgtacggaaatcaatgcaatgggcgtagttttgccagatgttancacaagngaagtntcaaatttcaccaaggggttccangggatncttnaatcacggna

SEQ ID NO: 31219 - DNA, 1337 bp, Triticum aestivum
  Clone ID: PAT_TA_31219
gagaactagtcttgtgtttttttttttttttttgtttacagataccgcagtttcatcccagcggcttgcaaacacactcagacagagcacttacacatcagttcgagccatcgggtgtcctgttccacaaatattggcaataaaaatctttcgtgtgtcgggcaaaaaaatgcagcgaatatctccagatacaggtgcatttccatccctcttgccaagggattggtgttaggtgctaaaagacatctcccattccctatctcaactgtggtcatatactcctacagatttgctatagttcttcctatccgtggtacaacaactcataagcactctgatatacactgacgtttagcagcattgcaggacataccacataatggcaaattggcaagtagcgaccaagcgtttttcttcagctgctgctgtctccctctagttcgcttcgtatggtctcaaacagcatctcgttccatgtatctataggtcctggcatgcaccaatgcagacaatcctggggtggaggcttcccatctggtcctctttgagtcttcttgtttgggtcgggacttctgtatggaccaggatgcccgtcagctctcaacgcaaagggctcagtgatgtccatcaatttcaacttggagccatgtttcccagaattctgcactgcctttctgaagcctgcaacttgtttctcatacattgcatccgtgtatccgttcctcaccaccacatccaagggcttaaccttcccggtgcatgacccaccagtgttccatgccccgccttcataatgatctggagagtatgtgcgcagaacagctatccctgtgaaatttgggtgggtcgccacagcagtcaggcaagtctcaactgacacaccaaatgcgtcaacgttgtttatctgcatctttccagcttgttgaggccaccagagctgccctccaacaacattgccattctggatataggctgaccgtttggcgaaccagtgtccagatgacaggacaagcacatcaaaagaagcgataaattgcatgaacttctcatctgctacatccaggaaaaccttatcaagacccttaggagcaaaccccacagcttcaattgagttgtgcactaaccaagcagaccagatgcggacaatagtcgttttggttgacctgaagatccacctgttcatcctccggccgccacggtctactggggtttctacctgccacagaatgcaaaggagagattccatgtgatttcgagcaaccgagtccccaacaaaggcaagagtcttgcctctcattaactccaagaacttaattccatcaaagcggggagggtgc

SEQ ID NO: 31220 - DNA, 1301 bp, Triticum aestivum
  unsure (1)..(1301): unsure at all n locations
  Clone ID: PAT_TA_31220
cccaggcgtccgcttagaaacaacagcgtttgggtgcaaataggatagaacaggggaggagctgggatagaccaagacagttcctacattgaagtccgcctcggggaggcccgcctgaaatctttaccaaggagggtacaggcgccttcctgaagtccgcctcggggaggcccgccgctgccacgacccgcacggccccgccgcgccgggcacctccacggtggagccgagctgaggcgccgcccccacgtccgacgaagccatgcgcacagccaccgcgccgctccggaaggggacggggaggagaggcaacggcggcggcgagcggcgacggagggcggcgaggcgggcgcggagcgagagggcgagggcgagggcgagggcgggggttttctgcaaaaaaacatgccacgtcggcacctgacgggcgggccccgctagtcagatacaccgtcaatatgtgtttatacgcagtttagacctatttgcaaaaatctagagcaatgctggtactgacatgtaaaaattagcaatcgtggtaccaatctgcatgtgatgtcccaattgaggtacttgtgtgcaattaactcgtttaccagcagcaaatcttcggcaggctatatatacagagcatgcacgaggtgcacggccgcagcagcacgaggcaatcaagcttaaccaacgggcaacgggctacggggagcgcatccttgtaagcatccaaaatggaggcgaccctgtccccaaaacctcacttcgtggtcatcccatggccaaccaccagccacatcatccccatcgtcgacatcggctgcctcctcgccctgcacggcgccgcagtcaccatcctcacgacgcccgccagcgcgcagctcgtccagagccgcgtggaccgcgtcggcgcccagggcgactctgccgggatcgaggtcgccgtgatcccgtacccgtccgtcgaggccgggctgccggnnnggtgcgagaggctggaccacgtcccctcgcccgacttggtgcccagcttcttcgacgccaccacgcgattcggcgacgcggtggcacggcactgccgactcatggcgtcgccgcggcgtccgagctgcgtcatcgccggaatgtgcaacacgtgggcgagcggcatcgcgcgtgagctcggcgtgccctgctatatcttccaaggcttctccgcgttcgcgttgctgtgctgcgagtacctgcacacgcacaagccgcacgnnncnggtcgcgtcgccagnnnngcnnnttcgacgtcnnggtcctgnnnnnntncnngtgcaagt

SEQ ID NO: 31221 - DNA, 1080 bp, Triticum aestivum
  unsure (1)..(1080): unsure at all n locations
  Clone ID: PAT_TA_31221
cnnaaactttttctgcaacaagcatggtctagcattttatatttcttgttacctttcaggcaggcatgaacggagactacggtgcacttgatcaccaatgttctcaaacatctcgttacagaagaacacacagtatgccccgttcggtgtttataggttcaacgacgagccactagacggcggtgatggtggcaggacgccttccttcttggccatctcgtacagagctatggccgagagcgcctttgcgtctgacgttgagcgccaaagctggtcgtaggggaccacacgcagcttgatgagctcgccatgatcccgcaggcccgtttccttcccttggagagccctgatggtctcctcgtccacatgccccctgtaaaggaacaggccaatctcttcgtcacagccacccggtgatggtagcattctgcacccagtagtagcagggtccagcaaagcagtaagatcaaccatgtcccctagatttaactttataccagtttcttcttcaacctctcggactgcagtgccaacaaagtcaccgttttcatcatctagcattccagctggtagttccaatataaattttccaataggaactctagcctgttcagtaagaacggcataaatttgccctttagactccaaaagaaccaacacagcaacagcaggccctcttgcgaagacaatccctggaatcttggattgggtctcctcgtcgacgatgtcggctttgaacttgaggaaccccacacgctgcccgaacatgtccaccccctggatgaggatctggcggaggctgagcttcccgtgggcgagcaggcccctctccgcctgcaggttctccagccaccgcctgaacagcgccgagtccagcgccttcctgaagtccacctcggggaggcccgccgccgccacgacccgcacgggccccgccgcgccgggcacctccacggtggcgccgagctgagcgtccgaagaagccatgcgcacagccagcgcgccgctccggcggggaagggggagggaagagaggagaggcagcggcggcgcgcgcccacgcgtccgcccacgcgtccg

SEQ ID NO: 31222 - DNA, 967 bp, Triticum aestivum
  unsure (1)..(967): unsure at all n locations
  Clone ID: PAT_TA_31222
aaaatggacacgagagagtctgaggcaaagcggtaagtgctgacaggtgagcggtgggcagcagcctggctggtgcgcgctgcctagcagcctttcagcccggtggcgacaaggggttcaacccggtgcattggtggagtaatgacaccatcggtgtagagtcgacgaggcttcaggcgcctacgacttcgttccgttcgacggacctggcatggcctgcaagcgtgacagcgacgtacccaggccaccaggaagtcatggagtacatcaggtcgtacgtgtgcgagtttgacctcctcaagtgtatcaagttcagtagtcaggtgttgggagttgaataccttggtgcaactgaggaagagatcatggagtgggagcattggtctggcaatgggacggcattcggagctggcaaggatggaaggtggagcatcacagtgaaggacctgaaaattggtgatgtggaggtttttcaagtggattttctcatactgtgcatcggaaggcatagtgggaccccaaatatcccggaatttccacctaataaagggcccgagttgttcaaggggaaaatattgcactctatagactactcttacatggataatgtggctgattttgttatagggaagagtgtgacaataattgggtccgggaatcccgctttcgacaccgccgcggtgcttgctggggggagtggtgcccatcacccatgctccatcatagactgatcgtggctctcgctggtgggttaacccagcctctcgggcgctccccgtcgttacttcgcgcgttaccccttttcgcaactacttgttcataaacctggtgaaggatttctgcactatttattggcttgtgcactctctcccttgagatgggcaattacaaaagtaattgaaacctacttcaagcaaaggattcctctagaaaagcatgggatggtacctcggccgcgnccacgcta

SEQ ID NO: 31223 - DNA, 651 bp, Triticum aestivum
  Clone ID: PAT_TA_31223
acatttgtagctgctgggcaagctccggcacgagagcgtggtggatgtcgtcgcgtgctaccactccaaagaggagaagctcgccgtctacgaacacgtgcccgggcgcagcctcttcgagctcctgcacgagaacagaggcgagggcagaatgccgctgccgtggccggcgaggctgtcgatagcgaagggcatggcgcgcgggctggcgtacctgcaccagtcgatgccgtttttccaccggccgccgcacggcaacctcaagtcgtccaacgtgatcatcctggcgacgcccagcggcaagcaccagcacccgcacgtggtgccgaagctcacggactacggcttccacccgctgctccctcaccacgcgcacaggctggccgcggccaagtgcccggagtacgcgcgcggcaagcgaccgtcgtcccgggccgacgtgttctgcttcggcctcgtgctgctggaggtggtgacggggaagttgccggtggacgaggctgacggcgacatggcggagtgggcgcgtctggcgctgagccacgagtgggccacgggcatactcgacgtggagatcgacggcaagctggagcggagcggggacatgctgaggcttacggaggacgcgctgatgagcactggtggggagcc

SEQ ID NO: 31224 - DNA, 374 bp, Triticum aestivum
  Clone ID: PAT_TA_31224
catcgaccgacgcggcaagtcggccggcagctagcaccccgtcaaaagcgcacaacacaagctcgaccccacgatggccggcgttcgccgcgccgccgccctcctcctgctgctcgccctcgcgtgcacccccgccctggccgcgcgcgacgtcgccagcagcgccgcccaggcgaagaccaagcacccctcgggcccggcggccggcaagaagcctgccaagccgtacatgccgccggccaccaagcttgcggggtcgggcggcgctggaggcggaggcgggatgccggccatcccgggcatcggcaccatcccggggttcaacgtgccggggatggggggcgggtggggcgggggctacggtgggcccgacg

SEQ ID NO: 31225 - DNA, 967 bp, Triticum aestivum
  Clone ID: PAT_TA_31225
agcgacgcgctggtgtctgcccggcgcccgccatcctccgcattgtcttccaccatttgtccctagtgagccgggggcgtgcatttgagtgccgtgccgctttttctgggggtcggcactgcctaggtctggggtgtggagttggctccttcctgcccccggaccgctcttggcttgctgtgcagacgacttccgcctgctgcggctaacttaagcgaggctatagatggcgctgatggttttcagaacacgcaccaatctcagcattgtgaatcagcaaaatttagtattgagcaggtggtgttcattttagagaagatacacattatgtgggaatcggtactgcctaggtcaatttacaggagaagtatgtctcatgtccttggacctgtcttttctagaattacaaaggacatgcttctgatagatgacatggctgccgagctgtggtttcacatcatctgagatgcggaatttcatcaaagcaattttcgccgattcacctcttcgaaaggagtgcttaggctggatcgccgcgaacccagcttaggatgcagagtgctgttgttgattactaggtgccctcattacggccctttatccccatcagattctgtagacacctttactgactgtatatcagctgctataggaagcggggagctagctaactgtggtttcacatcatctgagatgcggaatttcatcaaagcaattttcgccgattcgcctcttcgaaaggagtgcttaggctggatcgtcgcgaccccagcttaggatgcagagtgctgttgttgattagttggtgccctcattatggccctttctccccatgggattctgtgtagacacctttactgactgtatatcaatcgacatagggttcagtttgcactgaagctacagggcttgcggtttatttttatagaagaaacaacctgatcaaaaaaaaaaaaaaaaaaaaaaa

SEQ ID NO: 31226 - DNA, 896 bp, Triticum aestivum
  Clone ID: PAT_TA_31226
cgcagccatccatccacagccaaaagaaaaaaaagaaatcttttcaaaaaaaatccgattcgctcctcctctcgcgaagcaactggtctgccggcgccagccacccatgtcgtcgctcgctgccggctacgggctggacttggacctggagttggggatctggttcgcgggcctcttctcggcgccggaactggcggcggctgacctgctgctgcagctcagcgtactcggagaggcggaggccacgaagccctcgcggtcttcggccagttcgtgctgcgagggcctctccgtcggggtggaggagcgggtcttcgaggagaccccgtcgtcgccgtccacggagctgctggacgcgagggcgaggaagaggtaccgcccgctgtcagagctctactccgacacgatcccgccgacctccgccgccgccgccgtgaagaagaagaggaggaagacgcaccacgaccaccgcggggcgtcatcgtcatgggagtcggaggccacgaggtacggcggagactactagactactaaagagtagaggtacacaggtagaagacggctcttgtgtaattaccgcctctcttcagagaagaaacgggaaaagacaaaattgtgttcagaaagaggaagcagatggttagcggctccgccttttgaatttgaaatttgaatctggccttccgagatctgcaaaacatcagagctcatcattacctaccaactgcatgtagcacgccaccgatcttggcatgctctgaattttcttaccaagtcgatttttgttctaaaactatccttttaatccagctatgtactctagcagtgctctttcacgggattttggtctaatgttgtccaaaaatagttatgtcaaagaggtttttccccccttc

SEQ ID NO: 31227 - DNA, 1260 bp, Triticum aestivum
  unsure (1)..(1260): unsure at all n locations
  Clone ID: PAT_TA_31227
gacccagcgnccgcccacgcttccgacccatcccgcggccgctgccgagnataaatacgggaggagaaatgccgccgccgtcgatggtgctgcagctcccacggctgggccgattcgccggagtaacggcggcacctgcattccaagacggagcccgcaacttgaattcccatgggtgccacagcagccggcgctcctcctcgtccagcagcagaagcagcagctggttctcctccaacgccgagaatcccggccccgacaccagagacgataacaggactagtagtaggaggtggtggtccgatgaccaattcgacgtggaggaggaggaggaggaggaattcgggagcgagggctcgtttggttctgcaagggagatgttcgacgagccatggtttaccaaggtgttcagggtgtacgggtatgtgctcccggtgctgctggcgtccatgctggtgacaacgcggccacaggctttcctcatggccatggccatcccgctcgcccagtccgttctctccttcgccatttccaagattggttcatttggccggcgccgccgtgacgaagaagaatatgacgacgatggttactattattccgattacggcagcggcggctgggaagctgaagaacagtatagcagcaactcctcgacatacagaggagacagcagcactagtagcagcaggtaccagcagcagcaacaggaggaatctgcagattcagatccaacggtagaatcaggtgatattaacggtaccaccggcaccgcagctagaagtgaaagtggtagtatcggttttggaggatgggacgagctggaagaaggcgacgaccgccgcagcagcagcaggtcgcgtgcacgagcgtcgccggcggatactgctaccgctggtggtgcagtgggaacgagtagaccacctgcaactagaaggagaagaagcagaggagctgcggccgcaaggtacaggcaagcgcccctgccgatgcgcttgctcatcgcgctcttcccattcctgggttcatggttcagaattttgctctaattccataaattagggtcaattcctccacgaagaatatttatcgttgtttctcgtccaggtgtataccaatgtgtatgcataactagatcgatcctcacgatccagtgtgtgtattaccatttgatttttgaaacagatgtattaccagtataattttttagaaagaatatgttcctgctagaaaaaaaaaaaaaaaaaaaaaaaaaaaaaa

SEQ ID NO: 31228 - DNA, 631 bp, Triticum aestivum
  Clone ID: PAT_TA_31228
cccacgcgtccgagcttctactcgccaccccctcctgctctgcagatcttagccaaggtcttccgccgatcaccgcctgcgccaacctcatggcccgcttcgccgtcgtcgccgccatcgtggccctcctggccgtcaccgccgccgcgcaggcccccggagcggcgcccaggatggcgcctctccccgcaccgccggcgaggtccccggccaccgcgcctgcgccggtcgccacgccgcccaccgccgcgtcgccgtccccgctggcctctcccccggccccgcccaccgacgccccgaccgacgctccctccgcgatgcccccgtccgcggtctccggcacacccgagggcgcacctgccgctgcccccagcggcacccccgccagctccgccgtctacacgtcctccgtcagcttcgtcgccgtcgccggcgcggtcgccgccgccatcgtgttctagacggagcgaggctctgctctccgtgctctgttttcgcgttgtttatactggagagattctttccatgattctttgctggaccgactgaggagagggatacataccaccatgcgatgtaatcttgttacggatgcatgagattattatgaatacaaattcgtttattcgtt

SEQ ID NO: 31229 - DNA, 929 bp, Triticum aestivum
  Clone ID: PAT_TA_31229
gaaaaaaaactctactagtgagtatatattatacaataataggaacaaaattacacttcacaaaagtccaaaggattcaaaatccaaaacagacgaactattttaagagcaataatgcatccagaaaattgtagaagtaattttctgtagttatggtaacactgaaatttcaagacaaacacttcctaaaatcatctacagaaccctgaaggtagcactcttgtctcatcttcttttcctattgaatacactagtgagaaaggtgctattgtcttcagcaaatacctgcataatcagcaggtccatatggctggaaccattcagccaggaatcctttcttccttctagggttgcatccgatgtcttggcacaacagatcattaaaccaaatattcacggtgcttatgcaagatctgcggaaatactttccattgtaaagatccttgtactttgcccactctgttacattctcttccatgcatcttacgcttggcaactggaagccgccagctaggaaatggattacccaattggccatcctctccgaggcatatatgtttgtaaggctctcggagtatccgactattgccaactgaggaatccgaggatggatgcattctctatataaaggaactgatgtatctgatgatccaaccactatatttctacaccagtttgccgtgaagatgtccctaagcttctggtctcctctgaatcctgttgctagaattacaatatcactctttatgcattcatttccatcctccatgataatcccattaccgcagaagctgaacttcttggatttcttaagaataatgctgccctcatcaaccctgtcataaaacccttctggcagcaatgcaatcaagcaagaagacatggcgaaggagtagctgtagtcaggtacctcggccgcgaccacgcta

SEQ ID NO: 31230 - DNA, 1079 bp, Triticum aestivum
  Clone ID: PAT_TA_31230
agataaccaccactgaacaatgggtgcacacaaatacagaaacgacgtctagactctctagaggagctactgggaaaataaatatcaagaacgttctcaaataaaaattatggcgtcactaacaagaagtcatatgcaagggtacaaattgttatatcttcacgttaatcactagaaaaataccacagttaaaagcaacaaaattctatgtcactaccagtacaaccagtgaattagaactatttgcacggacttattcagcttggtcaacttccattgcttcaacggagtccgtgagtatttccttcaacttttgtcctctttcttttgccaagccaatgcacgccttaattgttgccatggacgtcactccacctccaggtttttgtattgacactaagcgtccggaagaatctagaacaactgtcacagacgtctctattattgattcttcttcagcagttgggtccgctagaatactatccttgtgaagtgcacatgtgagaggaaatggaatgtcaccaagagtaagcttcctcttttctctgtttaccaattcatatttgcttttgccttcattgcctccaacagtaaacactctaccatcatcaccaacagatactaggggaatttccaaatgtgtaaatgcagccaccactgagatcagtgcagcatcaaacaaagatccatcagcattcaaacaatagacatccaggtatgctacccacgaagccttccccttcttgccgagttaccaagtaatacaacattgtttcctctgacaggttcatctgtatcataaaattgtgtacacaactttaggccggtgctcttaagaactgaaatagtgaaatgtattctcatactgaaaacccggcataatcttaatgcagtagaaaccaattatcataaatcaagttaagagatcattcacgtttattcaaaaaattcacataaaatatataccgaaccaaggagcaaaaagatacttattccaaacatgaaataaaaccaccacattattccgtatgaggaggttatttagactttcagtgccagtttggttgaaaaactaagtc

SEQ ID NO: 31231 - DNA, 723 bp, Triticum aestivum
  unsure (1)..(723): unsure at all n locations
  Clone ID: PAT_TA_31231
gtgcggcgctcgagccggccgggctgcgnnaaaggtaaagagaccgaacccaagcaactcattcttctttctcgtccgctcccactcgcctccccgcgtcgccgtcgaacccactccgccgccccgtcgccggcagcgcccccctcccgcgatggccacccccgacctcctcttcaacctgcgcaacctcttctacctcggcgcctaccagtccgccatcaacaacagcgacgtcccgggcctcgacgccgacgccgcggccgagcgcgacgtcatcgtcttccgctcctacatcgccctcggatcctaccagctggtgatcagcgagatcgactcgtcggcggcgacgtcgctgcaggccgtcaagctgctcgcgctctacctcaccggagacaaggaaggtgcgatctccagcctgaaggaatggttgagtgattcagctataggaagcaatcctgttctgcgattgattgctggaattatatttatgcatgagcaagactacaatgaggctctcaagcacacacacactggggggactctggacctgcatgcactgaatgtccagatcttccttaagatgcaccggtcagattatgctgacaagcaactgaagatcatgcaacaaaccgacgaggaccatacactgacacaactagcaaatgcttggctcgatattgctgttggtggctctaagatccgggaagcttatctcatattcca

SEQ ID NO: 31232 - DNA, 934 bp, Triticum aestivum
  Clone ID: PAT_TA_31232
caattttggttgatggtcgatcgagaggtggtagatacagatgcaagaagagagacatgttgatatggctattgcttcctttcatgcttcaccggcgtcgatgccaccaaccacaagggacattgcaaagatatgaagggatagtctttcgttaaaaacctgatcttttgtttgaaagggtctaacttttactgtgaactacttatcatgatcttattttgaagtgatggatttttacagatattaggtcacggggtcagagcacagtaacctgacacggtgttccaaactcaggcggtcatggtcgaccagatgtcgaagggcttggtagaaattctcacggagaaagagaacaagttttgaagagattcagtgtaactggaaattgtcagactcaccggagatgctgtcgcgtgcaaaccctatgcctggttcctggacttggtcggcctctcgggggatgtagctgcgctccagtgtcgactcctcgaccaatgacgctccatcccaaccccaccaatcttcaccgctgcttgacgacatggagctgaacaccgctgcaaccatggtggcgccccctctgaccaagcaaaaaaatttgagatatctcatatattggcaaagctaatgcctgagagggagctacccaaacaagcatgctttatatttggggtgtgtaggctggaaggatcattggtaattgatcctatcaaaggaaggcgcgatctccagcctgaaggaatggctgattgatttagctataggaagcaatcctgttctgcgattgattgctggaatcatatttatccaagagcaagactacacacgatgctgtcaagcacacacacacaacggaggaactctggacatttcatcatcttctgacattggaagaggatgcactaagttataaagtaataaagtaagacatgga

SEQ ID NO: 31233 - DNA, 1722 bp, Triticum aestivum
  Clone ID: PAT_TA_31233
gggtcggcccctcgaccaatgacactccatcccaaccccaccaatcttcaccgctgcttgacgacatggagctgaacaccgctgcaaccatggtggcgccccctctgaccaagggattgcgacgccagcaaagcaaaggaagatccgcaacaaaactctgcaaggttaattcactgatctgtacttcaaacttgattgttgaattgtactaaattccatacccggtcttccggtggcctccctgcaaaaaaattgagatatctcatatattggcaaagctaatgcctgagagggagctaccaaacaagcatgctttatatttgggacgtgcaggctggaaggatcattggtaattgatcctatcaaaggaaggtgcgcgcacgcgtgggccaagcaactcattcttctttctcgagatctcccactcgcctccccgcgtcgccgtcgaacccactcctccgccccgtcgccggcagcgcccccctcccccgaagtccgccgccccgtcccccggcaacctgcgcaacctcttctacctcgccccctaccactccgccatcaacaaaagcgacgttccctgcgtggctaccggccccgcggcagcaagcgcgacgacccgctcctggacctcgatggccctgcgatgctagacggctggtgatcccgcgagatcgactcgtcgggcggcgacgtcgctgcatggccgacaacgctgctggcgctctagcctcaccggcgacaaggcaaagggggtcatctccaagcctgaagggaatggttgaagtgattcagatctccagcggaaagcagaatcgtgttgctgcaattatgattgctgggaattcatatttttatgcatgagcaagaatctacaatgaggctcctcaacgcacacacacactggggggactctggacctgcatgcactgaacgtccaaatcttccttaagatgcaccggtcagattatgctgacaaacaactgaagatcatgcaacaaactgacgaggaccatacactgacacaactagcaaatgcttggctcgatattgctgttggtggctctaagatccgggaagcttatctcatattccaggactttgctgaaaagtaccctatgacgggaatggttcttaatggcaaggcagtttgctgtatgcatatggggagctttgaggaggctgaaactctattgcttgaagccctaaacaaggatgcaaaggatcctgaaactcttgccaatcttattgtatgtaatctccaccttggcaaaccgtcgtcacgatacttcagccagctgaagctgtcgcaccctgatcacgtgctagttaagaccaccacgtccgcggagggcaacttcgagagggcgctccaagccgtcgcctgaaacacccctgcctcattcgagttagcgcattgagcatcccctgttccattttgaagtgctttaacagagtgaattgtattggttttgctttatattgttcagtggtaacacaccgctcggccaaccctgtactcaaacacaaacacccgctgtaagaacggatatatatgtagaatctccaatcatggaatttgttgtcaacatcaggttgtgctggctaattcctccgccagcgacgtgtctggatcatgtaaaacatcgtgctctctgtgatgcctgtatccatatgcgcacgttatgtgatttatgcgtgcaaaaaaaaaaaaaaaaaaaaaaa

SEQ ID NO: 31234 - DNA, 742 bp, Triticum aestivum
  Clone ID: PAT_TA_31234
ccccgcccccccccccgttggttttcttttttgtttttttatgtcttcgtcctctcgtgtgctggtgcgcatggcacttcaatcaatagtacgacagcgtacatgcaatgatgtgaacagctagccctgttccaaatcgaaatatacatacagtacactcatttgtactcgtaggcagtatgtatatagtactccgaccgatggcaacggagtggcgagtcggatcacaggctcagagcctgccgtcggcggaggtccacctgtcgagcatggcgaggcactccttggggcggtactcgggcgcggtgtggccgccgcccttgacggtggcgaaggtgaggttgtgggcgtactccgtcgtgaacccggcgacctgccggttggcgtaccacggccgccacggcgccaccgcggggtaccccagcgtccggatccacgcctgcgtgcccacgaaggtcatgtccaggtcgtggtcgccgttgtacaccagcgcgcggtagccgcgccgcgtcaggttggcgtggtagggcacggtgctggccacgtcgtgccggaaatgcgtcagcgtcacgcaccggctccacgcgccgaccgacccctcccggatgcccagcgtcgccctcacctccgcgtcgtccgcccaggcgtacgacagccggtacccgttgtcccggcactccaccgggagcgccagccggtccgccttctgcaccagcagcctcgccgaccgtttcctcgtgcc

SEQ ID NO: 31235 - DNA, 603 bp, Triticum aestivum
  Clone ID: PAT_TA_31235
ttttttttttttttttttttacaaaaatggtttgaattgaactgcacataaatgaaaaacagaaggaggttcaacataggactttgtaagttcaatcttaacaatacgcagaggttcacagcaacataaaattatcacaatttagacaagattacataaaactgaagttttgcagctttgcattactagctccaccaaggaagatttccattgcttgatttgcttgaggatccttttttccctcattttttcattcaacgccatacttcttccaaaatttgatgcccttttgcatgtagaaagcggtttcttttatttttcctgcaaacagagcttggggacgggggtgggcgacgggggcgggcggggggacggcgcctggggggaccgcgccgggggcgggcgcccgggggcggggggggcagcacccgcgggcaggtcgcacggaaggggagggcaggccgcgccagagcgcgggggaggtcgcaccggggcggaggggacgggaggccaccgacgcggcaggtgcgcttcggcgcggtggcggaccggtgtcggtcgctcgagggtggacggggaggcgcccatgtcgggggcagaaca

SEQ ID NO: 31236 - DNA, 457 bp, Triticum aestivum
  unsure (1)..(457): unsure at all n locations
  Clone ID: PAT_TA_31236
gtggtgatttgaggagtgacccgaccaatgtccgcatatgtgcccgggcgcttcgacacccgggggcgaatcccgtaaccatcgcactatataataataaggaataataaaagtaagaaaattagacaagtatctatctcaagtaagaatttttttctttcagaaagaagataagaacaagaggctcaccacggtggtgccggcgacgagatcagcgcgggcgatcgacggcggttgtcgtggttttgtcacggcagatgtcctagagaaaggacttagtcgtggagccatcgctacgggttagcttgaaggggttaaagcggacacatggacgcaagagagttatatactaagtcagccccttacaatgaaggtaaaagcctacgtctagttgtgatggaattgatggggttccgatgactanggagcaaacaagttcgcctattcngaggggggg

SEQ ID NO: 31237 - DNA, 516 bp, Triticum aestivum
  unsure (1)..(516): unsure at all n locations
  Clone ID: PAT_TA_31237
tcataggcacgcaccctcaccactggttttttgccataaagcaatgtgtccaagtaatcttgtttccaaaaaggaataacgtaaacantaaatttgaatctctttgtttatatataataatctcctcccattttattacgtaagtaactagtacaatatcttcttgaaagtagcatcacaaatattcaggattaggtaacacatgaaccacatatatcatttatatgtcgagcttactacttgggggagaataaaaccacacatcaaggctcaatggatggtgcgggtgaattggccaatccgccaccgaacccgcaacagtaaatgttcctagggcagcacactggattgtaccccaccggtctagcagctgcatgtgctgccggtgttgccatcatcatgagcaagcagacttgcgccatgagaaaaacaatgatcacttggaagatgccatttttcgccattgcctaagaacacagaacaacagagaatatgtaattatgcaatagtctatca

SEQ ID NO: 31238 - DNA, 559 bp, Triticum aestivum
  Clone ID: PAT_TA_31238
taggggccttttttttttttttttttccagaaacagatatagatttgagattgggcactgatttgctaccctcatcaagagattgtgaaatacaagaccctgccttactcatcacgtttctcaaatccatcatccttcatcttcaaggtataagcctttccgtacgtgttttggggatcacgtttcttaaacgcatctccctccatcctcagagtatatggtctggtatataagttctcacgtttctcaagcgcatcgtccttcatctttagagtatagggtctgccatataaattctcgcgctttttaaacgcatcaccccccatcttcagagtgtaaggtctgggatataaattctcgcgctccgcgatggcattgtctgggatagggcttgcagctgcaaagccgcacaccgcagcgacgctgaggaattgagatagcttcatgttcaaatgatcaaattgctactgtaaactatcaggtttttggccttttttttttttttttttttttttttttttttttttttcccagacccaggccggcctcggagcgggcc

SEQ ID NO: 31239 - DNA, 974 bp, Triticum aestivum
  Clone ID: PAT_TA_31239
cgggttcccctcccgccgagcgcacgtactactttcttcggcgggcgttccacgtggtggccgccgcgcctgctctaaggccacccgcgcgcgaacgactcgcccaggcaagccaaggcatggccaccatccgctctagcaagccccgccaccgctccgaggcctccgcccccgccacctccgtggccgtcgccgcggcgagggcgcaggacgctcccaagcccccgctcaggcggtccgcggccttccagccgcgccgctcgcacagccacccgcaaccgcatgcgcacggccaccagcgctgcgacagcgagcatgtcagccgcagcggcaggcagccccgctgcggcgaggtggccggcggcacggcggccgggtgcgccgccgtatgctgctgcttcccgtgcgtcatggtggaggtcgtcgtgctcgccacggtccgcgcgccagccgcgctctgccggcgcgcggtccgggcgcgccggcgccgccgctcggcctcggcggggcagccggtggacatgtacgagctgctcgtcgacgacggcaccgtggccggtcccggcgacgcggcggtggtctggcccgcgggtcagccgccggaggaggaggcgggggagacggagaaggaggtgtggtcgaggttctacggcgccggcttctggaggagcccctcgtcgctcggcgacgagaacagatgatcgggacaggccggcggctcctgcatgcatgcgacgccctggcttcttctacggctttcttgattcttgctcgggtaggcttccttcgttttcctcggggggaaaccgatgtagaggaggaaatgggaagcttgtgtgtcgtgtttgatccacaccgcattcttgttccaccttgtatccgctcttttttcttcttttctttctggtgtacgtcttctttgttgccattgtatgcaactaaatgtatataccgagtaatgtgattggggaaaa

SEQ ID NO: 31240 - DNA, 684 bp, Triticum aestivum
  Clone ID: PAT_TA_31240
cgtgaaaagataattgcttagtcagtgtttatatatgcatacattagtcaagctttggttttcatctcctttgtatacaaaaatgtattccacggtctacgtactggtttgcctggtgaatgacgggtagcgcacagctaatctagttaccaaataaatacctgagcattagtaagctttgtaagctatctgcaagttacctggtgcatagaactacaaaacgattcattctgtttcctcactctatggacaaaacgttttggagaaataacaccagtctttttcttcgataggcttatctgcgcaaaaagatctgccaagcaggtcaacaaattttcctcagcatctcctggattcctgtaatttgtataatattccagcaactgctcccgaaatggaatacaataataaagtgcctgcagcacgctgttgcagtagcacgtgctgccaaaattctccaggccgaagtagggctcaccctcggggaacgaagtagtgctcaccttcgggggcctggtcgcccccagttcgacgaccgaccaccgatccagtcccgacgacccagcgctgacgagggaccggagccccgacgcgaccgcggcccccgaggcccgacccgtccgcggtgcgggcggtctccgcggccggcagggcctcgacgccctccgatcgcgccggtttagc

SEQ ID NO: 31241 - DNA, 881 bp, Triticum aestivum
  Clone ID: PAT_TA_31241
ttctctgccgccttataacaatagagagggagagaaagatcatccattcatcgactaccatggccatttctctgctgccttacaccgcctcggctctgcttgccatcgtcatcgccgtcgccatcactgtcgcccctgcagttgttcgatcggaccaagagcctgggcccagcattgaagccatcaacgccacatgcgcgactgctacgtacaaatttgagtgcacccagccgctactaagcagccggcggggccggccgcattcgccaaggccatcaagaaaccctccaagtgcgtcaccgactgcctcgacgacctcgccgtactatccaagcacatcaagacgctcccggcgacgctcgaaaccgccaacgacgcgggcttctttgagcaatttgacaaaaagagaaaatgtcacggagatggttgctcggaccacttcgacgggcttctttgagcaatttgacacaaagaaaaaatgtcacggagattgttgctcggacaacttctcgggcgaggaatgcaacgcaaagagccaaatcggtggggtgtttgacgctcttcgtgtcactgatgacctgttgatgaggagggcgtattttaggaagcagcagcttgacaacaaaacaacatcacctaactctaactgaagaggacagccggtgtgatttgctcttacattgatatcgcatgcgtatgaataatggtccaatggaattgggagcggagtaagaagctcatgttgcctttatgcatgtaataatcatgcctgcctgcatggcccgctagctgttggtccaatgcctggctgcctgcctgaactggcgtcaatttccagtttgtttttgtaatatataataactcttctgtattgtgcatta

SEQ ID NO: 31242 - DNA, 581 bp, Triticum aestivum
  Clone ID: PAT_TA_31242
cccacgcgtccgcaaattagaacagaagcaacgcgaacagagtagggcttcgggcctccggcggcggacctatgacgcggggcgaacgcggtcgccgcggtgctgacatactgggcttcgatgtccggcgggcaactcgccccatccccgccccgccattctccacctcacccccttccccacccgatctagcgcctacctgcgccatccgccgacgctggagaatagaactccggtgttcagggactgatggagtcaatgtcaagtatggctccgagtgccggatcgactacagcgatgggacttgaagatgatgcttacttttatggcctgtgtgccaagtgtgtttccttgcttcagaacaacatggaacaattatctaccttcgtgcttatattatgcaaaactagaagtgctctgtttgaatgtgacactgtgtaactatgtgttactgggcatgtccactaattcctttatgaattggaacctggacctatttatttgctatcaatgagggtccatcataatgcttgttatgctaaaattatttgatacaattagtttatcatgatgatgtccac

SEQ ID NO: 31243 - DNA, 955 bp, Triticum aestivum
  Clone ID: PAT_TA_31243
cggacgcgtgggttagagactgcgacgtcgataccaccgccacaattaacgatggctgccgcgccagattcactcgcatcatccatggcgggccttggcgtatctaaacagttcacgctctctagctccgactcttcatcctctgttggcgacgacgctcctctccctttccctgaagctcttgctcgcgccgactttctcgctgaagactttcaacctgccgcttacctatccgctttaccgcaccgccaccaaacactcgaggatttaagatcggacctgcgtgaccgaagtgctgctattagctctgaacttctcgagctcgtcaattcaaattacacagcttttctttcgctgggcagtgagctgcgcggcggcgacgacaaggtcgaaaatgccaaagtctctctgctaggctttcgcagagctgttgaagaagtcaaaaccaaagtgacggagcggagggaagagactaatactctcaacggggaactacgtggtgtgcgatctgctatcgaaaagggtcgaaagatgatagagctatctgagcggcttgcatctttagaagaacgcctctctttggacagtctgccagctgacgaagactgggatgaggatagtgaggatgaaggggaggacgacaactacgggagctcaactgcgaagttgctcacttcggctcaagaatgcagccgaatcacaaagcttctcgagtccatggaccccgacacaccatatgtgatcaaaatggaggaacgtttgacacgttgcagaaacacattgctgctggatttgggcaatgcgctgaaagaagccaaaaaggctggcgttaaaggccaggatagagtcctcaagtgcttggcaatatatagagtgctggatgcacaatcagaggccgtcaaggctctccgaggtggttaaagatttcactgcaaatacaatactaatgataccc

SEQ ID NO: 31244 - DNA, 538 bp, Triticum aestivum
  Clone ID: PAT_TA_31244
acgaacgcgtgggcggacgcgtgggagttcatcctcgagagcaccaccgtcgccggcgtcgagcccgtcatcgaccgccccttgctctacatccaggggacgaggctcaagtgcgggggcttcatcttcgggcagcgattctgccactgcgtggtggacgcgccggccgggatgcagttcgagaaggccgtctgcgagctggcgtgcggcgccgccgcgccgtcgatcacgccgtcatggggcagggagatgttcatggcgaggcagccgccgcagccgtcgtacccgcacctagagtacagcgagccggcgggcggggcggtcgaccggatgctgacgactcctcccggcgacgtcgcgcgcgtgcccttcttcttcgggccacgcgagatcgcggggctgcggcagcgcgcgccgccgcacatgagccggagctcccggttcgagctggtggcggcgtgcatctggctcggccgcacggcggcgctcggctacggcgccgacgaggaggtgcggctgtccttcatcgtgaacgcgc

SEQ ID NO: 31245 - DNA, 591 bp, Triticum aestivum
  Clone ID: PAT_TA_31245
cccacgcgtccgcggacgcgtgggcagatttgtttggagagttctgtccatctaagcaccatgcgtatgtggccaaagaaacgcttacaaaaagaagaaagagacctggtttgccttccttgctggcgtccttgtcatctccaacccgcccacaggttggtgcaccagacacgacaccagaagtttcactactgcataagtgcgtcttcaaggtgacgaggtggacggtaagtgaactgcgggatgtgccgttggctgatgatgtgctctccattaaaaccaagaaggccatgcgccactgaaaccagagaggaccttatccttttgtttgtggatgcgtgaagaaaggatggttggctaagggggtgtctcttctaggacagtgtcacgtggctctgttagcttcgattttatggcgccctgttgtccgatatacatttatttatggattggacgcatctggttagttcatgttgttatgttgttcaagaataagcacatgttgcagttagtatgctactctatgtaacctctttgtccttgggatttcctttgcagcaaactaaatggattttaaatgctaccttggtc

SEQ ID NO: 31246 - DNA, 900 bp, Triticum aestivum
  unsure (1)..(900): unsure at all n locations
  Clone ID: PAT_TA_31246
atctcaccgtgcggtcgccgccaaacgcgaactggcagaccgcaggcgcccggcggcattggcccggtcctcctatccagaatcgaaatccaacaaaacaaagaccccccatattctccagcaaccgtgatcccccggtaacatttctcgctcccaaccaccccgcgccgccctagtcagctgcaccctccgccgccacggcccgccgcggcctccggcgctttccgccgccgttgctcctccttctccgcgccctcttcctcgtcgcggcggcggcggcggggaagggaaagaagaggggcggcggcgggctgcggttccggcgggagggcggcacgttcaaggtgctgcaggtggcggacatgcactacgcggacgggcggagcaccgcgtgcgaggacatgctgcccgagcaggtcgccggctgctccgacctcaacaccaccgccttcctctaccgcgtcatccgcgccgaggaccccgacctcgtcgtcttcacaggtgacaacatctacggcgcggatgcgacggacgcgggcaaggcaatggatgcggccatcgccacggaccttgccatggatgctctctgggctgctgggaatgataaccatgacctggagggtaccctgtcacggggggggcttgatgcgacacctagtgggcatgaagacttcactttcacgcttcaatcctgcaggggtagcagtcgatggcacccggattctggtgggggcgcaggtaggctgccggccaacttatctaatgacagtaaataaactccaatacactgtcagtaattgaaaataaatacactttcagttatttaaattactgaaacttttgtnccccatgatagtgtattgtcaataatcaaccgaattgtagtnaatatgctgttta

SEQ ID NO: 31247 - DNA, 1059 bp, Triticum aestivum
  Clone ID: PAT_TA_31247
gccggccgggcttccgatgtccaagcatcaactacacacaccttgcgctactgtacaagtacaaccaacacaatccacgcagcaagcatcccctccggcaccacatacacacctttattttgcaagctagttagactagtgaactataatcaagatgaagaccaaggcttcgacattcttcaagcagatgctgtccaccatcgtggccgtggtcaaggccaagtccacggcggtgcgcgccaagacgagcaccctcaagacgcgcctcctcgtcctcggcgtcctccgcaacaggaagctcctcgtcagcgccatcaaccacaagatccacgccatcatgggccaggacgaccacgcgcgcaaggaggaggcagcccaggaagacgacggaggcaagaaggccatcgtgctctacacgtcgcccagctacgtgacggagcgcgacgtggaggccgccgccgaggaggaggaggaggagagcgacgacgagtacctgacgcactcgctgttccgcgaggaagacgacgatgacgacgagctggtgaacgcgccggggtcggtgattgacgtggtgcgcgacgccaaggagaaggaggcggagggggctgagttccggctggaggacgagatcgaccatgtcgccgacgtcttcatccgccggatccacaagcagctcaagctgcagaagctcgagtcgttcaagaggttctgcgagatgatggagaggagcgcttgatccacatccctagaatcagatccgcctccagtccagtgatttattattcataagtatgcaatggcgccagctccatcactccttaagccaggattatgtttaacttaatccgagacccatgcatgtaagtagaaggaaaagataaatccaggcaagaagatgcttatcttctgctagggttttagtggggatgcgaaggtctactacgtggtactttaatcattacgtactcctgttcttttgttctttgatctgggggaagattgtaaaagtgctcaagttttgagtgaaaaaacaataaatgaagcaaataaatagacggc

SEQ ID NO: 31248 - DNA, 889 bp, Triticum aestivum
  Clone ID: PAT_TA_31248
tctttacgcgtccgcccacgcgtccgccacccgatttccaatcatggcgctcgcgtccggcacgacggcccgcccgctcctcggccgcctcccgggcacggcgcccacctcgccgtctccccctcgccctccgcccccgcctgctccgtccgattcgccgcccgcacgcgggggccccgcgcgcgccgtctccccccctccgcgccggcagccgcgccagctgcaaccgcaacgcctggtgagcatggcatctcattgacagagaaggcactaaagcaccttgaagcatctggatagaaaaagaatgaagatctctgtttgaggattggagttaaacaaggttgatgttctggcatgtcttacaccatggagtttgagagccgaggaagcgccaaccctgacgaatcagtcatcgagtatgaggctttcacaatggtctgtgacccaaagagacttctcttcatgtttggaatggagctggactacagcgacgctctcatcagggggtcggcttcaacttccagaacccaaacgcgacgaaagacgtgcgggtgcgggcaagtcgtaagcggaccgagcaaggaaatgcaagagcaaagcaactgcctgcaacaaatgaactagaaatatagtgccagggtgtgatattatcatgcatctttggttgctcctgcatccggaaatggccggatggacaataccacaggttcacagatatactcagaatgaatggctacaatttgtaatacagttcagttcagtgtgtatcaagattccaatggggcttgtaagttgtaactgctcagtagaatttttaaagataatcatgtgaagatagatatacttctttctcaaaaaaagggggggaaaaaaaaaaaaaaaaaaaaaa

SEQ ID NO: 31249 - DNA, 934 bp, Triticum aestivum
  Clone ID: PAT_TA_31249
cgaaccctagccgccgcctgcacaagcccctccggcccctcctccccttgccgccgccggcggacgtcgccgggcgaagcccgcgcggctcggcggcggcggggcctttccctcctccagctcgagcaggggcggcgcgggccgttcgttcgtgcggggactcggctcggcgcggcactcgtgcgggtgcgcgcaccggcgtgtgtggccgtgctcggggctgcgcggcgagggcgcgaggggcacggcctgggtgcgcagggcgcggagttgggcgtcctcgttccggtgatttggggtgcggcctcggtgcgcctcgacgggatctggcggggacggcatggcgggtggcggcgctccggcggctcctggcgcgtggatccggcgggcggggatgcggactgcggctcctggctgctcgacgagacccctcccggcgatgctgcggctgcagtgggttgctcgggctttggcccggcagccctgctcggcgggatggggtggggtggcggcccccctcccggcttggtgctatggagctggtcggcttgctagccctgcgtggctggcagcgtggtggcgtggcggcggggccaggccggtggtccagccacttctctctttcctgccagatccaagtcaggggcggctaggtgctagcatattcttgatttcatctgtcatcatcagcaactgtggatcgataactgggggagcgaccctttcccaaaaatggcgaacagctatatggccatatcttcctggcattcatggtttttgccatcaactcatcatccaccatgatctttagcttaatgtactaatgacctgttgttgattttttttttcatttggacaaagtatttcatgcagactttgttgtgctgtacaataactgttgtgctcagacttccagtaatgatatatattaatg

SEQ ID NO: 31250 - DNA, 1989 bp, Triticum aestivum
  Clone ID: PAT_TA_31250
aattcgcatttgtttctcacactcatacatagcaccatgggccgggtgaaaagattttaccaggatttcatccatatcaagctgcatagcttctgccgtatcagtggatatgttgtcgattcaatagcttttgtctatagatttgttgcattgcatgttcaccccttctggatccaactgtcctacttccttgccattgctatacttggttcagtcctcttgatgtcgctgaaaccaagcaaccctgacttcagccctccttacattgacatgttattcttgtcaacttctgctctaacagtttctggcctcagcaccatcacgatggaggatctctcaagctctcaaattgtggttttgacattgctcatgcttataggaggggagatctttgtttcactcttagggctcatgcttagagtgaaccatcaagacatgcaagatcttccaagcgtgaagatcagctcggttcctgtcgagcttgaagagctagacttgcccaacagcatggcactatgtgatgagtcgcagcttgaagaagcagctcatgcaattccacccaagaaatgtacagagttgaagaggagtaggtctgtcaagtgcttaggatatgtggtctttgggtactttgccatgatccatgtcttgggctttctgctggtttttctgtatataactcatgtgccaactgcaagtgccccactgaacaagaaagggatcaacatcgtgctcttctcactatcagtcaccgttgcctcctgtgcgaatgcaggactcgtgcccacaaatgagaacatggtcatcttctcaaagaattcaggcctcttgttgctgctgagtggccagatgctcgcaggcaatacattgttccctctcttcctgaggctactggtatggttcctggggaggctcacaaaggtgaaggagctgaggctcatgatcaataaccccgaggaagtgcattttgctaatttgcttcctaggttgccgactgtgtttctctcctcaacggtcgttggccttgtagcagctggggtcacgatgttctgcgctgttgattggaactcttcagtgtttgatgggctcagctcttatcagaagactgtcaatgcattcttcatggtggtgaatgcgaggcactcaggggagaattccattgactgctcgctcatgtcccctgccattatagtactattcatcgtcatgatgtatttgccatcatcagcaacatttgcaccacccagtggagatactaaaaccaccaatgagaacacgaaagggaaagtcaagagagggtcgttggtgcagaatttggcattctcaccgctcgggtgtaacatcatctttgtgatggttgcctgcatcacggaaaggagaaggctcagaaacgatccactcaacttctccaccttgaacatgatatttgaggtcatcagcgcatatggcaatgcagggttatccactggttacagttgttctagactgcatcagctgcacccagagatcatctgccaggacaaaccatacagcttttctggatggtggagtgacggaggaaagtttgtgctaatattggtcatgctctatggaaggcttaaggctttcacactggccacgggtaaatcctggaaagtatgatacaagtggccaagattacttggaaaggcagatgtaccaaattggtataactgtcgctagtgtactgcctgaagaatcaggcttctaattggattatagtttgtggatgttgcgcttgcaaaggacaagcttctgtttccctgctaaagtcatctttgtatttgtcagtcatcatcaggtatcaatgcaactgaagaattgagccatctgttgatgtgttgcatgctagatgtaaccacatgagttccccacaattgtagcgaaagagaaagcaaatattatttgtattgttggagtggagttaatattattgcacacaatttataatacagataaattttgtgttgctta

SEQ ID NO: 31251 - DNA, 1888 bp, Triticum aestivum
  unsure (1)..(1888): unsure at all n locations
  Clone ID: PAT_TA_31251
cgtccggcccagtcgccgccgagcttgtctccgaggtactcaaagctcctaagatggcggatgaggaacatgctcaaacctctcggaagagggttgcagataaacaaatcaacaaggacaatcctgagcttgatgatgactcaccggagcaagagggaggaacatttaagaaagctagtgaggaagtgatggcaacccgaaaaattgtaaaggttcggcgccagcagccgtcgtcagctccttcttccaatcctttctctgcaattaagtttaccacaagtgattccagtgttcaagcaagtattcctgtctcaaaacctccaccttctgatgtcacaacgtcaaatgtaaggagctcaactgagaaagctgatgaggtcagcaatggaagtgggaaagatgatgtcaagactgcagattctaatgaggtagcagagattcaaaaggatgaatcgggcctgaatgaatcaaatgcagaaaacaagtcaaatgcgccaatggaagcacactcttcgcttactgaaactgataagaaggcaggcagcacagagggtggaactggtgaggataaagtgctggttggagaacccaaggtagatagcagcaagacatctggaatcgagggtaaaacagaagatgaagctgctaaagtgaatgaaggtggagatgaagataaaagcagcatggacggcgctgagaagaaagatgaatctgaatcagggaccaaggatgaagtgaatgaaggtggagatgaagataaaagcagcaaggacggtgctgagaagaaagatgaatctgaatcagggaccaaggatgtatcaccaacacctctgttctcttttatgaatgtgtcaagtggtcataacgccttcacaggactggctggaactgggttttcagcctcgtcattttcctttggctcagcttctaaagaaagcacaaatgctcccctatttgggctaaagaacgacagcgcatccttcccttctttcaatatcggtggtacgaacaacaacgggagttctgttccatcgcttgtcgctgcagcagaagcaccaaagaaattcatcatgccagagggcccagtggagacaggcgaagagaacgagatggccgtgttcaccgcggactctgcaatgtacgagtacctcgacgggggctggaaagaaagaggaaaaggggagctaaagctgaacatcccagtgtccggcggcgagaggtcccggctcgtcatgagggccaagggcaactaccggctggtcctgaacgcgagcctgtacgatgacatgtcgctgaaggacatggagaagaagggcgtgacgttcgcctgcatcaacagcaccggcgactcgccgggcaggctcaccacgttcgccctcaagttcaaggacactggcgtcagggatgatttcaaagccgcggtggaggcgcacaaggcgaagaaggcctcggacgcgatgcccaagacgcctgagagctcccccaaggtgtctgatgactgaaagagaccgccctggttgcgtgtttcgatgatgtgtatgcgggtttggaggggggagaggggctggctgaagttgtcctcgttcattcggagtctaaagtgcaccattttctgtattctgtatccccatgtcgtgatgccttaagatacattttgcatgcacgcggttacttggtttcctgctgccgttttggaacggtgggtggtctgttgaacatttaattgttgagtcacaattttagcttaactggagagacgagggagactattaattacatcctgtggacaccgatctgagctatattcagtaatcagtaatgtcttggaaatgagtcaaaaaaaaaaaaaaaaaactcgagggggggnccgtacccaatcccccccccc

SEQ ID NO: 31252 - DNA, 781 bp, Triticum aestivum
  Clone ID: PAT_TA_31252
gcacgaggcacgcaagcagcacattcttgtgggactctgatcagtctcggcctctcagggaaggaagagaagagactgcttggtgaagtcgctggtttcgtgtgatcaagagctcgggtatggagttggagatggtgagccagcacggggcgctgctgaaggtggggctgttcgtgctggtgcaggcgctggtgtacctcatcctcgcccagtcctcctccgtcttctccaccaccaagaccctctgtctgcccccggcgcgctccctcagcgcccgccgcatggtcgcgctgctctccgacctgccgctgccgctcggcggcgagccctcgccccgcgccgccttcgtggagccgccgtcgcccgtacccctcgcccaccagaagaaggattagttattaaccaagcgcgactggcggcagggacacggaccgagctagcaagcgatcgtttccgagctactagtagtagtactcggtgcgtgctgtaggagctattcacgccattctttcattgattggttattggtttgttctttgggattggatatgtaaactgagctacacgccgtttgggtttgtacaatcaagtgaagattatgttttggctaccgtgcaaaaaaaaaaaacgagagttttgaggagaaacttctgaggaatggaacagttttgttcatatcatgaaactctcccaaatggttttgttttcgtatttttatatgtgcattgtaatgctcaggatgtccttgcatacgcgatttctaaatagaaattcttctttt

SEQ ID NO: 31253 - DNA, 785 bp, Triticum aestivum
  unsure (1)..(785): unsure at all n locations
  Clone ID: PAT_TA_31253
cccacgccgtccgaatgtcacaattcaagatggtgcaagaagcacttgaactgtcaaaatcacaagtggatgatttggagcagaagcttgcctcgcaggatgctgacatcagtaagctcactgaagagttgagtctccattgttcatctgaagaatctttgaaggaaaagagccttaaactagagactgaacttgccaccgtgaatgaagagttacaagcgaagcttctgagtttgcaagaaatggagataaaactggaagagcatgtgaaggaaaaagagacaagtgaagctacattggagaagcaacagtcgcagatactcaacctgcagtctgggctcgatgaattaaaggatgaacatgaaactctcaaagggactctagttgacgctgaatcaaaactatcagagagagactccatgctacgtcaggctgaagaggagcatgctaaagcacagttgctcctgtcagaagcattgtcgcataaagaagaactggaggtaaatctgaaatctatcaatgagcagcatggtgagtccaaagctgttgctgaagatgcaaacgggaagattcttgaacttgaagcacagattcaggcactacatgcagctgaagaggctttgaagtcgcatctggaagaggctagcatgaatgtgaaagttgcggagaagaaatgctctgatcttgagcaacggctcagtgaatctgagagtaaattagccacttcaagtgaacaagtaaagttgctggaagagcaggtccaacaagaagcancttcttcagca

SEQ ID NO: 31254 - DNA, 1014 bp, Triticum aestivum
  Clone ID: PAT_TA_31254
cggacgcgtgggttttttttttttttttttttgtttttaacaacatatgagtttcttatatcctctcctcgaaatacaacaaacaaacaaacaaatgggtgacttttgctcaaacagacaaaaagaaaatggtgttttgtatgattgtatccaactcgtgcacgtcgtgaacaacggtctaacctacagtatatgcatgtgtcgcagtagccttcttcgaaatttcgctgcaatttaggaataggaagatcccgactgacctcctaccccgatgttgacccacgcacgcccctttgggtatccgggaagccaccttgcacggtcacgatcaaggttcctcctgcaccgaacaacgcctgctgcggcggctccctggcagacgacgacgacgacgacgacgacgactgcgccgccacctccgccttgtcgttccccttgggcagctcagcctcggcgcggcagagagggcaggtcgtccgggagcgcagccacgcgtcgacgcactccacgtggaacgagtgcccgcagttgggcagctcccgcaccttttctccatcggcgagctccgataggcacacggcacagtcagccccggcggtggcggcgccctccttccggtacgtggtgaccggcagcgcggagagcgcggaggcgtccagcccacgccgaccgctagttccgccaaaagagttgatggaccgcaggatgccggcggtgaagctgccgcggcgacggcggccgcccgaccgcgccactaacacgtacagcaagaagcggatgagggtgaagaagatggtgagcccgaaaaggaggaaggcggccataagcaggacgcgcccgttgaagctgtagttctgctgccgcggggtacggagccggggggccatttgacgccggcgcgccggtgaaacggtcccctgacatgtcaggataaagctttctagtctgcaccacgaatcaagaaccttaaacaggagaaaggagggaggcaacggccgccgtgttcggcacgag

SEQ ID NO: 31255 - DNA, 917 bp, Triticum aestivum
  unsure (1)..(917): unsure at all n locations
  Clone ID: PAT_TA_31255
ctaaagctgaaacaagagattggcttaacagtgtggttagtgatttggaaaatcagattgataattttgaagcggagcttgaaggactttcatttaagaaaggaaaacaaagacctcctcgattggtacatttagagaaatctattacgcggcataaggctcatataaaaaaattggagtcaattctgagactcttggataatgatgagttgagtcctgagcaagtcaatgatgtgaaagatttcctagaagactatgttgaacgtaatcaggaagattttgatgaatttagtgatgttgaggatctctatagcacattgcctatggagaaggttgaagcactcgaagacatggtttcacttgctccttccattcttatcaagggtgttgctgctgtttccactactgcagttttgagtacgaagagtccgacagcaacttcacctactcaggctactgtatcaacaatctcacaagggacatcacaagatcaagcagaggaaacaactacgctagaaagcaatcctgaatcggtgccacaaacaccacctccgaagggtggaaatctgggaccatcagtgccagttgtgcccactgccattagtaccagtgctgcagctgtttccgtttcggcagatactattacttccccaggcccagtacgaccagttattcctgccacagcacccacaatatttgctccttctgctgctgttcgaaatgctccagagagcatgcctgctgttgcttcaacctcctgcaaacttatctacgccgtgaggatgatgaaaggaagacttcgccactgtaaacgtcccccaattacggaattgnctggaaggggataccgtggnttactancngnattactgccccaangntnggccattcaaaaagnggtcattaggaatccccaa

SEQ ID NO: 31256 - DNA, 1152 bp, Triticum aestivum
  Clone ID: PAT_TA_31256
cgcaacgctcaccgttggagcgcaagcagcgcagaggccgccatccagccacccaatggttacagtgtctatagctacaaagcccgatcccggcccaaaggtccgccttcacgtaactagtgaggttcgtggtggagatctcgcccgagctgtctctcaggcgggcggcaggggtcttgatctccccgctgcccatcacatcggtatgatggccactgtgatgaatgcaatatttcttcaagcaacaatggagagcattgggataccgacccgtgtccaaactgcattccgtatttcagaagtcgcagaaccatacatacgccgaagagcaatcaggcacttagagaaaggaagagttgttatatttgctgctgggacagggaacccattcttcacaactgatacagctgctgctctccgttgtgcagaaatcaacgcagaggtagtgctcaaggcaacaaacgttgatggtgtgtataatgcgaaccccaagcataacccaaatgcccgcatcctcgagacagtgagctacaaccaggtgatctcaagagacctctcagtaatggacatgactgccgtcacactatgccaggagaacaacattcctgttgtcgtgttcaacctgcaaaacactggaaacatcgcgaaagccatcgtcggcgagaaggtcggtaccttcataggcagcacaaggaatctggaataccgcgaaagcacggagggttcgctggatcaagaagacaagatcttggttagtgagtggtgaatccaagagctgtctgtctccctagctggattatagaataggttagctatccaagtagtaccggttcaattgtaatactcgaagaagagaaaccgctccggacataaaaattcgcagaaaactgctgctatgctgtgtatgatagaatgaatgtaggagtagtctcctgtggcatgtatggtatggtgggctgaacctaaatagaacttctattgctgctgatggtgttcgcagacaactgcaggtgagggtttcttgatagaattcctcagtagtctcctgtggcatgtatggtggctgaacctaaataatacttctattgctcctgaacgtagatcatatttgaaaaagaaaaaaaaaaaaaaaaaaaaaggcccccccctttt

SEQ ID NO: 31257 - DNA, 1025 bp, Triticum aestivum
  Clone ID: PAT_TA_31257
gcgcacgccgccagcacccgaccgcgcccggccgccgtccgcggctgccggaccgccgccccgcccggggccggccgccgcctccccgccccccgcgtcgccgtcggcgacagcatcaagaaacaggcccaaaaggtgtccaatgcattcatgccactgaatggcttgccaaccttagcaaaatcatcggagagaccagaggcggcggccatggctgtcccggagctgtccctctcatctccagcgatcgacgccccctgcccggccgccccgagtgccgacagcagcgcctagacggacgctggagctcaacgcgagcagcagtcggcgcagcggaaggccaggcggtgctggtcgccggagctgcaccgccggttcgtcgccgcgctccagcgcctcgggggcccgcaagtggccactcctaagcaaatcagggagatgatgaaggtggatgggctcacgaatgatgaggtcaagagccacctgcagaaatacaggctgcacacacggcgagcatccgacggcgaccagcagcagtcggcgtcggccgggcagtggccacggccggagcagtacaccacgtcgcagcacagctcgtcgcagtcgggctcgcctcaggggccgctgcagctcaccgtgtcgagccgggggatgtcggtgaccgtcggagatagctgcgatggcggcgaggagaacgaagaggaggatggcaagtcggcgagctacagctgggggatgcagcagaagggcacgaaggcttcgtcgtcgtcttgaacaccaagaaacacatgtgtggaattttcagaggcacgctgcacagcaacaccaacacactactgagggttcaggattgaggcttttcttctttgtgcaagttttaaaatagattatgagattgagaggtgtgttctttttgagctggaatgtgccgagagttaactgaactgacgtgagtcgttgggttatacgtactgtattagagatatgagctactatgttattagcattctatacaacttttggtt

SEQ ID NO: 31258 - DNA, 1283 bp, Triticum aestivum
  Clone ID: PAT_TA_31258
gtgaggatcgccgactacttcgacgtgatcgccgggacaagcaccgggggcctggtgacggccatgctcacggcgcccgacgccaaaggacgcccgctcttcgccgccaaggacatcaacaacttctacctggagcactgcccgaagatcttccccgccggctacggcgggcctctgggcttgctcaggagcatgagggggcccaagtacgacggccagtacctccactccgtcgtcaaagagctgctcggcgagacgcgggtcggcgaggcgctgcagaacatagtcatccccaccttcgacatcaagctgctccagccaaccatcttctcccgatacgacgcccgcaacgacgtctccaagaacgctcttctgtccgacgtctgcatcagcacgtcggcggcgcctacttacctccccggccaccacttcgagaccaaggacaaggatggcaggccccgggcattcaatctcatcgacggaggcgttgccgcaaacaatccgacaatgttggccatgacggacgtgagcaagcagatcctgctgggcaaccaggacttcttcccgatcaagccggccgactacggcaagttcatggtgctctccctcggcaccggctccgccaaggtagaggagaagttcgacgccgccgcgtgcagcaagtgggggatcctcggatggctctacaacaagggcgccacgccgctcatcgacagcttcagccaggccagcgccgacctcgtcgacatccaggcgtccgtgctcttccaggcgctgcgctgcgagaagcgctacctccgcatccaggacgacgagctcaagcgcgacacatctttcgtcgacgtctccgcgcccgagatcctcaacaggctcgtcgaggtcggcaaggcgctgctcaagaggagcgtgtgcagggtgaacgtcgagacgggcaagaccgtgcccgaccacaatagaggcaccaacgaggaggagctaatcagtttcgcacggatgctctcacaggagcgcaaggccaggttgcagaagaagggagtcaccgtcccacagtaaataacattgggtagttaatagtagcatatagctaaactcaccttattacgtgtaaggcaaatataggataagtcaatagacggtcgaaccatggtaggctagaaatattgaactgccaaagctcagagacttatgcaaattttagaggtccgcaaacaagttgtataagtgggagaatgaaataaatagccaactgtttatcgtgggcacaaaaaaaaaaaaaaaactcg

SEQ ID NO: 31259 - DNA, 215 bp, Triticum aestivum
  Clone ID: PAT_TA_31259
acatgtcatgcgggtgacgcaagtagttttcgtttttattcgcgggtgtaaatattcttgtggttttcttccgaaagaaagaaaaaacagcatgggttgtgatgaactgcataggagccagtcagtgcatgtctgtttggtcatcagagattcggaacaagttcctcctgattaaatttctacgctccaaatgtgcatcaagttgggagcatttc

SEQ ID NO: 31260 - DNA, 856 bp, Triticum aestivum
  Clone ID: PAT_TA_31260
gaatcacactgaatccatgatcctcctttttattcatgacgtgaaaaattacaactctgagaacttgcgtatatatgtcttgtactatctgtttcttttacactattacggactccgtaatatactgagcaccaacagcacacatgatgagcagagttaggatgcatcactcatgcactgttcccatcccgaactcagattttagcatgatccttgctgcttctcccctttccgattagatcccacgttccataggacttcagagtgaatcgtggttagttatcaagcctcatgcccatgtcttgatagacttgcattccttcgccaccactcccggttctctgtcttcctcaagttgcacagacaccaccctttgctcctcgtcgaccaccccggccttcccatatggcatggtaaccgaaccgaccgggcatagcacatcctgaataccttcccgcagaagtcatttatgtgataagtgatcatgtcctaagaaggcagccttcccacttccagcttggaccatggtgatcaagaggccagagttgatggacggcgagctgatgccttcctcctgcttaactcctgtgaaattggatgccgtaactctggtgaactccggcaatggaatgtggaagtatgcaagagcaggtgccggctccttctgtctgggttcttctttcgtgtagttcttctggaggctcgaagacgttttccggaaccaagcttcctgcgaagctgtgatccagccataaccagggattgatggcacggtagaatagtcaccactgtcaagaaaatacatgttgagcactgatttgtagccagcagtgttccctcaaccccaccaacttcc

SEQ ID NO: 31261 - DNA, 452 bp, Triticum aestivum
  Clone ID: PAT_TA_31261
acgggcttccaaaagttctttggggattgaggacaaccccgaaccgatcgaccgaaagaaccccattctttctggtctacggagccgaacagctttgccgagtgacctgcttcacaacgcaccccgagtcgagctctactctgaagatgaatcagaacaagcccggcaggacgcaatcgacctcctataagaagaaagagaaatggccatggtccgatcgaccatctatcagcaagccttgcatcgattccatgccagaaatgtgaagagtcgagccttccaagaaggagacttggtcctccgagtggattaacaaaaaccacacaaactctcacctacttgggaaggtcccttcatagtcactagagtcctcctccacctttataacgtcgatcgccaagattgatgagcaacgaatcctgaaatgcggaactactttgccccttttatag

SEQ ID NO: 31262 - DNA, 1074 bp, Triticum aestivum
  unsure (1)..(1074): unsure at all n locations
  Clone ID: PAT_TA_31262
gtgcgcaagctgctcgacgaggacggcacgctcgtcagcgcccgcgactacgacagccgcacgccgctccacgtcgccgcgctccacggatggcaggacgtcgccgagtgcctcctcgccaagggcgccgacgtcaacgcgctcgaccgctggcagaacacgccacttgctgatgcagagggtgcaaagaggcatgctatgatcgaactgctcaagaagcatggcgggttgacattcgggaaaactggaagccactttgaagcaaagtcaattccacctcccctaacaaacaaggctgactgggagattaacccacttgaattagatttcacaaaagcagtaatgattggaaagggttcttttggtgaaatcctgaaagcaaattggcgaggaacaccaattgctgtcaaacgcattcttccatcattatccgacgatagactggttatccaagattttaagcatgaagtcaacttgctaataaagctgaggcatccaaatattgtacagttccttggagcagtcacagaaaccaagcctttgatgctagttactgagttcctccgaggaggtgatcttcatcaatatctcaaggagaaaggctccctctccccacttactgccgttaacttcgcattggacatcgcaaggggcatggcctatcttcataacgagcctaatgttataattcatcgggacttaaagccaagaaatattcttttagttaatactgctgccaaccacttgaaagttggagatttcggtcttagcaagattatcaaatctcaagcatgccaatgatgttatacaagatgaccggagagaccggaagctatcggtacatggctcctgaagttttcaagcaccggaaatatgacaagaaagttgatattctcccctttgccatgttactttaagggatctcgaatgggatcacttttccaagttagtaaccgaatgcggctccttaggatacagccgatgggcagcgcccaactttccgttcaaaaggacataccgctnagctgaaagaattgactgaggtatgttgggctgcggatatcaatttgagac

SEQ ID NO: 31263 - DNA, 1063 bp, Triticum aestivum
  unsure (1)..(1063): unsure at all n locations
  Clone ID: PAT_TA_31263
ttgctgtgggtgtctctgaacgaagttnngttgtcactaggttgttggtcccattatttntacaattatggtttnggttaagtnttggttatnaacccaanccntttnttgnaattgccccggaaaaanggcatcattttggcagttntnggagttnttgaacaagttngggnctcntgtattngaagtccaatnggggggaaatgggatgatggggaacaaggttcaggggntaaggttattaagttggttaggaccntaaccaatccatctnaatgtgcccttccagtccttnaactctctttctcctacctggattgctttctttttgggaggttggaatcccttgcctcttgcattattgtggatgcacacatctatctttgcttgagtagatgcttggcttcggtgtcttttgtcttgaacaagcagaacataacaaagataactatgtcataacagttgcaaggtatgaatctaacacctatgatttagtcaactttgtccacaacaacgccttcaagaagggataaatgccccagaaaaaaacaccccctcgagcgccgtcgggccttcccccccttctcgtctcgccgatgtcggaggccctccgccggcgaagctcgggcaggctccagtgagggtggcggtggggcctctccctgggtgccctccgttcttctcctcccctcctcgctgggtgtggcggctgcgtggcggcgcgcgcccgatctacgaggtctggcggcggggagcagccgcggtccatggcgggctgctggctgcggccagtgtcgtcatggtggcccaaacacgtggtggggtggacgcggttggccggggctagcggccagatctaagcgccatgcgcgacagcggggatggctggtggtgccgcggtggctgcgttcggccggtgctctgtgttgctttggcggcggggctggcggtcggaggtgcggtcggtggttgcttgctctgtcggacctttagctgggtcttggcgagcggcgcgggttagggcaacggcccgacgtgggtggttgctctggtcatgggctac

SEQ ID NO: 31264 - DNA, 710 bp, Triticum aestivum
  Clone ID: PAT_TA_31264
ttttttttttaaatgtatgcaagctctaaattactggagctcaaaaccaaacatggtatcgagatcacacaacatagaagccgctacggtgttgaagcctgaactatggtaagaacggctaacaaaggattaaagttagaagtttggagttccagacctaaggcaattgcaacatcattcaaattgcactaatattttggcaatgccgataaagatgctaaccactagtgcgtcccgtaccccctcttcttcctcctcggattctgttagcccctcgtcctcctcctccccgggttctgttgccccctcgccctcctcctcctcctcgggttctattgcctcctcgtcctcctcctcgggttctgttgcttggcgctcgttgaggtgcgtcactctcggaatcgtcactctcagaatcactctcactcacaagggtatcagtggaaatggagtttgtttcttcaactgcatctatataatcattgtccacaatgtccacaactagcttctcttctgtttcattcttatgctcttctgtgttctccctgcccttcccgttctttgtcggttccatctgaggggggagaggatgagaagagcttgccgttggtgtcgggggctcggcggcgaggtcgatctgccgaggtcgacaaagggtgcggggcggtcggcgtgactaggagtaggagaagctcgaggtcggggttggg

SEQ ID NO: 31265 - DNA, 543 bp, Triticum aestivum
  Clone ID: PAT_TA_31265
atcgtaaaaaacttcaagtaaaaagaaccaagatcgtacgtactaagagggatatatcaagtgctgctgatgctggacctacgtacaagattccttgaaatgcaaagcaaagccaagcaaatcacagtctcgagaaaaaggccaagcaaatcactgaagattgcacatcaacgcaaaaagagggcagattaatcacaccatgtatcatgactgacatgatatcactctcgactctaagaacagtggagaggttgctgtcgtggagtgctaatgctcggttctttctcaacggagaaagaaggcgaccaaactgataggggcatcgcacgatcttctccgcggacgcgtgggccagcgattggtcgatattacgttgaatggagctcgataaatgcaataatgacgtagtgcatgctcatcatgacgcgtccctggtccattgccgaggaagacacctttctgtagcaaagaaggattgttcagtatggaagactgtaagcatgcatctggaggcgtcagtcataaaccagttctacataacat

SEQ ID NO: 31266 - DNA, 399 bp, Triticum aestivum
  Clone ID: PAT_TA_31266
cccacgcgtccggcatacttccaggagatcgacgcctttgaactgccggaggaagaggcctcagaaactgactgacctgcatcgaaaatcaagccttatccgttgatcatgtacgatacagctgtacagaaatgtactcgcgcgggttacttttataggacaactgcgagttatgaagtaggaacagacagtccttgtaacataggtggtgtgctttagtgatcactgatgctcagtttcgcgtgtttgtagttgttgtattgatgtctagtaggatatggttgtgttgggacatgtccttgcaagtttttctgtgtgtggaaggagccatgtccttgcaagtttgtttccccaatgtatgtacattgagctaaaatgatgtaatgaatggagttatcc

SEQ ID NO: 31267 - DNA, 779 bp, Triticum aestivum
  Clone ID: PAT_TA_31267
gttgaatacgggcagccacaaccactccagtatgtagtcaatgctgcattccttgcttctctgttcagtgactatcttgaggctgcagatacccctgggtggtattgtggcccccatttctactccatcgaggttcttcgcagttttgcaaggactcagatggagtacatcttgggcaaaaatcctttgaagatgagctatgtggtcgggtacggaaagcattaccccaagcgtgttcatcaccgtggtgcgtcgatcccgaagaagaaaggtgttcaccctggctgcaaagggggttggacatggagggacaccaagaagcccaaccctcacatcattgttggagccatggtggccggccctgatcgccatgacggcttcaaagacatccggaagaaccgcaactacacagaaccaaccctagcgggcaacgctggtctagtcgcagcattggtagctttatcgggtgaaggacatggagtggacaagaacaccatgttctctgctgtgccgccaatgttcccttcgcccccgccgcctccagcaccatggaagccataatggctgggtgtttagaatagaacagtggagacgacgacgtaaccgtttatttttatttattttagtgtagtatcatcaccatgccatgttgtttgctatgcaaggactatgttgaacgaaatgcataatgacctaagttagtactagtagttttccctcgtgtacctgtagctgtctgacaccattgtcgtcttgaagcagcgagaggatgcacaacc

SEQ ID NO: 31268 - DNA, 912 bp, Triticum aestivum
  Clone ID: PAT_TA_31268
ttgaagcaaacacatcacccgattcttcgaaacgacaacgtactgtttctcaagtcaatggtttgactacagatcaagataatcaagaatcagttgatcctgccccacgcgtccgcccacgcgtccgcggacgcgtgggggaggagatgaaattagatgcttctgtgcagatggatgcgagtttcagtggtcattctgggttcctcgagccagatgatgtatcaactgagtgcatcaagatttttactaccccttcttaccaatttaatcggagaacattgatcaagcacaaagatagtccactacacctttgctgcgctggcttgaaagtccagtttggagttggtacaaagttcctagacactgcaggtcgtccaaagttgaacatggtggttcatatccctgagaatctaagcaaagttctagaattctgtgataatcaggcccagagattttttcaagagtctggtaccacttccgagtggagaaccctgataaagaagtacggttatgtgaatcgtccaactgttcgcctcaacatccctaccactcccagcagcggtgcttcgccctactcgacagacatataccagaaagagcccagcggcaacattcagaagcttgcttttagcaaggtagatgccgcggaactggactccctgtttgttcgggggaacaggctggatgcgttcttctcgctggaaatatatgactaccagcaaaatgctggcatccggttggtcgcaaagaggctggttgtacactccaagtagcaccagtcatagttcatactatgatgtactagtgctagaagctaactcttgcactaatttaattgattgctttatgtcttcacccagttgtatgttaattattatgccagtgtgaataagatctgaccagtagcaggct

SEQ ID NO: 31269 - DNA, 1069 bp, Triticum aestivum
  Clone ID: PAT_TA_31269
gcttttcaatccatctacttcttggtcacaagtccaattagtagaaattcaaacatgaaaataacatccatcttgttctggtaatcatcttcaacaaatttcgtatgtatcagacttgcatatgtttattagtagggcagatctctgttgtataagacgctagatgttgattttcaattatgctgtgacaaaattttcagtcatcttgagtctgttccctatatcacttcagatcctttttcttgttggtccagtgcatgtcccgcaatgagccaggacagggaagttgttgcacactgccgtcttcgtcggccgtcacgctatgagtggctatggccattggtcactgttggtcgtcggccgttcttctttgccacctcctgaaggtgaaaaaaggagctcccttttagttcaaatggatccaaaaaatggttgctgcattacatttcaagaccattctgttggtttaggctacatcttgctagtttggcaaacattttttgcatctacttgtggatggcttccattttgtgctccatggatcatgatcttgagaggctcgctgtcgagactgtagggagatgcacaagtcattgccgtccacatcgtcgccacaaggaaacaccagcatcactgccagctacacgcacatctttggcacaaccagtttctaaagttgtcgctgcgtcgacgcgtcccactccaacggcatggcttatgcttcagtgcaaaacagtggagcctgctggaggagtcacgaggtcgaggacctcctgctcaacagtacaacttcttgttttgtggccggtcgctcaaggagctgagtgcaggccgcagtaagtacatgagtactagtattaggatatgtgcggtcctagtaagtacatgagtactaattagcaagtttgattgctttctgaaaagtgaaaatgtcagcttgtactgatgcattccaaaaatgtgttgtgtgttttcaagaaaaaaacatttgtcgggtttttggtggccaagtattattgatatggaggtgaataactatgcggatgcgctcctattgtttttctggaac

SEQ ID NO: 31270 - DNA, 782 bp, Triticum aestivum
  Clone ID: PAT_TA_31270
atactccattcaccaggaacaacacaaatatcaatctccatcctagatttctgttgattctctttctttgagaatcccgagtctagtcgataccagctttcctttcaaacaaacgatcaccaggcgcagtcttcagtcgaagttctgccctctttttttcgcttccttcaccccgcgatttatcacttctaggtcgagccgagcttgatctagattttcaaaagcctcaaccgcaatcatggctgacaagggtcttgaggatgtccctgagacacagattgagactaactatgacgagaccgtcgactccttcgatgacatgaacctcaagtctgagctcctccgaggcatctacgcctacggtttcgagcgcccctctgctattcagcagcgtgctatcatgcccgtcattaagggtcacgatgtcatcgcccaggcccagtccggaactggaaagaccgccaccttctctatctctgtcctccagaagatcgacaccaacgtcaaggcttgtcaggccctgatccttgctcccactcgtgagcttgctcagcagattcagaaggttgtcgtcgctattggcgacttcatgaacattgagtgccacgcctgcattggtggtaccagggtccgggatgacatgaaggccctcgccgacggcccccaggtggatgtcggggacccccggtcgtggccagggaccgaatccagccggcgtgtcctccagaacgcccccccccgcaagacggcccccggggggggcgcaggcgcgggggaggagg

SEQ ID NO: 31271 - DNA, 1074 bp, Triticum aestivum
  Clone ID: PAT_TA_31271
cccacgcgtccgcccacgcgtccgcccacgcgtccgcccacgcgtccgcgtacccggtggcgtgcttcaacttcacctgcgacacggtcaccggcgagaaccgggcgccgatggtggcgggcttctcctcgcggggccccaacccgattgtccccgagatcctgaagccggacgtcatcgcgccgggggtgaacatcctcgccgcctggtcaggtgccgccccgccatccgacagcgacatggacccgcggagagtggagtacaacatcatctcggggacgtcgatggcgtgcccgcacgtgggcggcgttgcggccctgatcaagaagcggcaaggcgactggacgccggccatgatccgttcggcgctgatgacgaccgcgggcccgctcgacaagaacggcagggacatcgtggacggcggcagtgccgtcggcgccgccgcgacgcctatggaggcgggggccgggctggtgctcccgcggctgaccatggacccgggcctggtgtacgactcgggcacgcacgactaggtcgacttccttctgccaccctcaactacacgggggagcaaatgcggcggttcgtcccggggctgagcaagtgcgcgaggacgatccccgggggggtggccaacctcaactacccgtcgtttgtggtggtgtttgagggccgcacccgggcccgcacgttgacgcggacggtgaccaaggtgtcggcgcaacccaaaaggtacaacgtgacggtccccgccccggacggggtgaaggtgacggtgaccccggcgtcgctggagttcaagcgggtgaacgaaaaaaggagctaccccgtgcggttcaccagcaaggccggagcaaaggcgagcccgcccgggacgtgggagttcggccccatcgcctgggagaacaggaagccccgggtcaggagccccgtccccttcaactgggacgactgatgccccagctctgaaaaagtaatgctcctgtgccttgtgagttgaccccccatgaaaaaaaaaaagaatcagcctttggttgttgcgaaaaagggaataattttcatccgatgtttttt

SEQ ID NO: 31272 - DNA, 1352 bp, Triticum aestivum
  Clone ID: PAT_TA_31272
aaatactgcgacctcctgcggagagtatgatctgacgcccgacaaggtcatgggcaaggtcgtggtgtgctcccgggaggcaggagcttcggctggccttgaggtggagagagccggcggagccgggatagtttccgtccaaagtacggaacggttctgggacacggtaatggccgaacccttcccccttcccggtctcctgctcagctccgccggcggcaagaagctggccgattacatgtcgtccgtggcgtacccggtggcgtccttcaacttcacctgcgacacggtcaccggcgagaaccgggcgccgatggtggcgggcttctcctcgcggggccccaacccgattgtccccgagatcctcaagccggacgtcatcgcgccgggagtgaacatcctcgccgcctggtcaggtgccgcctcgccatctgacaccgagatggacccccggagagtggggtacaacatcctctcggggacgtcgatggcgtgcccgcacgtggccggcgtggcggccctgattaagaagcggcacggcgactggacgccggccatgatccgttcggcgctgatgacgaccgccggcccgctcgacaaggacggcagggacatcgtggacagcggcagtgccatcggcgccgccgtcatgggcgcgacgccgctggcggccggggccgggttcgtgctcccgcggctcgccatggacccgggcctggtgtacgacgccggcacgcaggactacgtcgacttcctctgcacactcaactacacggtggagcagatgcagcagttcgtgccggagctaagcaagtgcgagaggacgattcccggcggcgtggccaacctgaaccacccgtcgttcgtggtggtgttcgacggccgcacccgcgtccgcacgctgacgcggacggtgaccttggtgtcggcgcgccccgagaggtacaacgtgacggtcgccgcgcccgacggggtgaaggtgaccgtgacgccggcgacgctggagttcaggtggccgaaggagaagaggagctacagcgtgcagttcagcagcgaggcgggggcgaaggcgaggccggccggcacgtgggagttcggccacatcgcctgggagaacaggaagcaccgggtcaggagccccgtcgccttcaaatgggacaactgatgccatgcatgtagagggcggaactctgagagtgagtctgactgcctgaactctgagagagtaatattgtgatacttgagacttgagagttgatctgtaatgaagaagaagaagaatcagcatttcattgtggtgaacttgtgatgaggagaaaggaataatcagcatgttatttttctcctgtccc

SEQ ID NO: 31273 - DNA, 747 bp, Triticum aestivum
  Clone ID: PAT_TA_31273
cgaccaattcattactcaggtcgggcaattgaatcgaaacatggaagtgatcatggtgcaaacgctcatacggattatggaatgttaactcttctttcaacagatggcacccctggcctgcagatatgcagggacaaggatggccgtccccagctctgggaagatgttcatcacattgatggggcacttgttgtgaacattggtgatttgctagaaaggtggacaaataatgtttataggtcaaccctgcatcgtgttttgatggttggcaaagagcggtattcagtggctttctttgtttggccaagcccagatatggtggttacatgcatagaaagttgttgcagcgaggcaaatccaccaagatacccgcctattaggagcgacgaatacttggagcagagattaacttccacatacaaatacaaatagactactgtatcgtggtcattgctagctgtaggctgtttggttttatcagaagttgccaaaagctttctgttgatgcagtcaagtaccatagttgatgaatcatggggtgtaatctctatgttttttgtattggcttaaattgagagtttcctaataaattgggtgtgatgttgtctgatgtataaggacaatttggaatatgaggtagctagtatcggctatataatatatattgtttgcctacaatagtcatacgttgtaaaaaatacagtcagttttcgcataaatatacacatatcagagttttattgtaac

SEQ ID NO: 31274 - DNA, 1405 bp, Triticum aestivum
  Clone ID: PAT_TA_31274
ccgctcaggcggcggcccagtggattcagagactactgctagctagcttcagagtggacacaacgagctagctctccggcgtcgtccaggaacaacatttagagatgggtcacgcgagcgcagccctccccgtgattgacctcgcgtccccggacatcggcgccgccaccaaatccatccggcaggcgctggtggattacggcttcttctacgtgatcaaccacgggatcgacgacgccctgatgaagagcgtctacgcggagagcgccagcttcttccagcagccaatggaggagaagatggcgctgcacaagaacagcagccacagaggctacattccgcccgattttgaaggcttcgaggctgacgctggtggcaagggggacctattggagtgtttccacattgggtctggggtagacggcgactccaagaatcctgtgaatcagtggcctcctgcagaacgctttccatattggaaggagacaatgaagtcgtactatcaatgtgcaatgggaactagtaaaaggatattgtccctaattgctttgagtttggaccttgacgctgaattcttcaagccagatggctccgaaacaattcttcgaccaattcattactcaggtcgggcaattgaatcgaaacatggaagtgatcatggtgcaaacgctcatacggattatggaatgttaactcttctttcaacagatggcacccctggcctgcagatatgcagggacaaggatggccgtccccagctctgggaagatgttcatcacattgatggggcacttgttgtgaacattggtgatttgctagaaaggtggacaaataatgtttataggtcaaccctgcatcgtgttttgatggttggcaaagagcggtattcagtggctttctttgtttggccaagcccagatatgatggttacatgcatagaatgttgttgcagcgaggcaaatccaccaagatacccgcctattaggagtgacgaatacttggagcagagattaacttccacatacaaatacaaatagactactgtatcgtggtcattgctagctgtaggctgtttggttttatcagaagttgccaaaagctttctgttgatgcagtcaagtaccatagttgatgaatcatggggtgtaatctctatgttttttgtattggcttaaattgagagtttcctaataaattgggtgtgatgttgtctgatgtataaggacaatttggaatatgaggtagctagtatcggctatataatatatattgtttgcctacaataaaaaaaaaaaaaaactcgagacttgtttacccccgccgcgacccacctaatcaattgtgaatttaacaaaaaaaaaaaaaaacctgcccgggcggccgctcgaaatcacttagtgaattc

SEQ ID NO: 31275 - DNA, 883 bp, Triticum aestivum
  unsure (1)..(883): unsure at all n locations
  Clone ID: PAT_TA_31275
cagtcccattggctcgtacagcttcccccaatggaatttctgactgcagacggctgtgtttcgttgttaatgaaacactcatctggcagtttagcaccaggtaccaaatgggagaaacatgatatagtgctaagctcaaataatacatgttgagttacattcaacccagggaaccggggtaacaaaaccaagataaattgactcctaacaaccaaacataccgttcaatccaggggtaacagaacccagataattcagcatccatccgtcagagatactgcttcgatatctcaactgaacaagccgcaaaaaaggccatatgtagcataagaggcagcgcaaactccacgcctccgccgaacatattggaaaccttctctgcttctgattttggcatggggcactcgtctcggacggtgggaaaaccattcacaacaggtagcctctcaatgttcagatcagtcatcctctgtgtcgtttgccttctgcttcttccacttgtaagcagcttccaatatcttgaggttcggggccagcgtgacttcatcagggaagatataatcaatgtactcctcgtacgcaatattggagccgtcgtctgtggggagtggtctcttcctcttcactttccttggcgccttcttctgcactaaagtgacatcaccaagatcaccaaagctcaactctttttttgagccactcttccaggagcattgctctttcttcttttagctctgcagcattggtcctgaagtagtcgaatgccctttcaaagacagcccgacacatccggacccgctcgatctgctggtcctggtaaccnncatcattcttattcacctcacttccattnncttctgccaagcnagctgnnnnntngnnn

SEQ ID NO: 31276 - DNA, 1564 bp, Triticum aestivum
  Clone ID: PAT_TA_31276
gccgcgatccacagcaagctcagagctcctcctccccacccaggtacccaccatggccgggatgtaccgtcccgagccgcagaaccccaccgcgcgccgccagcgcctcttatcaatcctcctcggcgccttcttcgccttccagctcctcctcttcgtcgcggcaggtaatgggctggacagcgtgcaggttgggaagcacgaggtgcgaattcgcgtggaagtgagctagctaattatacagacacatatatagacagtattggcgcagaaggcagatgaaaggagtcaaatcaagatgaacaaatctctgagatcagatgtatatacatatgtatgtatgtatgtcttatgcagactcttattttttcgagcataagaacaactctattcgcctccttctttgagagggagatgatgaaaaaggtgaacttgaaggtatggggctggatctccatcaacgctttgtttggaattgtgctagcaatgggactgcactactacggcctgcgcgccaccaatgcggcctacactgtcaatttccttaatgtgatccctgttgtcacctttatcattgctataatactccgagtagagcggctgaagattggcacatgcccaggcaagatgaaggtcatcggtgcggcgatttgcgtgggggggaccatggtgatcagcatgtacaaaggcaagctgctgcatctctggcctacccacctgctgaaaccgcagctgcagtcggttggtgcggcatcctctgtccctgaccaccacaacatgctcatcggcacactgttcttagccggcagctgcctcagctacgccttctggttcatcatacaggttcgagtgtccaaggagtttccgtccaagtacttctcgacaatgctggcgtgtgtgtcggggaccgtgcaagcggtggtgatcggggtcatgctcgacaggcgtccaatggcatgggcgctcaattggaatctgcagctgctcaccgtcgtttactcgggggtgttcaacactggcatcaccttttgcttgatctcgtgggccgtgtctcgtcgcgggccaatatatccttccatgttcaactcgctgtcgctgataatcaccacggtcctcgattcggtgctgcttggcaccgatgtgtctgtggggagcttgctgggagcgctgctgatcatcatcgggctgtatgcattcctctgggggaaagggaaggaaacacaagagcagcgcaagcaaagcagagaggcggcgaacggaaacgggagcgcggcaggtaatgggctggacagcgtgcaggttgggaagcacgaggtgcgaattcgcgtggaagtgagctagctaattatacagacacatatatagacagtattggcgcagaaggcagatgaaaggagtcaaatcaagatgaacaaatctctgagatcagatgtatatacatatgtatgtatgtatgtcttatgcagactcttattttttcgagataagaacaactctaatagattctttaaaaaaaaaaaaaaaaaaaatgtgcagtaaggatcaactggaaacttgccttaaa

SEQ ID NO: 31277 - DNA, 608 bp, Triticum aestivum
  Clone ID: PAT_TA_31277
gaaataaatacaaatgtgcttcataaatgctgattataatagtacattcttactcggccactcagatggcagccatacccataccagttcctacacacatagatgtcgcgccgaccttctggccagttctcttcagctcatatagtagggtagagacttgtcgggcaccggtgcaacccagagggtgaccaaaggcaatggcacctcccttggggttgatcttctcttgaggaatacccagctcattggcgcaccacaagcactggctggcaaaagcctcgttgatctcccagatgtcgacatcatccttggagataccagcgaggtcgagagccttggggatagccttccagggaccctgacccataaggaggggcttgacaccgacaattgaagcgcagacgtacttgccgatgatcttttgtccgagcttctcagcggtagatcgcttcatgagaagaacagcagcggcaccatcagagatctgactggcgttaccagcgtggatggatccatccttggcaaaggcagggcggatcttgccgagggactcgacggtgatgccctctcggacaccgtcatccttggagacggtgattccttgaaat

SEQ ID NO: 31278 - DNA, 586 bp, Triticum aestivum
  Clone ID: PAT_TA_31278
cagagacagaataaatcagcactgttactatttcttcagttcatgaaacagttaacttacaagatgacagagtacaaacagcatcatcatccaacatggcagggagcagcccatctatgcggaggtgaacttggtgacggccttggtgccctcggagacggcgtgcttggcgagctcaccagggaggacgaggcggacggaggtctgcacctcccgggacgtgatggtgggcttcttgctgtagcgggcgagcttggcggactcgccggcgagcttctcgaagatgtcgttgatgaaggagttcatgatggacatggccttggaggagatgccgatgtccgggtgcacctgcttcagcaccttgaagatgtagatcttgtacgtctccacgctcttcttggacttcttcttccccttcttgtcagcgccgccctccttggacgccggcggcctcttctcggccttggtcttcttcgccgccgtggtcttctcggccttctccgccaccggcttcttctccgccttgggggccatggatgccgctgctccttcgccggggacgggtgtggtggtgtttcgctgggag

SEQ ID NO: 31279 - DNA, 817 bp, Triticum aestivum
  Clone ID: PAT_TA_31279
tagcgtggtcgcggccgaggtactaatgctcatatattacaatttgcggtccacagcccgggttcacgggatcttgaaaaaagtagtttaggcattttgcttgtgtcaactatatgaaatctgcaaagtcttttttgtgtgcagaaaatttcacactctgcattacttgcaaaagatgctgattttgatcttaacaattatagttgttgttcaagcagtagaagatctggcaacctcacggccatctcattcgaaattgaagtcctatccttaaagtttagctaagtgtattatttattttctggtttaaattattttcctcatgtgacacaaaaggcttgaagccttcttttaactcgcacttctatgctaaccaaatttatttctggctgtcagaagagttcggagcgaagctggccagcatcttcgcatgtgacacaaaaattgttgttcaagcacacaactgctgtatttcgtaaattgtgacgtgttcatatgattttttactgaaggtgcttgtcaattataggtgaaaaacttggcatggaggcgcataggattgctgcttctgtttttggattggcccttgcgagggagaccgaagcaaactccagcaggtttcagggataatacaaccaatccaactactacctttggtgtgctttttggatggactaatctgaagatgctgactagcttgcaccaccatcatatagtcacgaagcaagggcaaggattatagggaaaataaaggcaattcaccatccggaggaaatgccaactaatacatttttgtacctcggccgcgaccacgcta

SEQ ID NO: 31280 - DNA, 1111 bp, Triticum aestivum
  Clone ID: PAT_TA_31280
taggggccttttttttttttttttttgaaagataaaaagaaaagcattcatcatgataacggcaccctaaatacagacaaagagcaggtttgaagaaccattgcattactttttggtagccccatatgcacctcccaaagagatcaaggcgcagaggattgccccgaagcccagtcatgcggccaagtcggaatctcccccctgtttcgtcttccggactggcagcagcgcagcgtggtataaaaagcctgccgcctttccaggcgaaactctagaaacgagatctatcaacaactgccacaagagattcccccgtaaaaccctccccaagatttcaggctgccctgagtcgtctggtcgtaaacagctggctgaacagccagaaaaacggattttagacgatccgtgttgctcttttttttcgcttttttcgtttcaagcttagataagatcggcaacgttcatgggcatctcgtcgacctgagtgctgtaaaagctttctatctcacgcagcatgcgaacgtcatcagcggtgacgaagttaatggcgacaccctttcggccgaaacgaccaccacgaccaattcggtggatgtagttctcacggttggcggggagatcgtagttgatgaccagggacacctgctggacatcgataccacgggccagaaggtcagtggcaatcaggacacgagaagaaccggatcggaactccttcatgatcaggtcacgctgagcctggtccatgtcaccgtgcatggcggagacagtgaagtcacgggcagtgagcttgtcggtgagccagtcgacctttctgcgggtgttgcagaagatgacggcctgggtgatggtgacggtctcgtacaagtcggagagagtgtcaagcttccactcttccttctcaacagcaatgtagaactgcttgataccctccagggtaagctcgtccttcttgacgagaatgcggacagggtcgcgcatgaacttggtggtgacctcaaggacgtcctggggcatggtggcggaaaggaggacgacctgggtggactgagggaggagctggaagatgtcgtagatctgctcggtgcaaccacgagaaagcatctcatcg

SEQ ID NO: 31281 - DNA, 561 bp, Triticum aestivum
  Clone ID: PAT_TA_31281
gccagccccctgggagattcgggaatcacaagaaggccagccagctgcagtaaacatggtgtcactcctacgattgccaaggtacgcaggtgatacatgtccccagagcatacgcgagcgatgccccacaacatatcataaactggtttacggctgcgaaccgtcctctaagattcttgggtgttatctctgatatatatactgggaccacataggaaagaaggccaattccacatccaattgagagcctcccaaggtcaagccacacagagttcttagaaaaggctataaggagatatccaagaatgcagaacacatctgatattgccattgcacatcttcggccaactcgatctgctatggtaccgctgacaatagcgcccagcattgctcctatggttaatatcgagccaaagacagaatactctgctaaggaaagatgaagatcccgcatgatgcccttctgagatggcgaagagtagcccaccgagatgccgaacacgaaggatccagcaacggcgaccgtggtgctagcgaccaccacccaaatcgaagaaacgt

SEQ ID NO: 31282 - DNA, 2390 bp, Triticum aestivum
  unsure (1)..(2390): unsure at all n locations
  Clone ID: PAT_TA_31282
aggctggaatccttnaagaacgggccgtcccttttttttttttttttttcactactatatctcttttttttctctttttttccaattgttttacagaatattcgtacgagaaactcactctgaataccacaacagttacagtgcactccgccgcttatgtcgacatagcccgctcgcggggcagaatcacatcgtaaccttataaccacgatgtacgatcgtgttggtacacaatacgtatgcgaaacaaagtcacaagaaaaaagaatgctacccacagcagccgatctccccttcctccccgtcgatatccatatcgacggcgggtggtaatatgctgttgacatcaacggagggtggtgatatgctgtcggcatccacggagggtggtgatacgctgtcgacatccacggagggtgctgatacgctgtcctccatttcatcttcgacctcttcttcgatgtctctcttcatgaagagcccgagcctctccagcgggcttccgaggccaggtgggagctccatcccgtcgacgaaatccacgattagcttggcaggagggttcagttcccactttttgctgatgttttccaggtcctttaggaagtcgctgttgtcaatgtccacggtcttcttcatcatgtgtagtgccagccgtcctgcctctctttctcgctccctcttcttccttaattcttcatctcactggagctgtgcagcagcttcagccgcctgcacctggccttccatcctttctttccagacttagtgcccagcgctcaccgaggcgttgtggcatcgggcgtacggcggcgagatcgatgctctgtcgccggcggcgggttggggacggtggcgcacaagcgttccagcccgacagcttttcagcactcatgcacggagggcctgggctggtgacaaaggttcagcctgtaaataacttccgtctcctggaccataggaagaaagaggcgaagttgaagtatcactgcaagaccgtgattcatttcccaatcgactgaactctgtgctcacttgactggaccttagttgtgttagcgctctccttggtgcatgggatagaatgatgtaaagggccctccttgctaccagctgcttgcaaaggtgtctctttggataaggtctgccccgatccacgcacacaaaacttaatttttactttggaggatattgcatttgtcaatgtcttctttgcagatgaatttgagcatgcgaccaaccctccagaaaccactggctttgaattgacagccacacgagccttaattaccttcatcggcaactgcactggcttcagatttctgtcgctccattttctttcatatgatgtccattccgaattaaacattatattcagctgttcagctactgtgtggacctgatttccaggaggattatacgtcattgcatttgaaaatgttagtctcacatctgctgcaaactcatcggtgcttgaataattcttgtttgtgagtttcttcttgacagtgcccaagtccattggattgcggataacatcaaagtaatcaggaatgccaaataggtctggatcaaccggtttatggaacagccaaccacccgggtgatccatgagcttccccagaatatttctacagacccttgtcttgctagcattcatgcttccagccttgttgttagaagatggtcgatgctcagatgaagatattgacgtcgtcccagatttttgagaccgtttacttccctcaacctctgaatctgtaccagaatcttctgacccactgcttatataaactgacctccgcctcttacaggcttgcgtggtcattgtgattggtttagtactttctgattttggcaaatgagcagtaacttcaggcttcatgatgccctctccgatagacacacatggtacatacagcacagcttctctcagtcagctgagcgtgtcttgggcggggcgggcggagggcagaccccctgggagttccgtaggaagcctttgccccggagggagagcctccgctggcgtcgcggggagccggagacttgcacgcgcgcggaggctagggtttcggcccgggctccgcggcgcgcggcctccgcgtcgaggcggggcgtcggggggcgggcggtggaacaggccggcgggggacggacgcgggaggatggggccggcggaaggcggggaatttggccggcgccggggggtggtcggtcgcgggggcggaggagcggcgggagggcgtcggtggcgggcgggggaggagcggctgggggtggatgcggaggcgggaggatgggggccgccggacggcgggggggtaggggagcggcggcgctggaggaaccctagcgcgagagctttttttttcttttcggacgcgtgg

SEQ ID NO: 31283 - DNA, 641 bp, Triticum aestivum
  unsure (1)..(641): unsure at all n locations
  Clone ID: PAT_TA_31283
cgggctgaggaattcggacgagggttcttgtggtntagctctattctattgattcgccattaaagcgccgcacaagtgaaaaacctgctgtgctgttcgacgacaaccggttccgtgggatgctgtccatggaggtggtacgcgcagcaacaaaggacttcggcagtgaaaatgtgatcggcattggtggctctggcgcgattgtgtttcagggggttctcccttctgggtcaagggttgctgtcaaacggttccaagctatgtggccgtgctcaaaggcgtttctgagtgagcttcgtgccatgcttgattgcccacaccaccccaatcttgcgccactcttgggatggtgctccagtgagcatgaccaggttcttgtttacgagttcatgcccaatggtaatcttgacagtgcactgcacacaaagggtggagcaatacttccttgggaggcacggtttggggcggtgcttggtgttgcatcagcacttacatttctgcatgatgaatgtgagcaccgcattcttcatcgtgatgtcaagtcatcaaatgtgctgctcgatgcagacttcaatgctcggttaggagattttggtcttgctcgcgtggtgagccatggcggggtgcctttggcaacacag

SEQ ID NO: 31284 - DNA, 395 bp, Triticum aestivum
  Clone ID: PAT_TA_31284
cgacccagcgtcccccacgcgtccgatcagaatggattaccgttgcctagaaacaacggcgtatgggaacctggggcagatatttgggttggtgcgaggccacccacagacttggatgcctttggtaggtcagacagtgaaggtacagactcaaagatgcagataatggatgctttcttatggggaaggtgtctgactgaagatgaaattgctgcgctatatacaatcatgagtcctgcggagtatggcttttttgaccttgcagctgaagatgcttggcatggaagctattctgctagggtggatgactgggagagtgaagaagcaaactatgagctactgcatcgcgcaccggacgtttcctaccacttgaatactctagttctagatcgcga

SEQ ID NO: 31285 - DNA, 1891 bp, Triticum aestivum
  Clone ID: PAT_TA_31285
ggcacgacgagcagagcagactagcattccaggtgctgtatgtgtacttgatgatgaaccaaggagtaccggacgccattgtggagaaattgacctgtgtctttgtcaaagtcaaagagtgagcttctccattgcagtaatggttcaaccggtatctggtccactctgtcttttccgaaccgaatttgagaagaaggtttgctgggaaatcttggtggcagggtcacaacagggaatggaagcggggcacgttggtcttacattactaactaacggtgaaaggatgaccactgttgctaaagagtggaatattggtgcgtcaagtattgcagatggcaggtggcatatcgtcacagtgactatagatgctgacctaggtgaagcaacttctttcatagatggagtttatgatggatatcagaatggattaccgttgcctagaaacaacggcgtatgggaacctggggcagatatttgggttggtgcgcggccacccacagacttggatgcctttggtaggtcagacagtgaaggtacagactcaaagatgcagataatggatgctttcttatggggaaggtgtctgactgaagatgagattgctgcgctatatacaaccatgagtcctgcggagtatggcttttttgaccttgcagctgaagatgcttggcatggaagctattctgctagggtggatgactgggagagtgaagaagcaaactatgagctatatgatcaagaggatgttgaatgggacgggcagtattcaagtggtaggaaacgtccggtgcgcgatgcagtagctattgacattgattcctttgctagaagacccagaaaaccgaggtttgagacacgagaggaagtcaaccagcgtatgctgtctgttgaaagggctgtcagggaagctcttagtgcaaaaggggagagggcatttactgatcaagagttccctccagatgatagatctttatacgtggatccagggaaccctcctctaaaattgcaggttgtttctgagtggacgaggccttctgacatagcaaaggagatatctattagttctcagccatgcttgttttctggttccgtgaattcctcggacgtatgccagggtcggttgggagactgctggttcctgagtgcagttgcagttttaactgagatgtctcgtatatctgaagttataatcactccagcatacaatgaagaagggatttacactatcagattctgcattcagggtgagtgggtggctgtggtcgtggatgattggattccctgcgagtctcctggaaaaccagcatttgctacgagtagggaaacaaaatgagctatgggtatccattcttgagaaagcttatgcaaaacttcatggctcttatgaggcgctagaaggcgggcttgtgcaagatgctctagttgacctcacaggaggagctggcgaggagattgatatgcggagtccccaagcacagatcgatcttgctagtggaagattgtggtctcagctgttacattttaatcaagaaggttttcttcttggtgctggaagtccctctggctctgatgctcatatttcatcaagcggcattgttcagggacatgcttactccattttgcagataagagaagttgatggccacaagcttgtccaaattagaaatccttgggcaaatgaagttgaatggaatgggccatggtcagactcgtcacaagagtggactgaacgaataaagcataagctcaagcatgttccacagtcaaagaatggtgtattctggatgtcttggcaagattttcagatccacttccgatcaatatatgtttgtcgtgtttatccacctgagatgcgctattctgtccatgggcaatggcgtggctacagtgc

SEQ ID NO: 31286 - DNA, 1574 bp, Triticum aestivum
  Clone ID: PAT_TA_31286
gccggccgggctgggacttcttaaccaccatttatcttctcttatctccctgcaggcccatcttgcatcttgcatcttgcatcttcattcttcatcaacaccacagctcgcaatactctttgtcgagcatctttattcacatccaactcggtcgcattctcgatccgattgccatcatgaagagcgctcttcttaccgctgccgcgcttctgggctctgctcaggccggcgtccacaagatgaagctcaacaaggttcctcttgccgaccagctggctatgaactccgttgaggaccacctccagagcctcggtcagaagtacatgggtgctgctcgccccaagaacgctgccgattacgcctttgctaccaacgtccccagcgttgagggtggccaccccgttcccgtttccaactttatgaacgctcagtacttctccgagatcaccatcggtactcctccccagagcttcaaggttgtcctcgacaccggtagctccaacctctgggttccttcccaggagtgtggcagcatcgcctgctacctgcactccaagtacgactcatctgcttcatcaacttacaagaagaacggcagcgagttcgagatccattacggctctggcagcttgtccggtttcgtctccaacgatgtcgtttccattggtgaccttaagatcaaggaccaggactttgctgaggctaccaaggagcccggtctggccttcgctttcggtcgcttcgacggcatcctcggtctcggttacgaccgcattgccgtgaacggcatggtccctcccttctaccaaatggttaaccagaagctcctggacgagcccgtcttcgccttctaccttgacggtcaggagggccagagcgaggccactttcggtggtgttgataagtccaagtacactggcgacctcgagtacattcctctccgtcgcaaggcttactgggaggttgacctcgatgccattgctttcggtgacgaagttgctgagcaggagaacactggtgctatcctcgacaccggtacttctctgaacgtcctccccagcgccctcgctgagctcctgaacaaggagattggcgccacgaagggctacaacggccagtacaccatcgagtgcgacaaggtttcttctctgcccgacatcactttcacccttgctggttccaactacagccttccctccaccgactacatccttgaggtccagggcagctgtatctctaccttccagggtatggacttccccgagcccgtgggtcctcttgttatcctcggtgatgctttcctccgacgatactactctgtctacgacctcggcaagaacgctgtcggtctggctcgcgccaagtaagaaatgaacatttatgtatgaattatttgatagcgcatgggaatatgcagcatggacatgggtttggacattagcaggggactactagtttgaactttacgacagacttgagtatgctgtattgaggagatagctcctcaaacttgatgctctgtaatatgattatatgggtttttacacgaaaaaaaaaaaaaaaaaaggccccta

SEQ ID NO: 31287 - DNA, 1595 bp, Triticum aestivum
  Clone ID: PAT_TA_31287
cctcccctcccttactaatctttctactggaggagcaggggacctatctcgatcttcaaatgcccctgttgcttctggttcgccatctaactcggtctccaaaagtactggtggtagcccacctgcatctggaagtgcgaagggtggccagccagttgtccaattgtcatcacctcaacaacatgcagcaaagaactccccttcaacttctggatccaagtcggcttcaacaaatccctacagcagtatgcctatgccatcgatccttggtcagcaaccaaacatggctcactctggtggtaagcagcagtcacatggaccctcattgaaacaacagcagccgttcccacaaggccatggccacggccacttcttcatctccaatgcctttgcgccacaaggtccgcctcagcatgtaaatgctggagctggtgctggcctctaccaaaagcgctcggctgacaagacgcagcagcagcagcagcagcagcagcagaatgctgtctctggttcgtctgcgatgctctctcttggttccatgtcgatgtccacatctgcgattccagctgatgcggggaaggctcatagtgcagctggcagtaacatgaaggccaatcttcatccagcgcctggtggttttatgcaccttgcgacagcggggcaatctgcgagtggttcgcctcactctcacctttcagcggcacaattgacgttttcaatgccgatgcccgtaaagcctaccagtgatcagaagcctgctgctggtaagtaaaggacccagacgccagagcatgggaatgctgctaatctgagtcggcgagctaactgctaattctgtcggaagctcggcgcgcggaagaagcgattgcgtggcaagaggcatagctgcgagagccggaacgtcgacgaggaggatgatgcacccattccatccattcaggggctctggcaaatctgtggagtaaaaatgtggaacggctggctgatgggagtgatacttgtgtgtagtaggttatcctcccatggtggaaagctggaggtgcatagaaacccttttttttagcagttttatgcaagattgtcaaaagctggtctctctctgaacttctcccctcccctccaactgctgctctgctctggtctggtctctttagatttgttctttttgttgttgtcttaactgaaggaagaaggtttaattagaatgcaggtcaagggaaaacttttgtgatgttgctgctcttgccttcctcttttctttctttctgtgtttctttccttttttttctccatgtgttttgtcaatactcagatctgcttggattgttttagaaacaatttggggcagagagggaaatgtctctcaaggagtagtagtagtagtatgttggattgttttagaagcaacaactggggctgaggcagagaggcagataagtagtagtagttgttgcatagcatagcatagcatagcatatagcatgagaatgaccatgacctggcttttgggcgtgtgcgttgtaattagctagctagccttgtagaagaaatgaatcaatcaaggcggtggaagttggatgggtggaaaaaaaaaa

SEQ ID NO: 31288 - DNA, 471 bp, Triticum aestivum
  unsure (1)..(471): unsure at all n locations
  Clone ID: PAT_TA_31288
ggcggaattgtagtccggctgtccggaacacccctagtcccaggntccctaaaaggcctttccgggtcgagaggaaccgtgtcctttgagtattcagaactatttcagttatacaatcaatacgcactcgacaaatctatcgtcagttgctattgtctgtaagtgatttctttctgtagtttaagtctccaagctagctgtagtgatcattttgatcaatcattacctgtaattatcctcactatattcttttctgtggtattatgcaggatgaagatgtatgaaatgaaaaaatctggacgctatggcattgggttcattgagccaaataccgttaatgagttcacatggaatattcaacatcatgtaaaggaagtttagaggacagcatgctagagttcttcaagcgcctcaataccaatggagatatactacttccttacaacttcctgtgagtcacactgtcttgta

SEQ ID NO: 31289 - DNA, 815 bp, Triticum aestivum
  Clone ID: PAT_TA_31289
gcgctgcggccgtccgtaccagctttccgggcccggtccccggcacccgtcgtctcctccatctcaccccctccgtcgcctccctcctccgccccgtgcccggcggcgcccccgccgcccccgcccccgcgccgttccaccgattcagacccccacgccccaacgcggcggggaagccggccttcttcctgccgagccggacggggatgttcgtgctcaacgccttcatcgtggtgtgggtgttcgctcggcggatccggtcggcttcggcctcggcggctgggccagcatggtcaacttcatccgccagatcaacaccttcggcctcttcgccaagtgctaccagtgccccaagcccggcgccgccatgcgtcgctcctggcccctcctccttgcaccactagctccctcgccgtcgcccgggaccgtgacactgccatgccactggccggtgggaagcaagcaaggagctcgagaagcttcccctcccgctcccggcggccggcacggcggatccattactgttgcttgctaggttttggtcgccttgtaatatacaagcctcgcctctcctagggcgtccgtcagtgtcacaccgcaccgtagtagaacagcagggtgaccgggtccctaagaccacgtccgttgcttccccctgccagacccgttggtagtacgtacgtacgtgtccgtgtgtttgtgtttggcttgccccaccaatatatatgtgatggtcttcatggcttataagattggaaagtaaagacattaatataaaaggaaagatctgataaaaaagggggccgtaccattcc

SEQ ID NO: 31290 - DNA, 1386 bp, Triticum aestivum
  Clone ID: PAT_TA_31290
gtcaaggcggagaaggccctcgttaagggggcaattgacaggagcgatctggttccgatgatagagagtttaaggaaaggaagggaaagacgtaggggcatcggagcggcctcaggtgaaccatatatttcacagcgctgcccagtgtcgactgttgagatgccccttgcaaccgaactagaccctgactcgaatccaggtgtgtcaagaagaagcccgcccttcgtcgcaggtgatgcggccaacggaggaccaaagaaaggcactctgggtgattaggacggcggttgtgcatgggtctgataatttttctggtaaagtttgtgaagaggtacgagctgctgaagtcgatgatgcgtagtcgggaaacagagatgtagatgagtcccgcctagttctcctgcgcatttgttgggttctgacgctctccctcggtcacgtcttggcctatacccggttgacggaggaaaagacaccacgtcttcctcccggattttcataaacattcccttccacggaactgtcagagcatcttggtatacgattgctcaacgagaggctaaatgatccaaacatgcaaggatcctttgagtcggtcttcccaagagaccacccaaagaacaccagattctccatcaatttcttcacctccatcggtctgggaggcatcacggagagcctgcgagagtacctgaagaacatgccccgcatgataatgcagcaacaaaagcccccctccccgtccgagtcggaatcaagcggagaaagctccgattcagggtccagttccgagtctgaatcaagttccgatgagagcgagaaaaagcgaaggaagagaaggaagaagtaggaagggagaggaatcaggtggaggagaggaataagttctgatcggatcagctgcctagttggactctgttgcgtgtgcatgtgtatcaatcagaattgggcagcctgcgagtgtacctcaagaacatgccccgcaagataatgcagcaacaaaagcctcccgccccgtctgagtcggaatcaagcggagaaagctctgattcagggtccattctgagtctgaatcaattctgatgagagcgagaaaaagcgtagggtaactacgtagctgttggtgcttgttgaatccaggacttcactatcgaagcaacgaggccacaccagctggaagaagttcggtttttcttggtaaattttagacagcacaggttttgtatctccttccgagttttgtatctgctcaagaatttgttaccttaccggtctgtatgttggtttgctacagaattggtatttttttccagcaacgccacttaactccaaactctttgtgcctaaggataataatatgaacgatgattgtacgctcaaaaaaaa

SEQ ID NO: 31291 - DNA, 837 bp, Triticum aestivum
  Clone ID: PAT_TA_31291
gcgtccccccgggcgtccgggagcggaccgacgaggagtgcgagagggtggccgcctccggcgggtacatcgaggacgggtacctcaacggtgtgctctcggtgacgcgtgccctgggcgactgggacatgaagatgcctgactgctccacgtcgcccctcatcgcggagcccgagttccagcaggcgacgctgagcgaggacgacgagttcctcatcatggggtgcgacgggatctgggacgtgatgacgagccagcacgcggtgagcgtggtccggcacggcctgcggcagcacgacgaccccgagcggtgcgcgcgggagctcgtcatggaggcgaagcggctcgagacggccgacaacctcaccgtcattgtggtgtgctttgggtcggagctcgggtccccgccgccgccccccgctgtggcggcggcgaggccgaggagctgcaagggcctgtcggcggaggccctgtgcaacctgaggagctggctggaggctgaccgctagctctctggcttgagatgcctgctctgctgctcctgctcctacctagtgctgctggtcggttcgttcccacgctgtaaatatgctgacatcggtcgaggaatcgtaactaccacttcccttttagttccctaccattttttcaggcggtagcccatcagtttttgtaggggcattctcccattgtttcctgtgcttttctctctctgttgctgttattgctcacgccattgctgttgtacatagtacatggtactacatccgttgcgcccacggatggacctgctttcctcgagcaacatctgctgtttaacagaaatattcccggggc

SEQ ID NO: 31292 - DNA, 722 bp, Triticum aestivum
  unsure (1)..(722): unsure at all n locations
  Clone ID: PAT_TA_31292
ccactccaccccacaggatcctatccatcggcgctgtgctccgatgagcagctccgatccgatcgaccacatgtcggtcagcgagcggctgcagcggctggcgacgccgtcggccccggcggaggacgacgtggacgtggacgcggacggcgacggtgcgaccttccgggacatccacccgtctccggcgccggcgccgctgcggcagccctcctgggacgtggcgagccagcgctcgctgcccgtcctactcggacgagcagttcatgtccagcatgggccgcgagttcacggccatggtggacgcggggggcgcgccggccgacccttgccccggccgggactccggcgccgggaacaacgacctgcagctggcgcggatcggggagcacgagcccgtgccggagacggagacgaacccgctggccatcgtggcggacaccggccgcgcgctaccaccggcgccaacgtcgtcggcggcgcccgcgcccgcggcggtggtggtggaggtgcggcaggtggaaaaaagaggaggcggaggcnaangtggcggcgtggcaagcggaggaggtggccaagatcaacaacaagtttaagcgggaggaggtgggtgatcaacggggtgggagaaccaacanatncacaacgggcaccacctacctcancaagatnnaaaaggaaacttggagggangagcgcgccaaaggcgacggngaaaggng

SEQ ID NO: 31293 - DNA, 1579 bp, Triticum aestivum
  unsure (1)..(1579): unsure at all n locations
  Clone ID: PAT_TA_31293
attcggcacgaggcttccttgcccgctgccgagtgttctccctttgctcgcgccgacccgcgcgagagggttcgaatgcgcgccctccaccccccccgcggcccccccccaacccccggattcccccccttcctgcaccgccatggccgcttccccccccgcggccccgttggtcaccgtcaccgcagccgggcatccggcctactgcggccagcacacccggcctcccggcgccgcccccgtcaagccgtcgccctgggcccgggagtccccacccctgtccctcgccggcggcgcccccctccgcgacttcgtggacccctttgatagacttacagacgagaataggcttccacatttgttgctctacggtccacctggcactgggaaaacatcgacaatactagctgtcgcgaggaagatatatggcccacagtatggcaacatgattctggagctcaatgcatcagatgaacgtggaattggtgttgtaaggcagcagatacaggactttgctagtgcacacagcctctcttttggagcaaagcctgctgttaagttggtcctcttggatgaagcagatgccatgaccaaggatgcacaatttgcattgcgaagagtcattgagaagtatacaaggagcacaaggtttgcactcatatgcaatcatgtgaacaaaatcatcccagcactgcaatcaaggtgcactaggtttaggtttgctccacttgatggctctcatgttactgagcgtcttcgacatataataaaatctgaggggcttgatgtagatgagggtggcttgactgcccttgttcggttaagtaatggtgacatgaggaagtctttgaatatattgcagtcaacacacatggcatcccagcaaataacagaagaagctgtctacctttgcacgggaaaccccatgcctaaagatattgagcagatagcgttttggttactaaatgaaccattttcaaccagcttcaaacatatagctgatatgaagatgagaaaaggtctggccttgattgatatcatacgggaggtcactatgtttgtgttcaaaataaaaatgccatccaatgtacgagtaaagttgatcaatgatttggcagatatcgagtatcggcttacctttgcttgcaacgataaactgcagcttggggcactgatctcgactttcacgactgctcgcacggctatggttgctgccgccgactaaattgaacaaaatggcccaccatggatgcctacatggatctggaaatgttgtggcagcttatttatcttctctgtatttagtttaaagcgcattgagcagaaaattttcatgttagatctgtctgtctgctcgacgtgctagctgcttgggaccttggaagggtttcagaactgaactgtaactgattgttgtcaggtttaggtgatgtatggacgtaaggtgcatgctacaatacatttctatgcagtagggagtcattcacaactcaaccaattaggttgcgcagtattgtcgngaaaaaaatcaagatgggcaattcttttnatcagctattaggttttgtaggtgcaaagt

SEQ ID NO: 31294 - DNA, 1080 bp, Triticum aestivum
  unsure (1)..(1080): unsure at all n locations
  Clone ID: PAT_TA_31294
aaatccctctccttcgctcggtcccccgcccccccccgccgccccgcccgacggcccccccccccccctcccccctcccgcccgcccccccgccccgcccgctcacctgaagccggtggcctcaacgcccgacgccgcctcgccggagttcgctcgggccgtcgcctaagggtccaaagctatggttgcagatgaaaaactgccagcttctggagatgctaacaactcacagcagcagcttcatgatactgacacaaaatcacgtgtgganggatatgtggaagaaaatgaacggcggtttgcctgcgaagatgcccaaacctcccacgcgtccgctcaaaacagtagcaaaagaaaagaaaactaaggcgacaaataattggatgaccattcttggccttccaccaaaaaaggcttctgcaaatgatcaagtcccaccaaatgagcaacaacagacacaacacaaaacaagtgaggataccaaaaaacttgcggcaaatgctcttgcagctgttagagatgccgccactgctgcatctggaagagggaaagtggagataaccgaggtaagggactttgctggcaaggatattgagatcaagaaacttgtagatgcggattcaaaggaagcggttgagaaggccagtgcagcgggtgcctcgccgtccgctgtggacaacatcctggagcagataaggaagaagcagaagctgagcgtcctggacaagacgaagaaagactggggagagtacaaggcagagaagggcgtggaggaggagctgggggcgtacaagaagagctcgaaccagtaccttgataggcagtccttcttgaagagagccgattacagggagtacgagctcgagcgagacgcgcggttgtcgttgatggcgaagcggaagagcgagagtatgcaggacgatgatgtctaggctttgatgaaaattgcgaccatgttggctgcactttgccttttgttggactcggtggagattcttttgaggtaatggtaaagacgttatttcatcgttgccttgtcctcttattatacaatcagctggtcaatgtgaaatctttaag

SEQ ID NO: 31295 - DNA, 550 bp, Triticum aestivum
  unsure (1)..(550): unsure at all n locations
  Clone ID: PAT_TA_31295
aaaaaaaaactagtcatataactatacaagtttgctacaagcaaagcacgactatacctacattatagcagtaagtaagatgcattccgaaagaaaaacataaactataacagaacaatctggcttgcccaacaagtggaaattacatggcaaccaatcggtatgacaagtagaatgatcaagcggttgcttcttcagttgacgacaacttggcgtatcccagtagcccccaactggttctcgctgttctctttgcgctcgtagtagaacgcggtcatggcgcagacggcgaacaactgcacgagtgccatcagagccgcgtacacaaaacccaggagcagcccaagcgccacgctgtcatcatcacccgcgcatgtcgtcgcgagcgtgtgcaccggcgataagatggcggccaggggcgccggtaacgnaacgttacagcacgacctgcctcctcttccccttggccagcctccacgccctgcctaacgcggccgcgcctgggcagccggggctcggccaccgccaacgacgacgctgaaagagcaca

SEQ ID NO: 31296 - DNA, 745 bp, Triticum aestivum
  Clone ID: PAT_TA_31296
gtaccgtacataccaacaacagtcctgggggagttttgtttgcaagtattttgatttgatttttcttaaagcatgggactgggcatcccggtgaccaaccatgttctcgtgagagaggagcggagtccactcctcttgagaataacccacctagcatggaagatacaaacaaccctagttgatacatgagctattcgagcatacaaaacggaatttcatttgaaggtttggagtttggcacatacaaatttacttggaatggcaggtaaataccgcatataggaaggtatggtggactcatatggaataactttggggtttaaggaattggatgcacaagtagtattcccgcttagtacaggtgagggctagcaaaagactgggaagcgaccaactagagagcgacaacagccatgtacatgcattaaaattaataaacattggatgcaagcatgagtaggatataatccaccatgaacataaatatcgtgaaggctatgttgattttgtttcaactacatgcgtgaacatgtgccaagtcaagtcattcaaaagaggataccaccccatcataccacatcataaccatcttaatagcatgttggcacacaaggtaaatcattataactcatagctaatcaagcatggcacaagcaactctgatctctaattgtcattgcaaacatgtttattcataataagctaataaagaacgcgggactcatcatatttacaaaaacaaaag

SEQ ID NO: 31297 - DNA, 488 bp, Triticum aestivum
  Clone ID: PAT_TA_31297
gaaccaagcagtcacacttacaaggaacatagaatcatacataatgtattcgtagatagcgattacatgttagtagattgttccactaactacttagtacttccactagaatcatgaaaccctttattaggaggcgcctagtgaaatccctatgaatgaaaagaaacacaaatgacgtggaatagtaaaatgtgtgatgggctctgattctatcttgttcgaaaaggaaatttaggggtatccggcactgccggatccggatccgctacctccaccattgccgaacccaccattgttgctgccaccgccgccgccacccgttccagcaccggttccggtggcatagccttgaccataggaaccagtgctaccagtctgtccgcctccaatgccagagccagaaccaactcccatgcttggaccttgagctacgcctccactttggccacctccgctgccgttgccacttccactagcattgccctagt

SEQ ID NO: 31298 - DNA, 860 bp, Triticum aestivum
  unsure (1)..(860): unsure at all n locations
  Clone ID: PAT_TA_31298
acggattgctcaccccggtgttgccctgagaacgagatatgtgcagctcctatcgggatgtcggcgcatcgggcggctttgcttggttttgttttaccattgtcgaaatgtcttgtanccaggattccgagactgatcgggtcttcccgggagaaggaatatccttcgttgaccgtgagagcttataatgggttaagttgggacacccctgcagggtattatctttcgaaagccgtgcccacggttatgtggcagatgggaatttgttaatatccggttgtagagaacttgacacttgaccttaactaaaatgcatcaaccgcgtgtgtagccatgatggtctcttgtcggcggagtccgggaagtgaacacagtgttggagttatgcttgaacgtaagtagtctcggatcacttcttgatcatagtttatcgactgtgccttgctttctcttctcgctctcatttgcgtaagttagccaccatatatgctagtcgcttgctgcagctccacctcatacctttaccttacctataagcttaaatagtcttgatcgcgagggtgttagattgttgagtccccgtgactcatagatactgccaaaaccagtttgaaggtgccgatgaaaccgtgcaggtgatgcaaccgagctcaaggaggagctcgatgaagatctcgttcattgtgttatttcgtttcagttgatcagtactggagtccagttgggacgatcggggatctgtgtagcatttggggtagtcttcttttattttggttccatagtaggaccttgtgtgtatctggatgatgtaatgctttattcatgtattgtgtgaagtggcgattgtaagccaactatgt

SEQ ID NO: 31299 - DNA, 723 bp, Triticum aestivum
  Clone ID: PAT_TA_31299
ggaattttgtttgcagttattttgatttgatttgcataaagcatgggactgggcatcctggtgacgagccatttctgagtgaggagcggagtccactcctcttgagaataacccgcctaacatggaagatacgaacagccctagttgatacatgagctatttgggcatacaaaacagaatgtttatttaaaggtttagagtttggcacatacaaatttacttggaacggcaggtagataccgtatataggtaggtatggtggactcatatggaacaactttggggtttatggaattcgatgcacaagtagtattccagcttagtacaagtgaacgctagcaaaagactgggaagcgaccagctagagagcgacaacagttatgaacatgcattaaaattaatcaacaccgaatgcaagcatgagtaggatataatccaccatgaacataaatatcatgaatgctatgttgattttgtttcaactacatgtgtgaacatgcgccaagtcaagtcacttaaatcattcagaggaggataccaccctatcataccacatcacaaccattttcatagcatgttggcacacaaggtaaaccattataagctcctagctaatcaagcatggcacaagaaactatgatctctagttgtcattgcaaacatgtttattcataataggctgaatcaggaacgatgaactaatcatatttacaaaaacaaaag

SEQ ID NO: 31300 - DNA, 368 bp, Triticum aestivum
  Clone ID: PAT_TA_31300
gaactatgagtgggccattttatttgtgctggaaataaaatgtcgtatacatacatgtgaaaccccaataaattgctggatcacctacatatatagccatacaaccatacagaggaagagtacgcgcacggggctcactgcaaccgtagttcttgtggttttatattcacagcaaagtttcagttcctgtataccccaatcttcatgttcttgttcgggctgaaaacacgttattcatgtccagcgaatcgagactggactcgccgatttggcgcctcttcatgccgccacgatggggtaggaggcgcaggtagcaacagcacacatgttctcccacgcgtccgcggacgcgtgggcggacgcgtccg

SEQ ID NO: 31301 - DNA, 321 bp, Triticum aestivum
  Clone ID: PAT_TA_31301
tagcgtggtcgcggccgaggtaccaacaagcatagtgctaggtatggtcagttcagctctgcatgtttccctatgtgcgtgctcatgatgcatcattactatacatccgttttgtatatttcttcaagtcggttgtttaatgtatgaagttatgccttttgccggagtatagaactcgtcttatagaatatcagcagacccgtaagtggagcgactgcattggaacaactgatggaattcattcatgtattttgtgtaatataggaatttcttctttattctgtgtttgtaggctcgtacctgcccgggcggccgctcgaa

SEQ ID NO: 31302 - DNA, 409 bp, Triticum aestivum
  Clone ID: PAT_TA_31302
gttgcttcttcgggttggttcccataacttcgtgtttgtgaggacccgttcgtctacgtccgtttgtcttcttcatggactcgttcttcttccttgcgggatctcaagtgtgcaggtgccaatgataccgtgtaggtgatgcaaccgagctcaaggaggagctcgatgaagatcgtgttccgttatgttatttccatttccaagttgatcaagtagtggagcccaattgggacgatcggggatctgtgtagcatttggggtagtcctcttttatttgggtccgtaatcggaccttgagtgtatttgggatgatgtaatgctttaatcaagtaattgtgtgaagtggcgatgtaaccaactatgtacctttccctaatgtatacatgggttgtttgcgaaaaaaaaaaaa

SEQ ID NO: 31303 - DNA, 382 bp, Triticum aestivum
  Clone ID: PAT_TA_31303
attcccggggtcgacttccaccaaagcgaaatccaccatctcatcgaaagacgggacacctccgcctctaccaagtggtatcagatttccaggttgctcggtgagattttacagtttttcgtagtttagatcgagtctgttcttcatacctatagtccacgaaaaagccaaacaaaaaaattagggttagttcatcccatccgaaccaatctgagccttgcataatcttttctgtatttgctttgttgaatttgcggttgcatcgtcgtgttcagttgctggtcttagcgtctagtcttttggagtttcgagttctgttcacaagttgtcacgccgtcgccgcaccatcatcatctgccctggccatctacgaccagcgctc

SEQ ID NO: 31304 - DNA, 851 bp, Triticum aestivum
  Clone ID: PAT_TA_31304
ccacgcgtccgcactcgaggccctagtgttgcttcgttttggatcgtcaagactgactacacctactgatgcgtcaagtaccttggaacgtctacgccttcctggatttcgccaagttcatcggatgcctagtacgactacaggaccatcaacaccaagtaccccttcaaaacaccaagttccactatgattgccgtgtacatctaccgtcgcccgaagacccgtgtaccacgagcgccaagttcgattaccgcacggttacgccaagttcatctacgaaaaatgtgtacaactacccttgccaagatcgcgagtacctctaccgacgccgtgtacgactacttcccacgacgacccatgaacgtctacttccactaccctcgcgagaacgactacctccactatggcccgtgaacaactacttcccctacgactcatgtaccactacttccctcgatgaactcgatccgccccgaaatgcatgcttcgaagcttcggtttcgttccggagttgtgaggattcgttcgactacgtctgcttgtcttcttcatggactcattcttcttcctatcgggatttcagctgcaggtgccgatgataccagtgcaggcgatgcaaccgagctcagatgggagctcaatgaagatcttgttcattgttttatgtcttttacggttgatcagtagtggagcccagttgggacgaccggggatctagcatttggggttgtcttcctttattttggttccgcagtcggacctttgattgtactttgggatgatgtatgggattatttatgtattgtgtgaagtggcgattgtaagccaactctttatccaaaaaaaaaaaa

SEQ ID NO: 31305 - DNA, 707 bp, Triticum aestivum
  Clone ID: PAT_TA_31305
tccgcccattgcttgcgctgcatgctggtggtcatggttccttaaatggcaaagatcttggtcttcaagttgtgggagttgtgcagaatgtggactggtcgcagacacatctcaaggttgttctgtagatcccacccacactatcagatcagctgaaacaaagcagcccaattttagtcgagagagttaaaagtaggcacataaaccatagcagtagtataagggctcatggagagtaagaagaaaaaccagtgcctattcagtttccaagtggactcgccacgcgttgactgaaaaacagctcatcacatacgggatctttccttgagaggaggaagaggagggcgatgtcttggtccttcctgacaggaagaagaggaggggtctttccctgagaggaggaagaggaggtcgctgtcttggtccttcatgagggctagcggtggtcggtgaaggccccggcggacgcggctgtcggtggccgtgtcaatggggaaggcatgcatcgatggggttagggatctgggttatgctcaccgccgtcggtccctcgcgccccctcccgaagagcttgagcaccacgagcttgtcgagcagggccttcatggcgtcgagatcttcgggagggggcgcgagggtgtcgtagggcaccaccacctcatcggtgggggtctggatcttgctccactcgatctgcggacgcgtgg

SEQ ID NO: 31306 - DNA, 675 bp, Triticum aestivum
  Clone ID: PAT_TA_31306
tcgacccacgcgtccgcccacgcgttcggttgagtacataaacgagatcaaactaaataacgtgtcgtggtgtttcatcaataagcaactcgttgcgtattgagctccacttaatttgtagtgttgtttgttgcactttgccatgccatgtttcattaaaccggacatgcatcatactcgattgtgcatcgtgccatgttgttgtgttggttgtttactatgttgtgtgcttcttttccggtgtttgcttcttcgggttggttccgataacgtcgaggttgtgaggatccattcatctacgtccgtttgtcttcttcatggactcgttcttcttccttgcgggatctcaggcaagatgatcataccctcgaaatcactactatctttgctatgctagtttgctcgctctttcgctatgccattgcttcgatgcctaccacttgcttgtcagccacccaaattgccatgtcaaacctctaacccaccatgtcctaacaaaccgatggttggctatgttaccgctttgctcagcccctcttatagcgttgttagttgcaggtgaagattgaagtttgttccttgatggaacatggagataccgttccttgttggaacatttatttgcttgttgggatatcacaatatatcttacttaattaatgcatctatatactt

SEQ ID NO: 31307 - DNA, 762 bp, Triticum aestivum
  Clone ID: PAT_TA_31307
cagatctggcgcacttccggggctccaagaacaagtaagctgatggattatgatagccttaccacatcaactccagttcgactgttccactagtagttcttcctaagatagagtatgctgaattgctgctggagctgcaactttatttagctcaccgttctgtgttttggtggcagggattggccttgactagagttcctaagatcaagtacctcataatcataggcggcgccaagttccgctcacccgcaatagccgataaggcctacgccaacatgatcaaaatcccctcgcttcacttcctcggtagtacttccatatgttcttcacagacctgttctttacagttgccatggctggttggttgttggctagcgtatcttcccagctgcttccttggcggtgtgtgcggatggctgtctccttatcatatttattttccagccggcatgtatacctcatgtgcagttatgttccagtgtttattatgtgattaggatatgtacttaaagtactcacaccaactgtgtgattcttttgtatcatgcttacaatttttttttccaaaggctttatgcatcctaacgacagtactcatgaaaaaacctccaagagctcgatatattctaatgatggtgcacagcatatttttaggggatactttacagaggaaggatataccataggatcatcatgacatagtttacactctgaacaatctatattgtgtgtgtgtgagatcaagctttaacatattatctg

SEQ ID NO: 31308 - DNA, 421 bp, Triticum aestivum
  Clone ID: PAT_TA_31308
taaggtgcctttaggtcatggttctatactcagtgatgctgttggagttgatggactcgcttatcttccaagccttccgttgttaccgttgtaagatggccttaagccatatttattgcaataagttctcttttgagacattcgatgtaataagtgtgtgattgctattctgttataaatccttcgggtactatgagtgtcagcattattgatctagggatgacacttatgcacagagatcagactggttgaggtctggtcgctacaagatggtatcagagcacacgctgactgtaggacacgaccactaagctaaagccctagatcactactcactcttctcatgtctgacttctcatcttttctactcttttaggatggcggatgcaaggaacaagttcacgcaaccggatgaagatac

SEQ ID NO: 31309 - DNA, 595 bp, Triticum aestivum
  Clone ID: PAT_TA_31309
cctccccgccgccaagtcctgctgcagccgccttgccctgcgtcgcgtctgtccagatccggcgctggctcggcatcgtcaacctcccagccgcgtgcccgcaagctcgccaagacctgtcgctgacattcatcgtcaggactgagcagagtgcagcgcccctgccgcgttgaccgattccagttgagccgctcgccccagcgccccatcgaccgcccgcacgtgcgtggtctggcccatcgctccagttggccacggttggttccggtaacgtcgcgtttgtgaggatccgttcgacttcgtccgtttttcttcttcatggactcgttcttcttccttgcgggatctcattttgcaggtgccaatgagtccgtgcagatgacgcaaccaagctcaagaggagctcgatgaagatcttgtcctttatgttgattcgttctagttgatcagtagtggagcccagttggggtcgatcgggggacctttgtcgcatttggggttcttcttttgtttggttccgtagtcggaccttgattgtatctggatgatgtaatgctttattcatgtaattgtgtgaagtggcgattgtaagcca

SEQ ID NO: 31310 - DNA, 893 bp, Triticum aestivum
  Clone ID: PAT_TA_31310
tcggtggaagattcggccttttgcctggtgttttgttccactcttgccgccctagtttccgtcataccggtgttatgttcccggattttgcgttccttacacggttgggtgatttatgggacccccttgactgtttgctttgaataaaactcctccagcaaggcccaaccttggttttaccatttgcctacctaagcctttttcccttgggttctgcagactcaagggtgatctttattttaccccccgggccagtgctcgtcgtgagtgttggtccaacttgtcaaccgccggtggccaccaggggcaactttgtgctggcctaccggaagtttggacaattcggtgtgccctgagaacgagatatgtgcagctcctatcgggatttgtcggcacagcgggaggctttgctggtcttgttttaccattgtcgaaatgtcttgtaaaccgggattccgagtctgatcgggtcttcctgggagaaggtctattccttcgttgatcgcgagagcttgtcatgggctaagttgggacacccctgcagggtatataatctttcgaaagccgtgcctgcggttataggcagatgggaatttgttaatgtccggttgtagataacttgacaccagatacgaattaaaatgcatcaaccgcgtgtgtagccgtgatggtctcttctcggcggagtccgggaagtgaacacggttttgggttatgtttgacgtaagtagtcttcaggatcacttcttgatcacttctagcttctcgaccgttccgttgcttctcttctcgctcttatttgcgtatgtcagccaccatatatgcttagtcgctgttgcaacctcaccactttaccccttcctacccataagcttaaatagtcttgatctcgt

SEQ ID NO: 31311 - DNA, 439 bp, Triticum aestivum
  Clone ID: PAT_TA_31311
tggggttaatttcttgaaaattggactagactggttatgttggatcagatggcacctttggttgatgaaagctggaggtcaaagtttgagagagttagagatgatggcttctcccgtttaaggggtctgtgggtcctccatgaaattataatgccgattgtcaccaagctccttacagctctctgtgtcccatacgtccttgcaaggggcatcttcccggtgctgggttaccctctcatagtgaactcagcagtgtaccgctttgcctggcttggatgcctgatcttcagcgcactcttcttttgtggcaagagattccatgtctggttcaccaacctccacaactccatcagggatgaccgctatctgattggccggaggctgcacaactttggcgaggactcacactcacccgaaccaagtgaatctggagcaacta

SEQ ID NO: 31312 - DNA, 412 bp, Triticum aestivum
  Clone ID: PAT_TA_31312
tttttttttttttttttttttttttttttttgaacaaggaaacatagatatcataacataatgtattcgtaggtaccgattacatgttagtagattgttccactaactacttagtacttccactagaatcatggagccctttattagggaggcgcctagttgaaaaccctatgaatgaaaagaaacacaaatgacgtggaatagtaaaatatgtgatgggctttgattctatcttgtttgaaaaggaaatttaggggtatccggcactgccggatccggatccgctgcctccaccgtggccgaacccaccattgttgctgctgccaccgccgccacccgttccagcaccggttcctgtggcatagccttgaccataggaaccagtgctaccagtctgtccgcctccagtgcc

SEQ ID NO: 31313 - DNA, 331 bp, Triticum aestivum
  Clone ID: PAT_TA_31313
gagagaggaatctgttgagtacgctaacgaggatcaagctttcgacaactctgagaactttgtaggtgttgaggataccagtgcaagtgatgctaccaaactcaagtgggagttcgacgaggattcgggccgttactatgtttctttttcggatgatcagtagtggagcccagttgggacgatcggggatctagcttttggggtttatcttccttttattcggatttgaacgtagtcggtctttgagtatttggagtgtatttggatgatgtatgaattatttatgtattgtgtgaagtggcgattgtaagccaactctttaaaaaaaaaa

SEQ ID NO: 31314 - DNA, 1062 bp, Triticum aestivum
  Clone ID: PAT_TA_31314
gtcctggcttttgcgaatttaaatgtatccactggcagcacatgcacagaagtaacatagttcacatgttctactacttactactccctccattccgaattacttgtcgcaggtatgggtgtatctagatgtattttagttctaaatacatccatttctgcgacgagtagtttggaacggaggaagtactttcagtgcgccatgttcttttggaggacgcaaacaccttacatacgactcaataaacccactgaaaaacccaagaaacacatccacagtggttggctgatccactacttgacagttgtgagttgtgacctacatgcatcttcccctgagcagcaatgcatattcatggcctgatctctaggcctcttcttcgagcagcatccgatcaaagtgccacacccctgcatgcatacaaaccatgcaagtaaaacatccgatgccgcagcaatatcagttgcttttcacaagtacaaactaaccgtgccctttgccgattctcctaagctgcgtcacgtactcggagatcttcttcaccggcgacaacctgctcctgaagaaattgactctcaacaaagtcactcagctgaggatcgttgcaccttgttgccacctgttaaattttggaaaaacagtttaactatggggtggcgcagtattgcatgtactggttctgataaatcaatcatgaattcatttggtcccagtcgcacacagatcccttttacaataacctccttgcaagcatgaaggagcaacttacagagtgcaggttgtgcagcttctcattcacgagcttttcaagagctagagccaactccattgcatacagagcatcccctttctcagagtggtcgaactctgtcaatggggtcacgatagactggagcctcacccgccctccacgtctgttctggtactccataagcatctccgcgtgttccctctcctcgtcgctcgattccctaaagaacttggcaaagcccttgagagcaacattgtcccggtcgaagtaggcgtagagggagtggtacgcgtacgaggcattgtactccc

SEQ ID NO: 31315 - DNA, 675 bp, Triticum aestivum
  Clone ID: PAT_TA_31315
gatcgtgtccaagctcgcgcgggcagccctcgcatcccgccccgttggagatattgctggtggcatctccccgtgtctctcccggctctatctggcggctggtaccagccgtcgcatgtttgcagctgcaggcggtcccaagtcaaaagaagcaccccgaatatttccccttgttgatgagaattccattaagtcgaaggaatccctatgggccttgtatgaatgctggtgcaagtattggggggtatcccgtgaccgtgaagagatggtccgccggttcaagtcatttgaggctactgcacagtgggtttacaaaatgaacaactctgggtgttcgcaagtgtctcaactgggcccgcatgcagatttttcagagagtgagtttgctgaggtggtgtttcctccacttcctgatgatgatgatgaagacataaaagagatggtatgattgttttcttattgccttgtctttctgctatttttaaatagcagttattggaccaggggttacctactatctacttaaccacaggcattagtaagaaaaatctagttaaccactaggcattaggaggaaaaataatctaatctctttctgacctacccctgtgtaggttgtataccaagttttccttcagttttaggtgttgctgtgcattgcctggttatatcagt

SEQ ID NO: 31316 - DNA, 556 bp, Triticum aestivum
  Clone ID: PAT_TA_31316
gcgaatgttgaagcttttgtacttcgagcaagtgatctcgaacaagttactggacaatttgcacggttcttgcgcaatccaagagtgcagggggctatcaggtatgaatcaccctactggaggaccatcgctgcagcgcgcatccaagtcgcatggaggtatcgtaagagacgactaaagcgagctgaaagatcaaggccaagcgaagaacccgatcgtatactgggtacatgttctcagtatgcttttcagcctggacagagggggtgatagtctgcctaagtatttgtctttttagagatttcaacaagtgattacatacggagcaaaatgagtgaatctacactctaaaatatgtctatatacatccgtatgtggtatctatttgaaatctctaaaaagacaaatatttaggaacggaggaagtattggttaacagttctacatctccaacctctagaaatcctgaaatccgcgggacacaactctttggttctctgatcttgtacttacaaatgtgtgaaactaatctccttgtatagatataaaaaaaaaa

SEQ ID NO: 31317 - DNA, 648 bp, Triticum aestivum
  unsure (1)..(648): unsure at all n locations
  Clone ID: PAT_TA_31317
aacatcccctccgacctaggctatggctttcatcgtgtccaagctcgcgcgggcagccctcgcatcccgccccgttggagatattgctggtggcatctccccatgtctctcccggctctatctggcggcttgtaccagccgtcgcatgtttgcagcttctggcggtcccatgtcaaaagatgcaccccgaatatttccccttgttgatgagaattccattaagtcgaaggaatccctatgggccttgtatgaatgctggtgcaagtattggggggtatcccgtgaccgtgaagagatggtccgccggttcaagtcatttgaggctactgcacagtgggtttacaaaatgaacaactctgagtgttcgcaagtgtctcaactgggcccgcatgcagatatgtcagagagggagtttgctcagctgtttcctccacttcctgaggatgatgatgaagacatagaagtgctggtgcccggtgaagatttgggccaggagcttgaggagcccttaaataattaaactatgaacttgtcttactccatccgttcccaaatataagtctttctagagattcaacaagtgactacatacggagcanaatgagtgaatctgcactctaaaaatgtctacatgcatacgtatgttgt

SEQ ID NO: 31318 - DNA, 800 bp, Triticum aestivum
  Clone ID: PAT_TA_31318
cgccgtttgactctcgttgttccattcgttctgattctttttgccaaccggagttcttaagttgaaccttctgtttagatcctctcatttgagtttaacccgtgcattagatgagtacttattgtatgcttgtttgtttgtctgcgatagaatacccgaagtgcgccgcttgttacttcgaatcgctaggtttcccggatcatcagcaaggcaggtaacactttgatcataccttttctactacccagttttattgcattagatcaaatcctcacacattgcatgattaggattctaattaatttgtgggatgggaagtagttgaggtagtacctattacctgtttactttcaaacctttgggagttacttccgcgtttgcttattatgccatgttatgctagtagacgtggattgggtgagtgtatccatgacagttgtgagattgttaattaatggtttatttaaggtggcaacctaaacacacatctgggtggattgaggcacctagctattccagcgattgtctgttttcttttggaccgccacccaggctcaaggggatcatgagattattcatgctataaacttccgtgtgcagccacaagctactatgggctctagcatagttgactaagtcgtgcgaactcttacagtggtagactagcagatgtaggggatgtaggttggtacggtctacccattcgtaaggcgctagcgcttctgaaagactatgtctcggtcatccgtttctcaaacaccatgtaatgcgagaagtccaatggaggagcccgtcggccc

SEQ ID NO: 31319 - DNA, 838 bp, Triticum aestivum
  Clone ID: PAT_TA_31319
cagtctcttataataagcaaagtgttcctgagggtacacgggaatttcatctagtcactttcatcatgttggtttgatttgtgttcgctactttgataatttgatatgtgggtggaccgtgcttaggtgttgttcttacttgaacaagcctcctacttatgattaaccctcccgcaagcatccgcaactacgagaaaagtattatgaataaattcaaaccatagcattaaactctaggatccaatcggtcccttatggaatagtgcataaactggggtttaagtttctgtcactcacgtaacccaccatctatttactattccacaatgcattcccttacgcccaaatatggtgaagtgtcatgtaatcgatgttcacatgacaccactaagggaatcacaacatacatactatcaaaatatcgaacacatttcaagttcacatgattacttgcaacatgatttcccccgtgacctcaagaacaaaaataactactcacaagtgataaacatgatcaagatcaaaggggtattaaatagcataatggatctgaacatataatcttccaccaaataaaccatatagtaatcaattacaagatgtaatcaacactactagtcacccacaagcaccaatctatagttccagtaacaagattgaacacaagatattaactagggtttgagaggagatggtgttgttgaagatgttgatggagattgccctccccaagatgggagagttgtcggtgatgatgatgacgatgatttccccctctgggagggaagttcccttggcggaatcgctccgccagagggcaaaagtgctcctgcccaag

SEQ ID NO: 31320 - DNA, 506 bp, Triticum aestivum
  Clone ID: PAT_TA_31320
cttgggcataatgaatctgcactctttaggcgagctcaactgaaagctcttgtttctatacacagcaaagaggctggtaagggtggggagcttacccacgatgagactacaatcataagtggagctttggacttgactgaaaagactgctcaagaagctatgacacctatcgaatcaactttctcactagacgtggactccaaattggattgggaagcaattggtaaaattcttgcccggggccacagccgtgtgcctgtgtacagcggcaagttgctccgtcttgaattcatgaagtcagttcaaagtgggatgttaaatgataataatattgccagatgtatgcatgtccaggcttggctgcaaataacatttttctcccagatttgtgaaaagtcactataatgtgaagtttgatattgacgaagtatgatatcgacatccatgtgacgttaagaaattcaaaagaatttgaaagagcttgtacctcggccgcgaccacgcta

SEQ ID NO: 31321 - DNA, 468 bp, Triticum aestivum
  Clone ID: PAT_TA_31321
attccagggtcgacgttcacaggacaccactaagagaatggcaacatacatatcatcaaaatatcgaacacatatcaagttcacatgattacttgcaacatgatttctctcgtgacctcaagaatgaaagtaactactcacaaatgataaacatgctcaagatcagaggggtattaaatagcataatggatctgaacatataatcctccaccaaataaaccatatagtaatcaactacaagatgtaatcaacactactagtcacccacgggcaccaatctatagttttgatacaaagattgaacgcaagcgatgaactagggtttgagagaagttggtgttgtgaagatgttgatgaatataaccctccccaagatgggagagttgttggtgatgatgatgacgatgatttccccctccgagagtgaagttccctgggcggaatcgctctgccggagggcaaaagtgc

SEQ ID NO: 31322 - DNA, 752 bp, Triticum aestivum
  unsure (1)..(752): unsure at all n locations
  Clone ID: PAT_TA_31322
agttttccaccggccatatatgcatatagtatagttgtttcattccattactctctatgtgttacattgccagcatattccatgtgctgacccgttttcgggctgcaactttcatgttgcagacttttcagacgacgagtaaggtgcttttaggtcgtggttctatactcagtgatgccgttggagttgatggacccatttatcttccgagtcttccgctgttatcgttattagatggccttaagccatatttattgtaataagttctctttgagacaacgatgtaataagtgtgtgattgccactctgctataaatccttcgatgtactgtgtggtgtcagcattactgatccagggatgacacctgagcacagagatcagactgtttgaggtctggtcactatagacaaacacgtatcatcatggaagtgtatttttttgtagtgattgctaaggtgcggcatcctcgcatcttcgtagtcanatcgtcaaagtctactcctccaatatgatgatcaccttctcatcgaaagacgggacacctttgtctctatcaagtggtatcagatttctaggttgctcactgagattttcaagtttctcatagtttatattcagtctgttcttcatacctacagtccacgaaaaagaacaaaatagggttagttcatcctatccgaaccaatctgagcctttgcacggtcttttagagttttgctttgttgaatttgtggttgcatcgccgcctgca

SEQ ID NO: 31323 - DNA, 427 bp, Triticum aestivum
  Clone ID: PAT_TA_31323
cgccattaccagccatattctcgtgaatgaggagcggagtccactcccttgggaataacccacctagcatggaagatacaaatagacctagttgaaacatgagctgctcgagtatacaaaacagcatttcatttgaaggtttggagtttggcacatacaaatttaattgggacggaaggtaaataccgcatataggaaggtatggtggactcatatggaacaactttgaggtttatggagtttggatgcacaagcagtattcctgcttagtataggtgaaggctagcaaaagactgggaagcgaccaactgagagagcgacaatgctacgtcttgagcttgtgttggttttccccgaagaggagaggatgatgtagcacagtagcgttagtatttcgctcagtttttgagaaccaaggtatcaatcc

SEQ ID NO: 31324 - DNA, 726 bp, Triticum aestivum
  Clone ID: PAT_TA_31324
atgtggattgtacaaatgtcccatacacctgcaattagacaaaacacaaaagtgtgtgaagtatttttgttctggataacataaatagattattgaatagtttgcactagaaatcacctgacaaatatgcatatatgcaatatttttggtcatatccaaggtagtcatgtcctcatcagaatagaccttcgtggtcaggctgaccgtgcttccggcatcgtcagtaacctcaggagattggtttagcgattgctaaggcgcaacgtcgtgcacgtttgtagtcggatcatcaaagtcgtctccaccaaatcgatagttatcatctcatcgaaagatcgggacaccctcgcctctatcaagtggtatcagatttccaggttgctcggtgagattttacagtttttcgtactttagatcgagtctgttcttcatacctacagtccacgaaaaagccgcaaaaaaaaattagggttagttcatcatatccgaaccaatctgagcctttgcataatctttttagggtttttgctttgttgaatttgcggttgcatcgtcgtgtcaagttgctggtcttagagtctagtcttttagagtttcgagttctggtcataagttgtcacgccgccgccgcaccatcagcatcgccttgccatctaccaccattgcttatccgtcaccgccttgaatccgtaaccatataccaacaacgctgtcatatagcaccac

SEQ ID NO: 31325 - DNA, 423 bp, Triticum aestivum
  Clone ID: PAT_TA_31325
ttccaccaaagcgaaatccaccatctcatcgaaagacgggacacctccgcctctatcaagcggtatcagatttccaggttgctcggtgagattttacagtttttcgtagtttagatcgagtctgttcttcatatctacagtccacgaaaaagccacaaaaaaaatttagggttagttcatcatatccgaaccaatctgagcctttgcataatctttttagggtttttgctttgttgaatttgcggttgcatcgtcggtctagttgctggtcttaaagtctagtcttttagagtttcgagttctggtcataagttgtcacgccgccgccacaccatcatcatcgcccctgccatctaccaccaccgctcatccgccaccgctccgaattcgtatccatataccaccaccaatccgtgtccatat

SEQ ID NO: 31326 - DNA, 426 bp, Triticum aestivum
  Clone ID: PAT_TA_31326
ttcctccaaaatgatagccaccatctcatcgaaagacaggacacctttgcctctatcaagtggtatcagttttcagattgcttggtgagattttccagtttttcatagctaagatcgagtctgttcttcatacctacagtccacgaaaaaagccaaaaaattagggttagttcatcatatccaaaccaatctgagcctttgcatagtctttttagagttttgctttgttgaatttgcggttgcatcatcatgtcgagttgctggtcttagcgtctagtcccttagagtttcgagttctgttcataggttgtcatgccgctgccgcaccatcgtcatcatcattgccatataccaccaccccagcctatacatcgccactgccatatacgaccaccaatccgagtccgcatataccatcgccatata

SEQ ID NO: 31327 - DNA, 747 bp, Triticum aestivum
  unsure (1)..(747): unsure at all n locations
  Clone ID: PAT_TA_31327
tcccggggccacgttcacctgacgacactaaaagaagcaacaacatacccccttcgttcctaaatatttgtctttctagagatttcaacaagtgactacatacggagcaaaatgagtgaatctacactctaaaatatgtctatatacatctgtatgtgatagtccatctgaaatctctaaaaagacaaatatttaggaacgaagggagtatatatcatcaaaagatcgaacgaataccaacttcatgattacttataacaagacttctcccatgtcctcaagaacaaaagtaactactcacaaatcatattcatgttcaagatcagaggggtattgaatatcattaaggatcttaacatataatcttccaccaaataaaccaactagtatcaactacaagatgtaattaacactactagcaaccaataggtaacaatctgaggttttgggacaaagattgaatacaagagatgagctagggtttgagatgagatggtcctggtgaaaatgttgatgaagatgggtccttgcgatgataggatcgttgctgatgacgatggcttcgatttccccctgcggaaggaagtttccccggcggaatggctccgccggagagcaaaagtgctcctgcccaggtttcgcctcgagacagtggngcttcgtcccaaaaccttccttctaatttttttctaggtcaaatgacaccttatagcataagatgagcttcggagggctgccaaggggccc

SEQ ID NO: 31328 - DNA, 780 bp, Triticum aestivum
  Clone ID: PAT_TA_31328
aaatataactctattaccttcactacagctgccaactactccctccgttcctaaaatataagactttagagatttcaatatggactacatacggagcaaaatgagtgaatctacactctaaaatgcgtctatatacattcatatgtagtccgtattgaaatctctaaaagggcttatatttagaaacggagggagtatgttgttgcgcctttgacctgtaaaatgctcctctgcagtttgtagaagattactgctcttgatatccttgtaacattttctcacacttgcctacaatctgcagggactagtgctgctgatcattttgatatcaggactatgctgtatgatgggaatcgataccccctcgaggtttgaggctccccaggattaggtaggagagtacaaaatcccatagaagcctgccagatatgaaagctcaaggcaggcgtgagaaatacaaatagccaatttgcactctggatataagttgcctcatacttcctccgtcccaaaataagtgtctcaacttcgtattaacttgtgttgagacacttattttgggacggagggagtatatgttaccaagacacgtgaccgattttttgtataatattattacatctcggacctatgaccgaccagaaagatgtagctgagctcaaaacatattcttatgccaggcttgtgttatacccccccccccgcttcaggcattctctgtgaataacctggaattcaggtagtcagtaaaatggcattgtccatgaataaaatcggacg

SEQ ID NO: 31329 - DNA, 334 bp, Triticum aestivum
  Clone ID: PAT_TA_31329
tagcgtggtcgcggccgaggtactccattaacttctcggcgtgtcccctctcctcgtcgcttgattccttgaagaacttggcaaatcccttgagagcaacgttgtcgcggtcgaagtaggcgaagagggagtgatacgcgtcatgactgtatttcccatgctgcccaaagtgaaatgtcacttcttttctgcgctctctgcagcattggtcccataattcttgatgtcagatactaacgtcagctcatctcaccatctgagatggatttataccattgttgtagacaaacttgtcactgaaattcagcagtacctgcccgggcggccgctcgaa

SEQ ID NO: 31330 - DNA, 612 bp, Triticum aestivum
  unsure (1)..(612): unsure at all n locations
  Clone ID: PAT_TA_31330
ttcgagcggccgcccgggcaggtactagtggaataaaattagcaaacttgtagaacaaagaaactatgacattcaaagtaaaaggacgccaagtgaagcccacatatgcatgatactatttcccctccccactacatgagaaaatgggacgaaaagttgcctattacaaaacaaagctaatagcatacatacacatagatacattcttctgttttacaacaaagaaagaaacaattacatatattgatcactactactttttgaaataaactggtcaatatgtgacaccttctgcataatcttggattgcatgccatcgacagagaagagaagagcacatctccatgtctcaactgaaaagagcagtccaaaccatagccaaaatccaaaaacaaccccggcagtcacacagtagtacagccactggtcctccccttcaacggttttctcatccaaagcaggcaagtatttggacaatcngctagaggaaatccgcaaagggcggaattttccggtaaacgaaaggtcaatcaacgtcgcatctggtccanaaggtacntgcctgacaaatgatgttggagaagtgatatgctgagctcacagacantctct

SEQ ID NO: 31331 - DNA, 754 bp, Triticum aestivum
  unsure (1)..(754): unsure at all n locations
  Clone ID: PAT_TA_31331
cgggccgaccgggtgcagcacacaagctattatgggctctagcatagttgagtaggttacatgatctcttgaagaggtgggctagcagatgtaggggaaagtaggtgtaccggtccatccagagtaaagagtgattgttcctgaaagactgtgtctcggtcatccgtttctcaaacatcatgcagtgcgagaatcaagcggaggcgatcgagtcttgtggggagaaatgcgcaaacctctacagagtgtacaaactaatcatggttagccgtgtccccggttatggacaacttgagtatctagtacctggattatcatttgaatctcatcatgtgactttaattaattttgttgggttttaatgatgatgcttaattgggattgagagggtgtctacgctctcaatgtttaacaaccaccatgatagttaaataaaatatattcctttgcagtagggaaaaattagcttttcgcaaaaaccttataaccatagagcttttccactagccaaatatgcatgtagtgatagccattgttcatcattctctatggtgtgaatttgctagtacattcaatgtactgaccctttatggatgcaacgtctcatgttgcaggattatcttacgacgagtgagtgatacttagggttacgatttcatactcaactttgttgttggtgttgatgggaatcacaaccttgtacttcgctattggattgaggtaataatatttacgttacttanacatgtgattc

SEQ ID NO: 31332 - DNA, 772 bp, Triticum aestivum
  unsure (1)..(772): unsure at all n locations
  Clone ID: PAT_TA_31332
ttcgctaacgaggagcccgttgagtttgcttttcaggatccagtcaactctgacgactgtgcaggcaagatgatcataccctcgaaatcagtactatctttgctatgctagtttgctcgctcttttgctatgccattgctatgatgcctaccaattgcttgcaagcctcccaaattgccatgtcaaacctctaacccacctttatcctagcaaaccgttgattggctatgttaccgctttgctcatcccctcttatagcgttgctagttgcaggtgaagattggaggtcgttccttattggaacatcttttatttacttgttgggatatcattatattgccatgttatcttaatgcacctatatacttggtaaagggtggaaggctcggcctctcgcctagtgttttgttccactcttgccgccctagtttccgtcatatcggtattatgttcccggattttgcgtccctaacgcggtttggtatatgggaaccccttgacaattcgcgttgaaagaaactcctccagcaaggcccaacctttgttctacatttgcctaacaacccattacttttcccatgggagtaattaacccgagggtcatctttattttaaccccccccccccgcgcgccagtgctactctaagtgttggtccgaactagagccccttgcagtgccacctcggggaaactcgaggcctggttttagttgtacggactgctcatctggtcgtgtcctgagacgatatacgtgtggcttgtctcnagggt

SEQ ID NO: 31333 - DNA, 621 bp, Triticum aestivum
  Clone ID: PAT_TA_31333
tatcacatcgaaacatcgggacacctttgcctctatcaattggtatcagattttcaggttgctcggtgagattttacagtttttcgtcgtttagatcgagtctattctttgtacctatagtccactaaaaagccaagaaaaattagggtttgttcatcctatccgaactgatctgaacctttgcataatcttttctgtatttgctttgttgaatttgcggttgcatcgtcgtgtcaagttgctggtcttagtgtctagtcctttagagttttgagttcagttcacaggttgtcatgtcgccgctgccatatatcaccaccgcatcatcatcatcgctgctgccatataccacgaccgcaccaacttcatcgctgctgcgatataccaccaccacatattcaccgccaatcccaatccatatacgccaccacatatccgccgccatcacaccaatccgagttcacctgcaacatatatccgccacctgtccgcgttccatcagattcatctcccccaccagtcctactccaagtccagtattttgttactctattttggatttccagatcactccatactccgagtcctgacagagaacgactccaaaacttctgtgttacc

SEQ ID NO: 31334 - DNA, 709 bp, Triticum aestivum
  unsure (1)..(709): unsure at all n locations
  Clone ID: PAT_TA_31334
gtaatccatcaagtcggacaagttgaggccatcaacaggatcacgcacgggaatgtcgtcccagttaaggaactcggactcagactctgattctgcgcggttacccaaaagtttgatcgataggaagcctagctaaatcggcgcaaaagattattactccctccgtttctaaatacaagtcctttagatattccaatacggactacatacggagcaaaatgagtgaatctacactctaaaatatgtctatatccatcatatgtagttcttatcgaaacctctaaaaagacttgtagtatttaggaacagaggaagtagaaaacatagagaagctaggcggtaatactcaccgctctcgaggaaccctctctctttcttctacgccaacaccaccgccgcctcctcctcctcctcctcctcttcctcctcctcgaacgcatcaaggagacgatggtgggtagagccgaatagatctggggcgatttcgaatctaaacacatcgatgggggcctcctcgcgagtctcatggagatgccggggaaagggaccaaaaagatctgtggggatttcggagatgggcagatggccgggatagcagtcgccgggaagggcgtgtcgagaactcgggctctccttcgccgacaacatcgcgatgctagggtttcgtcggctgcggcgttggcggagacgcgtaaaaagcctncgtgcc

SEQ ID NO: 31335 - DNA, 653 bp, Triticum aestivum
  Clone ID: PAT_TA_31335
gaatccagtgttgtcctagtatatcctggagtacccgtgtgataatcctatggtccgccgcccaggctcaaagggaactgagatattttcatgctagaaacttccatgtgcagccacaagctattatgggctctagcatagttgagtaagttgtgtgaagctcccgaagaggtggatcagcaggtagagggatgtaggttggtatggtctgcccggagtaaggggttaatgcttctgaaagactgtgtctcgatcatccgtttctcaaacaccatgtagtgtgagaaatccaacggaggagatcgagtcttgtggggaaaagtgctcaaacctctacagagtgtacaaactaatcatggttagtcgtgtccccggttatggacatcttgagtatctggttcttgaattattattctgatctcaacactctaaattagtttgttgggttattaatactgcttaattgggattgagtcggaggaaccttctcattgtttatcaactaacataatagttaaacaaaatatattcctttattgtaggaaaaaaaatggcttttcgcaaaaccatattaaccgtagagcctccaccacccaaatatgcatatagttgtaactattacttgttcttttgctctaagtgttatatttcca

SEQ ID NO: 31336 - DNA, 785 bp, Triticum aestivum
  unsure (1)..(785): unsure at all n locations
  Clone ID: PAT_TA_31336
tttttttctttcagaatatatgtatatcatcaatattcgagaactcgagaatgcaaggtagcattccagtacaaaagttggtagagtaggttttctgaatgtgtacaaacacaccagttaattgattctataccagagagatcacgactggaaaaaaaatccaacgaagaagagaacagagcgaacactttgtagcatcatagtgactgagaaatattacagatggtacattgatacctttacagtcacaacctatgatcttcatccagttttcggtcacgaaatttcctatatatattaaaaaaaaggaagaaacgctcaatagcatcatagttgcaggcgctggacaaaatcatgaccgatgaatgttacgaatggctgcatttatacttttacagtcaaaatccatgatcttcatccagttttcaaagtctccaatttccttgaggaccgagttgaccgcgttggtggcggcgagccactggtcgctctgcttcctgtaccgcgcgatggtcccgagcagcgcgcgggcctcgagctcgatgcgcttctcgttgacgaagagctcctgcaccccgccgtcgacggcctccacgagatgaccggcgacacgcgccgcgctccgcagggcgtccttcttcgccctctctgcggcgcgttgggtgtgagataatttagcaagagaagattggatttgcttggcggattaggaattttgagtagatcgttggttgatcgttaccggtttgttggcgctggcggagggnattggtggtggtgttgcc

SEQ ID NO: 31337 - DNA, 1063 bp, Triticum aestivum
  Clone ID: PAT_TA_31337
cgatccaataaagtcatactcaatgtaaactaacagtaaaggatgcaaatgatagtggtgctctccaactggtgcttttcaataagaggatgatgactcaacataaaagtaaatagataggcccttcgcagagggaagaagggatttgtagaggtgccacagctcggttttgaaatagatatgaataatattttgagccgtatactttcattgtcaacataacaaccaagagatggcgatatcttccgtgctacagacattatatgcggttccgaaacagaatggtaaagtttatactccccctccaggaacaagcatcaatccatggcttgctcgaaacaacgagtgcctccaacattcaacgggtcctagggggagttttgcttgccattattttgatttagtttgcataaatcatgggactgggcatcccggatactagccattttctcgtgaatgaggagcggagtccactcctcttgagaataaccagcctaacacggaagataagggcaactctagttgacatatgagctattcgagcatgcaaaacagaatgtttatttgaaggtttagagtttggcacatacaaatttacttggaacggcatgtcaataccgcatataggaaggtatagtggactcatatggaacaactttgtggtttatggagtttggatgcacaagcagtattcccgcttagtataggggaaggctagcaaaagactggcaagcgaccaactgagagagcgacaacagtcgtaaacatgcattaaaattaattcacaccgagtacaagcatgagtaggatataatccaccatgaacataaatatcatgaaggttatgttgatttcattcaactacatgtgtgaaacatgtgccaagtcgagtcactcaattcatttaaaggaggataccatcccatcataccacatcataatcattctaataacatgttggcatgcaaggtaaaccattataactcatagctaatcaagcatggcacaagaaactataatctctaaatgtcattgcaaatatgtttacttcataatagctgac

SEQ ID NO: 31338 - DNA, 511 bp, Triticum aestivum
  Clone ID: PAT_TA_31338
gatgtgctgtgagggtcagagtcagatgcttgacttgcatccagcttcttacttttcgcaacagccaaagcatgcttagcaatgtcaccataccaaagtgtacttattataaagctgaagatgtagaggggataaaaccaaaatacatagaaaatctcgacaagccccgaacgtaagaacgaatacaaggcaacagctgttgtgtgatcacatagatgttgtccccatgattgatcgcattgctcgggcagtatccatagaagagttggaatgaccaccgatttcaaggttagcaagctccccaggaagatgaacccgttgagcaggaagcactgagcgattctgatcgacagagccctggagctgacgcagaaggagacgacgcggtggagacgcgcggcctggaggaagccggcgagccagagcacggcagccggcttcgcttgcgaggcaagcgactccatcagagaacgggcctagcaggagagcctcctttggtgaagatgttcat

SEQ ID NO: 31339 - DNA, 528 bp, Triticum aestivum
  Clone ID: PAT_TA_31339
tgcacctgcatactgcatgctctgctctgcatggacagcctcgccgcccggctcccgtgcgccttgccgccggcagccgtgatccttgcgcccgccgtctgatcgcccgggtgtttggagctgtttctgcggcagcgcctgccggtcaccgccagcaagggcgatgcctcctcacgcgccttccttcgagaagagctgctccggcgaccggcaaaggcaggagtcaggagggcagctgctgcgaggcccggggcagcggtcggcgtcgttccacgggcgcggggcggagcagcggcaccagctgccaaagcagaggcccaagacgcagccggacctgctcgccggcgttaggggcaggagcttccgcgccgccgacggcggcgagccgctggcggagctggcggtccggaggacgccgagcaaggtgctggtgaacgtgaccgtgcagaggagcctgtggccgctgaacgtcatggcgtcggcggagtggagcgtggcggacctcgtggccgccgccgtggggatcta

SEQ ID NO: 31340 - DNA, 395 bp, Triticum aestivum
  Clone ID: PAT_TA_31340
cgtggtcgcggccgaggtgttgtgcttctttccggtgttgcttcttcgggttgtttccgacaacgtcgtgtttgtgaggacccgttcgtctacgtccgtttgtcttcttcatggactcattcttcttccttgcgggatttcagcttgcaggtgccgatgagtccgtgcagatgacacaaccaagctcaggaggagcttgatgaagatcttgtcctttgtgttgcttcgttctagttgatcagtagtggagcccagttggggtcgatcggggacctttgtcgcatttggggttcttctttattttggttccgtagtcggaccttgattgtatttggatgttgtaatgctttattcatgtaatggtgtgaagtggcgattgtaagccaaaaaaaaaa

SEQ ID NO: 31341 - DNA, 703 bp, Triticum aestivum
  Clone ID: PAT_TA_31341
ctcttatatactcagggtaaatacatctgtgtcgatggtgatggatccgttcccgcagaatcagcaaaggcggacggccttgatgcagtggcgagaattggggttgctgctgaccaccgaggcatcgtctgcgaccaccgcgtgttccgcatagtccagcactggctgcacgcgggtgaacctgacccgttctacgacccgctcaacgactatgtcgtcatcccaaccatcttcgaggtcgagaagcaccacgagaaacgcggggacgtcacgtcggtcagggaggactgggagatcatctcccacaccgatggcgacgaggccaaaaggctggctgagctccctgctatggttggcgcgatgtctgcgtcttgcgagggtaaggatggccttatggacgaggcgcaggccaccgtggtggtccacccggagagcggagggcggcagcatgtggaagtcagggctgtcggagtcagccacggtggctagctatgggcctactcgccgtataactttagctagggcgattgcacatactgtaaaccgttgatgcacataagatgtggccaagtagggaatatgtctctgtaaatacggtatactgctgcttgtaaatatctgaacttggaagcacaaggtgcactggctatgagcaccaaggaggaaggaaataatcagaatggattaccagctaaaaaaaaaa

SEQ ID NO: 31342 - DNA, 407 bp, Triticum aestivum
  Clone ID: PAT_TA_31342
tcccacataaaacgattgctatctcatcgaaacatcaggacaccttcgcctctatcaagtggtatcagatttccaggttgctcggtgagattttatagtttttcatagtttagatcgagtttgttcttcatacctatagtccacgaaaaaagccaaaaaaattagggttagttcatcctatccgaaccaatctgagcctttgcataatcttttgtgtatttgccttgttcaatttgcggttgcatcgtcgtgtccagttgctggtcttagcgtctagtcctttagagtttcgagttctgttcacaggttgtcacgtcgccgctgccatatatcaccactgcatcatcatcatcgctgctgccatataccaccaccacaccaacttcatcgtcgctgccatataacac

SEQ ID NO: 31343 - DNA, 1237 bp, Triticum aestivum
  Clone ID: PAT_TA_31343
cgttccaaatttaagtttttttagagattacaacaagtgactacatacgaagcaaaatgagtgaatttacacattaaagtatgtctacatatatttgtatgttgtagtccatttgagatgtctaaaaacacttatatttagaaacggtcataagatttgaattctaatgatttttgttatgtagtttttttaatttggaagatattttgcttttttgcgctattaatcttgagcccaccaagcttggcttcagagggagcgaaatgggcggtgctcttcctgggggccgagcaccggcgagcttccatgctctagtcttcttcgctgccggcagcgcttatggacgcgccggcttcatggtcgtggcagcgaggcgcgggcgtggcggagttgggaatatcgtcctcatcctcgctcttgtcatagacttcgttggccacctcgtggatctccttgaaggccgcatctatctccgcctgacgctggcggtgccgtcggcggttgcggcggatttcacaggcggtgcaatatgagtcgaccatcacctcctactccacctcgtcgtgcagagtctgcttctgcttcccttatctttcctttggtgtgaaactgctggcatgcaatgccggtcacaatctgaatccgctgctaccgatgcgggtcgggctcactgcggtagaaggtgcagcccctgctgaacttgaatggcagccccttccactctgctcccattgcacatatgacaatcatacccaaggtgccaggtgtcgtggtcgtagatgtcgtcgatgacaaagtggagatgagggctgacacgcccatgaagtcgccgaagaaggccatcacttggtcctcccccaccatagggccgccggaagccaggaacaccaggtcttcacacacgcatacttccgcattagcttcgccattgctgcaggatggacagaagctgctcatctccatcgcctcccgtcgacgccgtgtcgcaacgccaccgtatccatgtagacactcagccggagctcgccatctcgctcggaaccggcgacgaacaccgacgccatgaacttggagttcaagccccgctgctagacctcctcccgcgtctcctggatcacctccacgccgtccccgaaacaggatccggccactgcctcgcctcctcgaccgaatctggccggagatcgccgtcgtcgcgcccggcggcgcgcagcagcgggcaaggggtggcggcctc

SEQ ID NO: 31344 - DNA, 437 bp, Triticum aestivum
  Clone ID: PAT_TA_31344
agcgtccgggagcacgccagcgtgacgcatgggaggtcgatgtggaggcggcggatcggacgagcccgacgagaggtccgcccgggaactggagctgcagcgccgccggcttttcctcccaatttcttcgagcagagctggagcgatgccgtcgccggcgtcgtcgagctgtcgagttgcaggtgccgacgatgccagtgcagatgacggcgtcgatctcaagtgggagttcgacgaggaacgtggtcgttactatgtgtcttttcctgatgatcagtaatggagcccagttgggacgatcggggatatagcatttggggttgtcttattttcatctggattttgatcgtagtcggtctatatgattgtattttggatgatgtatgatgatatttatgtattgtgtgaagtggcgattgtaagccaactctttaaaa

SEQ ID NO: 31345 - DNA, 577 bp, Triticum aestivum
  Clone ID: PAT_TA_31345
ttggcaagtgggtggagaaattgttaaagcagagcaagctgcgagccatccaggaggtggatggcaccaccgtcgccgtcgccgccgccgccgcgagtgtgcgtgaccggcggcggcgggttcatcgcctcgtggctcgtcaagctgctcctctcccggggctacgccgtccacgccacgctccgcgacccgagtgatccgaagaacgcgcatctgatgcagctggacggcgcggcggagagcctgagcttgttcaaggccgacgtgctcgaccgcgccgcgctggccgccgccgtcgcgggtttgccagggcgtcttccatgtcgcctcccctgtgcccgcggagaagatcgtcgatcctgagtcagaagtcatggtgcctgccgtgaagggcaccttaaatattcttgaagtttgttcatctctgaaggttcagaaagttgtggtggtgtcatccactgctgccgttcattatgatcccaactggcctcagggtaaaccccaagacgagagttgctggtcggacagaaaagtatgccaggattatgagatctggtatagtcttgctaaaactgtt

SEQ ID NO: 31346 - DNA, 485 bp, Triticum aestivum
  Clone ID: PAT_TA_31346
ttttttttttttttttttttttttttttttcaggaacatacataactactcacaaagcatattcatgttcataatcaaaggagtaataatatgcataaaggatctaaacatatgatcttccaccaaataaaccaattagcgtcaactataaggagtaatcaacactactagcaacccacaggtaccaatttgtggttttgatacaagattggatacaagagatgaactagggttttgagaggagatggtgctggtgaagatgttgatggagattgaccccctcccaatgagaggatcgttggtgatgacgatggtgatgatttccccctcccggagggaagttttcccggcagaacagctccgcaggagccctagattggttctgccaaggttccgcctcgtgaaggcggagtctcgtcccgtaagcttgcttatgattttttccagggtaaaagccttcatatagcagaagcctcgtgccgaat

SEQ ID NO: 31347 - DNA, 715 bp, Triticum aestivum
  Clone ID: PAT_TA_31347
gtgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatatccattttgtttgatgtttggtggctgatgattaggaaagttaaatactccctccgttcctaaatatttgtccttttagagatttcaataagtgactacgtacgaagcaaaatgagtgaatctacactctaaaatatgtctatatacatccgtacatgttgtccatttgaaatctccaaaagacaaatatttaggaacggagagagtatatatatacactgagctgaaagctaaatatatataactgtgactttttagtagatatacagatttactggatttagttttgacttgtatatgccatgataattcaaatcgttagtattagatgatatacctgttgaatatggctcaaaagggtaaatattcttgattgtataatcaaatccaaacaaaatccatcaaaatcagacatttacagcaagtaggctaggaccaatatactatgcaccaaatagttcctattgagatgcaattacatcaatc

SEQ ID NO: 31348 - DNA, 492 bp, Triticum aestivum
  Clone ID: PAT_TA_31348
ttccaccaaagcgatatccatcatctcatcgaaagacgggacacctttgcctctatcaagtggtatcagatttctaggttgctcggtgagattttacagtttttcgtagtttagatcgagtctgttcttcatacctatagtccacgaaaaagccaaaaaaaatagggttagttcatcccatccgaaccaatctgagccttgcaattttcttttcattgcttgcatagttgaattatcggttgcatcatcgtgtcgagttgctggtcttagtgtctagttcgtttagagtttcgagtttttttcacattagtcacgccaccgctgcatcattatctcttccgctgtctaccacccatccatcaatttccaccacgtgctacccaccattcattgtcataataatagttgagatcgttcacatcttcacttgctccaatctgcatcttatctagtttgttttgtgaaaagtgtaaaactatggaacaacgaaat

SEQ ID NO: 31349 - DNA, 597 bp, Triticum aestivum
  Clone ID: PAT_TA_31349
ttttttttttttgacaaacaaaccagaaatatattactagaagttcagttcgtgtaacatacatataataaatcatccatcaaatggtacatacacaatctactttttttgtggaacatacacaatctaccagacaactgtgtagcggctaccattacctagcataagctccaggtttcacataaagacgagagagaatgaaactaccaaggaacataaagatcccctttgagactcaggacgtggttcaccagctagagatggtcagtagacggtagcagcagcacggtttgtgcctatattacaaccgaagccacgacgagtatttcagttatacccatcaaatctgaatggtgtgcgcagcggagggttgacagctgggcgccaagaagcaagcagccacagtcctttggattatggaattcacattcgctgattaggttccacctaggatttatgtgccgaacacaaagccataacctaaacaagcttcttccatattcaggaatgtcaccaccatgcagaagatacaaccagctttctgttcttccatccgagataaatgacaccatctttctcctctagcttgtagtaact

SEQ ID NO: 31350 - DNA, 805 bp, Triticum aestivum
  Clone ID: PAT_TA_31350
gtcacgggtcctcctacctcctaggccgccaccccttgctcctatataagtagatccatctagtagcttttcccttcggatttgtttagttaaaagttagccattgcaacttcgtgtacttcgtttgtgtccaacgaccagaccaagaccgcttacggatccccacctttatcaatacttcatacatattcacaatattcagattgcttttatcatattcttgcttgttctttgattgcttgcaggaatagaccttcgtggtcaggttgatcgtgctccggcgtggtcaataacctcaagagattggtttagcgattgctaaggcgcgacgtcctcgcacgttcatagtcggatcgtgaaagtcgtctccaccaaatcgatagttatcatctcatcgaaagatcgggacaccctcgcctctatcaagaggtatcagttttcaggttgctcggtgagaatttccagtttcccctagattagatttattttcttacctattgtccaagaaaaagccacaaaaaagttagatctattcatccttttgtccaagccagtctgagcctttgcaattttctattcattgcttgcatgattgaattatcggttgcatcgtcgtgtcgagttgctggtcttagggtctagttcgtttagagtttcgagttctgttcacattagtcacgtcgccgctgcatcgttatcccttctgctgtccaccacaccatccatcaaattccaccatgtgctacccatagttcattggcacaatcatagttgaggtcgttcacatcttcgcttgatccaatct

SEQ ID NO: 31351 - DNA, 1121 bp, Triticum aestivum
  Clone ID: PAT_TA_31351
ttctcaaaacaatcataatatgatataacaagatggtatctcgctagccctttctgagaccgcaaaacgtaaatgcagagcacctttaaagaccaaggactgactagacattgtaattcatggtaaaagagatccagtcaagtcatactcaatgtaaactaacagtaatgaatgcaaatgacagcggtgctctccaactggtgctttttaataagatgatgatgactcaacataaaagtaaatagataggcccttcgcagagggaagcagggatttgtagaggtgccagagctcggttttgaaacagaggtgaataatattttgagcggtatactttcattgtcaacataacaaccaagagatggcgatatcttccatgctacacacattataggcggttcccaaacagaatggtaaagtttatactccccctccaccaacaagcatcaatccatggcttactcgaaacaacgagtgcctccaacaagcaacagtcccagggggagttttgtttgcaattattttgatttagtttgcataaagcatgggactgcgcatcccggtgaccagtcattttctcatgagtgaggagtggagtccactcctcttgagaataacccgcctaacatggaagataagggcagccctagttgatacatgagctattcgagcatacaaaacagaatgtttatttgaaggtttagagtttggcacatgcaaattttacttggaacggcaacgtagataccgcatataggaaggtatggtggactcatctggaataactttggggtttaagggattggatgcacaagcagtattcccgcttagtacaagtgaaggctagcaaaagactgagaagcgaccaactagagagcgacaacagccatgtacatgcattaaaattaatatacattggatgcaagcatgagtaggatataatccaccatgaacataaatatcatgaaggctatgttgattttatttcaactacatgcgtgaacatgtgccaagtcaagtcacttaaatcattcaaaggaggataccactccatcataccacatcataatcatctcaatagcatgttggcacacaaggtaaaccattataactcatagctc

SEQ ID NO: 31352 - DNA, 630 bp, Triticum aestivum
  Clone ID: PAT_TA_31352
ccgtcttcctcattcgcgccgcccctctcttcgaatcattcgccccgccgcgccgcgccgccgcccgccgatccgatccgacccgacccgccccgcgcgccgccgtggccgggcccgggttccgccgatcgacccccatggtgcagctcccggccatggggaagcgccagcacccggagccggccgagccgcccatggcgccgccggccgccgccgtgaagatggaggcggacgagctccgggacttcgaccacggcccgctcggcaagcgcgccaggcccggccagccctcgccgcccccgctcacgcccccgcaccaggacatgtatcacaatgtacttgatgaacctagcccattgggtcttcggctgaaaaaaagtccatctctgttggatctcattcagatgaggctttctcaagcaaattccgatgcaggacagtccactacggacaatgctgagccttccaagaagaaagaccttaaatctggtacatcatcagctagtgaacggttgaaagcatcaaactttcctgcaagtgtattgaaaataggtacatggaagtacacatccaaatatgaaggtgatttggtggcaaaatgttacttcgcgaagcataaacttgtatggg

SEQ ID NO: 31353 - DNA, 1168 bp, Triticum aestivum
  Clone ID: PAT_TA_31353
gagttttttttttttttttttttttttttttttttttgtataaccaaattacttgctgcaaaagcagaggattaatcatctctgggtgtcatggtaaattcgcctggccggccaaataattttgttgaaatgcatcatctcatatgtgtttatcttgatacgcacataaaggtcctgtagctgcatcttttacgggccgtcgcaacaaaaccctcgaccttcttgttatataatatataggagtataccaaaattgaagtacttttggcacgtaaatattcatgaccggtagtccattaacgcgcaacaatgtctcaacaacaacaacaacaacaccaacgtcggtcttggttgtatcacagatgactcagaattactggcaatagcttgtctccgtactcgattagatgatgcatgcctccaccgacttggaatatagcatgcattggctcgatgcacatgtcgtggatgcagcacagccctgctgtttaactccatgcggatcccacactcctcttctatcttggagaccggcctcttgctatcctccccctcgccgtctctcctcctgtacctctccgagcacaccaccctctgcctcgggtcgtcggtgtcgctgatcccgtgttccagttgcacaagggagggaaatgtcacagcgtagaaagaattccttggtgctgggtttcctttcgtgggtggacaaatggttgtggtgccgtccacataaaccttgtagatggggatcctgaggaggccgggggcgccggcgatgctgcagtcggtccgctgcaggaggaagaggaaaatgttcgcagcggggcatgtaggacatgcgcatctgcaggcacgccccgtcgtagtccaggttgttggcgtgctggatgtcggcctccagcaccttgagcgactccctgaacgacctccgcgcagcgcacggcgccgctgccgccatctccctcccccctcctcctccgccaccagaggccgccgccggcgaattaaacactgccaccagagcccagcagggccagattagaacgccaccgcgcgcgcgcgcgaaccctcgaccgcaacggcgacggcgacagcgccgccgacagtggaggctcgctctccgctccgctccactccactccaccgaaagcaggctcgccggccaccccgt

SEQ ID NO: 31354 - DNA, 1021 bp, Triticum aestivum
  unsure (1)..(1021): unsure at all n locations
  Clone ID: PAT_TA_31354
cagatccgccgctagaaccccgtcccgagcgcgtctaggagcacggccttgttgccgtcgtgctcaccatcatcctccgcctcgccgaccgtgtccctcttcttcctcgacgtccactacgtccacgacatcgactacgtggagctggaacccgttgctgcgccgtcttcttcctcgtcttcgactccggccaccacagttgttcgatcgccctcaccgtcgtctccgtccacttcacgtcaagtcgaacaccccatcgtgttcgtgagccaggagacgagttcgtgaacgaggaccctgtcgagtacgttcacgaggagcaaggattcgataccactgagaacattgcacacgagatgatcattacccccgatatcacttctatctttgcttgctagttgttcgttctatcgctatgtcgcgctacctaccacttgctttatcatgcctcccatattgccatgtcaagcctctaacccccctttcctagcaaaccgttgtttggctatggtaccgcttttgctcagcccctcttatagtgttgctagttgcgggtgaagatgaagtttgttccatgttgggaacatggatattgttgggatatcattattatctcttatttactttaaatgcatatatatacttgctaaagggtggaagtttggccttatgcctgggtgttttgttccaccttgttgccctagttcccgtcataccggtgttatgttccttgattttgcgttcttacgcggttggctgttatgggaacccttgacattcgcgtccgaataaatcctccancaaaggccaaccttggtttacaatttgccnactacaacgcatacttccctgggtctgcagaccaagggcatcttaattaaccccccccccgggcaatgccctccgantgttggncgaacaaccgctgcgggcactcgggaaatcaagggggccggacaatcgccatatgagcgataggcgtnatgccncttaaagcngacggaaaccnggtacaataacc

SEQ ID NO: 31355 - DNA, 605 bp, Triticum aestivum
  Clone ID: PAT_TA_31355
gaggcctctgctacgcgccggcgagccagaaggagcgcgagtggcgcaagacccacgacgacctcaagaaagacaagacctgccagttcaaggtcgcccagcagccctacgccggcgccggcggcagggtcgagtaccgcgtcgccctcgacatccccaccgccacctactacgtgcgcgcctacgcgctcgacgcctccggcacgcaggtcgcctacggccagaccgcgcccgccgccgccttcaacgtcgtcagcatcacgggcgtcaccacctccatcaaggtcgccgccggcgtcttctccaccttctccgtcgtctccctcgccttcttcttcttcattgagaagcgcaagaagaataactaagctcagaaccgtacgtggcaaggtgttcgtccgtgcgcgacttcttcctcttgtcctttgcaacgtacgcacaaaaggtgtacatgtaatgtaagagagtgttggtgtttccttttcggggagctcacgtgattgttacacattacctatatgtaaatgccaaagtttgggactgctccgcttcaaatcagttcaatttcatcaaatctacgttggagcaaaaaaaaaaaaaaaaaa

SEQ ID NO: 31356 - DNA, 683 bp, Triticum aestivum
  unsure (1)..(683): unsure at all n locations
  Clone ID: PAT_TA_31356
atcaaaaccaccgcgaaccttctctgaccgagcagctgcgagctcgagcccaagttccaagctagaatcgcggcgaatggcacggctcggagctagcgatggcgttgctggtggtggtcctcgccgccggctgctgcgcgtcggcgtggcgccgtggcgtacctctccaagctgccggtgaccctcgacgtcaccgcctcccccagtcccggccaagttcttcacgccggcgaggacgtgatcacggtgacgtgggccctgaacgcgagccagccggccggcaaggacgccgactacaagaacgtgaaggtgagcctctgctacgcgccggtgagccagaaggagcgcgagtggcgcaagacccacgacgacctcaagaaggacaagacctgccagttcaaggtcacccagcaggcctaccccggcaccggcaaggtcgagtaccgcgtcgccctcgacatccccaaccgcactactacgttcgcgcctacgcgctcgacgcctcccggaccaagtcgcctaacggcaaaccgcgcctccttccgcttnaaagttcgtcagcataacggcgtcacaactccatcaaggtcgccgccggcncttctccgctnttcgntgctccctnggatcttcttcttaattggggaaacncagaagacaactagatntggaatttggacctt

SEQ ID NO: 31357 - DNA, 1002 bp, Triticum aestivum
  Clone ID: PAT_TA_31357
gccaaaaacgaacgacaatataatgttcaaatataagagacaatcctccacgtaacatccatcatgtcatgtgggcaacgcaacaccgttctacaactaaaacactaaccaactggaaagaaaagaaaataacacacccagagctcagctccgtccacgccacccttgttggccttcaggccccttcctgaagcagcatctgatcaaagtgccacaccccgtgccccttgttgcccactctcctcagctgcgcgacatacttggagaccttatttatggcttccacctgctcctcgaggaactcactctcgatgaagtctatcagctgaggatcattgcaccttgttgccacaccatgcaggctgtgcagcttctcattaaccagcttttccagagccagagtcagctccatagcgtacagagcatcgcctttctcggggtggtcaaactcggtcaaaggcgccacaatcgactggagcctcaccctgcctccgcgtttgttctgatactccatgagcttttcagcgtgctccctctcctcgtcgctggattccttgaagaacttggcaaatcctttgagggccacgttgtcgcggtcgaagtaggcgaagagggagtggtacgcatacgaggcgttgtactccacattgatctgctcgttgatggctgcctcgcagtcgtcgacgaacttgtggcgcgcgagcgacctgtcgggggactggggcacgagggcgagctcccccttgatctcctcgaagggctggaacaccaccccgctgagcacctccttccccttgccggcggcggcggcggacagcgagacgccgctgcgctgcgccgtgaccctggcaggagccggggccgcggccccaccagagagctggttggccaccgcggcggccggagaagcggaaaccctaagcatcatctggatggggacgggaggaggaggcgggcgggtgcgttctcgtgaattctgggcgtcgggagcggaataatatg

SEQ ID NO: 31358 - DNA, 383 bp, Triticum aestivum
  Clone ID: PAT_TA_31358
ttttttttttttgaacacagcacattagcaagcttacaaacattaccagtacattacattattacattttacattactttcataaatccaaacaaattatgtggatcgtcctggtcccacgctacacacacctaattcttgcgtgtggacagagaagcacttgattcagctgtaatttattttcaccctaatttaactaggaatgatcgtagaaataattcagacaagcagacgggtcgatcactgcgactcccatgcgccgagcgcgcgcctgggcttgggcttgggtttgctgtccgccttgacggggtaggatgcctccatggcgatgccgcagagcccgccttcggcaccggaatccttctccaccctgatgtacccct

SEQ ID NO: 31359 - DNA, 733 bp, Triticum aestivum
  unsure (1)..(733): unsure at all n locations
  Clone ID: PAT_TA_31359
cgtccggtcaacagctgctcctctcccggggctacgccgtccacgccacgctccgcgaccccagtgatcccaagaacgcgcatctgatgcagctggacggggcggcggagagcctgcggctgtttaaggccgacgtgctggacagcgccgcgctggccgccgccgtcgaggggtgcgagggcgtcttccatgtcgcctcccccgtccctgcggataagatcgtcgatcctgagtcagaagtcatggtgcctgccgtgaaggggaccttaaatattcttgaagtttgttcatctctgaaggttcataaggttgtggtggtgtcatccactgctgccgttcattatgatcccaactggcctcagggtaaacccaaagacgagagttgctggtcggacagaaaagtatgcaaggataatgagatctggtatagtcttgctaaaactgttgctgaagagacagtttgggaatatgcagagaagaacaggctaaatgctgttacagtatgcccttgtattgttttggggccacaattgcaatctgttgtcaatactacaagcgaactcctcctctatgtcataacaggaggtcctaatgcattgaatgagatgctgtggcacatagtcgatgtccgtgatgtggctgaggccctgcttctggttacgagaaccagatcatccgggagaatatctgcgcaccanatacattagcacaaaggctttgctggagctgctaa

SEQ ID NO: 31360 - DNA, 677 bp, Triticum aestivum
  Clone ID: PAT_TA_31360
tttttttttttttttaatatgcataagggatctgaacatataatcttccaccaaataaaccatatagtaatcaactacaagatgtaatcaacactactagtcaccccctagcaccaatctatagttctggtaacaagattgaatacaagagatgaactagggtttgagatgagacggtgctggtgaagatgttgatggagattgccctccccaagatgggagagttgttggtgatgacgatgacgatgatttcccccttcggaaggaaagttcccccggcagaatcgctccgccggagggcaaaagtgctcctgcccaagttccgcctcgagacggcggcgctccgccccgaaagtcttctccttattttttctaggtaaaaatgacttatataccagaagatgggcactagaggtggaccaagggggctacaacccaccagggcgcgcttgggctgcctggcgcgcccaagtgggttgtgcccacctggtggcccccctctgctacttattggctccaataattcttaaatattccataaaaaatctccgtgaagtttcagcttgtttggagttgtgcagaataggtggcctgacgtagctttttcaggtccagatttccagctgccggaattctccctcttggagtgtaccttgcatattatgagagaaaaggca

SEQ ID NO: 31361 - DNA, 794 bp, Triticum aestivum
  unsure (1)..(794): unsure at all n locations
  Clone ID: PAT_TA_31361
tgtcttcttcatggactcgttcttcttccttgcgtgatctcagttgcaggtgacgatgatgccattgcagatgacgcaantgagctcaagtgggagctcgatgaagattgtgtttgttgtgttgtttactttccagacgatcagtagtggagcccagttggggcgatgggggatcttatgcatttggggttgtctttattttggttttgtagtcagaccttgattgtattctggatgatgtaatgctatatttatgtattgtgtgaagtggcgattgtaagccaactctgtatctctttcttattcagtacatgggctgtgtaaagattacccctcttgcgacatgcctactatgcggctatgcctctaagtcgtgctccgacacgtgggagatatagccgcatcgtgggtgttacttgttggtaatcaagagccttccccgacttaggagccccctacttgatcgaatcgttggcgttgttgagtctacaaaaagggtttgagtctaataggattgtatatataggagagtangattgtttacccctcagtccctttgtcgctctaatgagggccctgactagagtttgaccctccctccaaattcaagaattttccangatatgcgtgtacctggaacgtccgatggtttgggacanaaatgtctggaccccgaattaggggtgtngatgccgggagtacncaatgtgcgcnaattacgtnntcganacgantccgaacaanncttagatgtggaaacncaccacaanggggagttaaatcaaccnaggttt

SEQ ID NO: 31362 - DNA, 610 bp, Triticum aestivum
  Clone ID: PAT_TA_31362
ttcaaagggatcatgagattactcatactagaaacttccgtgtgcagccacaagcaattatgcgttctagcatagttgatttagtcgtgtgaactcttatagtggtagactagcagatgtaggggttgtaggtggaacggtctacccatcgtaaggtgtaaacgcttctgaaagactatgtctcggtcatccgtttctcaaacaccttgtagtgcgagaaatccaacgaaggagatcgggcttgtggggaaaagtgcgcaaactctgcagagtggttataaactaatcatgattagccgtgttcccggttatggacaatcttgagtatctggttcttggattatcatattgatctcatcacgttacttaaataatttgttgggttattgatgttaatttgggattgagttggaggaaccttctcaatattttcaaccaactttgtagttaaataaattatattcctttgtagtaggaaaaattggcttttcgcaaaatactatgaccataaagcttttccaccagccaaatatgcatgtagtgatagctatttgatagaggcaaaggtgtcccgtctttcgatgagatgatggatatcgttttggtggca

SEQ ID NO: 31363 - DNA, 1124 bp, Triticum aestivum
  Clone ID: PAT_TA_31363
ctttttcgataagtaagagtgtcgaacccaacggggagcagaaggaaaagacaagtgggtttcatcaaggtaatgtctacaagtgctaaaattgtaagtagcagagtagtttgatagcaagataatttgtaatgagcaagtaacgattgtagtaacaaaagtgcagccagatagcccaatccttttgaggaaaaggacaggccaaaatggtctcttatgataagcaaagtgttcttgagggtacacgggaatttcatctagtcactttcatcatgttggcttaattcgtgtttgctactttgataatttggtatgtgggtggaccggtgcttaggtgttgttcttacttgaacaaacctcctacttatgattaaccccctcgcaagcatccgcaactatgagaaaagtattaagaataaattctaaccatagcatcatacatactatcaaaatatcaaacacatatcaagttcacatgattacttgcaacatgatttctcccgtgacctcaagaacaaaagtaactactcacaaatgataaacatgttcatgatcagaggagtattaaatagcataatggatctgaacatataatcttccaccaaataagccatatagtaatcaactacaagatgtaatcaacactactagtcaccccctagcaccaatctagttccggtaacaagattgaatacaagagatgaactaggatttgagatgagatggtgctggtgaagatgttgatggagattgccctccccaagatgggagagttgttgctgatgatgatgacgatgatttccacctccggaagggaagttccccggcagaatcgctccgccagagggcaaaagtgctcctacccaagttccgcctcgagacggcggctctccgccccgaaagtcttccccttattttttttaggtaaaaatgagttatataccagaagatgggcaccggaggtgggccgagggggctactacccaccatggcgcacctgggctacctggcgcgcccaggtaggttgtgcccacctgacccccctctggtacttattggctccaataattcttatatactccataaaaaatctctgtaaagtttcaacttgtttggagttgtgc

SEQ ID NO: 31364 - DNA, 560 bp, Triticum aestivum
  Clone ID: PAT_TA_31364
cccgggtcgacttccaccaaagcgaaatccaccatctcatcgaaagacgggacacctttgcctctatcaagtggtatcagagcggtatcagttttcaggttgctcggtgagaatttccagttttcctagattagatttattttcttacctattgtccaagaaaaagccacaaaaaagagttagatctattcatccttggtccaagccagtctgagcctttgcaattttcttttcattgcttgcatagttgaattatcggttgcatcgtcgtgtcgagttgctggtcttagtgtctagttcgtttaaagtttcgagttctgttcacattagtcatgccaccgctgcatcattatctcttccactgtccactacccatccatcaatttccaccacgtgctacccaccattcattgtcataataatagttgagattgttcacatcttcacttgatccaatctgcatcttatctagtttgttttggaaagagggagaaaaaaagagagaaaaaaacgagaaaaaaaaggagaaaaaaagtcacagaaaaaaaaggagagaaaga

SEQ ID NO: 31365 - DNA, 802 bp, Triticum aestivum
  Clone ID: PAT_TA_31365
ggcggggaatgcaacaaattattactccctctgttcctaaatatttgtctttctagagtttttaacaagtgactacatacgaagcaaaatgagtgaatgtacactctaaaatatgtctatatacatctgtatgtggtagttcatttgaatctctaaaaagacaaatatttaggaacagagggagtagaaaaggatttggacccttcttctccttggtgcatcacatgcctaccaaagcaatcacgtgcgcataaaggatctcatatgtgtttatcttgatatgcacataaaggtcctgcagcttcaccttgaagtacttttggcacgtaaatattcatgaccagtactccattaacgcgcgacaatgtctgaacaacaacaacaacaacgtcggtcttggttgtatcacagatgactcagaattactggcaatagcttgtcttcgtgctcgatcagatgatgcctccaccaacttggaatatagcatgcgttgacggtagcacttgatgcacacgcctcttctatctcggtgactggccttttgctatcctccccctcgccgtctttcctcctgtacctttccgagcacaccacccttcgccttgggtcgtcggtgtcgctgaccccgtgttccagttgcacgagggagggaaacatcacagcttcagtttctgctggacgtctgtttaggtaccgtagacagaattccttgatgctggctttcatttcgtgggtggacaaatggctgtggtgccgtccacataaaccttgtactagatggggatcctgaggaggcccaggg

SEQ ID NO: 31366 - DNA, 967 bp, Triticum aestivum
  unsure (1)..(967): unsure at all n locations
  Clone ID: PAT_TA_31366
caaccttctctgaccgagcagctgcgagctccagcccaagttccaagctagaatcgcggcgattgcacggtcggagcttgtcatggcgttgcttgtggtggtcctcgccggcggctgctgcgcgtcggcgggcgccgtggcgtacctctccaagctgcctgtgatcctcgacgtcaccgcatcccccagtcccggccaagttcttcacgccggcgaggacgtgatcacggtgacttgggccctgaacgcgagccagccggccggcaaggacgccggactacaagaacgtgaaggtgagcctctgctacgcgcccggtgagccagaaggagcgcgagtggcgcaagacccacgacgacctcaagaaggacaagacctgccagttcaaggtcacccagcaggcctaccccgggcaccggcaaggtcgagtaccgcgtcgccctcgacatccccaccgccacctactatgtgcgtgcctacgcgctcgacgcctccggcacgcaggtcgcctacggccagaccgcgcccgccgccgccttcaacatcgtcagcatcaccggcgtcaccacctccatcaaggtcgccgccggcgtcttctccgccttctccgtcgcgtcgctcgccttcttcttcttcattgagaaacgcaagaagaacaactaaactcggaagtcggaaccgtggcaaagtgttcgtcttcgtccgtgcgcaatttcttcctgtccttcgcaacctacgcataattgtacggaaaaatgtactgtactgtactatatgtaagagattgtttgatgttcctttttcttaacccggagactctcgtatataattggttatgttgtaatacaaccgatgggcatgtgtaggaacgaaaacgtacgagttcttcatatttgttttcatattttattttatggtagaaatgagattgggtacaaaaacctnaaaacaaatacataaacaaagagc

SEQ ID NO: 31367 - DNA, 881 bp, Triticum aestivum
  Clone ID: PAT_TA_31367
tgctcttgttgttgtaaatatgtaaggcagcattaaagttttcagcaaagattatgattaaccacattcaaaataacacttaggtctcatatttactcatgtcaatggcataatcaactagcgagcaataataataaatctcagatgacaacactttctcaaaacaatcatgatatgatataacaagatggtatctcgctagccctttctgagaccgcaaaacataaatgcagagcacctttaaagatcaaggactgactaaacattgtaattcatggtaaaagagatccaatcatagtcatacccaatataaattaaaagtaatggatgcaaatgacagcggtgctctccagctggtgctttttaataagagggtgatgactcaacataaaagtaaatagataggcccttcgcagagggaagaagggatttgtagaggtgccagagctcgattttgaaatagagataaataatattttgagcggcatactttcattgtcaacaaaacaaccgagagatggcgatatcttccatgctacacacattataggcggttcccaaacagaatggtaaagtttatactccccctccaccaacaagcatcagtccatggcttgctcaaaacaacgagtgcctccaactaacaacagtcccgggggagttttgtttgcaattaatttgatttgatttgcataaagcatgggactgggcatcccggtgaccatccattttctcgtgagtgaggagcggagtcaactcctcttgagaataacccgcctagcatggaagataccgacagccctagttgatacatgagatattcgagcatacaaaacagaatttcatttgaaggtttagagtttggcacatacaaatttact

SEQ ID NO: 31368 - DNA, 763 bp, Triticum aestivum
  Clone ID: PAT_TA_31368
gcataaaggatctaaacatatgatcttccaccaagtaaaccaattagcatcaactacaagaagtaatcaacactactagcaacccacaggtaccaatttggggttttaatacaagattggatacaagagatgaactaggattttgaaaggaaatgatgtttggtgaaaatgttgatgaaaattgaccccctcccgatgagaggatcgttggtaatgacgttggtgatgatttccccctcccggagggaagtgtccccgataaaacagctctgccagagccctaaattgattccgccaaggttccacctcgtgaaggcggaatttcgtcccgtaagcttgcccacaattttttccagagtaaaaatgatgatatagcagaagatgaacgccggaagcccaccaaggggcaggagataaggggcgcgccctataggggggcgccccctgtctcctggacagggtgtgggtcccctggactatttcttttgctcagaaattcttattaaatccaaaaagttgtttcgtggagtttcaggacttttggagctgtgcaaaataggtttccaacgtttgctcattttccagcaagaattccagctgccggcattacccctcttcatggtaaaccttgtaaaataagaggaaatggccataagtattgagatataatatataataacagcccacaatgtaataaatattgatataaaagcatgatacaaaatggacgtatcacccgtcttgccgatgcccacctgcccac

SEQ ID NO: 31369 - DNA, 682 bp, Triticum aestivum
  Clone ID: PAT_TA_31369
agcaagcttacatacattaccagcacattacattattacattttacattacatccatataaatctaaacaaatattgatggtcccacgctatacacgtccaattcttgcgcgtggacggagaaacacttaattcagctgtaatttattttcaccctattttaactaggaatgaaagtagaaataattcagacacgcagagagattgggtcgatcactgcgactcccaggcgccgagcgcgcgcctgggcgtgggcttgggtttgctgtcggtcttgacggcgtaggacgcctccatggcgatgccgcagagcccgccttcggcgcctgaatccttctcaaccctgatgtaccccttctccccccacgatggcccccacgagttcttcaccgtccagtacgccttgccgtcctccgccacgccgtacccgaccgccgcgacgccgtggtccaggtcagttccacagtcaccggtgaacaccccctcggagtagaacatgaacgccttcccgctggcatcgatggccacggacacgggctggttcgccacggccttggccagcgcctcctcgctgttggccggcacgtcctggtgcccgtcgatgcgcaccaccacgggggagctcttggccaccctcgcggcgttgcaggtgccgttggcagcccgtacggtaggcgcctcgt

SEQ ID NO: 31370 - DNA, 1460 bp, Triticum aestivum
  Clone ID: PAT_TA_31370
tcggcacgaggcagaccacccaaggccgtctcgagccctgcccagagcagccaagccgccgggaaccgacgccgcccctgagctctgcccgcgccgtcgttgcccagatccggcgccggccggccggatccgccccgtctccacctcgccggccttccctgcagccgccgtcgctccccttcaagtcccacgccgtcgttgctgtcccctgctgctgccgctgtttcccctgtcgaacgaacgagcacgacgccccagcgctcacgcctgggccacctctgcttcggcccagcggctcccctccgtcgcgtgaggcccagcgccccaagctggcctcctctgcctcggcctttaggcccaatcttcggtttcgttccggagttgtgaggattcgttcgactacgtccgtttgtcttcttcatggactcgttcttcttccttgcgggatctcagttgcaggtgccgacgataccagtgcaggtgacgcaaccgagctcaagtgagagttcgacgaggacctttgatcgtttctatgtctcgtttcctgatgatgagtatggagcccagttgggatgatcggggatctagtcatttggggttgtcttcttttattttggttccgtagttagaccttgtttgtactctgatgatgtatgtttaattcatgtattgtgtgaagtggcgattgtaagccaactctttatcccattcttgttcattacatgggattgtgtgaagatgacccttcttgcgacaaaaccactatgcggttatgcctctaagtcatgcctcgacacgtgggagatatagccgcatcgtgggcgttacagaccacgagcccacaagcccacaaacctcaaaagaggagcaaggagccgccgtggagcgtccgttaatgcattgattggatcaatttcatggacttctcaaatgctaggctcgcatatatggacagatttggtggatttttttttaaaataattaacttcgttttgaattatatttggtggagataatatatatgacccccacttttgaaggcaatgatgccaccggtttgcaaattactatatgttttcatggattttcctatagatccaagcccagtggagccatacactattcctgctcatagctgtcatcagaactatggagcacagtcattcaagccacggctccaaacttcaggcgtggaattaaggccatgctaatgctggtggattggaaattctggcaggaaagaaatgccagagttttcagagatgcgagctcaccggctcaggtggtgacctcctggattagagatgattttgaggcctggaggctggcaaaagcaacgggaggagtagcatatggctctcaggggcctggtcccctgtcttttttaacctctgttttttatttccttggccatcttggccctcctggacattgttttacctcagcctgcttatcaatat

SEQ ID NO: 31371 - DNA, 746 bp, Triticum aestivum
  Clone ID: PAT_TA_31371
tatacaggttgctaactatgttgttgagaagcttgttcttgagaaaccattggatggaagtccggacagcacatttgccatgggtttgacctctggcacatcagccctagatagttcttcccggcttggactaaagccatggcaaaaactgaaaccttctgttgagatattgtgcaacaaccaggttctgtcacctgagatgagtttggcgacagtgcggacatatatttggaagaagccggaggatttgattcttaattacagagtggtccaatcaagataattgcaacctactccctccgttcctaaatacttgtctttctaggcatttcaacaagtgactacatacggagcaaaatgagtgaatctacactctaaaatatgtctacatacatccgtatgtagtagtcatttgaaatgtctagaaagacaaataggaacggagggagtaaaatacatccgctcgtttggttcaccataggtgctgagcatatctgcattggagatggcatcgttgaagataaccatatgacctataggatgcaaggtgttccattcttgtgctgctctttggtgccgttcccagaactacagcaacttaattcctcctcctgtaaagtttttctgtgaatcttgtatctccaaggcttctaggtgagattgtatcatagcacaggtgtaatggatctgctagctaccaagcttgtatatctagagatttgggatttctcaataaagcttctaaa

SEQ ID NO: 31372 - DNA, 1033 bp, Triticum aestivum
  Clone ID: PAT_TA_31372
tgccatatttgaaatgcttggcatttccaaactgtgtctccgattccggtgttctttacatcgatttcaacgaaatcacctcacctttccagtggcacgcttggatttccaagttgaggccgggttcattctttccttatcaaatcttgcatatgcatcacatatcgcatcccgcatagcataccatgtttgcatcatgttgtttgagctttgcacgtggttgattgtgttcctcttgcatgtttgtcttgtttgggtagagccgggagacgagttcgctaacgaggagcccgttgagtttgctttggaggatccagtcaactctgacaactttgcaggcaagatgatcataccctcgaaatcactactatctttgctatgctagtttgctcgctctttgctatgccaatgctacgatgcctaccatttgcttgtcagcctcccaattgcatgtcaaacctctaacccaccttgtcctagcaaaccgttgattggttatgttaccgctttgctcagcccctcttatagcgttgctagttgcaggtgaagattggagccgttccttgttgggacatttatttacttgttgggatatcattaaattagcttgttatcttaatgcatctatatacttggtaaagggtggaaggctcggctttttttcatagtgttttgttccactcttgccaccttagtttcggtcatatcggtgttatgttcctggattttgcgttccttatgcggttgggtgataatgggaaccccttgacagttcgccttgaataaaactcctccagcaaggcccaacattggttttaccatttgcataccacttaaacctttcccttgggagtaattaacctgagggttatctttattttagcccccctgggacaatgcttgtctaagtgttggtccaaactagagcaccgtgcgggaccatcccttggcaactttggttatgtcggtacctatacgcttcgcttatccggtgtgtcctgagaacgagatacgtgcgactcttatcggggtt

SEQ ID NO: 31373 - DNA, 510 bp, Triticum aestivum
  Clone ID: PAT_TA_31373
ttccaccaaagcgatatccatcatctcatcgaaagacgggacacctttgcctctatcaagtggtatcagatttccaggttgctcggtgagattttacagtttttcgtagtttagatcgagtctgttcttcatacctatagtccacgaaaaagccaaaaaaaattagggttagttcatcccatccgaaccaatctgagccttgcataatcttttctgtatttgctttgttgaatttgcggttgcatcgtcgtgtccagttgctggtcttagcgtctagtcttttagagtttcgagttctgttcacaggttgtcacgtcgccgctgccatatatcaccaccgcatcatcatcgtcgctgttgtcatataccaccaccacatattcaccgccaatccgaatccatatacgccaccacatatccgccgccatcacgccaatccgagttcacctgcaacatatattcgccacctgtccgtgttccaccagatttatctccgccaccagtccgagt

SEQ ID NO: 31374 - DNA, 636 bp, Triticum aestivum
  Clone ID: PAT_TA_31374
ttccaccaaagcgaaatccaccatctcatcgaaagacgggacacctttgcctctatcaagtggtatcagatttctaggttgctcggtgagattttacagtttttcgtagtttagatcgagtctgttcttcatacctacagtccacgaaaaagccacaaaaaaaaattagggttagttcatcatatccgaaccaatctgagcctttgcataatctttttagggttttgctttgttgaatttgctgttgcatcgtcgtgtctagttgctggtcttagagtctagtcttttagagtttcgagttctggtcataagttgtcacgccgccgccgcaccatcatcatcgcccctgccatctaccaccaccgctccgaatccgtatccatataccaccaccaatccgtgtccatataccaccaccgattcatatccatatactaccaccaccgctgccatataccatcaccatatatctaccaccaatccgagttccttgattactagggttgttttcgagatccatctagttttcaattcgtgtttccttgccggagtcaggtagccacgctccgtttaggcccaaaatttttcgaaaacgcatttttcgaaaaattttccagctatcctacttttaagtgt

SEQ ID NO: 31375 - DNA, 806 bp, Triticum aestivum
  unsure (1)..(806): unsure at all n locations
  Clone ID: PAT_TA_31375
gctgtacgcgcagatcgacgcggtgtacgcggccatgaaggccatggggcacacggacatcggcgtgcgggtgtcggagacggggtggccgtcgaaaggggacgaggacgaggtgggcgccacccgcgcagaacgcggcggcgtacaacggcaacctcatgcagcggatcgccatgggccagggcacgccgctcaagcccagcgtgcccatcgacgtttccgtgttcgcctcttcaaaccagaacatgaagcccgggccggcgtcaagaaagaaactacgggcttgttctaccccaacgggtcgccggtgtacgcgatcaacgccggcaccgccggctccggctccagctccggcgacggcggggggtcgtcggtggggaggttcgacccgtactcgtcgcagtccatgttctcggccgcgtccagattggtggcggtaagaagaagattatcttctttgacgctactgctggtattgcccgtgctgtcagcattgttggcatgctgattgattaaagtaaactagtagtgattcatcaccattcattgtatacggagaacatgttgtaaatcggttatggggctggccgagattctgaaattcggcacgacggcgatgtctgtcccggaaagtttctcctttctctgattattcccgccccaatgatcccgagagcaaaaggcacccaaagggacggcgatggacggacgggcggggcatcgcagaaagcgcgggaaattcctggagtgtttgactggagaaacatgctagcacttnnnnnggaaagaaagannnnnnnnnnaaa

SEQ ID NO: 31376 - DNA, 1041 bp, Triticum aestivum
  Clone ID: PAT_TA_31376
gaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatcgccacctacctcccgctcgtcccaactgagcgcattgcaagggttttcgccaacccggccgccgacactgcgcctgccacagctcctgagatgcagcccatcccgacgcagtaacaataagagctacccggagttatgttacctataatagctgttaggagtcagtatctcgttgtagtgtcttgtttggcttgtggtggacagtggtattatgtgtggatggtcactgtggtatccgcctgtgtggaggcgactctgaatgctgttgctgtgcagcatcacctgctttgcgttttactccctcagttcctaaatatttgtctttctagatattttaataagtgactacatacggagcaaaataagtgaatctacactctaaaatatgtctatatacatccgtgtgtggtaatccatttaaaatgtctagaaagacaaatatttagaaacggatggagtagatcagagtacatacaacgaactaatgaatgaattaatgaaatcttcagcagcatcttgtcggccgtcgcctgtgaagtgccatcagctgtccagtccaagccgaatcatctttcgtcgcccgcgttccggtgctccgacgagccgtcgctcttctcaggccaggcgccgaagctcagctggcgcagcagcgccccgaccgccttggcccatcgctggatttcgcccttgagcttgtcaggttctatgtctgcgaacgcaccggcggcaaggccagacaagaggcggtcataccgcgcaccgctggacgacgatttcggcaagccggcgctcgcgtcctcggcgtacttctggccgactgacatgccctcggggtcttggttcttcggaaaa

SEQ ID NO: 31377 - DNA, 920 bp, Triticum aestivum
  Clone ID: PAT_TA_31377
gccggccgggttgggctttccattcctccctcctcctcgtcttgccgccacaaggtaagccactccacgccatatccgtcgccaacgccatgcccaagctctactctggcgcgatcaagctcgtcatcgtcgtcttcttcctcggggagtgacgcacgcgtccccgactttgtccccgtctccgtccccgaccgattcttatgggtggctggactggatcgcctcccacgctgtcgtccacgtctttgtcttcttcctctacctcctctacgtcatgaacgccggctcctctgcttccccgtcgtcgacctcgtacgactccaacagcacccccacgttgcaggtacaggttatgcgatgatcatgacgcaagagcgatgcttgtttgcgttgagatcttcttctgctccttcgatcaggggataggttccaggtcggtagcctgggctagcagggtggatgtcgtttgagtttctgtttgtgtttcatccgtagtcggatgatcctctgatgtattgtgatgttgtattcatgtggcatcgattatgtaatgttgatgtaatgatatccaccttgcaaaagcgtttcaatatgcgggtctatccttggtgggaccttcgagttccttttggatagggtcgcatattgggcgtgacaagttggtaatcagagcctcgaccgaccctaggagcccccttgattattcgtgtagtttggccgatgttgagtctagaagaacactgttttcagagtctagttatatcggagagtagcaattctttttactcctcagccccttcgtagctctggtgaggaatcttgacgtaggtgttttgaattacttctcttccccttcaaattttctttaggttcacgcagttggttttccgttcgttggttctcatctcttttcatccggt

SEQ ID NO: 31378 - DNA, 415 bp, Triticum aestivum
  Clone ID: PAT_TA_31378
ttccaccaaagcgaaatccaccatctcatcgaaagacgggacacctttgcctctatcaagtggtatcagatttccaggttgctcggtgagattttacagtttttcgtagtttagatcgagtctgttcttcatacctatagtccacgaaaaagccacaaaaaaaaattagggttagttcatcatatccgaaccaatctgagccttgcataatctttttagggttttgctttgttgaatttgcggttgcatcgtcgtgtctagttgctggtcttagagtctagtcttttagagtttcgagttctggtcataagttgtcacgccgccgccgcaccatcatcatcgcccctgccatctaccaccaccgcaccgaatccgtatccatataccaccaccaatccgtgtccatataccacca

SEQ ID NO: 31379 - DNA, 910 bp, Triticum aestivum
  Clone ID: PAT_TA_31379
gggctgccagtttttaggagctagaatcaaacacaaatacgagcaatcatctctccgtgtgtgctagctgctaattctctaatcgatcatgggtggaggccacgacatgcacggcggccacaacggcggcgtgaagggcttcgtgtccggcctcgttaacggcgggaaaggccacggctacggatcgtcatacggccaggggcacggctacggcggtggccacgtgcagggctaccagcagggctacggcggccatggacagagctacgagcacgggtacggcggacatgcgcagcacgggcacggcggctacgagcactggtacggcggcggacatgcgcagcacggccatggccacgagcacgggtacggcgggcacttcagcagcacggatacggcggcggccacgcgcagctcgggtaccctcccgctgccggcgcctaccctccacacggcggataccaggcgcacggctacgcgccggcggcttacccctctcacggggggcaccagggtcacatgggatcataccacaccgggcatggcggcgggcaccaccacggcggcaagtaccacggcggcaagtacaacggcggcaagcacggcagtaagtggatcaggtgaagtggcgcgcgcggcagcgcgtacgtgcgtgtgcgcctccatgacatgcctcaattgatcactaaccatgctctccgtatgctacctaaataagagcgatatatgcatggtgtgtgatactttgtagctttccgtttcagctgggtaatgatgtgtgttggtgacctaataatctgtgtgtggcttaatacgaaaatttgtgttcactgtactgatgaattacaaggtatatgttccaccgtgctcggcctgtgtgtactggatgcatcaaataaaactcctattg

SEQ ID NO: 31380 - DNA, 690 bp, Triticum aestivum
  Clone ID: PAT_TA_31380
gcctcaccaccgagggacctcgcaagggacggggtggcgctacacagcagcatgtgatggcggtcaagaacaagttaccatggtggtaatattcatcacttttcaccagacggagcggtgtggtaaatgtatcctcactattatatgatggtactaaaacatacgcaagctgtggcaaatgtatcctcactattatgataatactaaaatatactgaagctatggtaaatgtatcctcattactagtagtatgatgatactaaaaatcatgacaattagttactaccattcccgcaaaaagaaaatactaccatcataaaacttagggtcatactcccttcgttcccaaatataagtcattttagatatttcaacaagtgactacatacgaagcaaaatgagtgaatctgcactctaaaatatgtctacatacatccgtatgttgtagtccatttgaaatgcctaaaaagacttatatttaggaatggagagagtatattgttacaagtgaaaatgctaaatggaggacgagctccatggagccctttattttttttaaatttaatacctcattttcaagttcaaaaaaaatcttgaaggatcacacacattcatacagatgtatagtatatgtgtgtaaaattagaagatgatatacattatgtttgctatgaaaatgcatgaatttgt

SEQ ID NO: 31381 - DNA, 1423 bp, Triticum aestivum
  Clone ID: PAT_TA_31381
gtggaaggctcgcccttatgcctggtgttttgttccactcttgccgccctagttttcgtcatgccggtgttatgttccctgattctgcgtcactaacacggtgacaggtatggggacctcttgatagtttgctttgaataaaactcttccagcaagggcccaacattggttttaccatttgcctaataacaaataaaacttgcagagggacccgccggcacccgaggtcttttaatcaacccccgggccaatgctcctcatgggtgttaggccaaactgggcgatgtccggcgccccctgggcaaccagggtctcagccaacccgacgtcttgcccatacggtgtaccctgagaatgagatacgtgtgagtcctatcaggctaggtcggtgcatttggaggtcttgttggttttgttttaccattgccaaaatgtcttgtgcaccgggattccgagtctgatcggagggtccggcgatagaggattgtctccatggatcgtgagcttgtcatgggctaagttgggacaccccatcacgatttaaactttcgaaagccgtgcccgcggttatgtggcagatgggaatttgttaatgtccggttgtagataacttgacaccagatacgaattaaaatgcaccaaccgcgtgtgtagccgtgaatggtctcttttcggcggagtccgggaagtgaacacggttttggggttatgtttgacggaagttcgagttcaggatcacctcttgatcactgctagtttcacgactgctccatttgatctcttctcgctcttatttgcgtatgttagccaccatatcatgcttagtcgctgctgcaacctcaccactttagcccttccttttccctttaagctttgctagtcttgatacccatggtaatgggattgctgagtcctcgtggctcacagattactacaacaacagttgcaggtacaggttatgcgatgatcatgatgcgagagcgatgtttacttgtgctggagtttcttcttcttctccgtcgttcttgggttaggttctgggtcggcagcctgggctagcagggtggatgtcatttgagtttctgtttgtgtttcatccatagtcggatgttgctcttatgtattgtgatgttgtattcatgtggcattgtatgccttttgtatgtatccccatctattatgtagtgttgatgtaatgatatccatcttgcaaaagcgtcttcaagatgcgcttctatccttggtgggaccttcgagttcctttaggatagggtcacatcttgggcgtgaaaatttggtatcagagcctcgaccgaccttaggagcccccttgattgttggccattgttgagtctagaagaaaactattttgagtcttaggattatatatgtcggagagtaggattctttttactcctcatcc

SEQ ID NO: 31382 - DNA, 1015 bp, Triticum aestivum
  unsure (1)..(1015): unsure at all n locations
  Clone ID: PAT_TA_31382
agttagatctcttatttgagttttacctgtgcattagttgagtacttattgtgtgcttgtttgtttgcgatagagtacccggagtgcgccgcttgctacctcgaatcgttaggtttcacggatcgtcagcaaggcaagtaacactttgatcatacgtcttactacccagttttattgcattacatcaatcctcacacattgcatgattaggatctaattaaattgtgggtttggaaagtagatgaggtagtacctattacctgttattatcaaacctttgggagttacttctacgtttgcttattatgccatgctatgctagtagacgtggattgggtgagtgaaatccatgacagatgtgagattgttaaagtaatggtttatctaaggtggcaacttaaacacacatctnggtggattgaggcacctgttttctagcaggacttgcctgtatttcttcggaccgccacccaggctcaaagggatcatgagattattcaaactagaaacttacatgtgcagccacatgctattatgggctctagcatagtcgactaagtcgtgcgaactcttacggggtggactagcagatgtaggggatgtaggttggtacggtctaccccacatgtaaggtgttagtgcttctgaaagactgtgtctagatcatccatttctcaaacaccatgcagtgcgtgaaatacaatgcaggagatcgagtcttgtggggaaaagtgtgcaaacctctgcagagtgtataaactaatgatggtagccgtgtccccggttatggacatcttgagtgtctggtgcttgaattactatgttgatctcatcactttacttaattaatttgtggggttattgattattaattgggattgagatggggttaccattctaaatgtttttcaacaaacattgtagttaaataaaatatattcctttgttgtagggaaaaactggattttcgcaacatgataaccatagagcttccaccagccccgtggacctggaa

SEQ ID NO: 31383 - DNA, 669 bp, Triticum aestivum
  Clone ID: PAT_TA_31383
ctcgtgccgaattcggcacgaggctccgacctaggctatggctttcatcgtgtccaagctcgcgcgggcagccctcgcatcccgccccgttggagatattgctggtggcatctccccgtgtctctcccggctctatctggcggctagtaccagccgtcgcatgtttgcagctgcaggtaatccctatgttgagaaagctttttcgaaatttggatctgaatcccgattgccgaaattttcaaaggaattctcttacttggatctgaattttatatctgaaattcccgcgttatgtttatagcccttccagaatttggatctgaattctgaatatataggaattctccttacttggatctgaatttaatacctgaaatccccatattatttcctattataagtagatctatttgaataagcatgttcattcggacatctagcaaggatattgtttatttacttatgccagctgccttcaatcaaatcaattccgctgagagcaatagtaaaaatgattgtatttttctgcgtaccacaaatcaaattgtaactatgtgctactgaacggcaggcggtcccaagtcaaaagaagcaccccgaatatttccccttgttgatgagaattccattaagtcgaaggaatccctatgggccttgtatgaatgctgg

SEQ ID NO: 31384 - DNA, 1147 bp, Triticum aestivum
  Clone ID: PAT_TA_31384
ggcgggcaggaggaagagggcaggagggaagatggcaccgccgcggcgcgtgtgcgtgaccggcggcggcgggttcatcgcctcgtggctcgtcaagctgctcctctcccggggctacgccgtccacgccaccctccgcgacccatgtgaccccaagaatgtccacctcaagcagatgggcgaggtccgggagaatctgcacctgttcaaggccgacgtgctcgactacgacgcgctaacacgtgcgtttgagggatgcgagggggtcttccacctcgccactccggtgcctgaagataagattgttgatcctgagtcagaagtattggctcctgctgtgaaaggtacttcaaatgtgctaaaggcctgctcagctatgaaggttcagaaggttattgtcttgtcatccaatgctgctgttgattttaacccgaattggcctcaagataaacttaaagacgagagttgctggtcagacaaagacttctgccaggagaaccaggactggtattctgttgccaagattgttgctgaacaggcatccttggaatattcagagaaacatggattaaacgttgttacgctttgccctcctttggtttttggtccattgttgcagcctactgtgaataccagtagcaaattcttaatctatgttattaatggaggccctgacgtgatgagcaacaagctgtggcacattgtggacgtccgtgacgtggcggacgccttgcttgctgtgtacgagaaggcagaatcgtccgggcgatacatttgcgcgccgaatagcgtctgcacaaaggacctggtggacctgctgaggaagatgtacccacagtacagctatgtgaacaacatcgtcgacgtggaccgtaaagcggggctgtcatcgcagaagctgaagggtctgggctggaggccgaggaagctggaggagacgctctcggacagcgtgggctgctacgagaaggccggccttctgcagggttccgctgggcgtaattgccggcttccgcatctgttccgtctggctggtgatcagtgaatgaaccgtggtggctggtgatttgtttgttttatggtcgaacttctgtaaggtgtagtgtcgcggacggagtctcgcaacagccacaaggtcgaacaactt

SEQ ID NO: 31385 - DNA, 1124 bp, Triticum aestivum
  Clone ID: PAT_TA_31385
tataacaagatggtatctcgctagccctctctgagaccgcaaaacataaatgcagagcacctttaaagatcaaggactgactagacattgtaattcatggtaaaagagatccaatcatagtcatacccaacataaattaatagtgatgaatgcaaatgacagctgtgctctccagctagtgctttttaataagagggtgatgactcaacataaaagtagatggataggcccttcacagagggaagcatggatttgtagaggtgccagagctcggttttgaaatagagataaattgtattttgagcagtatactttcattgtcaacgtaacaaccaagagatggtgatatcttccatgctacacacattataggcggttcccaaacagaatggtaaagtttatactccccctccaccaacaagcatcaatccatggcttgctcgaaacaacgagtgcctccaactaacaacagtcccagggggggttttgtttgcaattattttggtttgatttgcataaagcatgggattgggcatcccggtgaccagccattttctcgtgagtgaggagcggagtccactcctcttgagaataacccgcataacatggaagatacggatagccctatttgatacatgagctatttgagcatacaaaacagaatttcatttgaaggtttagagtttggcacatacaaatttacttggaacggtaggtagatactgcatatgggaaggtatggtagattcatatggaataactttggggtttatggagtttggatgcacaagcagtagtcttgcttagtacaggtgaaggctagaaagagactgggaagcaaccaactagagagcgacaacagtcaagaacatgcattaaaattaattacaacgagtgcaagcatgagtaggatataatccaccatgaacataaatatcatgaacgatatgttaattttgtttctactgcatgtgtgaacatgtgccaagtcgattggtcgaatcattcaaatgaggataccaccctatcataccatatcacaaccattttaatagcatgttggcacgcaaggtaaaccattataaactcctagctaattaagcatggcataaacaactataatc

SEQ ID NO: 31386 - DNA, 859 bp, Triticum aestivum
  Clone ID: PAT_TA_31386
tttggaggcatcgtgggctcttgcattacccagctgcgaaggggattctcaggcgattagttggtaacccaggtttcccagtcagagttgtaaacgacgccagtgagcgcggtatacgatcatataggcgattggtaccggcccccctcgagctcaagtggggttcgacgaggatctcagtgatactatgtttcctttcttgatgatcagtagtggtgcccagttgggggtgattgggaccattgtcgcatgttgggttttcttctattttggcgccgtagtcgggccatgagtgttttggatgatgtaatgttatttatgtacttgattgacgtggcgagtgtaagccaactatgttctcccctttattattcatattacatgggatgttgtgaagattgcctaacttgcgacatatgccttcaatgcgattatgtctctaagtcgtgcctcgacacgtgggagctatagtcgcatcgagggtgttataagttggtaatcagagccttccccgaccttaggagcccccttgattgatcgtgtagtttggccgttgttgagtctagaagaaaactatttttggagtctagtatatcggagagtaggaattctttttactcctcagccccttcgtcgctctggtgaggaatcttgacgtaggtgttttgaattacttctcttccccttcaaaaattttctttaggatcacgcagttggttttccgatcgttgttcctcagcccttttcatccggtgcatttctcgtcaacttgactcgagcctcttcatctttgccaagttcaatcctcagttcgctctcaacgaagttgtttctctgtcctcagttgttttctttccca

SEQ ID NO: 31387 - DNA, 696 bp, Triticum aestivum
  Clone ID: PAT_TA_31387
gagaaggtgctggtggtgagcgtgacgtgcagcaagcagcgcgacgccatgaccaaggtgtgccgcgcgctcgaggagctccgcctcagggtcatcaccgccaacatcacctccgtctccggctgcctcatgcacaccctcttcgtcgaggtagatgagatggaccgcttccagatgaaggagacggtggaggctgctctctcgcagcttgattccatggggagcccgccgcttagttcgatgagctattagggatcactgctacggtcactagtggctggtcgcctattttcacctcacctagtttctcttttgcaaggccaatattatatactccctccattcagatttactcgtcgtggttttagtttaaatttgaactaaaaccacgacgagtaaatcggaacggagggagtatatcttatgtaatgtatgccagaattttgcaccttttttttgcaacacccatttatatgtgtggatcgaggtgactgcttttttttggtacgaggcaataactcaagggatagataaataggctaggtgtgctctggacctcatgtgtaaaggtcttcatgagcatggcatgatatgcttctggactatgatatatctatggtgataaataacaaggtgattactttatatgagcgtgtataagaaatgtagtggcagttttcttgccgttctccatgc

SEQ ID NO: 31388 - DNA, 1277 bp, Triticum aestivum
  unsure (1)..(1277): unsure at all n locations
  Clone ID: PAT_TA_31388
ttgatttgcatcctcccgtcccctctcacacgagagccccaaagctagaagaggaggaaggataccgccatggggagagctccgtgctgcgacaaggcgagcgtgaagaagggcccatggtcaccggaggaggacgccacactcaagtcctacatcgagcagaacggcaccggcggcaactggatcgcgctgccacagaagattggtctgaggaggtgtggaaagagctgccgcctccggtggctcaattacctccggccgaacataaggcacggtggattctcagacgaggaggacaggatcatcctcagcctctacatcagcatatgcagcaggtactggtacagttggtctcacctgtcttgtcaattgtatgatcaactcagctgtaggattagctgcaaactggtaggcaggcacatgggtgtagtacaatctattacatgctatctactccctccgttcctaaatacttgtctttctagagatttcaagaagtgactacatacgacgcaaaatgagtgaatctatattttaaaatatgtctacatacatccgtatattgagtccatttgaaatgactagaaagacaagtatttgggaacggagggagtatatatcaactcccaggaaaccatacagtagcacatcaaaatttcgtctccattgttgagagttcactaacctacaaccggcaatcacgcggtacatacccagtacacacccagcattgtcgctcagcaccaacacccaacccaacaccatcagacccggaagtttagtcgtgcattttacccagaagcttcagtgccagtgcctcctgctgcgcgagaaggtccccgcccttagctgcatcgccaccttcatcatcgtcgctgttgtttaagtacttctttttacccttggaggacatgttctggtttctgtccgactctgagccactgtcgtcagacaccgcatctgtttcctcctgtcgcctgcgcttcagtttcatcttcttctcaaacttcttctcgtgcaaactcttcttgtgctgggccttgtcctccttgtcatcctcctgcatttctctcaagcatctctgcatacctctgcaaaattttatcctttgttaatcaacgttcttcctgggcccaacttncttccggntaaaagaannaaagggggattaatccgcaattggcccctcaatccgtccgtaacctccnggccgccgaacaacgcctaaatncaattccccncnggccggccaatggggggggcggggaacaatccaa

SEQ ID NO: 31389 - DNA, 1057 bp, Triticum aestivum
  Clone ID: PAT_TA_31389
cgtccggtttgggactgttgctttttgcactactcatcgggaacatgcaaaattttctccaagctcttggaagccggaaactagagatgcaacttatacggcgtgatgttgagcagtggatgagccatagacgactgcctgaagatttgagaaggagggttagacatgcagaaaggttcacctgggcggccactcaaggagtaaatgaagaggagctcttaagtaatttaccagaagatattcaaagggacatacgtcgacatttctttagattccttaatagggttcgattgttcaccttgatggattggcctatcttggatgctatctgtgataaattaagacaaaacttatatatcagtggaagtgacattctttatcaaggtggccctgttgacaaaatgatcttcatagtgagaggcaagctagaaagcatcagtgcagatggaagcagggctccgttacaagatggagatgtatgtggagaggaactcctcacatggtacttggaacactcttcaacaaataaagatggcgggaaaagtagatttcatggtatgcgtttggttgctatacgtaccgtgcgatgcttaacgaatgttgaagcttttgtacttcgagcaagtgatctcgaacaagttactggacaatttgcacggttcttgcgtaatccaagagtgcagggggctatcaggtatgaatcaccctactggaggaccatcgctgcagcgcgcatccaagtcgcgtggaggtatcgtaagagacgactaaagcgagctgaaagatcaaggccaagcgaagaacccgatcgtataccgggtacatgttctcagtatgcttttcagcctggacagagggggtgatactctgcctaagtaggtagtactaactattggttaacagttgtccatctccaactgctagaaatcctgaaatccgtgcgggacacaactcttcggttctctgatcttgtacttccaaatgtgtgaaactaatctctttgtatatatagatataatatggctcaaaaaaaaaaaaaaagtcgacgcggccgcga

SEQ ID NO: 31390 - DNA, 1152 bp, Triticum aestivum
  Clone ID: PAT_TA_31390
ttttttttttttttttttttttttactgaacaaactgttgaatttcattcacagaaccagattggatagttgttcagttcatcatgtgaagtgcgcactcaaccaaacgagagcatgttccatagttacattattatctatatatatcgaccttaataatatactgaagcatagattcgatattatccacagttccacaccacctacccacgacgaagcgcagcgaagcttatactcccacaaattgcatcgccgagctcacctctcgcgctttctcttcaacgggagcagcttcttcaccttgtctgagcttctgttcaccgattctgtgtcttctacgcggcggaagccaaggtgcgacgacaagttctccacttcgactttggcgacatcctttctcactcctatgtcggtgatgtatctaccggcacagtacatcccggctgtgacagtggccattccaagcggaccggcagcaaaaatcttgaacggggtggacagaagagctgccagtggcacgccaatggcggaagatgcttgcccgctcaccccaatgccagcctcatccacgggtacaagtccagtcttgcagtagagcgcaaagtcctcgcaattcttctcgaatatgtcgtaattgccaaacccattctgaagcaagtgcatagctctccggaccacaacctccgatgggtctgattgggcaatggtgcaggttcccccacgaaattttgcaagggaaaattgcaggtggcactccgtactcgaagcagtagagggagccattgccaagaaagcaatccaagcaggtgagtacgaccccactatcggccagctgaaaaccacagtctgggaatgttgggcactctgatgaagcctgtgagatcaggccagagatgaagttggatgaatccgaagattcaacttccttctttcgtgtaaaatggaccactttgcttcctccaacataaataccgtggtgggagtaggcgtagacggccctccaggtgtagatgtggtcgccgggcctgacctccgaccgctccacccggttcgacagcagccccatcctccccgccgccgccgccgccgcccccaacgctctcctccgcgctgtcggtgcgtcgccgtggcttctcctcgctctctctcctg

SEQ ID NO: 31391 - DNA, 604 bp, Triticum aestivum
  Clone ID: PAT_TA_31391
atagtgactgaaatattacagatggctacattgatacctttacagtcacaacctatgatcttcatccagttttcggtcacgaaattccctatatatattaaaaaaaaggaagaaacgctccatagcatcatagttgcaggcgctggacaaaatcatgaccgatgaatgttacgaatggctgcatttatacttttacagtcaaaatccatgatcttcatccagttttcaaagtctccaatttccttgaggaccgagttgaccgcgttggaggcggcgagccactggtcgctctgcttcctgtaccgcgcgatggtcccgagcagcgcgcgggcctcgagctcgatgcgcttctcgttgacgaagagctcctgcaccccgccgtcgacggcctccacgagatgaccggcgacccgcgccgcgctccgcagggcgtccttcttcgccctctcggtttgttggcgctggcggagggattggtggtggtgttgctgcatgatgtggagaagcgccgattccagctgcccacccgccgccggccccgccgctgccttggctccttccatctttctccgattctgagcttttttttttccttttttttttc

SEQ ID NO: 31392 - DNA, 527 bp, Triticum aestivum
  Clone ID: PAT_TA_31392
agttttttttttttttttttacccaactggactttcccccacatgagctcacacacattttgaggacatacacatgcatggcaagaacacaaagagaaagaagaataagaagaagccagctactagctacatccatgaatgaataatggaacaatccgtgaccagccgattggcatgaacgattgtttctgattccctttctcttgtccgaggaatcgaacaacagatgcatccatcccctaaacctagaatgaacgaattgcccaaatcgcagcagcaacggccgatccaacagcaaccacgatttagcttgtgcttgacgaggactcgaggttcatgaaagaaaccattttttccatcactggctggcatttgtgagtgccagtgcaatggtccgcggatggccgtcatttcgagccgacgccgagcgtgagctcaagctcctcgggcggcgacctcgtggatcctctcccccttcccaagggcgtcaccctcccctttgtcgaactcgaactccggggcgcttt

SEQ ID NO: 31393 - DNA, 1052 bp, Triticum aestivum
  Clone ID: PAT_TA_31393
gaggctcactctcagggtcgggcttctcttcactgcaactttttcttggcaagccttcctcctcgcaggctcgcccacaccacaccatccaccggctccgcctccgccttcacccgccattccggaaaggcgcggctgctggtctctctagggttcgtcggcccggcgcgggggtgcggcgggggacccgtgcttctgcttccgcaccgagagtatggctggaaggcacaccattgttctcgtgcaaccatctccaaacaaagcgtccagaacttttatggacttcagttcactcaaccaagcactggatggtatctgtgcccgttatgaaaagaaaatcatggatatcaacccgatggccaggaacttcacttatgacatcaccgacctctacaatttcatcgatggcctagcggacatcagcgcgcctagtgtatgatcatcaactccaagcttttttgccgtatgacaggcagtggataaaacagaagatgttccagcacctcaagaaccaggcacggcagtagccagccgctggttctgattaacaaaagcaagtgtacaaggtggtatctgtctgttgtttgtagtttcgggttggtgtgagagatctagggttcatgtgctaattgtaagagagaagacgatcgatttgcttggctatctgccatttctgatgcgacaccgacacaccgtagtactccctccgttcctaaatacttgtctttctaggcatttcaacaagtgactacatacggagtaaaatgagtgaatctacactctaaaatatgtctacatacatccgtatgtgttagtcatttgaaatgtctagaaagacaaatatttaggaacggagggagtaacacataacatggcttttatttctctagatagaatacctagcggcgctagatcatactcgcttgatgtgatagcattcttcagtacagtcgaatctatttctagaatcacctgattacaccccattgatgaggtgatttgcaccgcttggagaagagctcgagcttcagcttgaagagcatggtcgaccc

SEQ ID NO: 31394 - DNA, 656 bp, Triticum aestivum
  Clone ID: PAT_TA_31394
ctttccccgtctaccacggtaggtggagaagaagcacgggagcacgccggcgcgacgcctgggaggtcgatgtggaggcggcggatcggacgagcccgacgagaggtccgccggggaactggagctgcagcgccgccggcttttcctcccaatttcttggagcggagctggagcgatgtcgccgccggcgtcgtcgagccgtcgaggcacctactcctcttgtgcaccgtgattttccttctcatccatgttggccgcgagggtttctgccccgccgccgggaagccgtgcgcggagtctgcacattaaggtgttggggacgccaaagacagagaagaagggcaatggagaagccgatttgtcgttggttagagatatacttttgatgagatgatgaagatggagaaggaaggcaaccgaaacgggcgaagagaggtggatagaaagtaattctaaaaaatacagtattagtcgcatcacacggtagagggagttgctcggtccatacccgtagttgctcaaaaaacctgatgcatcgttttttatacttgtgtatataatgcatctatatgtatatgtgtgtgttactgccacctataaaaaaaaaaaaaaaacccccgcgtccgcccacgcgtccgcccacgcgtccgcggacg

SEQ ID NO: 31395 - DNA, 908 bp, Triticum aestivum
  Clone ID: PAT_TA_31395
tccatcgaaccgccgcaaccttctccgaccgagcagcagctgcgagtgcgagttcgagcccaagttcgacgggcgatcaatggcacggtcggagctggtcatggcgttgctggtggcggtcctcgccgccggctgctgcgcgtcggccggcgccgtggcgtacctctccaagctgcccgtgaccctcgacgtcaccgcatcccccagccccggccaagttctccacgccggcgaggacgtgatcacaagtgacgtgggccctcaacgcgtctcggccggccggcgacgacgccgcctacaagagcgtcaaggtcagcctctgctacgcgccggcgagccagaaggagcgcgagtggcgcaagacccacgacgacctcaagaaggacaagacctgccagttcaaggtcgcccagcagccctacgccggcgccggcggcagcgtcgagtaccgcgtcgccctcgacatccccaccgccgcctactacgtgcgcgcctacgcgctcgacgcctccggcacgcaggtcgcctacggccagaccgcgccccgccgccgccttcaacgtcgtcagcatcacgggcgtcaccacctccatcaaggtcgccgccggcgtcttctccaccttctccgtcgtctccctcgccttcttcttcttcattgagaagcgcaagaagaataactaagctcggaaccgtacgtggcaaggtgttcgtccgtgcgccacttcttcttctcgtcctttgcaaacgtacacacaatagtacgtactgtacatgtaagagagtagtgttgggtgttccctttttggggactcccgtgattgttgatgttgtacctcttcattgtataatgttatgcatgtttgattttttgaaaaatgaaacatgtctatgtttgatcaagtttagta

SEQ ID NO: 31396 - DNA, 576 bp, Triticum aestivum
  unsure (1)..(576): unsure at all n locations
  Clone ID: PAT_TA_31396
ataacataacataacatattcgtaggtagcgattacatgttagtagattgctccactaactacttagtacttccctagaatcatggagccctttattaggagacgcctagtgaaaaccctatgaatgaaaagaaacacaaatgacttggaatagtaaattgaagagactagaaatgtgtgataggctccgattctaacttgttcgaaaaagaaatttaggggtatccggcactgccagatccggacccgctacctccaccgttgccgaaaccaccattgttgctgccgccaccgccgccacccgttccagcaccggttccggtggcatagccttgcccataggaaccagtgctaccagtctgtccgcccccaatgccagagccagatttcccaacgagccacacgggttctcacgctggatcgtggtctgacacacggcaagctgatcggtcgtcagcatgtcgtcgcncagtgctcccgcgcgaagacgctgatccagtgaaatatcacaaactgaggacggacatatgagtatgatacaagtcggatcgcatctgcgttctctgggcgcacact

SEQ ID NO: 31397 - DNA, 751 bp, Triticum aestivum
  Clone ID: PAT_TA_31397
agtctgtaaaagacaaatatttatgaacggagggagtagcatagcatacatacatacatacattctttgatttacaacaaaaaaagaaacaattacatagtatattgatcattactactttttgaaataaactggtcaatatgtgacaccttcttcataatcttggattgcatgccatcgacagagaagagaagagcacatctccaggtctcaactgaaaagagcaggccaaaccatagccaaaatccaaaaacaaccccagcagtcacacagtagtacagccactggtcctccccttcaccagttttctcatccgaagcaggcgaagtagttggacaatcggctagaggaaatccgcaaaggccggaattgttccggtaaaacgaaggttcagtcaacgtctgcatctggctcccaccaggtatcctgcctgacaaatgattgttggagatgttgaatatgctgagcgttgacaagaacgagatgctctgtggaatgtgtcctgaaagctcattacatgatagatcaagaaactcgagattcttcaaactaccgacatctccagggatgccgcatgacagatgatttcttgacaggttcagaaatcggaggccgtaaaggttggttagctcgtcagggatgcactgagacaagaggttgcctgacagatcgatgccggtcaataaccggatcgttctttggaagatgagctcctggcccttccagattatatcgattctatcctgatgac

SEQ ID NO: 31398 - DNA, 2006 bp, Triticum aestivum
  Clone ID: PAT_TA_31398
aatttaagcatcgaaaagcggaagtggaggagcacaactggcggtcgacagcgaggcgccgacgacgactcccaggttgaaatcctattgaatttcagggacgggggagaggaataaaaacgaggagagtcgacactcgacagacaggtggcgagatcccccgaagccgtccgtactctcgcagcagatcggccggcggaagccagcaggatggaggtggcgtcgctgtaccggcgggtgctgccgtcgccgccggcggtggagttcgcgtcggcggaggggaagcggctgttcgcggaggcgctgcagggcgggaccatggagggcttcttcaacctcatctcctacttccagacgcagtcggagccggccttctgcggcctcgcctccctctccgtcgtgctcaacgcgctcgccatcgaccccggccggccgtggaaggggccctggcgctggttcgacgagtccatgctcgactgctgcgagcccctccacaaggtcaaggccgagggcatcaccttcggcaaggtcgtctgcctcgcgcactgcgccggcgcccgtgtccagtccttccgcgccgaccagaccaccatccacgacttccgcgcccacctcacgcgctgcgcctcctcccaggactgccatctcatctcctcctaccacaggagccccttcaagcagactgggactggccatttctcaccgatcggcgggtatcatgccgagaaagacatggcgctcatcttggatgttgcgcgcttcaaataccctcctcattgggttccattgacgcttctctgggatgccatgaacacgactgatgaagcaactgggcttctcagggggttcatgcttgtatcaaggcgcagttcagctccttcattgctctacacagtgagttgcggccatggaagttggaaaagcatggcaaagtattgtgtggaagatgtgcccaatctactgaaggatgagagtctagacaatgttacaacacttctgtcccgcctagtggaatctctcccagccaatgctggagatttgatcaaatgtgtcattgaagttaggagaaaagaggaaggtgaatcaagcttgagtaaagaggagaaagaaaggctttttttgaaggaaaaagtattacagcaaatccgtgatactgatcttttcagagtagtccacgaactgcaatatcccaaggggctatgtggtagttgctcgtcttcaagtgatgaagattcgcttgccgagattgcagccactgtgtgctgtcaaggagctgcattcctatctggtaaccttgtatctagagatgggttctgctgccgagaaacatgtatcaaatgtatagaagcaaatggtgatggactaaagactgttatctcaggaaccgtggtatctaaagggaatgaacaggctgttgatttgcttttaccaacatcctcgtcaaaaacaagcttatgcaattcaaacttgaagagcaagattgtcaagtatccatcaagcacagatgttctaactgtcctactgctggttttacagcctaacacatggcttggcataaaagacgagaacgtgaaagctgaatttcagagtcttgtttcaacagacaatcttcctgatcttcttaaacaggagatactgcatctaaggcggcagctccattatttggctggttgtaaaggacaggaggcatgtcaagagcctccatccccttagggacgctgctgcgacaatctgctcacttggttaggagataaggcccttggagatcccacgagcatactatcgaggcaaaaatatatgattcaataaacagacttacttcgtgaggtaggaggacatactaaggatcaaagtaataggattttgagagagtattggagccaagatagctggtaacatcctggttaccggtctcttttggttcactatatatgtaaattcttttgcgtttatattattttcttcgactatgtaaaaaaaaaaaaaaaaaaaaaaaaaaaaaaaaa

SEQ ID NO: 31399 - DNA, 884 bp, Triticum aestivum
  Clone ID: PAT_TA_31399
tcgcgatctagaaccacagatcaccgagctatcatctgtccgtgtgtgctagctgctaattctctaatcgatcatgggtggaggccacgacatgcacggcggccacaacggcggcgtgaagggcttcgtgaacggcgggaaaggccacggctacggatcgtcatacggccaggggcacggctacggcggtggccatgtacagggctaccagcagggctacggcggccatggccagagctacgagcacgggtacggcggccatgctcagcacgggcacggcgcctacgagcacgggtacggcggcggacatgcgcagcacggccatggccacgggcacgggtacggcggacacgtgcagcagcacggatacggcggcggccacgcgcagctcgggtaccctcctgctgccggtgcctaccctccgcacggcggataccaggcgcacggctacgcgccggcggcctacccctcccacggggcgcaccacggtcacatgggatcgtaccacaccgggcatggcggcgggcaccaccacggcggcaagtaccacggcggcaagcacggcggcaagtaccatggcggcaagcacggcagtaggtggtgaagtactgaagtggctagctgcagccattgctcgcgcgctctacgacgtccacgtacctgcgcccccccatggccagttacgctggcgtatctccatcatctgccttagttgattcagcatgctctgttgtagcgacgaataatgtcttacattattggaacgaagggagtatattatatattgtattaccaaaataaagagctacgcgtgcatgggcataatgtgtgatatgtaatgatctgtgtaccctaaaaaaaagtaatgatctgtgtggtgacgt

SEQ ID NO: 31400 - DNA, 2075 bp, Triticum aestivum
  unsure (1)..(2075): unsure at all n locations
  Clone ID: PAT_TA_31400
aaaaattcctagtttaacatggtgcactttattttgctgtttaacaactttaaatatggtttagggcagagcagcaccaaatctataatatggacatgaggattttccataattgttgtttgttgttccggccacatttaaacttgcctaaatagttagtttacttatgcttcacctcttgccatgttaatcaacatttaatattgttgggtacataaccgagagagaactaaataattgatgtggtgttccgtcaatgtgcaactcgttgcatattgagctccacttaatttgtagtgttgtttgttgcattttgccattccatgcctcatttaaaccggacatgcatcatacttgtttgtgcatcatgtcatgtttctgtgatggttgtttactatgtttcttgcttctttccgggttgcttctctcattagcttcggtttcgttccagagttttgaggatccgttcaactacgtccgtttgtcttcttcatggactcgttcttcttctttgcgggatatcaggcaagatgaccataccctcgaaatcacttctatctttgcttgatagttgttcattctaccgctatgtcgcgccacctaccacttgttatatcatgcctcccatattgccatgtcaagcctctaaccctccttcctagcaaaccgttgtttggctaagttaccgcttttgctcagcccctcgaatagcgttgctagttgcaggtgaagttgaagattgttccatgttggaacatggatgtgttgggatatcacaatatctcttatttaattaatgcatctatatacttggtaaagggtggaaggctcggccttttgcctggtgtttttttccactcttgccgccctagtttccgtcataccggtgttatgttccttgattttccgttccttacgcggttgggttataatgggaaccccttgacagttcgccttgaataaaactcctccagcaaggcccaaccttggttttaccatttgcactaacaacctataaccttcccttgggttttcgcgagcccgagggtcatctttattttaaaacccctcggggctattgctcctctgagtgttggtccgaaatgggcagcccgcggggccacctcggggcaacttgagggttggttttactcgtagcttgacctatccggtgtgccctgagaacgagatatgtgcagctcctatcgggatttgtcggcacatcgggcatctttgctggtcttgttttaccattgtcaaaatgtcttgtaaaccgggattccgagactgatcgggtcttcctgggagaagaagtatccttcgttgaccgtgagagcttatgatgtgctaagttgggacacccctgtagggtttaaactttcgagagccgtgcccgcggttatgtggcagatgggaattcgttaatatccgattgtagagaacttgacacttgactgaaataaaacgcatcaaccgcgtgtgtagccgtgatggtctcttttcagcagagttcgggaagtgaacacggtcttggtgttatgattgtgcgtaagcagtttcaggatcacatcttgatcacttctagcttctcgactgacgcgttgcttctcttctcgctctcacttgcgtatgttagccaccatatatgcttagtgcttgctgcagctccaccatattaccccccttttcctacctatgagcttaaatagcttgatctcacgggtgtgagattgctgatccccgtggtcacagatctaccaaaacagatgcaggtgccgaggataccagcgcaagtggcgcaactgactcaaagtgggagtttgacgagattctgggcgttacaagttccgtttccagaagatcagtaacggnccatccggacattcgggatctacattgggtgctccttcattgggattgaccgtaccngctagatgtattngaagagtagacttaattattatgttgaatgggatgtaccaatccntaccatctgtcataagggatggganatacctctcanaaacacatcgtanctcaatctctcaactgaaaacccactgggtannttaacg

SEQ ID NO: 31401 - DNA, 976 bp, Triticum aestivum
  unsure (1)..(976): unsure at all n locations
  Clone ID: PAT_TA_31401
gtgagattgttaattaatggtttacttaaggtggcaacttaaacacacatctgggtggattgaggcacctggttattctaggattgcctgtctaggcacctgggtaatccaggacttgcctgttttcttttggaccgccacccaggctcaaagggatcatgagatttttcaaactanaaacttcagtgtgcagccacaagccattatgggctctggcataaataagtaaattgtgataatcctttttcatgatgggctagtaaatgtaggggattgtaggtgtaccggcctatctatcggttaaggggacctcttcggaaagactgtgtctcggtcatccgtttctcaaacatcatacagtgcgagaaatacaacggaggcgatcgagtcttgtggggaaaagggcgcaaacctctgcagagtgtacaaactaatcatggttagccgtgtccccggttatggacatcttgagtatctagttcttggattatcccgttgatctcgtcatgttactttaattaatcttgttgtgttaatgatgatacttaattggggattgagatgctgtcaaccattctcaatgtttaacaaccaccatgatagttaaataaaatttattcctttgtagtagggaaaaattggcttttcgcaaaaacattataaccatagagcttttccaccagccatatatgcatgtagtgatagcctttattcatcattttctctagtggtgtgaatttgccagtacattcaatgaactgacccgtttcgggatgcaacgtctcatgttgcaggtttcttacaacgagtaagtgatacattagggttacgattgtacactaaactttgccgttggtgttgatgggaatccacaaccttgttgcttccgctactttggatttgcggtactagtatttacgttacttttacatgtgatctacctctggtataaatcctcgagtactgtgtgcgtcag

SEQ ID NO: 31402 - DNA, 1098 bp, Triticum aestivum
  Clone ID: PAT_TA_31402
ttgggtgagtgtaccattgatagattgtgagattgttaatttaatggtttatttaaggtggcaacttaaacacacatctgggtggattgaggcacctgggtattccagtgattgcctgtttttctttatggaccgccacccaggctcaaagggatcgtgagattattcatactagaaacttccatatgcagccacaagctactacaggctctagcatagttgactaagtcgtgcgaactcttacagtggtagactagcatatgtaggggatgtaggttggtactgtctacccgatcgtaaggtgctagcgctttgaaagactttgtctcggccatccgtttctcaaacatcatgtagtgcgagaatcccaacggaggagatcgagtcttgtggggaaaagtgcgcaaacctctgcagagtgtataaactaatcatgattagccgtgtccccagttatggacgttttgagtatctagtacttggattttcatgtgaatctcatcatgttactttaattaattttgttgggttttaaagatgatgcttaattgggattgagaatgttgtcaaccattctcaatgtttaccagccaccatgatagttaaataaaatatattcctttgcagtagggaaaaattggctttgcgcaaaaacattttaaccatagagcctccaccagcctcatatgcatgtagtgatagcatttacctgttcatcgctctaccgtgttatcttgccagcatattccatgtgctgacccatttcgggctgcaacatatcatgttgcagacttttcagacaaagagtaaggtgtgctaggtcgttgtcatgcactcagctatgccgttggagttgatggactcactttatcttccaagccttccgctgttatcttatttagatggccttaagccatatttattgtaataagttctcttctgagacattcgatgtaataagtgtgtgattgctactctgttataaatccttcaagtattgtgtgtgtcagcattaccgatccagggatgacacttaagcacagagattcgaccgtttgaggttggattgctacaatttagatgttcccgtcgacccgg

SEQ ID NO: 31403 - DNA, 756 bp, Triticum aestivum
  Clone ID: PAT_TA_31403
gagccataataataaaactcggatgacaacactttctcaaaataatcataacatgatattacaaaatggtatctcgctagccctttctaagaccgcaaaacataaatgcagagcacctttaaagatcaaggactgactaaacattgtgattcatggtaaaagagatccagtcaagtcatacccaatataaaccaaaagtaatgaatcaaaatgacagtgttctctccagcgggtgcttttaataagaagggtgatgactcaacataaaagtaaatagataggccctttgtagagggaagcagggatttgtagaggtgccagagctcgattttgaaatagagatagaataacattttgagcggcatactttcgctgtcaacacaacaactatgagatggctgtatcttccatacaaaatgcattataggcagttcccaaacagaatggtaaaggtttatactcccccaaccaccaacaagcatcaatccatggcctgctcgaaacaacgagtgcctccaacatacaacatccctgggggagttttatttaattattttgatttgctttgctctttttggatcatgggcctgggcatcccagttaccggtcctttctcgtgaatgaggagcggagtccactcctagtgagaataacccacctagcatggaagatataggtagccctagttgtaacatgagatgctcgagcatacaaaatagaatttcatttgaaggtttggagtttgcaacatacaaa

SEQ ID NO: 31404 - DNA, 1522 bp, Triticum aestivum
  unsure (1)..(1522): unsure at all n locations
  Clone ID: PAT_TA_31404
gaattcggcacgagcatctgccagcccgcgtccagcctccccaccgagccggtccatgaggcctggtgagcctcatatccagcgccctcaccctgtgcactcatgggccatctagattcggcccgatgtggtttttttcccctgctgcggatttgtctaatttccagagaaacatgttttgcagaaaaccccctagacatcatgcatataataactccacaacagtgcatcggtttaaaatgatttaaacatgtaaattgcttagaatttcatcaagtttcaaaatatgcaactttcatccatgtttaaaatgctgtttgattaaatttgctcaaatgccatgttaaaatgatttatttcataactaattaaccgtagctccgaacttaataaactttatatgtaaatggggtagaaaaatgcctagtttaacatgatgtacttatctttgcatgtttaacaaccctaaaatatggtttagggcagaacagtaccaaacctaaaatatgcatatgaggattttccggaattgttgtttgttgttccggcctcatttaaacttgcctagataggtagttttcttttgcttgacctcttgccatgtttaacaacatttaatattgtttggtacataaacgagagagaactaaataagtcatgtggtgtttcgtcaatatgcaacggagttgcatattgagctccacttaatttgtaggattgtttgtgcattttgccatgccatgcctcattaaaccggacatgcatcatacttggttgtgcatcatgccatgattatgtgatggttgtttactatgttgtttgcttctttccggtgttgcttcttcgggttggttctgataatgtcgtgttgtgaggattcgttcgactacgtccgtttatcttcttcagggactcgttcttcttccttgcgggatctcaggcaagatgaccataccctcgaaataacatctatctttgcttgctagttgctcgctctatttgctatgccgcgatacctaccacttgctatatcatgcctcccatattgccatgtgaagcccctaacccacctttcctagcaaaccgttgtttggctatgttaccgcttttgctcagcccctcttatagcgttgctagttgcaggtgaagattaagttacttccatgtttggaacatggatattgttgggatatcacaatatctcttatttaattaatgcatctatatatttggtaaagggtggaaggctcggccttatgcctggtgttttgttccactcttgccgtcctagtttctgtcataccggtattatgttccttgagttggcgttccttacgcggttgggtgatttatgggacccccttgacagttcgccttgaataaaactcctccaagcaagggccaaccttgggtttaccatttgccgcctaagcctttcccccgggttttcgcgagccccgagggtcaactttatttaaaccccccggggcaagngntcctctgaggggnggnccaaaactaa

SEQ ID NO: 31405 - DNA, 681 bp, Triticum aestivum
  Clone ID: PAT_TA_31405
tccggcacgaggctctccttccttcgccgccgcccggtaagtcctcgctcgtgccccatagccgtcgcccgcatcatggccgaggcaagctggagctcgtccccgccgtaggatccgccagcagcgccccgcctccctccaaacgctccgggtgatcgtcatcgtcttcttcctgctgtgaaccaaggtagaagacgccaagtccggctacttccccgtcgtcctcttcctcccctgcttcgcggacagcagccccgccaggttcagagctcgtccgcgtcgccgcaagctcgtccgcgtcgccgcaggctcgtctccgtcatcgtcttcttgtcctagggtaaggagagccgggagatgagtacatgcacgaggaacctgttgagaacgcttacgaggatcaagccttcgactactctgagaaccttgcagatgcaggtgccgaggataccagcgcagatggcgcaactgatctgaagtgggaatttgatgaggcccttggtcgttactatgtatcgtttccagatgatcagtagtggagtccagtcggggcgatcggggatctagcatttggggttgtcttcttttcatttgaacttgaccgtagccggtctatgagtgtattttgaatgatgtatgatcttaaattatgtattgtgtgaagtggcgatcgtaagccaa

SEQ ID NO: 31406 - DNA, 504 bp, Triticum aestivum
  Clone ID: PAT_TA_31406
acatggttttagttcaaatgtaaattttgaactaacattaccagtatattacattgttacattgttacattactttcataaatccaaacaaattatgtgtatcgtcctggccccacgctacacacacctaattattgcgtgtggacggagaagcacttgactcagctgtaatttattttcaccctaatttaactagtaggaatgatagtagaaataattcagacacgcagacgagtcgatcactgcgactcccaggcgccgagcgcgcgcctgggcgtgggcttgggcttgctgtcggtcttgacggggtaggacgcctccatggcgatgccgcagagcccgcccgcggcgccggaatccttctccaccctgatgtagccctgctccccccacgacggcccccacgagttcttcaccgtccagtacgccttgccgtcctctgccacgccgtacccgaccaccgcgacgccgtggtccagctccgtgccgcagctgccgtgaagg

SEQ ID NO: 31407 - DNA, 872 bp, Triticum aestivum
  Clone ID: PAT_TA_31407
cccccccttcgagagagattagggcttggcggcggctccgtgtcgtaaagcgcgatgaaactttctctctgatttttttctcctcggacgtgaatatatggagttggagttgaagtcggtggaggtcccagggggcccacgagatcggggggcgcgcccaggcggagggcgcgccccccaccctcgtggacagggtgggccccctcgccttgattctttcgccaaaaattcttattaattccaaaaagtgcctccgtggatttccaggacattccgagaacttttcttttctacacataaaacaacatcatggcagttctgctaaaaacagcgtcagtccgggttagtttcattcaaatcatgcaagttagagtccaaaacaagggcaaaagtgtttggaaaagtagatacgttggagacgtatcaactcccccaagcttaaacctttgcttgtcctcaagcaattcagttgataaactgaaagtgataaagaaaaacttttacaaactctgtttgctcttgttgttgtaacatgaaaagccagcattcaagtttcagcaaatattatgaactaaccatactcacaataacacttaggtctcacaattactcgtatcaatagcataatcagctagcgagccataataataaaactcggatgacaacactttctcaaaataatcataacatgatataacaaaatggtatctcgctagccctttctgagaccgcagaacataaatgcagagcacctttaaagatcaatgactgactaaacattgtaattcatggttaaagagatccagtcaagtcatacccaatataaaccaataataatgaatgcaaatgacagtgtgctccccagcgggtgc

SEQ ID NO: 31408 - DNA, 942 bp, Triticum aestivum
  Clone ID: PAT_TA_31408
tacggattatccggaattgttgtttgttcttccggtctcatttaaacttgcctagttaggtagtttcattatgcttcaccccttgccatgtttaacaacatttaatattgatcagtagcaataccgagagagaactaactaattgttgtggtgtttcgtcaatatgcaacttgttacatattgagctccacttaactttagtgttgtttgtgcactttgccatgccatgcctcattacactggacatgcatcatacttgattgtgcatcatgacatgattatgcttgtgtgtttaccatgttgtttgcttcattccggtttgcttctctcgttagcttcggtttcgttccggagttgtgaggattcgttcgactacgtccgtttgtcttcttcatggactcgttcttcttccttgcgggatttcagttgcaggtgccgatgagaccagtgcaggtgacgcaaccgagctcaagtgggagctcgatgaagatctcctccgttgtgttgtttcttttcttgttgatcagtagtggagcccagttgggacgatcggggatctagcagttgggttatcttcttttcttttggcttcgtccgtagtcggacctatgtgtgtactcttgaatgatgtatgatttatttaagtacttgtgtgaagtggcgattgtaatccaactctatttatccctttcttgttcataacttgggattgtttgaagatgacacttcttgcgacaaaaccacaatgcggttatgcctctaagtcgtgctacgacacgtgggagatatagccgcatcgtgggtgttacaagttggtaatcagggccatccccgacttaggagccccctgcttgatcgaatcgctgacgttgttgagtctagaacaaaaatgttttcagtcttaggattatatatatcggagagtaggattctcttttactc

SEQ ID NO: 31409 - DNA, 686 bp, Triticum aestivum
  Clone ID: PAT_TA_31409
ctggtgccgaattcggcacgagaatgcaaaatcagaaggggagttgctttccgagctggtttctgtgctgaaaatgtctgaggccagatatacagttctttatgcttcccaaccctatggtttactggagaacccttccaacctaccattagccaggtatcttgcagagaagaccaacactactactaaatctggcctaggcaaatgtgatggggagtgcctagtaaaatcaagttttttggaaggaacttttgttggactaagtgctgctgatcattttgatatcaggactctgctgtatgatgggaatcgataccccctcgaggtttgaggctccccaggattaggtaggagagtacaaatcccattgaagcctgccagatatgaaagctcaaggcaggcgtgagaaatacaaatagtcaatttgcactgtggatataagttgcctcatatatgttaccaagacacgtgaccgattttttgtataatattattacatctcggacgtacgaccgaccagaaagatgtagctgagcttaaaacatattcttatgccaggcttgtgttataccaacccccccgcttcaggcattttctgtgaataacctggaattcaggtaaccagtaaaatggcattgtccatgaataaaatcttttttatttattaaaaaaaaaaaaaaaaaaaa

SEQ ID NO: 31410 - DNA, 869 bp, Triticum aestivum
  unsure (1)..(869): unsure at all n locations
  Clone ID: PAT_TA_31410
agcaaacacaaatcgncgagcgatcatctctccgtgtgtgctagcttctaattctctaatcgatcatgggtggaggccacgacatgcacggcggccacaacggcggcgtgaagggcttcgtgtccggcctcgttaacggcgggaaaggccacggctacggatcgtcatacggccaggggcacggctacggcggtggccacgtgcagggctacggcggccatggccagagctacgagcacgggtacggcgggcatgcgcagcacgggcacggcggctatgagcacgggtacggcggcggacatgcgcagcacggccatggccacgagcacgggtacggcggacacgtgcagcagcacggatacggcggtggccacgcgcagctcgggtacctcctgccgccggtgcctaccctccgcacggcggttacaagcgcacggctacgcgccggcggcttacccttctcacggggagcaccacggtcacatgggatcgtaccacaccgggcatggcagcgggcaccatcacggcggcaagtaccatggcggcaagcacggcggcaagtaccatggcggcaagcacggcagtaggtggtgaagtactgaagtggctagctgcagccattgctcgcgcgctctacgacggccacgtacctgtgcgcccccgtggccagtcttcatcatctgccttagttgattcaccatgatccgttgtagccacgaataacgtcttacattactggaacggagggagtatattatactatactacctaaataaaaagctacgcgtacatggacatgatgtgtggtatgtaatgattcttgtaccttacaaaaatgtaatattctctgtaatggcgttcacaaacaa

SEQ ID NO: 31411 - DNA, 902 bp, Triticum aestivum
  Clone ID: PAT_TA_31411
cggcacgaggggcatcgagccgtcttgccttttagcatcatcttagcgtgtgtgctgctaatcctcttttcaagcatgggtggaggccacgacatgcacggcagccccaacggcggcgtgaagggcttcgtgtccagcctcgtcggcggcggcaaaggccacggctacgggtcatcatacggccaggggcacggctacggcggcggccatgtacagggctaccagcagggatacggcgggcatggacagagctacgagcacggttacggcggacatgcgcagcacggacacggcggctacgagcatgggtatggcggcgggcatgtgcagcagggacacgggcacgggtacggcggacacgggcagcagcacggatacggcggcggccacgcgcagctcgggtaccctcccgctgccggcgcctaccctccgcacggggggctaccaggcgcacggctacgcgccggcggcctacccttctcacggggcgcaccagggtcacatgggatcgtaccacaccgggcatggcggcgggcaccaccacggcggcaagtaccacggcggcaagtacaacggcggcaagcacggcagtaagtggatcaggtgaagtggcgcgcgtggcagcgcgtacgtgcgtacgtgcgcgcctccatggcatgccttagttgatcattaaccatgctctccgtatactacctaaataagggcgacgcatggtgtgtgacactatgtagctttcctttcagctggtaatgatgtgtgtggtgacctaataagtctgtgtgtggcttagtacgaaaaatttgtgtttgctgtactgatgaaatacaaggaatatgtaccaccgtgctcggccctgtgtgtactgatgcatcaaaaaaaaaaaaaaaaaactcgtgccg

SEQ ID NO: 31412 - DNA, 1199 bp, Triticum aestivum
  Clone ID: PAT_TA_31412
ccctacatatagtcctggctttattgcgaatttcaaatgtatccactggcagcacatgcacagaagtaacatagttcacatgttctactacttactactccctccattccgaattacttgtcgcaggtatgggtgtatctagatgtattttagttctaaatacatccatttctgcgacgagtagtttggaacggaggaagtactttcagtgcgccatgttcttttggaggacgcaaacaccttacatacgactcaataaacccactgaaaaacccaagaaacacatccacagtggttggctgatccactacttgacagttgtgagttgtgacctacatgcatcttcccctgagcagcaatgcatattcatggcctgatctctaggcctcttcttcgagcagcatccgatcaaagtgccacaccccgtgccctttgccgattctcctaagctgcgtcacgtactcggagatcttcttcacggcatcaacctgctcctgaagaaattgactctcaacaaagtcactcagctgaggatcgttgcaccttgttgccacagagtgcaggttgtgcagcttctcattcacgagcttttcaagagctagagccaactccattgcgtacagagcatcgcctttctcagagtggtcgaactctgtcaatggggtgacggtagactggagcctcacccgccctccacgtctgttctggtactccataagcatctccgcgtgttccctctcctcgtcgctcgattccttaaacttggcaaagcccttaagggcaacattgtcccggtcgaagtaggcgtagagggagtggtacgcgtacgaggcattgtactccacattgatctgctcgttgatggcggcctcgcattcgtcgacgaacttttgcctggcgagcgactggccctcggcctgcggcacgagcgaaagctcccccttgagctcctcgaacggctggaacatcacaccgctgaggagcacctcctccttgttccccttccccgcagccctgcacgccgtcgccgtcgacgaccctttcgccaacggcggcagcctcgcagaaccgtgggccggtcctggcgcagagagctggctagccgcggcgacggcggccggagacgacgcaatcctaagaaacatctcgaagagaagaagatgggggcgagtgtggggaactggaagtgggcgcggacg

SEQ ID NO: 31413 - DNA, 1140 bp, Triticum aestivum
  Clone ID: PAT_TA_31413
ttttgtccaaaagtcgtatatatagttatatgcaagaaagtatatatatattacatatggtaggagcatgcattccgaaaaataaacatatagtaatatacaagcaagtcaattacatgccaacaccaatcggtgtgacaagtagaatgatcaagcgtttgcttcttccgttgataacttggtgtatgcagtatcccccagctggctgtcgatgttctccccgcgctcgtagtagaacgcggtcatggcgcagacggcgaacaactgcacgagtgccatcagaacggcgtacacaaaacctaagagcaacccaacagccacgctattacccgcgcaagtcctcgcgagcgtgtgcaccggcgaaaggacgctggccagggcacaggtaacggcgacgtacagcacgacctgccacttcttccccttcgccagcctacacgccctgcctaaggcggctgcgccgtggcagccgggctcggccaccgccacgacgacgctgaaagagcagacgaaggagaagtacacgaaggagatggccgcggagaggactagcagcgacgccaggatgagcaacacgaagtactgcttcgccatgagaacaacgagaagcgcccccatcaacgccagaaacacgacgtagacgatctccaggatgtagacgaaggcgagcgtgagcaggggggccttcagctgcgccttagctttcccgaggagctcgctgaaggtagcacgctgctcgccggagtacgtcaagacggtggcgaagaggaggaggatccggacggcggagctgacgacgaccgcgaacagcaggtaccccgcgcttacgagcaggagctccttggtgtcatcctggatctcctgtacgagcttggcgtactccaggctgccggggtcggtgccgtttagcgccttgacgtcgagctggatctcgtcggcgaggggctggacggccaggtcgctgccgaggaggagcagcgtggtggaggcgacgatgatggcgccgaccgctatgaagagcttccggttgcgggtcgggaggaggaggccttcctttaggaagttgaagaacgaaggtgccgtgctttgactggtcgccatggctatgggttgtgtaagctagcttcaaatgaccgagat

SEQ ID NO: 31414 - DNA, 517 bp, Triticum aestivum
  Clone ID: PAT_TA_31414
gcaaaagcctccacctcctcctttcgattcgtcatcgtgcccgtctaccgatcgagcaggaggctcgatccccagccatctctgcgtccgaacctctcctctgctccttcccgcccgtgcatcgccgtctacttggctggaggccaccatgagcagcaaccaggcgcatgagttccaccatgcgccacctagggcatcatcgtcatcaaccagcttgcaggtgccgaggataccatgcagatgacgcaaccaagctcaaggaggagttcgatgaagttcttgtcctttgtcttgtttcgatctatttgatcagtagtggagcccagtcgggatgatcggggatctgtgtagcatttggggtagtcttattttactttggttccgtggtcggaccttgattgtatctggatgatgtaatgctttattcatgtaattgtgtgcaagtggcgattgtaagccaactatgtatctctttcccttatgtattacatgggttgtgtgaagattaaaaaaaaaa

SEQ ID NO: 31415 - DNA, 491 bp, Triticum aestivum
  Clone ID: PAT_TA_31415
tttagtgtgcaatcaatttatataggatataataagggagtaacatatctccattctccagcaagtgaaataacacagaatcctcacaggtcccaaacattacatttcagtctagaacatactcatggtaaactcgtttactggacacagacgctgctaaatccaacattccggctacaagagtaaaggcatgatctggcttgatgattcttaaacctcctggacgttcaaacctggggggagggactgcttgagcttgttggccttgtcggtgtcgtggacgcagagggtgtagaggtacctggagcagcggaccttgaacttgacggcgtccttggtcctcttgatccgcaccgaccgcgcgtccttccgccgcgccgtcagcaggaagtccttgatctcgtggatctgcttcggcatggtggacggcggaggtcggctgcgcagatcctaggggggggaggcggcggcggcgggggggaaagagcagg

SEQ ID NO: 31416 - DNA, 793 bp, Triticum aestivum
  Clone ID: PAT_TA_31416
aggaattcggcacgaggagcgacagagcaacagaacagagaagagcagcagccagcgacgaaccagaggggagaagaaagaaagaagtcatggacccggacatgggcgagaacttcgcatactactgggagacgcagcgctacctcgagtcggaggagctcgttgacagcatcttcgtcggggcgaccgaagacgccatctcgtactacgactccagctcgccggacggttcccactcgtcctcgacgccgatgggggcggccatgccaggggcggggatggggatgagcggtactggggcgaacaagaacatactgatggaacgccgaccgccgccgcaagctcaatgagaagctctacacgctccggagcgtcgtgcccaacatcaccaagatggacaaggcctcgatcatcaaggacgcgatcgagtacatccagcagctgcacgcagaggagcggcagatggaagcggaggtgtccgcgctcgagtccgccaccggcgcggaggatgactacgacggcggcctctccgtggaccaggtctcctcggcgcagaggaagaaggtgaagcgcgctctctcggtctcgtccatgaacgacgcgctgctcgccgcggcggcggcggtggcctcgccgcccgtggaggtcctggaactgcgcgtgtcggaggtgagcgaaaaggtgctggtggtgagcgtgacttgcaacaggcagcgcgacgccctgaccaaggtgtgcccggcgcttgaggagcttccggctcagggtcattaccgccaacataaccttcgtt

SEQ ID NO: 31417 - DNA, 1691 bp, Triticum aestivum
  Clone ID: PAT_TA_31417
tatttcataacttaataatcgtagctccaaatttaataaactttatatgtaaatggggtagaaaatgcctagtttaacatggtgcactttattttcttgtttaacaacaataaaatgtggtttagggcagaacattaccaaattgataatatgcatatggggattttccggaattgttgtttgtccccggcctcatttaaacttgactagatagttagtttacttatgcttcacctcttgccatgtttaataacattgaatattgttgagtgcataaacaggagaggactaaataagtcatgtggtgtttcgtcaatatgcaactcgttgcatattgagctccacttaacttgtagttttgtttgtgcactttgccatgccatgtttcattaaaccggacatgcatcatacttggttgtgcatcatgccatgtttatgtgatggttgtttaccatgttgtttgcttcttttcggttgtgcttcttctggatagttcctgtgacgttgggattgtgaggattcgttcgactacgttggttcgtctacttcatggattcggtcttcttcctagcaggatcttaggcaagatgactgtcaccttgggatatcacttctatctttgcttgctagttgctccgttctatcgctatgctgcgctacctatcacttgttttaccaagcctcccagtttgccatgtcagcctttaacattttcacccttcctagcaaaccattgcttggctatgttaccgctttgctcagcccctcttatagcgttgctagttgcaggtgaagttgaagattgctccatgttggacaggattatgttgggatatcacaatatctcttatttaattaatgcatctatatacttggtaaagggtggaaggctcggccttatgcctggtgttttgttccactcttgccaccctaatttccgtcataccggtgttatgttccttgattttgcgttccttacgcggttgggtgatttatgggacccccttgacagttcgctttgaataaaactcctccagcaagggcccaaccttggttttaccatttgctaccacctatccccttttcccttgggttctgcagactcaagggtcatctttattttagaccccccgggccagtgctccttcgagtgttggtccgaaccgagcagcctgcggggccacctcggggaaacttgagggttggttttactcatagctagtctcatctgagtgtgccctaagaacaagatatgtgcaactcctatcgggatttgttggcacattcgggcggtgttgctagacttgttttaccattgtcgaaatgtcttgtaacctggatgccgagtctgatcggaatgtcttgggagaaggaatatccttcgttgaccgtgagagcttgtgatgggctaagttgggacacccctgcagggatttgaactttcgaaagtcatgccctcggttatgggcagatgggaatttgttaattttcggttgtagaaaacctgaagttgaccttaattaaaacacatcaaccgcgtgtgtaaccgtgatggtctcttctcggcggggtccgggaagtgaacacggtgttggagtaatgcttcacgtaggttgttctaggatcacttcttgatcatagattctcgaccatgctttgccttctcttctcgctctcttttgcgtatgtta

SEQ ID NO: 31418 - DNA, 509 bp, Triticum aestivum
  Clone ID: PAT_TA_31418
gaggaaaaatagtgtgcaatcaatttatataggatataagggagtaacatatctccattctccagcaagtgaaataacatagaatcctcacaggtcccaaacattacatttcagtctagaacatactcatggcgaactcgtttactgaacacagacgttgctaaatccaacattcccgctactggtaaaggcatgatctggcttgatgcttcttaaacctcctggacattcaaacctggggggagggactgcttgagcttgttggccttgtcggtgtcgtggacgcagagggtgtagaggtacctggagcagcgcaccttgaacttgacggcgtccttggtcctcttgatccgcaccgaccgcgcgtccttccgccgcgccgtcagcaggaagtccttgatctcgtggatctgcttcggcatggtggacggcggaggtcggctgcgcaaatcctagggggcggcggcggcggcggcggcggcggggaaaggagcagaggggggagattc

SEQ ID NO: 31419 - DNA, 1343 bp, Triticum aestivum
  Clone ID: PAT_TA_31419
aaattcttattcatagagtggtttggataaatcgacagaaatcacgacaaatcatattacaggactctagcgaagggcggtcaaacgcagcatactgtaaggtctcatcgaaattagatctccttgaatgcagcaaagaggtccccgctgatgtagtcattgtccacgaggctgaccaagtaatagctcttctgaatctgctctagcaactccctggacgagtcgccctctgggaacaggcaggcccatcccctggaccagatctcaaacgcttcatctttccagaccatgaagctcgctgagtcaacgacggtaggctggatgatctccttgccggggaacacaccccatgtgacagcattcacggcgttcgcagggatgtttgagatcgattccccttccttgttcacggcgatgtacgtgagggaagggaatgccttgctcctcgtgccgaattcggcacgagaggcaccgagccgtcttgtcttgtagcatcatcttagcgtgtgtgctgctaatcctcttttcaagcatgggtggaggccacgacatgcacggcagccccaacggcggcgtgaagggcttcgtgtccggcctcgttaacggcggcaaaggccacggctacgggtcatcgtacggccaggggcacggctacggcggcggccatgtacagggctaccagcagggataccacgggcatggacagagctaccagaccgggtacggcgggcatgcgcagcacgggcactgcggctacgagcacggctacggcggcgggcatgcgcagcacgggcacggcggctacgagcacgggtacggcgggcacgggcagcagcacggatacggcggcggccacgcgcagctcgggtaccctcccgctgccggcgcctaccctccgcacggcggctaccaggcgcacggctacgcgccggcggcctacccctcccacggggcgcaccagggtcacatgggatcataccacaccgggcatggcggcgggcaccaccacggcggcaaataccacggtgggaagtacaacggcggcaagcacggcagtaagtggatcaggtgaagtggcgcgcgcggcagcgcgtacgtgcgtgcgcgcctccatgacatgccttagttgatcattaaccatgctctccgtatacgacctaaataagagcgatatatgcatggtgagtactatgtagctttcgtttcagctggtaatgatgtgtgtggtgaactaataagtctgtgtgtgtggcttagtacgaaaaaatcgtgacctctgtactgatgaaaaacaaggtatttgtcccgtgccaaaaaaaaaaaaaaaaaaaaaaaaaaaaaaa

SEQ ID NO: 31420 - DNA, 1229 bp, Triticum aestivum
  Clone ID: PAT_TA_31420
tggtttacttaaggtggcaacttaaacacacatctgggtggatttgaggcacctggttattctaggattgcctgtctaggcacctgggtaatccaggacttgcctgttttcttttggaccgccacccaggctcaaagggatcatgagatttttcaaactagaaacttccgtgtgcagccacaaaccattatgggctctggtatagttgattaagtcgtgcgaactcttacagggtagactagcagatgtaggggaaagtaggtgtaccggtctatccatcgaaaggtgctagcgcttctgaaagactgtgtctcggtcatccgtttctcaaacaccatgtagtgcgagaaatccaacggaggcgatcgagtcttgtggggaaaagtgcgcaaacctctgcagagtgtataaactaatcatgattagccgtgtccccggttatggacatcttgagtatctagtacctggattatcatgtgaatctcaacatgttactctaaaattaattttgttgggttttgtttaacgatgatgcttaattgggattgaggatgctgtcaaccattctcaatgtttaacaaccaccatgatagttaattaaatttattcctttgaagtagggaaaaattggctttacacaaaaactataaccatagagctttccaccagccaaatatgcatatagtatagctgttgcattccattactctctatgtgttacattgcctagcatattccatgtgctgacccgttttcaggctgcaacgttcatgttgcagacttttcagacgatgagtaaggtgcctttaggtcgtggttctatactcagtgatgccgttggagttgatggactcacttatgttgcaagccttccactgttatcgttattagatggccttaagccatatttattgtaataagttctcttttgagacactcgatgtaataagtgtgtgattgctactctgttataaatcctccatttgtactgtgcgtgtcagcatttctgatccagggatgacactggtgcacagcagcacaggccatttgaggtctggtcgctacaaagttggtatcagagcacacgttgactgtaggacacgaccactaagcttaagccctagaaagcttctctcttctcatttctgacccctctccactttctactcttttaggaatggcgaatgcaaggagcaatttcatgcaaccagatgaagacacgccgtttg

SEQ ID NO: 31421 - DNA, 1185 bp, Triticum aestivum
  Clone ID: PAT_TA_31421
cttcgcaaggggaagaaatcacccggcagccctaaggaatcggacgacgacgcctcctcggtggattccgtcaagagctggagccatgtggagaccaccccgacaccggttgaggcagaggtactccaaggtgagctccctgttcggcaacaaggcgaaccttggcaagccccatcaatgaagatgaggtctggagctgatcacacactgcctgaatccccttcggcttcggcctcctgggtcttcgtcgtcgttgatcgacaagatcgaagcagtccatctggacaaagacaaaccatcacccaatgccagtgcggtgatcaggcacacaccaaagaaatatggatctctgaatagtagacttatgaaccagtaccttggcactggagcacaattgggggattcaacctcggggcagcggtctatacgatcgcttctgtcagtagtctgatcaaatgagttagatgatgccactcaaatttgacaccgcttgtttcccttgatttgatgcttaaaagatacagctactttggtagcaccagacagacgacttcagtccccattgtttgagtcaatgtggtgttactggtgagcccaagatagctaatcatatctactccctccgttccaaaataattgtctttctagagatttcaacaagtgactacatacggagcaaaatgagtgaatctacactctagaacacgtctatatacatccgtacgtagtctgcattgaaaactctaaaaagccttatatttagaaacggagggaatagaaagcactgagcactgccaccctcccaatcactcttcggcagcttgataatggcggaaaatatccaggaaggcggtaggtctgtcccttggacatcctgcataattcccatctttcggtagtattcgatgctgtcccaggagcgtctcctcccaatgccctcggattccagcccagattactcaattttgctgacgaaatcggcgtgacaggagagttttgatgtgcatcggccttgcattttacatagttatagtcagggtacgtcttctttagcagctccagcaaagcctttgtgctaatgtaatttggtgcgcagatatatctcccggatgattctggtttctcatatatcagaagcaaagcatcggccacatcacggacatgaactatttgcaacggcgtgtc

SEQ ID NO: 31422 - DNA, 1791 bp, Triticum aestivum
  Clone ID: PAT_TA_31422
ctcggctggctcttatatggccataggaccagctgcacctgcatactgcatgctctgctctgcatggacaacctcgccgtccggctcccgtgcaccttgccgccggcagccgtgatccttgcgcgcgccgtctgatcgcccgggtgtctggagctgtttctgcggcagcgcctgcgggtcaccgccagcacgggcgatgcctcctcacgcgccttccttcgagaagagctgctccggcgaccggcaaagacaggaggcaggagggcagctgctgcgaggcccggggcagcggtggtcgtcgttccacgggcgcggggcggagcagcggcaccagctgccaaagcagaggcccaagacgcagccggacctgctcgccggcgtgaggggcaggagcttccgcgccgcggacggcggcgagccgctggccgagctggcggtccggaggacgccgggcaaggtgctggtgaacgtgaccgtgcagaggagcctgtggccgctgcacgtcatggcgtcggcggactggagcgtggcggaccttgtggccgccgccgtggggatttacgtgaaggagggcaggcggcccttgctgccggcgaccgacccgtcgaccttcggcctacactactcccagttcagcttggaaagtttggacccgagggagaaggtgatggagctagggtcccggagcttcttcctgtgccccaggtcctcctcggccgccgtccagacctcctcgtcctcctgctcctctgccggagcaagcggtgtcaggaagttgattaagttgtgcgaactcttacagtggtagactagcagatgtaggggaaagtaggtgtaacggtctaccctatcgtaaggtgctagcgcttctgaaagactatgtctcggtcatccgtcttctcaaacaccatgtagtgcgagaaaccaaacggaggcaatcgagtcttgtggggaaaagtgcgcaaacctctgcagagtgtataaactaatcatgattagctgtgtccccggttatggacatcttgagtatctagtacctggattatcatatgaatctcatcatgttactttaatttaatctgttgggtttaatgatgatgctcaattgggattgagagggtgtctaccttctcaatgtttaacaaccaccatgatagttaaattaaatttattcctttgcagtagggaaaaattggctttatgcaaaactgtaaccatagagctttccactagtcatatatgcatgtagtatagcatatttctgttcattactctctatgtgttacattgctagcatattccatgtgctgacccgttttcgggctgcaacgttcatgttgcagacttttcagacgacgagtaaagtgccttaggttgtggtcttatactcagtgatgccgctggagttgatggactcacttatcttccaagtcttccgctgttatcgttattagatggccttaagccatgtttatcatacttagtctctttggagatattcgatgtaataagtgtgtgattgctactctgttataaatcctccatttgtactgtgcgtgtcagcattactgatccagggatgacactggtgcacagcagcacagaccatttgaggtctggtcgctacaaagttggtatcagagcacacgctgactgtaggacacgaccactaagcttaagccctagaaagcttctctcttttcatttctgacccctctccactttctactcttttaggaatggcgaatgcaaggagcaagttcatgcaaccagatgaagacacgccgtttg

SEQ ID NO: 31423 - DNA, 686 bp, Triticum aestivum
  Clone ID: PAT_TA_31423
cccacgcgtccgccatggatggtcagagaagggatgaatcttacaaaagaacaaagaggagagtccagtaacacatcaaaaggagatgaaaaatcagaagtcaaagatgagaagaaacaggactcaaaagaagatgagaagagtttacaggatgaataccttaaggcatattatgaggccctcaagaaaagacaggaggaggaagatgcaaagagaatgcagcaggaaggccaggcattttcttctgaaattcattctgagcggcaggtgggcatgaaagccaaacgtgaggatgagaatggtgaggatgagggtgttgaatgggaagaggagcaacctgcagggaatacatcggaggagccatataagtttgtggatttgaatgctgaggccccagaatctggcgacgacgaggaagatgagattgactgggaagaaggttaaagtacagcggcaagttgctccgtcttgaattcatgaagtcagttcaaagtgggatgttaaatgataataatattgccagatgtatgcatgtccaggcttggctgcaaataacatttttctcccagatttgtgaaaagtcactataatgtgaagtttgatattgacgaagtatgatatcgacatccatgtgacgttaagaaattcaaaagaatttgaaagagcttgtaccctttagccctttc

SEQ ID NO: 31424 - DNA, 1327 bp, Triticum aestivum
  Clone ID: PAT_TA_31424
aggaattcggacgaggcgacagagcaacagaacagagaagagcagcagccagcgacgaatcagagggaagaaggaagacatggacccggacatgggcgagaacttcgcatactactgggagacgcagcgctacctcgagtcggaggagctcgttgacagcatcttcgtcggggcgaccgaagacgccatctcgtactacgactccagctcgccggatggttcccactcgtcctcgacgccgatggggtcggccctgccaggggcggggatggggatggacggcactggggcgaacaagaacatactgatggaacgcgaccgcccgccgcaagctcaatgagaagctctacacgctccggagcgtcgtgcccaacatcaccaagatggacaaggcctcgatcatcaaggacgcgatcgagtacatccagcagctgcaggcagaggagcggcagatggaggcggaggtgtccgcgctcgagtccgccaccggcgcggaggatgactacgacggcggcctctccgtggaccaggtctcctcggcgcagaggaagaaggtgaagcgcgctctctcggtctcgtccatgaacgacgcgctgctcgccgcggcggcggcggtggcctcgccgcccgtggaggtcctggagctgcgcgtgtcggaggtgagcgagaaggtgctggtggtgagcgtgacgtgcagcaagcagcgcgacgccatgaccaaggtgtgccgcgcgctcgaggagctccgcctcagggtcatcaccgccaacatcacctccgtctccggctgcctcatgcacaccctcttcgtcgaggtagatgagatggaccgcttccagatgaaggaggcggtggaggctgctctctctcagcttgattctacggggagcccgccgcttagttcgatgagttattagggatcactggtacggtcactagtcgctggtcacctaatttcacctcacctagtctctctgttgcaaggctaatattatatactccctccgttcctaaatacttgtctttctaggcatttcaacaagtgactacatacggagcaaaatgagtgaatctgcactttaaaatatgtctacatacatccgtatgtagtagtcatttgaaatgtctaaaaagacaagtatttagaaacggagggagtatatcttatgtaatgtatgccagaattttgcacctttttttgctacacccgtttatatgtgtggatggaggtgactgcttttttcgtacgaggcaataactcaaggggtacataaataggctaggtgtgctctggacctcatgtgtaaaggtcttcatgagcattgca

SEQ ID NO: 31425 - DNA, 1122 bp, Triticum aestivum
  Clone ID: PAT_TA_31425
ttgggcccattggccttgtacgacctagatttagttttaggctgccttgggacatcctcccacctccttggccgccaccccttgctcctatataagtagatccatctagtagcttttcctggggatttgtttagttaaaagttagccaacgcaacttcgtgtacttcgtttgtgtccaacgaccagaccaagaccgctttcggatccccacctttatcaatacttcatacatatttgcaatattcagattgcttttatcatattcttgctcgttcttcgattgcttgcaggaatagaccttcgtggtcaggctgatcgtgcttccggcatcgttagtaacctcaggagattggtttagcgattgctaaggcgcaacgtcgtgcacgtttgtagtcggatcttcaaagtcgactccaccaaatcgatagttatcatctcatcaaaagatcgggacaccctcgcctctatcaagtggtatcagttttcaggttgctcggtgagaatttccagttatccctagattagattttttttcttacctattgtccaagaaaaagccacaaaaaaagttagatctattcatccttttgtcctagccagtctgagcctttgcaattttcttttcattgtttgcattattgaattatcggttgcatcgtcgtgtcgagttgctggtcttagtgtctagttcgtttagagtttcgagttctgttcacataagtcacgtcgccgctgcatcgttatcccttccgctgtccaccacccatccatcaatttccaccacgtgctacccatcattcattgtcataatcatagttcagatcgttcacatctttgcttgatccaatctgcatcttatctagtttgttttggaaagagagagagagaaaaagagacagagaaaaaaaagagaaaaatgtaaaaaaatcagaaaaagaaaaagaaaaaaaagtgtgaggaaaagaagagagagaaaaaaacaaaattcggatctatctagactcaatctcgtagttgaattcggattggaatctgttttgtgcactgttcagtaaaacaggcataacttcctcatatgaagtctgttttggctccgcgagtacctcggccgcgaccacgcta

SEQ ID NO: 31426 - DNA, 1972 bp, Triticum aestivum
  Clone ID: PAT_TA_31426
catacatctcatcaaaatatcaaacgaataccaagttcacatgactactaatagcaagacttcacccatgtcctcaggaacaaacgtaaccactcacaaagcatattcatgttcataatcagaggagtaataatatgcataaaggatctgaacatatgatcttccaccaagtaaatcaattagcatcaaatcatgcaagttagagtccaaaacaagggcaaaagtgtttggaaaagtagatacttggagacgtatcaactcccccaagcttaaaccttaccttgtcttcaagcaattcagttgataaactgaaagtgataaagaacaacttttataaactctgtttgctcttgttattgtaaacatgaaaggccaacattcaagtttcagcaaatattatgaactaaccatactaacaataacacaaaggtctcagaattactcatatcaataacataatcagctagcgagccataataataaaattcagatgacaacactttctcaaaataatcataacatgatataacaaaatggtatctcgctagccctttctaagaccgcaaaacataaatgcagagcacctttaaagatcaaggactgactaaacattgtaattcatggtaaaagagatccagtcaagtcataccaatataaaccaataataatgaatgcaaatgatagtgtgctctccagcgggtgctttttaataagaagggttatgactcaacataaaagtaaatagataggcccttagcagagggaagcaggtatttgtagaggtgctagagctcggttttaaaatagagattgaataacattttgagcggcatacttttgctgtcaacgcaacaactatgagatgacgatatcttccatgctaaacaaattataggcggttcccaaacagaatggtaaagtttatactccccctcctccacaagcatcaatccatggcttgctcgaaacaacgagtgcctccaactaacaagagtcccagggggagttttgtttgcaattattttgatttagttcgcataaagcatgggactgggcatcctggtgaccaaccatttatctcgtgagtgaggagcggagtccactcctcttgagaataacccgcctaacatggaagatacagacaaccctagttgatacatgagctattcgagcatacaaaacatgatatttttttgtaggtttagagtttggcacatacaaatttacttggaacagcaggtagatacagtatataggtaggtatagtggactcatgtggaataactttggggtttagggagttggatgcacaagcagtattcccgcttagtataggtgaaggctagcaaaggactgggaagcgaccagctagagtgcgacaacattaatgaacatgcattaaaattaatcaacatggaatgcaagcatgagtaggatataatccaccatgaacataaatatcatgaaggctatgttgattttgtttcaactacatgcgtgaacatgcgccaagtcaagtcacttaaatcattcagaggaggaaaccaccctatcataccacatcagaaccaatttaatagcatgttggcacgcaaggtaaaccattataagctcctagctaatcaagcatggaacaagaaactatgatctctagttgtcattgcaaacatgtttattcataataggctgaatcaggaacgatgaactcatcatatttacaaaaacaagagaggtcgagttcataccagcttttctcatcccaataagtccatcctatatcgtcattattgccttttacttgcacgaccgaacgatctgtataataataagagtgcacgtgcattggactaagctggaatctgcaagcattcaactcaagagagaagacaagtaatatgggctctaaattaaataaacaatcattcatataagagccactaagcattttcaatattgtcttctcgacccccag

SEQ ID NO: 31427 - DNA, 641 bp, Triticum aestivum
  Clone ID: PAT_TA_31427
ctcgagtttttttttttttttttttttattaaatatttgtctttttagagatttcaacaaatgacgacatatgaagcaaaataagtgaatctacactctaaaatatgtctatatacatctgtatgtggtagatcatttgaaatctacaaatatttaagaacagaggggtacaagttttcatcatcatcgtgatactatttacaacccagatgcagcgaggcattaaacacgcagaactaccgccttgcctagttgggaccccagcagctgaggtacatgaccgtcctcatcccctcctcggccttctccgctcgccgcctctctgccacggccgccgcagaggcgggaagccgcttcgtgccttgcgagatcacaccaccaccgcgcatgttggccttggccttgggctgcgccgtgaacggacctgagagcgtagttccagcggcagaggccggcctgatccttgagcgcctccaccgcgccgacgctcatcgccgccatccacgacgccttcgccgcagccgccatgaactgatctgtgaactgctttggtagaggctggtctgtgaagcgtgtgatccctcccagtagatgattggtcagtagtagtggaagaactgagctgaagtgttggatgcttc

SEQ ID NO: 31428 - DNA, 1264 bp, Triticum aestivum
  Clone ID: PAT_TA_31428
tcggcacgagggacagcagggctgcattcgtgttcttctctctcgcccacattgagagcagaggccgtagccccggatgtcgtcggccgggagggcgagggccgcgagcctggcggcggtggcggtgcggatggtggtgggggcggcggcgcggcccgcgccgagcgcggcgctgatgatggcggcggtgcggggggaggacacggagttcgggacggcgttatggtgggcgtacgcggccttctccgccctcctagtgctgctggccgggatcatgtcggggctcaccctgggcctcatgtcgctcggccccgtggatctggagatcctcatgcgcagcggcaccgacgccgagaaggctcaagccgctgcgatccttccggttgtaaagaagcagcaccagcttcttgtcactctgctgctgtgtaatgcttgtgccatggaggctctccctatattccttgacaggattttcaatcctgttcttgctattatattgtcagtgacttttgttcttgcctttggggaggttatacctcaagcaatatgtactaggtatgggctggcagtgggtgctagctttgtctggcttgtacgcatcgtcatggtcattgcctatcctattgcttacccgattgggaagctcctagactttgctcttgggcatgaatctgcgcttttcaggcgagctcaattgaaagctcttgtttctatccatagcaaagcggctggtaagggtggagagcttacccatgatgagactacaatcataagtggagcgttggacttaactgaaaagaccgccgaagaagctatgacacctattgaatcaactttctctttagatgtggactccaagttggattgggaaacaattggtacaattcttgcccggggccacagccgtgtacctgtgtattcaggaaaccctagaaatgttataggtctcctgttggtcaaaagtcttctgacagttcgtgctgaaatagagacgccagttagtgctgtttccattaggaggattccaagggttccttcagacatgcctttgtatgatatactgaacgagtttcagaaaggaggtagtcatatggctgctgttgtgaaggcaaagcctaagaatgcaccacctcatgataaaactgaacctggttaatagaaataaagcccactcgatgcagccgaatgatacaccgtcaaatgcactggctcagttatcagaggatatggataatggtagtgtcattggtatcatcacactgga

SEQ ID NO: 31429 - DNA, 758 bp, Triticum aestivum
  Clone ID: PAT_TA_31429
gcggccgcgtcgactttttttttttttttttttttttaaaacaagcagtagcaaggcatattggttcaaaaagtagtaagcaagcactcagactaacaatgaaataacataagatacacgtaggtagcgattacatctcagtagattgctccactaactacttagtacttccactagaatcatggagccctttatttggaggcgcctagtaaaaaccctatgaatgaatagaaacacaaatgatgtgaaatcgtgaaatgaagagactagagtacatgatgtgctccaattctagcttgttcgaaaaggaattttaagggtatccgccactgccagacccggatccgctacctccaccgccgccgaacccaccattgttgctgccgccttcaccaccacccgttccagcaccggttccagcggcatagccttgcccataggagccagtgctaccagtccgtccgcctccaatgccagagccagaaccaactcccatactcggaccttgagctacgcctccaccctggccaccaccgttgccgctaccccctccacttgcattccccccagaagtgtcatcgctggcggcctgtccagctccagcgccattaccacctccatttccaccgtcaccaccaccgccgccgttaccaccaccgccagcttcagagtagctgtcaccaccagcagaaggagctacagccggggcagttgctatcccactctcaccttctccttggccacacctcctcgtgcaa

SEQ ID NO: 31430 - DNA, 1432 bp, Triticum aestivum
  Clone ID: PAT_TA_31430
ctcgctaaccctttctgagaccgcaaaacataaatgcagagcacccctgaagatcaaggactgtctagacaatgtaattcatggtaaaagagatccagtcacattcatactcaacataaattaatagcaatgcatgcaaatgatagcagttctctccaactggtgctttttaataagaggatgatgactcaacataaaagtaaatagataggcccttcgtagagggaagcagggatttgcagaggtgccagagctcgagttttgaaacagagataaataatattttgagcggcatactttcattgtcaacataacaaccaagaaatctcgataccttccatgctacatacattataggtggttcccaaacagaatggtaaagtttatactcccccttccaccaataagcatcaatccatggcttgctcaaaacacagagtgcctccaactaacaagagtcccgggggagttttgtttcaagttattttgatttgatttgcataaagcatgggactgggcatcccggtgaccagccattttctcgtgagtgaggagcggagtccactcctcttgagaataacccacctagcatggaagatacagacaatcctagttgatacatgagctattcgagcatacaaaacagaatgtttatttgaaggtttagagtttggcacatacaaatttacttggaacggcaggtagataccgtatatagacaggtatggtggactcatatgcaataactttggggtttatggaagtggatgcacaagcagtattcctgcttagtacaagtgaaggctagaaaaagactgggaagcgaccaactagagagcgacaacagacatgaacatgcattaaaattaaccaacactgagtgcaagcatgagtaggatataatccaccatgaacataaatatcgcggaggctacgttgattttgtttcaactacatgcatgaacatgtgccaagtcaagtcactcgaatcattcaaaggaggataccaccctatcataccacatcacaaccattttaatagcatgttggcacgcaaggtaaaccattataaactcctagctaattaagcatggcataagcaactataatctctaactatcattgcaaacatgttcattcataataagctgaatcaggaacgatgaactaatcatatttacaaaaacaagataggtcgagttcatactagcttctctcatctcaatcatttcatcatatatcgtcattattgccttccacttgcacgaccgaatggtgtgtataataataagagttcacgtgcattggactaagctggaatcttcaagcattcaactcaagagagaagacaagtaatatgggctctaaattaaatagacaatcatgcatataagagccactaagcattttcaatatggtcttctcgaccccc

SEQ ID NO: 31431 - DNA, 1686 bp, Triticum aestivum
  Clone ID: PAT_TA_31431
atggtatatcgctagccctttcagagaccgcaaaacataaatgcaaagcacctctgaagatcaaggactgactaaacattgtaattcatggtaaaagagatccagtcatacccaatataaattaatagtaatggatgcaaatgacggcggtgctctctaactggtgatttttaataagagggtgatgactcaacataaaagtaaatagataggcccttcgcagagggaagcagcgatttgtagaggtgccagagctcaattttaaagcagagataaataatattttgagcggcatactttcattgtcaacataacaaccgagagatctcgatatcttccatgctacacacattataggcggttcccaaacagaatggtaaagtttatactccccctccaccaaaaagcatcaatccatggcttgctcgaaacaacgagtggctccaactaacaagagtcccatggggagttttgtttgcaattattttgatttagtttgcataaagcatgggactgggcatcccggtgaccagccatttttctcgtgaatgaggagcggagtccactcctcttgagaataacccgcctaacatggaagatacagacagccctagttgatacatgagctattcgagcatacaaaacaggatatttatttgaaggtttagagtttggcacatacaaatttacttggaacagcatgtagataccatatataggtaggtatagtggactcatgtggaataactttggggtttaaggagtttggatgcacaagcagtattctcgcttagtacaggtgaaggctagcaaaagactgggaagcgaccagctggagagagacaacagtcatgaacatgcattaaaattaatcaacaccgaatgcaagcatgagtaggatataatccaccatgaacataaatatcgtgaaggctatgttgattttgtttcaactacatgcgtgaacatgtgccaagtcaagtcacttaaatcattcagaggaggataccaccctatcataccacatcacacccattttaatagcatgttggcacacaaggtagaccattataactcatagctaatcaagcatggcacacgcaactatgatctctaattgtcattgcaaacatgtttattcataataggctgaatcaggaacgatgaactcatcatatttacaaaaacaagagaggtcgagttcataccagcttttttcatctcaatcagtccatcatatatcgtcattattgcctttcacttgcacgaccgaacgatgtgtataataataatagtgcacgtgcattggactaagctggaatctgcaagcattcaactcaagagagagaagacaaggtaatatggactcttggttaaatctacaatcgtgcatatgagagccactaaacattctcaatatgattttctactctcgacccccaaagaaaagaaaagaaaagaaaactatttacacgggaaagctcccaacaagtaagaagaagaacgagaaatctttttgggttttcattttaattctactacaagcatggaaattaaactaactattttttttggtttttcttaaggttatcaaacacacaagaagaaactagaaaaagaaatttaaactagcatggataatacaatgaaagagtatgagcactgacgactagaatagtgtgtaaa

SEQ ID NO: 31432 - DNA, 1067 bp, Triticum aestivum
  Clone ID: PAT_TA_31432
gacaacgtgccagaaagggtcttgatgccccacagtatagggaactatagtagtcctttcgataagtaagagtgtcgaacccaacgaggagcagaaggaaatgacaagcggttttcagtaaggtattctctgcaagcactgaaattatcggtaacatatagttttgtgataaggtaattcgtaacgggtaacaagtaacaaaagtaaacaaggtgcagcaaggtggcccaatcttttttgtagcaaaggacaagcctggacaaactcttatataaaggaaagcgctcccgaggacacatgggaattatcgtcaagctagttttcatcatgctcatatgattcgtgttcgttactttgataatttgatatgtgggtggaccggtgcttgggtactgtactttcttggacaagcatcccacttatgattaacccctattgcaagcatctacaactacaaaagaagtattaaggtaaacctaaccatagcatgaaacatatggatccaaatcagccccttacgaagcaacgcataaactagggtttaagcttctgtcactctagcaacccatcatctacttattacttcccaatgccttcctctaggcccaaataatgatgaagtgtcaggtagtcgacgttcacataacaccactagaggctagacaacatacatctcatcaaaatatcgaacgaatacccaattcacatgactactaatagcaagacttctcccttgtcctcagaaacaaatgtaactactcacaaagcatattcatgttcataatcagaggggtaataatgtgaataaaggatctgaacatacgatcttccaccaaataaaccaactagcatcaactacaaggagtaatcaacactactagcaacctactagcaccaatcctggacttggggacaagaattggatacaagagattaactagggtttggagatgagatggtgctggtgaagatgttggtggagattgccctctcccgatgagaggagcgttggtgatgacgatggtgatgatttccccctccgggagggaagtgtccgcgacagaata

SEQ ID NO: 31433 - DNA, 1563 bp, Triticum aestivum
  Clone ID: PAT_TA_31433
cggcacgagccatcgctcatgctcgagcccctctgcctcgatccaccaggcgcctagctcgcagcaaccaacgcacaggagaggagctgcttgatccccttgaccccgacctctgcgccccacggcctcctccccgtcgccttggagcccgagtgtgccaccacctcctagcgccgctgccggcgacctcgccgtaccaggccaccccggccagccttcggccacctgcaggccaaccccgtcgccgctccttccctgctcctcttccttcctcctcctcccaaccttacctcgttttcccctgtctgttttctccatggacagggagcgccagggcatctgcttcaaacctctgcgccacccggagatcgtcgacgccggccagatccgacgcccttgggacccgcgtccccgccggacctccttcctctgcgccaagtcagcccaccatgccccgtttcgcctcgacctcgaccgaggagaacaagcagcactgctgccttcttcagttccgctcgcacgccacctcgccggagaacgttgtcctcgcccggatccccgcgccctgccatcttgtccatgccggcgagttcctcccgcgtcgtcgtcttctctgcatcaagccgcgccgccgtgccaagtcccctgcatcgcgcccagctgccggcgctcgaacctgcctgcttccacgacccgcgctcgcctccagaggaagagtcaacgcacgagcgtctcgtgcgtgttccagatccagtgaaccggcccagcctcccgaagcccagccgcttcttcgcttccagcccagtggcccgatcttcggtttcattccggagttgtgaggattcgttcgacttcatccatttgtcttcttcatggactcgttcttcttcctagcgggatctcagttgcaggtgccgacgataccagtgcaggtgatgctaccagactcaagtgggagttcgacgaggaccttggtcgttactatgtttcgtttcctgatgatcagtagtggagcccaattgggacgatcggggatctagcatttggggttgtcttcttttcttttggttccgtagtcggacctatgtgtgtactctgattaatgtatgatttatttatgtattgtgtgaagtggcgattgtaagccaactctttatcccattcttgttcattacatgggatgtgtaaagattacccctcttgcgacatgcctactatgcggttatgcctctaagttgtgctccggcacgtaggagatatagccgcatcgtggtgttatactttgataatttgatatgtgggtggactggtgctttggtactgtccttacttggacaagcatcccacttatgattagcccctattgcaagcatccacaactacaacagaagtattaaggtaaacctaaccataacatgaaacatatggatccaaatcagccccttacgaagcaacacataaactagggtttaagcttctgtcactttagcaacccatcatctacttattacttaccaatgaattcctctgggcccaaacaatggtgaagtgtcatgtagtggt

SEQ ID NO: 31434 - DNA, 1610 bp, Triticum aestivum
  Clone ID: PAT_TA_31434
ggcgcgtccgcacggttcttgcgcaatccaagagtgcagggggctatcaggtatgaatcaccctactggaggagcatcggtgcagcgcgcatccaagtcgcatggaggtatcgtaagagacgactaaagcgagctgaaagatcaaggccaagcgaagaacccgatcgtatactgggtacatgttctcagtatgcttttcagcctggacagagggggtgatagtctgcctaagtaggtagtactaactactccctccggtcctaaatatttgtctttctagagatttcaacaagtgattacatacggagcaaaatgagtgaatctacactctaaaatatgtctatatacattcatatgtgatagttcatttgaaatctctaaaaagacaaatatttaggaacggagggagtacatacaataaatcatccatcaaatggtacatacacaatctactttttttgtggaacatacacaatctaccagacaactgtgtgccggctaccaaggcctaccataagctccaggtatcgcataaagatgagagagagagaaaatgaaactacgaaggaacataaagatccccttttaagattcaggacgtggttcagcagctagagatggtcagtagacggtagcagcagcacggtttgtccctgtattacaacaggatgccacgacgagtatttcagttatacccatcaaatctgaatggtgtgcgcagcggagggttgacagctgggcgccaagaagcaagcagccacagtcctttggattatggaactcacattcgctgattaggttccacccttggatctatgtgccgaagacaaagccatgaaagaacctaaacaagcttcttccatattcaggaatctcaccgccatgcagaagatacaaccagctttctgttcttccatccaagataaatgacaccatctttctcctctagcttgtagtaactgttgtaatcatttaacagtgttctgatagtattgttcaccaatgcacttagggggtatggtctaaagccagccattgcaaacctagaccgccactttccaaatggttcgtgcctctccactctttctgcaccttcacatgcaattaaattgacaatatctcttgcaacacagtgctgctcagtgctcatcctcaccttgtcatccctagggcaagcaacatctattgcctcgaacatggctgtgtagtagtcaagggtctccatgtatctactgaagaatggggcagtgtttgtgttagcctcctgctctacaagagttaccaccctaggagacaggctcttaaccattctcaatatcctatcccggtggttttctatgcagacactctcatcaggagtatgatgcagctgatacgcaaagttgacagcaatagcctctcccattcttatatcgagatgttcaagtgtaacctcgtgactagctgcatttacggcattgaactcaaagggcagacaacatgactgggcaatgttgcataacctacgcccaactatatccagtccaccacctcgggcataagccgaatctgaatcatctataccagtaattcttaggtatggtggtccgctagccctcgcagcaagggcc

SEQ ID NO: 31435 - DNA, 1032 bp, Triticum aestivum
  Clone ID: PAT_TA_31435
ttttttttttttagaggcaaccagaataaccattagctttgtttttagacaaccttagctaggcatattgcttcggaaggagtaaccaagcactcacactaacaacgaaacatatcagaaatcataacataacgtattcgtacgtaggtagcgattacgtgttagtagattgctccactaactacttaatacatccactggaatcatggagccctttattaggaggcgcctagtgaaaactctacgaatgaaaagaaacacaaatgacgtggaatagtgaaatgaagagactagaaatgtgtgatgggctccgattctagcttgttcgaaaaggaaatttaggggtatccggcactgccggatccagatccgctacctccaccgttgccgaacccaccattgttgctgccaccaccgccgccacccattccagcaccggttccggtggcatagccttgaccataggaaccagtgctaccagtctgtccgcccccaatgcccagagccagaaccaactcccatgcttggaccttgagctacacctccaccttggccaccaccgttgccgctgccacttccattggcattgcctccagtagtgtcatcgctggcggcctgtccacctccagcaccattaccacctccacttccaccgtcgccaccaccaccgccagtgccagcacctccagcatcagagtagctgacaccaccagcggaaggagctacagacggggcaattgctatgccactctcagcttctcctttgccagcaccacttccagctccagatccgcttgacccatttgcaccgccacctgcacccccacccccaccctgaccatcagcgttgggcgtacccactgccgctaggggctgacgccgagccactcgaaccaacaccgttgccaccgccagagccggaaccggatccggatccgccttgagaaccaccgccagcaccattcccccctcctccaccagctcccttggcaaagttatacttgttattggcatctccaccaccctcgtgcc

SEQ ID NO: 31436 - DNA, 1964 bp, Triticum aestivum
  unsure (1)..(1964): unsure at all n locations
  Clone ID: PAT_TA_31436
ggccgccgccactccaccaaatcctcttcctcgggatctcccccactccaaatcagcagcaccaccttcccctcctcgattttgctaccgaaccaaccagccactcctgtcgatccaccaaccacagcgcctgcagcctcctccccgcctccgtccggccagcctcctcctcaccactggatcgaagccccgtgctccccaccacctcgccctcgcgagcacgaccaccggggcgccaccttgccggtcctctcgcgcgcccgatgctcaagctcctctgcccaggcgtcccacgcacctcaagccgtcgtcgtccttcgtccatggcctcctcctcctccaggccttcgctgcctcgtctcgctccagacctgctgccgtgctgccggcggcctggtccaagagcagatgagcgccgcccctccccttccccgtgctcttcctcccctctagttctttctctgtctctctctgatttctcctctgtctttttcttcaggcaatagttccgccatggcctggtagcacgttcccgccgctcggggatccgatccgcgcctcccctagccggatctggactcaggcgactccccgtgctccattccgccgttgccggtgtaccccacgatcgcctcgccggccttccctgcagcccgccgccgctccccttcaagtcccgcgcccctgcttcgtctcgctgcgggtggagcagcgagccaagcgcccagtcgccccaagcaaggacagcgccaagtcccgctcccgttgaccgctccccgcctgcgtcgcgtggcccagcgcctcctccctcgcctcgatctgggccttggcccatgttccggttacattacgattgtgaggattcgttcgactacgttggttcgtctacttcatggactcgttcctctttcttgcgggatctcagttgcaggtgccgatgataccagtgcaagtgatgctaccgaactcaagtgggagttctacgaggaccttggtcgttactatgtttcatttcttgatgatcagtagtggagcccagttgggatgatcggggatctagcagttgggttatcttcttttcatttggttgtccgtagtcggactatgtgtgtattttggatgatgtatcaatttattactgtattgtgtgaagtggcgattgtaagccaactctctttatcccattcttgttcattacatgggattgtgtgaagatgaaccttcttgcgacaaaacctacaatgtggttatgcctctaagtcgtgcctcgacacgtgagagatatagccgcatcgtgggcgtttcaagttgggtatcagagggattcccaacttaggagccccctgcttgatcgaatcactgacgttgttgagtctagaacaaaaatgttttgagtcttaggattatatatatcggagagtaggtttctttttactcctcagtcccttcgtcgctctggtgaggcatcttgacgtagatgttttgacttccgttgcctcaaatttcactaaaaaaaaatttagtatcacgcgggtatcttggaatcgttccgatggttttgtgacgagaacaatgttcttggtgcctcctgacatttaggggttgtggcagtgtcccggggagttgagctcccgaggtgttgtcgtcataattttatccgttgcagttctgggaatacctggantttgccaacatccgaaaactctgttatgcagctaagtggtaagataacctccgacccacccaattactggaggattccggganattgccataactccgtataagggatcctttcaaaaggttgaggtacacgatttcctgaaggtcctggtaatgtgttgatggatgggatacaactgggatgtagggatgtaatttgggctgagaaatatcctccctatacccaaaacagatgcataacagaaattcggagtttaaggtagaatcagtncccnaaatac

SEQ ID NO: 31437 - DNA, 1172 bp, Triticum aestivum
  Clone ID: PAT_TA_31437
gaaatatagataaataatattttgagtgtcatactttcactgtcaacacaacaactatgagatggttgtatcttccatactacatgcattataggcagttcccaaacagaatggtaaaggtttatactccccctcctccacaagcatcaatccatggcttgctcgaaacaacgagtgtgtccaacattcaatgggtcacagggggagttttctttaattattttgatttgctttgatctttttggatcatgggactgggcatcccggttaccggccctttctcgtgaatgaggagcggagtccactcctcttgagaataacccacctagcatggaagatatagacagccctagttgaaacatgagctgctcgagcatacaaaacagaatttcatttgaaggtttggagtttggcacatacaaatttacttggaacggcaggtagataccgcatataggaaggtatagtggactcatatggaacaactttggggtttatggagtttggatgcacaagcagtattcccgcttagtacaggtgaaggctagcaaaagactgggaagcgaccaactgagagagcgacaacagtcatgaacatgcattaaaattaattcacaccaagtacaagcatgagtaggatataatccaccatgaacataaatatcgtgaaggctatgttgatttgtttcaactacatgcgtgaacatgtgccaagtcgagtcactcaattcattcaaaggaggataccatcccatcataccacatcataatcattctaatagcatgttggcacgcaaggtaaaccattataactcatagctaatcaagcatggcacaagcaactataatctctaaatgtcattgcaaatatgtttacttcataataagctgaatcaggaatgatgaactcatcatatttacaaaaacaagagaggtcgagttcataccagcttttctcatctcaataagtccatcatatatcgtcattattgcctttcacttgcacgaccgaacgatgtgtataataataagagtgcacgtgcattggactaagctggaatctgcaagcattcaactcaagagagaagacaaagtaatatgggctctaaattaaataaacaatcatgcatatgagagccactaaacattttcaatatggtcttctactctcg

SEQ ID NO: 31438 - DNA, 1140 bp, Triticum aestivum
  unsure (1)..(1140): unsure at all n locations
  Clone ID: PAT_TA_31438
ttagcgtggtcgcggccgagggtttttttttttttttttnttttttagcccaaatatgcatgatattatttcccctccccactacatgagaaaatgggacgaaaagttgcctattacaaaacaaagttcataaggccctgtacaatgcaaggtgcttgggataggtgcttagagaaataaaccagtttttctctaagtatcggtgcttatttgtagagggtagacgcttaattaagcgtctgtcctatagaaataagcaccggtgcttaagaagaactcggcttattttactaagcatcttcctaagcatttcccatggtacaaggcctaacatagcatacatacattcttgtgttttacagcaaagcaagaaacaattacatatattgatcattactactttttgaaataaactggtcaatatgcgacaccttctgcataatcttggattgcatgccatcgacagagaagagaagagcacatctccaggtctcaactgaaaagagcagtccaaaccatagccaaaacccaaaaacaaccccagcagtcacacagtagtacagccactggtcctccccttcaccggttttctcatccgaagcaagcgaagtatttggacaatcctctagaggaaatccgcaaaggccggaattgttccggtaaatcgaagggtcggtcaacgtctgcatctggctcccagtaggtatcttgcctgacaaatgattgttcgagatgttgaatgtgctgagcccggacaagatcgagatgctctgtggaatgtttccataaagctcattacatgatagatcaagagactcgagattcctcaaactaccaatatctttagggatgccgcatgacagatggtttcttgacaggtttagaaatcggaggccttccagcctagttaactcttcagggatgcaccgagacaacatattgcctgacagatcgatgcccggttaataaccggatcgttctttggaagatgagctcctggcccttccagattatatcgattctatcctgataattcgacccatccagcgctgatgcctgactcgacacaatttctggatgcctcatggaggccatgttgccgaatgctacagggattggtcctgtcagtctcggcacgag

SEQ ID NO: 31439 - DNA, 729 bp, Triticum aestivum
  Clone ID: PAT_TA_31439
tttttttttcccaaatataagtcattttaaggatttcaacaagtgactacatacgaagcaaaatgagtgaatctacactctaaaatatgtctcccatacatccttatgtagtagtccatttgaaatgattaaaacaacttatatttaggaacgtaggcaggacatgttagtagattgctacttagtacatccacctggaatcatggagccctttattaggaggcgcctagtgaaaactctacgaaacacaaatgatgtggaatagtgaaatgaagagattggaaatgtgtgatgggctccgattctagcttgtacgaaaaggaaatttaggggtatccggcactgccggatccggatccgctacctccaccattgccgaacccaccattgttgctgccaccaccgccgccacccgttccagcaccggttccggtggcatagccttgaccataggaaccagtgctaccagtctgtccgcccccaatgccagagccagaaccaactcccatgtttggaccttgagctacacctccaccttggccaccaccgttgccgctgccacttccactggcattgcctccagtagtgtcatcgctggcggcctgtccacctccagcaccattaccacctccacttccaccgtcgccaccaccaccgccagtgccagcacctccagcatcagagtagctgacaccaccagcagaaggagctacagccggggcagttgcc

SEQ ID NO: 31440 - DNA, 1676 bp, Triticum aestivum
  unsure (1)..(1676): unsure at all n locations
  Clone ID: PAT_TA_31440
ttcgccggtcgacgggttgcatgaataggatctaattaaattgtgggatgggaagtagttgaggtagtacctattacctgttttattatcaaacctttgggagttacttctacgtttgccattatgctatgctatgctagtagacgtggattgggtgagtgatattcatgacagatgtgagttttttttattaatggtttatctaagatggcaacttaaacacagatctgggtggattgaggtacctgggtattccagggttgcctgtttcttttggaccgccacccaggctcaaagggatcatgagattattcatactagaaactttcgtgtgcagccacaagctattatgggctctagcatagttgattaagtcatgtgaactcttacagtggtagactagcagatgtaggggaaagtaggttggtacagtctacccgttcgtaaggtgctagcgcttctgaaagactatgtctcgatcatccgtttctcaaacaccatgcagtgcgagaaaaccaacggaggcgatcgagtcttgtggggaaaagtgcgcaaacctctgcagagtgtacaaactaatcatgattagtcgtgtccccggttatggacatattgagtatttggttcttggattatcatgttgatctcatcactctaaatttaatttgttgggttgataatgattacttttaattgggattgagttggaggaactttctcaatgttgttcaactaccatgatagttaaataaaattacattcctttgttgtaggaaaaaattggatttttgcaaaacatattaaccgtagagcctccaccagccatatatgcatgtagtgatagttgttcattgttcattgctctacagtgttatcttgccagcatattccatgtgctgacccgtttcgggctgcaacgtattatgttgcagacttttcagacgaagagtaaggtgcgctaggtcgttgtcgtgcactcagctatgccattggagttgatggactcatttatcttcgatgcttccgcagttatcttatttagttggccttaagccatattcattgtaataagttctcttttgagacattcgatgtaataagtgtgtgattgctactctgttataaatccttcaagtactgtgtggtgttagcattactgatccagggatgacacctgagcacagagatcagactttttgaggtctggtcgctacatcagcgttcgtgctcttaggttgtccattgctccgggggtgtgccatagaggcaaatgagatcttgcatcccagggcatgaacatattgcatgaaggcgcgactcctgaactgggtgccgttgtcagtaatgatccttgccggaactccaagaatgacacactgattatttcaagaacttgatagctgactgagtatcacctttctcacagcantcactttcggccactttgtaaacttgtcgatagcaacgancaagaatcanagccccaattctcgagggggggccggtaccaatcgccctanantgagcntatacnccgctnatggcctcgtttanacgccngacnggaaaacctgcctaccaactaaccctgagaaancccttccannggggtataccaaaggcnacgttccttcaantnccactaagnaatgaacnccnacggcatnaccgggggg

SEQ ID NO: 31441 - DNA, 459 bp, Triticum aestivum
  Clone ID: PAT_TA_31441
ccgcccgagtgagagaactagtctcgagtttttttttttttttttacttcctccgttcttaaatatttatctttctagagatttcaacaaataactacatacggagcaaaatgagtgtatctacactctaaaatatgtctacatacatccgtatgttgtagtctgtaaaagacaaatatttaggaacggagggagtagcatagcatacatacatacatacattctttgatttataacaaaaaaagaaacaattacatagtatattgatcattactactttttgaaataaactggttaatatgtgacaccttctgcataatcttggattgcatgccatcgacagagaagagaaggagcacatctccaggtctcaactgaaaagacctggcccggggcgggcggctcgaaatcgaattcccgcgggcgccaagggcgggcggggagcatgcgacgtccggg

SEQ ID NO: 31442 - DNA, 1125 bp, Triticum aestivum
  Clone ID: PAT_TA_31442
cccgggctgcaggtttttttttttttttttttttcagaaatcataacataacatattcgtaggtagcgattacatgttagtagattgctccactaactacttagtacttccactagaatcatggagccctttattagggagacgcctagtgaaaaccctatgaatgaaaagaaacataaatgacatggaacagtaaaatgaagagactagaaatgtgtgatgggctccgatcctaacttgttcgaaatagaaatttaggggtatccggcactgccagatcctgatccgctacctccaccattgccgaaaccaccattgttgctgccaccaccgccgccacccgttccagcaccggttccggtggcatagccttgcccataagaaccagtgctaccagtctgtccacccccaatgccagagccagaaccaactcccatgcttggaccttgagctacgcctccaccttggccaccaccattgccgctgccgcttccactagcattgcctccggtagtgtcatcgctggcggcctgtccacctccagcaccattaccacctccaactccaccatcaccgccaccaccgcctgtgccagcaccgccagcatcagagtagctgacaccaccagcagaaggagctacagctggggcagttgctataccactctcagcttctcctttgccagcaccacttccggctccagatccgcttgacccatctgcgccaccacctgcaccaccgcccccaccctgaccatcagcgttggcgtacccactgccactaggggctgacgccgagccactcgaaccaacaccgttgccaccgccagagccggaaccggatccggatccgccttgggaaccaccgccagcgccgtttccccctcctccaccggctcccttggcaaagttatacttgttcctggcatctccaccattctcgccatatcccaagccaccacctcctacggccccatggccccatccactcccacccccacccgacgagctgccaccgcctcctcctcccccgcctccgcctccagcactggaggagctagctagcatcctcgaagcattggtaacccaatgctcacgaggacaacaaaaccaagagctccaagct

SEQ ID NO: 31443 - DNA, 607 bp, Triticum aestivum
  Clone ID: PAT_TA_31443
ctctgaacagaactcaatatattagcaagctttcatacactgtaaccagcaatacattacatcacattatattttacattacattcagaaaatccaaatagatatcgatcgaccttgtcccacgtgacacttaattcttgccgcgtgcccacgcagaaccatttaattcaatcttaacttatttcacccttaatttaactaggaacgatagtagtagtagcaataattcagatccgcagaaggatcgatcagtcatcactgtgactccctggctccgagggcgcgcctgggcgtcggcgtgggcttgggcttgctgtcggtcttgacggggtaggacgcctccatggcgatgccgcagagcccgcccgcgacgccggaatccttctccaccctgatgtagccctgctccccccacgacggcccccacgagttcttcaccgtccagtacgccttgccgtcctctgccacgccgtacccgaccaccgcgacgccgtggtccagctccgtgccgcagctgccggtgaagaccccctcggagtagaacatgaacgccttcccgctggcctcgacggccacggacacgggctggttcgccaccgcctgggcc

SEQ ID NO: 31444 - DNA, 1408 bp, Triticum aestivum
  Clone ID: PAT_TA_31444
cggtcaggccattccgggtcgaccgggtaaaacgcgatgaatccttctctctgatttttttctccccgaacacgaatatatggagttgcagttgaggtcggtggagcgtcagggggcccacgaggcaggggggcgcgcccaggggggcaagcgcgcccccaccctcatggacaggtggaggcccccctagcgtggattcttcttccagtatttttaatattttccaaaaataagttccgtggagtttcaggtcattccgataacttttgtttctgcacataaataacaccatggcaattctgctgaaaacagcgtcagtccgggttagttccatttaaatcatgcaagttagagtccaaaacaagggcaaaagtgtttggaaaagtagatacgacagagacgtatcaactcccccaagcttaaacctttgcttgtcctcaagcaattcagttgacaaactgaaagtgataaagaaaaacttttacaaactctgtttgctcttgttgttgcaaatatgtaaagccagcattcaagttttcagcaaagattatgaactaaccatattcacaataacacttaggtatcatgtttactcatatcaatggcataatcaactggcgagcaataataataaaactcggatgacaacactttctcaaaacaatcataatatgatataacaagatggtatcccgctggccctttctgagaccgcaaaacataaatgcagagcacctttaaagatcaaggactgactaaacattgtaattcatggtaaaagatatccagtcaagtcatacccaatataaactaatagtaatgcatgcaaatgacagcggtgctctccagcaggtgctttttaataagaaggtgatgactcaacataaaagtaaatagataggcccttcacggagggaagcagggatttgtagaggggccagagctcgattttaaaatagagatggaataacattttgagcggtatacttttgctgtcaacgcaacaactatgatatggctgtatcttccatactacatgcattacaggcggttcccaaacagaatggtaaaggtttatactcccccaaccaccaacaagcatcaatccatggcttgctcgaaacaacgagtgcctccaactaacaacatccctagaggagttttgtttaattatattgatttgctttgatatttttggatcatgggactgggcatcccggttaccggccctttctcatgaatgaggagcggagtccactcttcttgagaataacccacctagcatggaagatataggcagccctagttgaaacatgagctgctcgagcatacaaaacaaaatttcatttgaaggtttggagtttggcacatacaaatttacttggaacggcaggtaaataccgcatat

SEQ ID NO: 31445 - DNA, 1126 bp, Triticum aestivum
  Clone ID: PAT_TA_31445
gccggccgggtcgggaccagcgccccttccccgagcgccggcctccaacaaaaaaaaaacacaccagccgacgcgtgcacgcagacggtccagacgccagacgccaggctccaggcagacgcggatgggcagcctcgccggcggggtcggggccaggcggccgcggttcctgtgcctgcacggcttccggaccagcggcgagatcatgcggaagcaggtggtggggaagtggcccgccgaggtcacggcgcgcctcgacctcgtcttcgccgacgcgcccttcccggccgagggcaagtccgacgtccacggcatcttcgacccgccctactacgagtggttccagttcgacaagggattcacggagtacaggaatttcgacaaatgcctggcttacatcgaggagctcatgatcaaagaagggccctttgatggactaatgggtttctcccagggctcgattctatctggcgcacttccggggctccaagaacaaggattggccttgactagagttcctaagatcaagtacctcataatcataggcggcgccaagttccgctcacccgcaatagccgataaggcctacgccaacatgatcaaaatcccctcgcttcacttcctcggcgacaatgacttccttaaaccccatggtgaacagctcatagagtcatttgtggatccattcattatacgtcacccaaagggccacacggtcccaaggctcgttgatgagacgagtttggaagtcatgtcccgtttccttgacaagatggaaaaggagatatctgaacttccatccgtcaaggctgaggccgaggctgaagcagccgctgatgttgacgaaaaagaagtgtgcatctgataccacctcaaggattagtgcctgaatacacatcaaatcagtatataggcaaatcacacggctgtgacctccttagttttgtgttgttgcaagtgtgtgattatttattactccctccgttcctaaatatttgtctttgtgaagatttcaataagtgactacatacgtagcaaaatgagtgaatctacattctaaaatatgtctatatacatccgcatgtggtagccatttgaaatatctaaaaagacaaatatttagaaa

SEQ ID NO: 31446 - DNA, 1534 bp, Triticum aestivum
  Clone ID: PAT_TA_31446
cccgggtgcgaccccacgcccgtcccgggaaccccgcagaccaagcgacggcggcggtgacggcggcggcggcgtcggaggtggccgcgaggctgctggtgccacgacctgccacttccagttctgctattactttagccacttgctgcgcacatctcggtgagctcgccactccggtggcggcggcggcgggcggagggaagaaaatggcaccgccgcggcgcgtgtgcgtgaccggcggcggcgggttcatcgcctcgtggctcgtcaagctgctcctctcccgcggctacgccgtccacgccaccctccgggacccatgtgaccccaagaatgtccacctcaagcagatggacgaggcccgggagaatctgcacctgctcaaggccgacgtgctcgactacgacgcgctaacacgtgcgtttgagggatgtgagggggtcttccacctcgccactccggtgcctgaagataagattgctgatcctgagtcagaagtattggctcctgctgtgaaaggtacttcaaatgtgctgaaggcctgctcagctatgaaggttcagaaggttattgtcttgtcatccaatgctgctgttgattttaacccgaattggcctcaagacagactcaaagatgagagtagctggtcagacaaagatttctgccaggagaatgaggactggtattctgttgccaagattgtggccgaacaggcatccttggaatattcagagaaacatggattaaatgttgttacgctttgccctcctttggtttttggcccattgttgcagcctactgtgaataccagtagcaaattcttaatctatgttattaatggaggacctgacgtgatgagcaacaagctgtggcacattgtagacgtccgtgatgtcgcggatgccttgctgcttgtgtacgagaaggccgaatcgtctgggagatacatttgcgcgccgaatagcgtctgcacaaaggacttggtggacttgctgaggaagatgtacccacagtacagctatgtgaacaacatcgacgcggaccgtaaagcgcccgctgtcatcgcagaagctgaaggatctgggctggaagccgaggaagctggaggagacgctctcggacagcgtgggctgctacgagaaggccggccttctgcagggttccgctgcgcgtcattgccggcttccgcatctgttccgtctggctggtgatcagtgaatgtaccgtggtgactggtgcttttgtttttcatatggtcggacttctgtaagctgtagtgtcgctggacggagcctcgcaacagcaacaatggtcgaacctcttcctttgcatccacaaataagcagctatccctgctgtatctgccgccccctgtctgtcacctccggaaatggacaaagtgtaaaacaagcagagcagagacgaaatgcatgtacttcctccgttcctaaataagtactatctctttctagagatttgtataagtgactacatacagagcaaaatgagtgaatctacactctaaattatgttt

SEQ ID NO: 31447 - DNA, 1143 bp, Triticum aestivum
  Clone ID: PAT_TA_31447
catcaataatatttagtaatattacaccatcatcaatacaagagcaaagtttaagaagaacaacacatcaaacaagaatagcccatgaatttctcgcaagacgaaaaatagtggaccgtggatccatagattaagcaacatgcaacttctccatgaacacatcctataatggcaattaatctcaagttctcaacaatggaaatgaaccaagcaacaactggggagggattattgactaaacatgcatataactaagagcgtccagcttattcgagaactcaatggcggcatgcccaagccggagtggcctagccgatgtagtacatcggggtcgggcagcttgaaagtgcggggcgccctcaggcgcgcccaaggatgtcgctccattggtcgccgatgttaccgatgatgacgtacccggcatcccgcagcttctgcctctcgccggacttgtaggtcactgcagagcccttgaagccgggctgcttcagcagcaggttcatccacccggagatgccctggcggcggaggttggtgacggtgatggcccttttgtcctcggtccggccggtgaggaacaccggcttgacaccgaccgagagcagcttgttgtacagcctcttcgtctccggcagtgacggcgcgctcccctcccgcacatatgcgtcgaagctcgtcgcgttgaacggtgtagctccgaagccgtgctcggcgtagtaggggaggttggagagggttgtctcgtcaatgtcgaagacccacgcctccttgccgttgccggcgagcttgagggagtcgacgtaggcgatggcctggtcgacgacgaccttggagtcccggcggtagtggctgccgagcatgtagtggccgacgtagccctcgcagctggcgggcaccgtcttccagccccgcacgttgtgcgcctccacgcccagcacccagctgtcgcacgccactccggcgtgcttgccggagcccagcagcggccgcagcgcgtggatcagcggcggcaacaaggccctcgtccagcgaggtcggcattcggaatgttggcttcccacgcgccgcaggaggccacgaggagagccgcggcggcgaggaggagcgtcgtcgtcgtcctggccatcgccatttctagcgtgt

SEQ ID NO: 31448 - DNA, 1292 bp, Triticum aestivum
  unsure (1)..(1292): unsure at all n locations
  Clone ID: PAT_TA_31448
ggcacgagttttttttttttttttcacccaattgaacatgatcaattatgacagaacgaaccacacatcaaacaacaataccccatggaatttcatgaaaaaaaagaagaagaaaaagcagcagcccatggatccattgattgagcaagatccatttgactcccatacgtcttattgatagtagcaattgatcccaactgaggaaactaaccaagcaacaacaacagacgggatcatgcatctaattattcagaagatggagcttattcatcgaccacaagcaatggatggctgcgggcctagccgatgtagtacatggggtcgggcaacttgaaggtgcgagcgccctcgggagcgccgaggatgtcgctccactggtcgccgatgtttcccacgacgacgtacccagcgtcctgcagcttctgcctctcgccagacttgtaggtcaccgtggaacccttgaaccatggttgcttgaggagcaggttcatccatccggagatgccctggcggcagaggttggcaactgtgatggcccctccggtgctcggtccgtcctgttaggaacactggcttgatgcccaccgcgagcagcttgtagtacagccgttttgtctccggtagcgcaggcgcgctcccctccaacacataagcgttgtagctcgtcgcgttgtacggcctggccccgaagccgtgagtggcgtagtaaggtaggttggagagcatggtctcgtcgatgtcgaagacccacacctccttgccgttgccggcgagcttgaggctgtcaaggtaggcgatggcctggtcgatgacgaccttggagtcgcggcggtagtggctgccgagcatgtagtggcccacgtatccctcgcagttggcggggaccgtcgtccagtcccgcacgttgtacgcctccacgcccagccgccagctgtcgcacggcaccccgccgtggctcccgagctgcccgccggagcccagtagtggccgcaacgcgtggatgagcggcgccacggcgtcatctacagcagttgctgcaacctccgccatcggcgtacagatgttaggctcccttgcgctgcaggaggccactgcggccacgagagccacggcaacgaggatgggcatccttaccatcgccattgttagtgtgtgctactgctactggtgccgaattcctgcagcccgggggatccactagttctagagcggccgccaccgcggtggagctccagcttttgttccctttagtgagggttaatttcgagctagggaatnaaaagggnnttaaa

SEQ ID NO: 31449 - DNA, 1091 bp, Triticum aestivum
  Clone ID: PAT_TA_31449
tttttttttttttttttttatacaggcattatgccagtccagacattattagatgctactagtgcagcttaacattcacaatcattcagagcagcaaaacaaacatattacagaaaacgaaacagaccacgagaagataacttttattgccagtttgttcttttgaggagccgcgaagcttcagagcttggaaacaaggctgccgttctggatggctttaggcgactctgcttccttgacatcggcggcatcagaagtgccaggaggcacgtcaacagcaggcgagcagttgaagaatccatgtggcatggagcatgaagccgatgcgttccaccgggcatgaccggccagtcttcaagccttgggatgtggggtgagcccaaatacataccagaggacgatgtcagtttcctccaagggtctatccttcttcacccaagtagccaaaccctcgtgaagacgtggattctggttggggaactcccctccaggaaacttctcatcgctcttgtatggtgtcacccaaagattgtgctttaggaaccctgctcttcgaagaaactttgcctcgggcagagcaaatggcaaacagtttgaaccaggcacgagtctgaaaccagttggttgtccggtacgatttacagcccttgtgttcctaacaatccaatgccgcgcagatgaagggtcacaatctctcattgcttgcaactcggatttcagtattttttcttcagcatagaaagcattgttgtgcacattatttgtgcctgcactttcgactttgacattcacttcaaccacctgattatgagcttcgttaggtttgcaatcaacagccatgtccatacgggcaacaaagaaatgctggtggacaggtgcatacagactaggagcaatagttgtaccatatttccttgattccccaggcatcagagctcccaaactcagaattccagtaagttttacttcagcttctatcttaccatcctgataaaagtgccagtaaaaaccatattcatagttggcaactgtgcagataaacgacaccgtgagcctccttgatcgcctaacttctgctaaaccagttctcc

SEQ ID NO: 31450 - DNA, 1129 bp, Triticum aestivum
  Clone ID: PAT_TA_31450
gaacaaactattgaatttcattcacataaccagttcggagaattcttgagctcatcatgcgaagtgcgcactcaaccaaacgagagcaagttccatagttacattattatctatatatatatcgaccttaatatactgaagcatagattcgatattatccacagttccgcaccaacaaccgacgacgaagcgcagacaagctcatactcccccaaattgcatcgccgagctcacctctcgcgctttctcttcaacgggagcagcttcttcactttgtctgagctcttgttcaccgattctgcatcttctacgcggcggaagccaaggtgcgacgacaagttctccacttccactttcgcgacatcctttcttactcctatgtcggtgatgtatctaccggcacagtacatcccggctgtgacagtggccattccaagcggaccggcagcgaaaatcttgaacggagtggacagaagagctgccagtggcacgccaatggcggaggatgcttgcccgctcaccccaatgcctggttcatcaacgggtacaagtccagtcttgcagtagagtgcaaagtcctcacaattcttctcgaagatgtcgtagttgccaaacccattctgaagcaagtgcatagctctccggaccacaacctccgatgggtctgattgggcaatggtgcaggttccccctcgaaattttgcaaggaaaattgcaggtggcactccgtactcgaagcagtagagggagccattcccaagaaagcaatccaagcaggtgagtacgacgccactatcggccagctgaaaaccacagtctgggaatgttgggcactctgatgaagcccgtgagatcaggccagagatggagttggatgaatccgaagattcaacttccttctttcgtgtaaaatggaccactttgcttcctccaacataaataccgtggtgggagtaggcgtagacggccctccaggtgtagatgtggtcgccgggcctgacctccgaccgctccacccggttcgacagcagccccatcgccgccgccgccgccgccgcccccaacgctctcctccgagctgtcggtgcggcgccgtggcttcccctcgcgtccgtgcgaaatggagtga

SEQ ID NO: 31451 - DNA, 1187 bp, Triticum aestivum
  Clone ID: PAT_TA_31451
gactccgaattgggtgattcttttttttgttggaaactagatttcgtgcactttccaacccaattggaatcaccttcaaattcgtccggagcgttgagttgtgcacaaaacaatttgatgctgcagcagaatccgagtcaaactacaagtccaaaggtgttacatcacctccacttgggcccatgagccttgtatgacctaaggttagttttaggctgccttgggacgtcctcccacctccttggacgccaccccttgctcctatataagtagatccatctagtagctttttcctggggatttgtttagttaaaagttagccattgcaacttcgtgtacttcgtttgtgtccaacgaccagaccaagaccgcttacggatccccacctttatcaatacttcatatatactcgcaatattcggattgcttttatcatattcttgcttgttcttcgattgcttgcaggaatagaccttcgtggtcaggttgattgtgctccggcatggtcaataacctctcggagttggtttagcgattgctaaggcgcaacgtcgtgcacgtttgtagtcggatcgtcaaagtcgtctccaccaaatcgatagttatcatctcatcgaaagatcgggacaccctcgcctctatcaagtggtatcagttttcaggttgctcggtgagaatttccagttttcctagattagatttattttcttacctattgtccaagaaaaagccacaaaaaagagttagatctattcatccttttgtccaagccaatctgagcctttgcaattttcttttcattgcttgcatagttgaattatcggttgcatcgtcgtgtcgagttgctggtcttagggtctagttcgtttagagtttcgagttctgttcacattagtcacgtcgccgctgcatcattatcccttccgctgtccaccataccaaccatcaatttccaccacgtgctacgcactgttcattgtcataatcatagttgaggtcactcacatcttcgcctgatcgaatctgcatcttatctagtttgtcttggaaagagggagaaaaagaagataaagaaaaaaaaagagagaaaaaaggaaaaaaaaaaaagaaaaagagggagaagaaaaagaaaaaaaaagcgtgagaaaaaaagagagaagaaaaaaaaaaaaaaaaaaaaaaaaatc

SEQ ID NO: 31452 - DNA, 1071 bp, Triticum aestivum
  unsure (1)..(1071): unsure at all n locations
  Clone ID: PAT_TA_31452
gacgggacactaaaagtcaaaaggtgttacatcacctccacttgggcccattggccttgtacgacctagatttagttttaggctgccttgggacgtcctcccacctccttggccgccaccccttgctcctatataagtagatccatctagtagcttttccttgggatttgtttagttaaaagttagccattgcaacttcgtgtacttcgtttgtgtccaacgaccagaccaagaccgcttacggatccccaccattatcaatacttcatatatattcgcaatattcagattgctttatcatattcttgctcgttcttcgattgcttgcaggaatagaccttcgtggtcaggctgaccgtgcttccggcgtcgtcagtaacctcaggagattggtttagcgattgctaaggcgcaacgtcatgcacgtttgtagtcggattgtcaaagtcgtctccaccaaatcgatatttatcatctcatcgaaagatcgggacaccctcgcctctatcaagtggtatcagttttcaggttgctcggtgagaatttccagttttcctagattagatttattttcttacctattgtccaagaaaaatccagaaaaaagagttagatctatccatcctttgtccaagccagtctgagcctttgcaattttcttttcattgcttgcatagttgaattatcggttgcatcgtcgtgtcgagttgctggtcttagtgtcttggtcgtttagagtttcgagttctgttcacattaagtcacgtcgtcgctgcatctttatcccttccgctatccaccacccatccatcaatttcctccacgtgctacccaccgttcattgtcataatcatagttgagatcgttcccatcttccgcttgatccaatctacatcttatctagttgtttggaagaggaganagaaaaanagatagagaaaaanatgagaganaaaagtanaanagtcagnganaaaaagaaggaaagaaaaanatgtgagaaaaaaggagngaaaaaaccnganatctcttcnnactgccgggggcgccgaaacaatccgcggcgcaagg

SEQ ID NO: 31453 - DNA, 1156 bp, Triticum aestivum
  Clone ID: PAT_TA_31453
cgtcaccctgcacaatgcggccggtgggaggcgcgcatgggccagttcctcggcaagaaggcttacgacaaggcggcgatcaaatgcaatggtagagaggccgtgaccaacttcgagccgagcacctatgatgcggagctgctcaatgaagttgctgctgaaggcgcagatgtcgacctcaacttgagcatatctcaaccaacttcacaaagtcccaaaagggataagagcagccttggcctgcaactccaccatggatcatatgatggctctgaactaaagagaccaaaggtcgatgctccccctgagatggttgcgatccctcatcggtacccccttctgaccgagcatccaccaatctggcatggccaatcatatcccctctttttaaataatgaggaagcagccagagatcatagcaggaggccagaggtggccacaggggctgttccaacctgggcatggagggtgagccaccctcctccaacacaacccatgccactcttctcgtcgtcatcgtccgctgcagcatcatcaggattctccaaaaccgccgcggcagctgcccccggcgccccatcggcctcattccggttcgacccgatggcgccatcatcatcgtcaagcaaccaacaccaccaccaccacccccgctgaaaaagaagccatactgtaaattttctgggaagccagtatctttttgcccctccgggcgtttcagcgttttcggtcttgcgccggggcggtttcatgtagtggattggattcatgactgtatttcccatgctgcccaagtgaaatgtcccttcttctttgcgctctctgcatcagcgcattggtcccataattctcgatgtcagatactaacctcagctcatctcaccatctgagatggatttataccattgttgtagacaaacctgtcactgaaattcagcagtaccgataccataagataagaggaacctttactttgggaattattccagtcccttttcttgggatgtcagttgggctcttgtttttgctctatagccaactaccactgctgaattgtactgttgtttgttgttgcactgttacaagatttggctctaacggatgccaaagtatctggtgcaagaatataaattcttgaaataattatggacttaat

SEQ ID NO: 31454 - DNA, 1270 bp, Triticum aestivum
  Clone ID: PAT_TA_31454
gctactcatattcaatgctggaatgattgttattcccatctgacttggccgtctagtttttgaggctgttccccgcctgccaatcacacatggcatcaagtgcaatgatctgttctcttttagcattggttgctatattatctggagtgcagcagctggaaccagatatgcagttgactacattagatcacgacgtcttggcttcctggtgcaacagatctgcaagtggtgctctattgtcctgaagagttccgctctcctgtcaatatggatcttcgttatccccgtgctgattggactcctttttgagctgctggtgattgtgcccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggtctatgggtcctgcacgaaatcataacccccatcatcacgaagctccttactgctctctgtgttccatacgtcctagcgaggggtgtgttcccggtgctgggctacccactgatcgtgaactcggcagtctaccgttttgcctggctcgggtgcctgatattcagcacgctcttcttctgcggcaagagattccacgtctggttcaccaacctccacaactccatcagggatgaccgctatctcattggccggaggctgcacaactttggcgaggactcccgtcggtcgaacgaacctgatgagactccaggttcattagaggacgaccttgcgctgatccctctagatcatcaggacaatgacgacgtcgggctgaggttcaggggcaacaaccgtcatgaagacgctgggctggttgtcggttaagcaggagcgtgtgaccggcattgtagagtgaatgagttgccctgtagtgttagggtagtaggcaagcattgttgtacaacacacatagtagcgaggggaataagctagatagaaggatttgcgtgccgaaagctgatggtcaactgcctctttttttgttcctgtggtagtcgttgctgaatgtatatattgggcggagcacctaagaagacataacctgatgttgtacttgatgtaatgtgtaaggataaatctgattccacactggtgtaatggctgatgtttcacgttggacctactcgttctagttttccatgagatgaaaaaaagcaa

SEQ ID NO: 31455 - DNA, 2291 bp, Triticum aestivum
  Clone ID: PAT_TA_31455
aacaaaactaactcgattacatgataaatctcatccaacccatcaccgtccagcaagcctacgatgcaattactcacgcacggcggcgagcatcatgaaattggtgatggaggaaggttgatgatgacgatggcgacgaattcccctctccggagccccgaacagactccagatcagccctcccgagagagattagggcttggcgacggctctgtatcgtaaaacgtgatgaatccttctctctgattttttctccccgaacgtgaatatatagagttggagttgaggtcggtggagcctcagggggcccacgagatagggggcgcgccccccaccctcgtggacagggtgtgggcccctagcgttgattctttcgccagtattttctatatattctaaaaatattctccgtgaagtttcaggccattccgagaacttttatttttgcacaaaaataacaccatggcaattttgctgaaaacagcgtcagtccgggttagttccattcaaatcatgcaagttagagtccaaaacaagggaaaaagtgtttggaaaagtagatacgatggagacgtatcaactcccccaagcctaaacctttgcttgtcctcaagcaattcagttgacaaactgaaagtgataaagaaaaacatttacaaactctgtttgctctcgttgttgtaaatatgtaaagccagcattcaagttttcagcaacgattatgaaccaaccatattcacaataacacttaggtctcacatttactcatatcaatgacataatcaactagcgagcaataataataaatctcggatgacaacacttcctcaaaacaatcataatatgatataacaagatggtatctcgctagccctttctgagaccgcaaaacataaatgcagagcacctttaaagatcaaggactgactagacattgtaattcatggtaaaagagatccagacaagtcatactcaatgtaaactaacagcaatgaatgcaaatgacagtggtgctctccaattggtgctttttaataagaggatgatgaatcaacataaaactaaatagataggcccttcgcagagggaagcaggaatttgtacaggtgccagagctcgggtttgaaataggggtgaataatattttgagcggtatactttcattgtcaacataacaaccaagagatctcaatatcttccatgctacacacactataggcggttcccaaacagaatggtaaagtttgtactcccaccactaacaaacatcaatccatggcttgtttgaaacaacgggtgtcgtccaactaacaacaatcctgggggagttttgtttgcaattattttgatttgatttgagcatgggattgggcatcccggttaccggccatttcctcatgagtgatgagcggagtccactcatcgtgagaataacccacctagaatggaagatatagacaaccctaattgacacatgagctattcgagcatgcaagacagaatgtttatttgaaggtttagagtttggcacatacaaatttacttggaacggcaggtaaataccgcatataggtaggtatagtggactcatatggaacaactttggggtttaaggagtttggatgcacaagcagtattctcgcttagtacaggtgaaggctagcaaaagactgggaagcgaccaactgagagagtgacaacagtcgtaaacatgcattaaaattaatttgcaccaaatacaagcatgagtaggatataatctaccatgaacataaatatcatgaaggctatgttgattggattcaactacatgcgtgaacatgtgccaagtcgagtcactcaatgcatttaaaggaggataccaccccatcataccatatcataatcattctaatagcatgttggcacgcaaggtaaaccattataactcatagctaattaagcatggcacaagcaactataatctctaaatgtcattgcaaatatgtttacttcataatagctgaatcaggcacgatgaatcatcatatttacaaaaacaaaagaggtcgagttcgtaccagcttttctcttctcaataagtccatcatatatcgtcattattgcctttcacttgcacaaccgaatagtgtggataataataatagtgcacgtgcattggactaagatggaatctgcaagcattcaattcaagggagaatacaaggtaatatgggctttttgttagatcaacaataatgcatatgagagccactcaatattttcatcaaggtcttctcctctcgacccac

SEQ ID NO: 31456 - DNA, 1336 bp, Triticum aestivum
  Clone ID: PAT_TA_31456
aattcggcacgaggcgcagctccagtgcctccccgcaacacctcctttctccttcttcctctcttcctcccctacatctcagtcctttcgttttcccttggtcatgagcagaggaagcatgcagggggcctcaccactgccgccaccacggccgtcgcaccgccgccgcctccgagtttgccggccgttggcgaacatctcctctgcgaccggcgctgcgaccctctgcctcgcctccatcatacgtaaggatgatgacgaccgcgccgacatcgatccattgcggtccgtccctcgcctcgctcgtgtggggcgcacctgcgcgtggaccgccggtcaggcaagccgcccctcgttggcgggagcgccagtgccgcttgcctgaagcatctgatggcggcccagacgttgcttcgacggcgaccaggactcctctttgcgttcgttttgttactcatttgcatctctgccatctgagtcaattgtaaattgataacccacaagtataggggatctatcgtagtcctttcgataagtaagagtgtcgaacccaacgaggagcagaaggaaatgatgagcggttttcagcaaggtattctctgcaagcactgaaactatagataatagatagttttgtgataagataatttgtaacgagcaagtaatggtaatagtaacaaaggtgcagcaaggtagcccaatccttttgaggcaaaggacaggccaaaatggtgtcttatgataagcaaagtgttcttgagggtacatgcgattttcatctagtcactttcatcatgttggtttgatttgtgttcgctactttgataatttgatatgtgggtggaccggtgcttaggtgttgttcttacttgaacaagcctcctacttatgattaaccccctcgcaagcatccgcaactacgagaaaagtattaagaataaattctaaccatagcattaaacttttggatccaatcggtcccttacggaatagcgcataaactggggtttaagcttctgtcactctcgcaacccatcatctaataactactccacaatgcattcccttaggcccaaatatggtgaagtgtaatgtagtcgatgttcacatgacaccactaaggacatcacaacatacatactatcaaaatatcgaacacatatcaagttcacatgattacttgcaacatgatttctcccatgacctcaagaactaaagtaactacccacaaatgataatcatgctcaagattagaggtgtattaaatagcatatcggatctgaacatataatcttccaccaaataaacaatatagtaatcaactacatgatgtaat

SEQ ID NO: 31457 - DNA, 1019 bp, Triticum aestivum
  Clone ID: PAT_TA_31457
aaccggtagttttgtgatagtaatttgtaagggtccaagtatgaagtaataagtgcagcaaggtggccccaatcctttttgtagaaaaggacaagcctggacaaactcttatatagagaaaagcgctcccgaggacacatgggaatatcgtcaagctagttttcatcacattcatatgattcgcattcggtactttgataatttggtatgtgggtggaccggtgcttgggtgatgtccttaattggacaagcatcccacttatgattaacctctattgcaagcatccgcaactacaacaaaagtattatggtaaacctaaccatagcatgaaacatatggatccaaatcagccccttacgaagcaactcataaactagggtttaagcttctgtcactctagcaacccatcatctacttattacttcccaatgccttcctctaggcccaaataatggtgaagtgtcatgtagtcgacgttcacataacaccactagaggagagacaacatacatctcatcaaaatatcgaacgaataccaaattcacatgactactaataacaagacttctcccatgtcctcaggaacaaacgtaactattcacaaagcatattcatgttcataatcagaggggtattaatatgcataatggatctgaacatatgatcttccaccaaataaaccaactagcatcaactacaaggagtaatcaacactactagcaacccacaggtaccaatctgaggtttggatacaaagattggatacaagagatgaactagggtttgagatgagatggtgctggtgaagatgttgatggagattgacccctctcccgatgagaggattcgatggtgatgacgatggtgatgatttccccctcccggagggaagtttccccagcagaacagctccgccggagccctagattggttccgccaaggttccgcctcgtgggcggcggagtttcatcccgtgagcttgcttctgattttttcccggacgcgtgggcggacgcgt

SEQ ID NO: 31458 - DNA, 1567 bp, Triticum aestivum
  Clone ID: PAT_TA_31458
gcgttgcaagctgcaggtgaagttcaagatttctccatggtggacaggattttgttgggatatcacaatatctcttatattattaatgcatctatatacttggtaaagggtggatggctcggccttatgcctggtgttttgttccactcttgcctccctagtttccgtcataccggtgttatgttcccggattttgcgttccttacgcgatcgggtgatttatgggacccccctgacagttcgctttgaataaaactcctccagcaaggcccaaccttggttttaccatttgcctcaccaccacctacttttcccttgggagtcgctctctcgagggtcatctttattttagcccccccgggccaatgcttgtctaagtgttggtccgaactagagccacttgcagcgccacctcggggaaacttgaggtctggttttagctgtacgtagtgttcatccggtgttgccctgagaacaagatgtgtgcagctcctatcggggattgtcggcacatcgggcggctttgctggacttgttttaccattctcgaaatgtcttgtaaccgggattccgaaactgatcgggtcttcccgggagaaggaatatccttcgttgaccatgagagcttataatgggctaagttgggacacccctgcagggtataaactttcgagagccgtgcccgcggttatgtggcagatgggaatttgttaatgtccggctgtagagaacttgacacttgacttaattaaaatacatcaaccgcgtgtgtagccgtgatggtctcttttcggcggagtccgtgaagagaacacggcttttgagttatgtttgacgtaagtaggagttcaggatcacttcttgatcattactagttgacgaccgttccgttgcttctcttctcgctctcttttgcgtatgttagccaccatatatgcttagtgcttgctgcagctccacctcactaccttttcctacccataagcttaaatagtcttgatctcgcaggtgtgagattgttgagtcctcgtgactcacggatacttccaaatagttgtaggtgacgatgataccagtgcaggtgacgcaaccgagctcaagtgggagctcgatgaagatcttgatcgttgttgtgtgtctctctccggttgatcagtagtgctgcccagttgggtcgatcggggatctagcatttggggttgtctttttttattttggttccatagtctgaccttgattgtattctggatgatgtatgtttaacttcttatttgtgtgaagtggcgattgtaagccaactctttatccctttcttattcaggacatgggattgtgtgaatattacccctcttgcgacaaaactaccatgtggctatgcctctaagctgtgccccgacacatgggagatatagccgcattgtgggcgttacaagttggtatcacagctatccctgacttaggagccccctacttgatcgaatcgctgacgttgttgagtctagaacaaaatgtttttgagtcttaggattatatatatcggagagtaggattctttttattcctcaat

SEQ ID NO: 31459 - DNA, 2063 bp, Triticum aestivum
  Clone ID: PAT_TA_31459
gaggtcgggctgtggggctttggctctgacacatcggaacggcgagcgcgatggcggcggtggccggagccgggagggcgaggggggcgagcctggcggcggccgtgcgggccgtcgcggcgacggcgcgcccggcgtcgagcgccgctgccgcggcgggggtgagcgtggcggcggtcgtcctcaaggggaatgacacgccattcgggtcggtcgggtggtgggcgtacgccggcatctcctgcttcctggtgctcttcgccgggatcatgtcggggctcaccctcgggctcatgtcgctcggcctcgtcgagctcgagatcctccagcgcagcggcaccgactccgagaaggcgcaggctgctactatccttccagttgttcaaaagcagcaccaacttcttgtcaccctgctactgtgtaatgctgttgccatggaggctcttcctatattccttgacaggatttttcatcctgttgtcgctgttgtcttgtcagtgacatttgttcttgcttttggggaggttataccacaagcaatctgtactaggtatgggttggcagtgggtgctaactttgtatggcttgtacgtatcctcatgatcatgtgctatcctattgcataccctattgggaagctcctagactgcgctcttgggcataatgaatctgcactctttaggcgagctcaactgaaagctcttgtttctatacacagcaaagaggctggtaagggtggggagcttacccatgatgagactacaatcataagtggagctttggacttgactgaaaagactgctcaagaagctatgacacctatcgaatcaactttctcactagacgtggactccaaattggattgggaagcaattggtaaaattcttgcccggggccacagccgtgtgcctgtgtactcaggaaaccctagaaatgttattggcctcctgttggtgaaaagtcttctgacagttcgtgctgaaacagagacaccagttagtgcggtttccattcgaaggattccgagggttccggcggacatgcctttgtatgacatattgaacgagtttcagaaagggagtagccatatggctgctgttgtgaaggctagaccaaagaatcctccagccgacacaactgaaccaaacatggaagcagctggggcaacacagctgactgcacccttactatccaatgctgaagaaagggcggaaagtgtggttgtcgacattgaagcaccgcatagcaggcagactaatggaaacaaacaccactctgtgcagcaaaacgataagccatcgaatggagtgggtcgttcatcagaggacatagaggaaggcgaggtcattggtatcatcacacttgaagatgtatttgaagaactcttgcaggaagagatagtggatgaaaccgacgaatatgttgatgttcataaaaggatccgggtagctgctgctgctgccgcgtcatcagttgcaagggctccatcagttagaagattaactgctcaaaaggcttccggaacgcagagccggcaagggcaggctggacagcctgctggaattttgaagaagcctgctactgaaggtgattcaaacccatcaaaacaggtgaaccttgtcgaacctctgctggaaaataggaggtaattgtagatgtatcacataaatagagcgacgggacgcatggaagcatgttgtgatgttgctatatccagtgagagtaaatacgagtttgctcgctgtaaatttcaacagtagcaatttgaaccttgtcatgaatgtcactatgtcagcgttgagtttcatcactgggacggtagcaactactgacatttgggaatcgtagacttggaactagtgcaaatgataaattagatggtcccgcagactttctgaatgtcgagcacgtggaatattataaggtggaatgcctaaaaaaaaaaaaaaaaaaaaaaaaaaaaaaaaaaaaaaaaaaaaacaaaagaaaaaaaaaaacaaaaaaccaagacaaccaaagaatcaaaaaaaacagcacaaaaaaaaagcggcccccctaaaggt

SEQ ID NO: 31460 - DNA, 1298 bp, Triticum aestivum
  unsure (1)..(1298): unsure at all n locations
  Clone ID: PAT_TA_31460
gcacgagggggacagagcaacagaacagagaagagcagaagccagcgacgaatcagagggtagaagaaagaaagaagacatggacccggacatgggcgagaacttcgcatactactgggagacgcagcgctacctcgagtcagaggagctcgttgacagcatcttcgtcggggcgaccgaagacgccatctcgtactacgactccagctcgccggacggttcccactcgtcctcgacgccgatgggggcggccatgccaggggcggggatggggatgggcggcactggggcgaacaagaacatactgatggaacgcgaccgccgccgcaagctcaatgagaagctctatacgctccggagcgtcgtgcccaacatcaccaagatggacaaggcctcgatcatcaaggacgcgatcgagtacatccagcagctgcaggcagaggagcggcagatggaggcggaggtgtccgcgctcgagtccgccaccggcgcggaggatgactgcgacggcggcctctccgtggaccaggtctcctcggcgcagaggaagaaggtgaagcgcgcgctctcggtctcgtccatgaacgacgcgctgctcgccgcggcggcgacggtggcctcgccgcccgtggaggtcctggagctgcgcgtgtcggaggtgagcgagaaggtgctggtggtgagcgtgacgtgcagcaagcagcgcgacgccatgaccaaggtgtgccgcgcgctcgaggagctccgcctcagggtcatcaccgccaacatcacctccgtctccggctgcctcatgcacaccctcttcgtcgaggtagatgagatggaccgcttcgagatgaaggagacggtggaggctgctctctcgcagcttgactctacggggagcccgccgcttagttcgatgagctattagggatcactgctacggtcactagtcgctggtcacctattttcacctcacctagtctctcttttgcaaggccaatattatatacgtatataccttatgtaatgtatgccagaattttgcccccttttttgcaacacccgtttatatgtgtggacggaggtgactgctttttttagtacgaggcaataactcaagggatagataaataggctaggcgtgctctggacctcaacgtgtaaaggtcttcatgagcatggcatgatatgcttctggactatgacatatttatagtgataaataacaaggtgattactttataggagcgtttgtaagaaatgtagggcaattttcttgcggttctctacgcaaaaaataaaatanaata

SEQ ID NO: 31461 - DNA, 1573 bp, Triticum aestivum
  unsure (1)..(1573): unsure at all n locations
  Clone ID: PAT_TA_31461
atatatggaattggagttgaggtcggtggagcgtcagggggcccatgatgcaggggggctcgcccaggggggtangcgcgccccaacccttgcggacagggtgtgggccccctaacgtggatctttcttccagtatttttttgtatattccaaaaataatctccgttgattttcaagtcattccgggaacttttatttctgcacaaaaataacaccatggaaattctgctgaaaacagcgtcagtccaggttagttccattcaaatcatgcaaattagagtccaaaacaagggcaaaagagtttggaaaagtagatacgatggagacatatcaatagtcatattgcttaccaccaacatcttattttgattaggcggtattgtgggatgaagcggcccggagcaaccttacatgtccacgcacatgagaccggttccaccgactgacatgcaacttgttttgcataaaggtggctggcgggtgtctgtttctcctactttagttgaatcgaatttgactatgaccggtccttgaagaaggttaaaatagcaaacttgataatcgttgttgtggtttttgcgtaggtaagaacggttcttgctagaagcccgtagcagccacgtaaaacttgcaacaacaaagtagaggacgtctaacttgtttttgcagggcatgttgtgatgtgatatggtcaagacgtgataagatataaattgttgtatgagatgatcatgttttgtaaaagttatcggcaactagcaggagccttatggttgtcgctttattgtatgaaatgcaatcgccatgtaattgctttactttatcactaagcggtagcgatagtcgtaaaagcaatagttggcgagacgacaacgacgttacgatggagatcaaggtgtcgcgccggtgacgatggagatcatgacggtgctttggagatggagatcacaagcacaagatgatgatggctatatcatgtcacatagtttgattgcatctgatgtttatctattatgcatcttattttgctttgattgacgggtgcattatcagatgatctctcactaaaatttcaagatgaaagtgttctccctgagtatgcaccattgccaaagttcgtcgtgcccagacaccacgtgatgatcgggtgtggtaagctctacgtccatctacgacgggtgcaagccagttttgcacacgcagaatactcggggttaaactcgacgagcctagcatatgcagatatggcctcggaacactgagaccgaaaggtcgagcgtgaatcatatagtagatatgatcaacatagtgatgttcaccattgaaaactactccatctcacgtgatgatcggacatggcttcgttgatttggatcacgtgagcaattcgatgattagagggatgtctatctaagtgggagttcttaagtaatatgattaattgaactttaatttatcatgaacttagtaccggatagtattttgcatgtctatgttattgtagatcaatggcccgtgctgttgttccgttgaattttaatgggttcctgagcctgcagcccgggggatccac

SEQ ID NO: 31462 - DNA, 1080 bp, Triticum aestivum
  Clone ID: PAT_TA_31462
cgagcaccggcctccaacaaaaagaaaaaaaacaccagccgacgcgtgcacgcagacggtccagacaccagacgccagagagacagacgccgatgggcagcctcgccggcggggtcggggccaggcggccgcggttcctgtgcctgcacggcttccggaccagcggggagatcatgcggaagcaggtggtggggaagtggcccgccgaggtcacggcgcgcctcgacctcgtcttcgccgacgcgcccttccccgccgagggcaagtccgacgtcgacggcatcttcgacccgccctactacgagtggttccagttcgacaagggattcacggagtacaggaatttcgacaaatgcctggcttacatcgaggagctgatgatcaaagaaggtccctttgatgggctgatgggtttctcccagggttcgattctatctggcgcacttccggggctccaagaacaaggattggccttgactagagttcctaagatcaaatatctcataatcataggcggcgccaagttccgctcacctgcaatagccgataaggcgtacgccaacatgatcaaaatcccctcgcttcactttcttggcgacaatgacttccttaaaccccatggtgaacaactcatagagtcatttgtggatccattcatcatacgtcacccaaagggccacacggtcccaaggcttgttgatgagacgagtttggaagtcatgtcccgtttccttgacaagatggaaaaggagatgtctgaacttccatccgttaaggccgaggccgaagcagccgctgatgttgacgaaaaagaagtgtgcatctgatagcacctcaaggattagtgcctgaatacacatcaaatacgcatataggcaaatcacacagccgtgacctccttagttttgtgttgttgcaagtgtgtgtgattattattcaataatgatagctatcgtctagctctttgccactactccttcacatcctaaggacctagtatattttctcgtgttgatactgtatctctatagtactgtattaacaaataacacgaggaaaaaaaacagaagtaaaaaaaaa

SEQ ID NO: 31463 - DNA, 872 bp, Triticum aestivum
  Clone ID: PAT_TA_31463
ggttagatctccccaaggattccggcagcaataaacgcttaaggtcagagccctgtggtaggccgacatctaaggcttgtagggaaaaagtgagaagagacaagctgaatgacaggttccttgaattgggtactacattggatcctggtaagccagtaaaagctgacaaagctgctatcctgagtgatgcaactcgcatggttactcagcttcgtgctgaagcgcagcagctaaaggatactaatggaagtctagaagacaagattaaagagttgaaggctgagaaggatgaacttcgtgacgagaagcagaagctgaaactagagaaagagacattagagcaccagatgaaacttttgactgcaactccagcctatatgcctcatcctactatgatgccctccccattcgctcaggcgccgatggctcccttccatgcacaggggcaagctctaggacagaaactgatgatgccctttgttggttacccaggatatccgatgtggcagttgatgccgccctctgaagtcgacacctcaaaggacagcgaagcatgcccgcctgttgcgtgatatgcttggaccgcttaaatcgcatgaactcatggtaacctaaaacagcatagttgtttgatccattggttgcgcatagtctctctgattcagattaactattgttctcatgcggtagtttttgttgatgaggagaatgctggcatttgtgcgctctatagagtctactacccttcgtccactgtataatacattttttctggagaaagaaagaatgctcgttcttgttctgatctctgtatagaaacgaataacaattcgaatggcatgtttccttttctaaaaaaaaaaaaaaaaaaa

SEQ ID NO: 31464 - DNA, 1905 bp, Triticum aestivum
  unsure (1)..(1905): unsure at all n locations
  Clone ID: PAT_TA_31464
cgggtcgacctcaggtataaattcgtaatggtaggcctgcaccaccacctcaggtacgcgatgatgtccatattcctaaactgaaattgaatattccaccatttgagggtagatatgttcctgatatatatcttacttgggagttagaaactgaacaacgatttacatgtttacaatatcctgaggagagacgagttgctgctgctgtttgtgctttcactagttttgcatgtgtctggtggtctgaacattgtagattatatcctattccaactacttgggctgctttgaaaactgctatgcgtacgcgttgggttccaccatattatcaacgtgaattgcttcaaaaattgcagcgtttaagacaaggaaaaaattctgtagaagaatattatcaggaattacaaactggcatgattcgatgtggtatcgttgaggagaatgaagctatgcttgcacgttttctgggtggattaaatagagagattcagaccattctagactataaggagtatactaatatcactcgtttattccatcttgcttgtaaagctgaacgtgaagtgcaggatcgacaagcattggcgcgaactaacttttctgcaggtcgaccttcatcatggacaccacgtgcatcatctacttcacacattctgctacaccggcaactccatcggctgccacctccaaccgtgatacaataaagcaggcacaatcaccactatctgccaagatcacaccttctgggcctgcaaagagttgttcttcatccatggcatcaacagggcaaacacatgatattatttgtcgatgttgcaagggtggagctcattatgcgagagaatgccaatctaagagtgtgatgattattattgaggatggtgggtatgagtccgctagtgactatgatgaggagtctttggctcttattacacatgaagaacacggtggagatgattctgatcctgagacgcaatacatggctgctgaagatgctgacaggtatgaatgtttagttgctcaacgtgttttgagtgtgcaagttacacaagctgagcaaaatcagaggcataatttgtttcatacgaagggagttgtgaaggaacgttctgttcacgtcatcatagatggagggagctacaacaacttggctagcatggagatggtggagaagctatctctcaccacaagaccacatccacatccttactacatccaatggttcaacaacagcggcaaggttaaggtaacacgtactgttcgtgtgcattttagtatctttacatatgctgattatgttgattgtgatgtggtacctatgcaagcatgttccttattacttggtagaccatggccatttgataaaaattctgtacaccatggtaaaaacaatcactatactcttgttcataaggataaaaatattactttgcttcctatgactcctgattccattttgaaagtgatattaatagagctaataaagcaaaacaggagacgaataagagtgaaaatcagattgtggcaatagaatttgagcaacaaatgaagcctaataataaaccatctagtgttgcttctgggaacatttacgtgttgtttttattgctctacgtgatgcacgtttgtttggtaaccttggggaagtgcaccttttgcaccgaccgagcatctttccttgggatatgttgttactccacagggaatttgaagttggataaagccaagattgaagctatttgagagttgggccgcaaccccaaaacggtcacacaagtgaggagttccttgggctccgctggttctaatagcgtttggtgagaattcaacacattgcncactcctnaatgagctacaaagaagatgtcctttcctttggggnaccgcacaggaagagcttctccg

SEQ ID NO: 31465 - DNA, 1423 bp, Triticum aestivum
  Clone ID: PAT_TA_31465
ttaaggacgtcgcgccttagcaatcgctaaaccaactccgaaaggttattgaccgcgccggagcatgatcaacctgaccacgaaggtctgtttcctgcaggcaaacgaagaatgagcaagaaactaagattgcaatctggatattgcgaatataagaggaaagctttattgatcaaggtggggttctgtgacgcctttgtctggtcgttgaacacaaacgaagtacgcgaagttgcagctatggcgaactttaatctaaacaaaacccaaagtctaaacgacgccctaagggctgtatatatggaggaagagggggggggggatttcgtggcccttggaggaggggtccgaaaccaaccctaactcttgtttccccacacatacggactctaaaaacagcctatacttatgtatttcgaaattacatgggcctggcccaataataaggtgacgcagcacctagaatagcctctagacgaaatttatgaagtggcatcttgtatatttcgtccaaggcttcattcactccttatggtggcttcaaagtcctgaaatcatcacttgtaactccgttcttgttccccttgtgcatgccatcaactccatgcttgttcttactccaatgttcatccttctccaagctaggcccttcatttgtaagcaaaacaaatgtatccaatttaggcagcatcatattctcatgaacattagaatcattaccaagaaacgaaagtacctgataattcagttggcgtgcgcgagctctagtaattggtccaatatgtatagcagcaggggttgtgggtgtaacaatggtattgaagtcctcatcatcctccccttcttgaaatgaagttgtcctcgacggaagctcatcttcctcacccaaataaggcttcaaacctgcaatgttaaaagtgggactaaccccaaaatctgcaggcaactcaagtttatatgcattatcatttattttctccaacaccataaaaggaccatccacacgtgacattaactttgatttgcgcaaattaggaaatctatccttacgcaaatgtaaccaaacaagatctccaggtgcaaacacaacatgttttctacccttatctcgagcaagtttatatttagcattcatacgctcaatgttttccttagttaactcatgcatttttaaaatcaattcagcacgttctttagcatcaaaaataaccttctccgaagatggaagaggcaacaaatcaataggtgcacgaagtaggaaaccatacacaatttcaaaagggcacatcttagtaatagaatgcaatgaacgattataagcaaatccaatatgaggcgagcattcttcccacattttcttattattcttcagaacagccctaagcatagtagacaatgttcaattgactacttcagtttgtcc

SEQ ID NO: 31466 - DNA, 1592 bp, Triticum aestivum
  Clone ID: PAT_TA_31466
ccaagtcatccggaaggatttcataaattcagatcaatgaaatcctgcacaagttcagcaaccacattcagtagccaacagccaaaacaaccaggtcatagcaggctcggtctgctggataaactccagttgtggtaccatttctggtacagaatagagattaccgagccatcagattcatccaccgcagagcagcaggaattcacatcaaccacagcagagcagcaggatttcataagttcggattgataatatcatgcagcagtacataaaccatcatccagcaaaggtgacaacagccaactgccacggcacggaagattcaacgcagcacgcaaacagtctgctgggtaaactcaaccactgcccaaggagtaacattcgcagtacagaaaagagataaccgtgccgacagagtactcatcaagcattcggccatgccaaactggaaagaattaaaaacgcaagtacatagctcgactgcagcaacaggtcggtcactagtagcggtcgtcgaagcgtcctcctcccctggggcggtcgtacggcgcaggcctctccctgtaacctcctccctcgtagcgagcaggccctccgctgccatagtcggcgccgcctccacgtggaccgtccctgtcatagccaccgccgatgccgccccttgggccgtccctgtcgtagcttgcaccgccccttgggccactcctgtcataggcgccgccaccaccacgaagtccatctctctcgtagcttctctcccgctccctgccatagccgcctccaccaccacttggtgcataacggtccggagcagctccatacctgtctgcaccaaagcggtcaccaccagaagggtaccggtcactggcataacgatcacggcccccatcatatctgtctctgctgtcaataggctcacggtacccaccataacggccaccatcgtagcgatcatccacgtaacggtcgccaaacctgtctgatccagaaaagcggtctcccctgccaccgccgccactgaacttggaagggaatcgcccagaacggccgccaccagggttagggcagtcacgagcccagtgaccagcacggccacactcaaagcaattgccagggggtgggccatcacccttaccaccacgataatccccacggtcaccaccgccaccaccactgctgtaccgtgtgtcatccgtttgcaacttcgggctcagccctgttcactgaaatggtacgaccatctaactctttgttgtgcatatcattgatagcagtctcaactgcccctgggatctgaaaacgtcacgaagccaaagccacggtgccggtttgtgtgcctctccagcatgatctgggtgtcgacgaccttgccgaagcggcggaaggcgtcctcgagcttgcgctcgtcggtgtggaacgagaggccgcccacgaaagatccggctgtcctcccttgcccgccatttgccccgcgcctgcctgcgcgcccgcggccttcggttcgcgggggggagaggagattagggtttgggtgagaggaggaggaggaggcgacgacggcgagaggggagaaagaaagaaagaaagagcag

SEQ ID NO: 31467 - DNA, 1629 bp, Triticum aestivum
  Clone ID: PAT_TA_31467
caggctggtgaggctgacggcgcgcgccttctacgacgacatctccatcaagggcgacacccaggccaagacctcccgcggcgacaaccggggcatggccgtcgtcgtcctcgacggcctcaccagacgccagtgggtccgcgaggaagacttggctaaatcattaaagctccactcaaaacaacttcgccgtgtcctccgattctttgaagaagagaagctagtgacaagggatcacagaaaggagtcagcaaaaggtgcaaaaatatatagtgctgcagcagcagctgcaggtgatggtcaacccacgaaggagggagaagaaaaagtaaagctgcacacacattcctactgttgcttggactatgcacagatctgtgatgttgtacggtaccggatacaccgcatgaaaaaaaaaaacgttgaaggatgaattggacagcagaaatacagttcaacactatatatgtcctaactgtaaaaagaggtactcggccttcgatgcgttgcaacttataagctacacggacgagtatttccattgtgaaaattgcaacggcgaactacttgcagagagtgacaagctttcttctgaggaaatgggagatggtgatgataatgcacggaagcgtcggcgtgagaaactgaatgatatgcagcaaagaattgatgagcaattgaagccattgcaagcacaacttaagagggtgaaggatctgcctgctcctgagtttgggagtctacaatcatgggaaagactaaatctcggtgctttcgcgcatggtgattctgctgcagctgaggcagctaggaatgcacaagggcagtacaatggtacaccgatgccttatcttggagatacaaaggttgatgttgagttggctggttcgggtgtaaaagcagaaggtgatgaatctggcagagatggttcagcattgaaagtcttacctccatggatggtcagagaagggatgaatcttacaaaagaacaaagaggagagtccagtaacacatcaaaaggagatgaaaaatcagaagtcaaagatgagaaaaaacaggactcaaaagaagatgagaagagtttacaggatgaataccttaaggcatattatgaggccctcaagaaaagacaggaggaggaagatgcaaagagaatgcagcaggaaggccaggcattttcttctgaaattcattctgagcggcaggtgggcatgaaagccaaacgtgaggatgagaatggtgaggatgagggtgttgaatgggaagaggagcaacctgcagggaatacatcggaggagccatataagtttgtggacttgaatgctgaggccccagaatccggcgacgacgaggaagatgagattgactgggaagaaggttaaagtacagcgacaagttgccccgtcttgaattttcatgaagtcagttcaaagtgggatgttaaatgataataataatgttgccagatgtatgcatcatatcaaggcttggctgcaaataacatttttctcccagatttgtgaaaagttactataatgtgaagtatgatagtattgatgaagtatgatattgacatccatgtgacgtcaaggaattcaaaagaatttgaaagaacttgttcccttttaa

SEQ ID NO: 31468 - DNA, 1191 bp, Triticum aestivum
  Clone ID: PAT_TA_31468
tttttttttttttttttttttttttttttttttttaatgtgcaatctgcaaatggtacattattttattataaaatgtcccaagctgcaccataacgatcaatgcgtattttgtttcataaataaactgtcatacacacgtatgagtagagtacttcggaaccccaactgacaatctacctacacagccggggagacgtacaagtaggggtccggtcaactccttcccttcatgattttctattcacaaacagagtttccgttctgtataacccatcgccaagctcaggttaaacatgcattattgatgccaaacagaccatgtaacatttccgtaagggcctcatgcgacaatagggtaggatgcacacgtagcaacaccgcacatgttcttgcccatttccatcttgaagtaaccatcatcaccccagtcagcgccccatgagttctttgatgagcccagtaggggacaccatcttcgacaccgtagccaacagccagaacagcgtggttcacatccatcggtgtagttccacaatggtcgctagtgtaaactccgctcttgtacagcctgaaaccagtgatcacctcgaaggcaacactaactgggcgaaccagaccaacagcatccttcagttcatcctcagcacccagggtgatgttaacggagtccaaaaccttgactccaacgttttcaggcttgtaatgacagatgccattgacacccgtgtaagggtaagcctcttcagtgtcaaggccaccattgtatttgatgtactcaaaggcctgagatggtaggcctccactgcatccgaaattgttgaatggttttctcgcagtcaacaagctgttgctcagaaagagagacaggcttcccagtggcctgagtatatgctgcctccaagtgcgcccagtagtgctgaacgtccagcaggagccgcaatgggactggtcttttacggggctaacgatcccatcctccctccagtctttggtctccgggagcgcggcggcgtcgcgcatcaggtggttgccggcgagcgtcgccgagcaggtctgcgccgcgccgagccgggtcgcctggaactcctcccagctcatgtcccgagaagcggttgatgccgaggcggtaggggaggcccttccggttggtggagcggacgagctcgaggctctcggagaagatcccctc

SEQ ID NO: 31469 - DNA, 2093 bp, Triticum aestivum
  Clone ID: PAT_TA_31469
cggcctcatttaaccttgactagataggtagttttactttgcttcaccctcttgccatgtttaacaacatttaatattgttgggtacataaatgagatcgaactaaataacttgtcgtggtgttttgtcaatatgcaactcgttgcatattgagctccacttaatttgtaggattgtttgcgcattatgccatgccatgcctctttaaaccggacatgcatcatacttggttgtgcatcatgctatgttgatgtggtggttgtttactatgttgtgtgtttctttccggtgtttcttcttcgggttggttccgataacgtcgtgtttgtgaggaaccgttcgactacgtccgtttgtcttcttcatggactcgttcttcttccttgcgggatttcaggcaagatgaccataccctcgaaatcacttctatctttgcttgctagttgctcgctcttttgctatgcctatgctgcgatacctaccacttgcttatcatgcctcccatattgttgaaccaagcctctaacccaccttgtcctagcaaaccgttgtttggctatgttaccgctttgctcagcccctcttatagcgttgttagttgcaggtgaagattgaagtttgttccttgttggaacatggagatgttgttccttgtttggaacatgtttacttgttgggatatcacaatatctcttatttaattaatgcatctatatacttggtaaagggtggaaggctcggccttatgcctggtgttttgttccactcttgccgccctagtttccgtcatatcggtgttatgttccttgattttgcgttccttacgcggttgggtcataatgggaaccccttgacagttcgccttgaataaaactcctccagcaaaggcccaacattggttttaccattctccacctagccttttctttcccttgggttctgcagactcaagggtcatccattattttaacacccctcccccccggggccagtgctcctctgagtgttggtccaacctgtcagccgccagtggccaccaggggaaactctgggctggcctactggaagtttggacaatctgagtgtgccctgagaacgagatatgtgcagctcctatcgggatttgtcggcacattcgggcggtgttgctggacttgttttaccattgtcgaggatgtcttgtaaccgggatgccgagtctgatcagaatgtctcgggagaaggaatatccttcgttgaccgtgagagcttgtgatgggctaagttgggactcccctgcatggatttgaactttcgaaagttgtgcccgcggttatgggcagatgggaatttgttaatgtccggttgtagataacatgaaacttaacttaattaaaatgcaccaactgcgtgtgtaactgtgatggtctcttctcggcggagtccgggaagtgaacacggtgttggagtaatgtttgacgtaggttgttctaggatcacttcttgatcatacttttatcgaccgtgcttttgccttctcttctcgctctcatttgcgtatgttagccaccatatatgctagtcgcttgctgcagctccacctcatatctttaccttacctataagcttaaatagtcttgatcgcgagggtgtgagattgctgagtccccgtgactcacagatacttccaaaaccagtttgcaggtgccgatgttaccgagcaggtgacgcaaccaagctcaaggaggagctcgatgaagatcttgtcctttgtgttgtttttcattctagttgatcagtagtggaacccagttggggtcaatcggggaccttgtcgcatttggggttcttcctttattttggttccgtagtcggactttgattgtatctggatgatgtaatgctttattcatgtaattgtgtgaagtggcgattgtaagccaactatgtatctctttccctgatgtattacatgggttgtgtgaagattacctcacttgcgacattgctttcaatgcggttatgcctctaagtcgtgcttcgacacgtgggagatatagccgcatcgagggcgtttcaagttggtaatcagagccttccccgaccttaggagc

SEQ ID NO: 31470 - DNA, 2273 bp, Triticum aestivum
  Clone ID: PAT_TA_31470
gcgtccggtggaattgcttagcagatggtgcttgtaccaagactctccgccagcattctgattatgtgatatgtcttgctgcggctgaaaagaatagcaatattgtagcctctggtggccttggtggtgaggtcttcatatgggatcttgatgctgctattgcacctatagccaaatctgtagatgcaaaagaggatgaggttcctaacggaaactctggacctgctttgtcaaccttgtgcaatgtaaattctagtggcaacattgtttctaccaacggaaaatcacatgggtactgtccaattgctgccaaaggtcataaggattcagtttatgcattggatatgaatgatacagggacattgcttgtctctggtggtactgaaaaggttgttcgtgtttgggatcccaggacaggttctaagaacatgaaattgagagggcacactgacaatatcagggctttgcttattgattccactggaaggtattgtctatcaggctcgtctgactcaatgataagactatgggatctaggacagcaacgctgtgtgcattcttatgccgttcacactgaattcggtttgggcgctcgcaagcaccccttcatttggtcatgtttatagtggtggaagagatcagtccgtgtacctgacagacctctccacacgagagagtgtcttactatgcacaaatgaacacccaatcctacagttgtccttgcaagatgatacaatatgggttgcaacaactgattcttctgtttatggatggccagctgaagggcaaaccccacaaaaggtttttcaaaagggaggctcattcttagctgggaatttgtcattctcaagagcaagagcttctttagaaggatcagcacctgtgcctgtatacaaagagccatctttcactattcctggagttccagctatagttcaacatgagatcatgaataatagaaggcatgtcctgacaaaggatactgttggttctgttaaattatgggagattactcgaggagctgttatcgaagattttggcaaggtttcgtttgatgataagaaaaaggagttatttgagatggttagcatacctgcatggttcaccatgggacgctcgattggggtgcctgtctgttcacctggatactccacaatgcttttctgcagaaatatatgcggttgatttgaatgttactggagcacaggaagatcttaagattaatttggctcatgagactcttcgtggtttgttagttcattggagtaaacgaaggccgaaaccaggcccacacagcttgtccaatggtgattcttcaatagggaaagatgtatcattgaaaattttgccacattcaagatctgacgtcgacgatggaagcgaaaaccatgcaaataatgtgcttccctcgtttgagttctccacggtttcgcctccatcaattatcacggaaagttctagtggagggccttggagaaagagaattaccgatttggatggaaccgaggatgatttgccatggtggtgtgtggactgtgctgagaacggccgatttccaaaagagaacacaaagtgtggcttttatttgcatccggccgaaggctcacctgcaccaaacataacgcaagggaaactcagcgctccacggatattgcgagttctcaaagttgctaactatgttgttgagaagcttgttcttgagaaaccattggatggaagtccggacagcacatttgccatgggtttgacctctggcacatcagccctagatagttcttcacggcctggattaaagccatggcaaaaactgaaaccttctgttgagatattgtgcaacaaccaggttctgtcacctgagatgagtttggcgactgtgaggacatatatttggaagaagccggaggatttgattcttaattacagagtggtccaatcaagatgattgcaacctaaaatacatccgttcatttggttcaccataggtgctgagcatatctgcattggagacggcatcgttgaagataaccatatgacctataggatgcaagtgttccactcttgtgctgctctttggtgccgttcccagaactacagcaacttaattcctctgtaaagtttttctgtgaatcttgtatctccaggcttctagtgaggttgtatcatagcacaggtgtaatgatctgctggctaccaggcttgtatatctagagatttggatttctcaataaagcttctaatgggtaaaagaaaaaaaaaaaaaaaaaaaaaaaaaa

SEQ ID NO: 31471 - DNA, 1599 bp, Triticum aestivum
  Clone ID: PAT_TA_31471
ggcgagaacgacgtcggcgccgacgacgacgaggaggaggccactccctcgcctccacctccgccgacgcggcactaccaccagcacctgctgcagccgcaacaactcgtcacccaagagctgttccccgccgcggccaccgccggcggtccgccgccgatgtccgtgccgcagcattgggccgagctcggcttcttccgccccgcggcgccgcctccggacatgaggatcctgcagatgcagcagcagcagctgcaggtgcacgcgcagcccccgccgccgccggcggcccagccgccggtggccaagaagagccgccgcggcccgcgctcccgcagctcgcagtaccgcggcgtgaccttctaccgccgcaccggccgctgggaatcccatatctgggattgcggcaagcaggtgtacttgggtggatttgacactgcacatgctgctgcaagggcgtacgatcgagcggcgatcaagttccgtggcgtcgacgccgacataaacttcaacctcagcgactacgaggacgacatgaagcagatgaagggcctgtccaaggaggagttcgtgcacgtgctgcggcggcagagcaccggcttctcgcggggcagctccaagtacagaggcgtcaccctgcacaagtgcggccggtgggaggcgcgcatgggccagttcctcggcaagaagtacatatatcttgggctattcgacaatgaagtagaggctgcaagggcttacgacaaggcggcgatcaaatgcaacggtagggaggccgtgacgaacttcgagccgagcacctatgatgcggagctgctcaatgaagttgctgctgaaggcgcagatgtcgacctcaacttgagcatatctcaaccaacttcacaaagtcccaaaagggataagagcagccttggcctgcaactccaccatggatcatatgaaggctctgaactaaagagaccaaaggtcgatgctccccctgagatggtcgcaatccctcatcgatatccccttctgaccgagcatccaccaatctggcatggccaatcatatcccctctttttaaataatgaggatgcagccagagatcatagcaggaggccagaggtggccacagggggtgttccaacctgggcatggagtgtgagccaccctcctccaacacaacccatgccactcttctcgtcgtcatcgtccgctgcagcatcatcaggattctccaaaaccgccgcggcagctgcccccggcgccccatcggcctcattccggttcgacccgatggcgccatcatcatcgtcaagcaaccaacaccaccaccaccacccccgctgaaaaagaagccatactgtaaattttctgggaagccagtatctttttgcccctccggcgtttcagcgttttcggtcttgcgccggggcggtttcaggtagtggattggattcatgactgtatttcccatgctgcccaaagtgaaatgtcacttcttttctgcgctctctgcagcattggtcccataattcctgatgtcaagatactaacgtcagctcatctcaccatctggagatggatttatacaatggtgtagacaaactgtcatga

SEQ ID NO: 31472 - DNA, 1904 bp, Triticum aestivum
  unsure (1)..(1904): unsure at all n locations
  Clone ID: PAT_TA_31472
ttgtttgtttctttctgggttgcttctcacgttagcttcggtttcgttccggagttgtgaggatttgttcgtctacgaccgtttgtcttcttcttggactcgttcttcttccttgcgggatctcaggcaagatgatcataccctcgaaatcactactatctttgctatgctagtttgctcgctcttttgctatgccaatgctacgatgcctaccatttgcttgtcagcctcccaaattgccatgtcaaacctctaatcctccatgtcctagcaaaccgttgattggctatgttaccgctttgctcagcccctcttatagcgttgttagttgcaggtgaagattgaagtttgttccttgttggaacatggagatgttgttccttgttggaacatgtttacttgttgggatatcactatatatcttatttaattaatgcatctatataattggtaaagggtggaaggctcggccttatgcctggtgttttgttccactcttgccgccctagtttccgtcatatcggtgttatgttcccggattttgcgttgcttacgcggttgggctataatgggaaccccttgacagttcgccttaagtaaagctcttccagcaatgcccaacattggttttaccattcgccacctagcctttttttcccttgggtttcgcggactcaggggtcatcattattttacccccccccccgggccagtgctcctctgagtgttggtccacctgtcagctaccggtggctaccaggggcaactctgggctggcctacccgtacctaggacaatctgagtgtgccctgagaaagagatatgtgcagctcctatcgggatttgtcggcacattcgggcggtgttgctggtttagttttaccctgtcgaaatgtcttgttgtaccgggataccgagtctgatcggaatgtctcgggtggaggtctattccttcgttgaccgtgagagcttgtgatgggctaagttgggactcccctgcagggatttgaactttcgaaagccgtgcccgcggttatgggcagatgggaatttgttaacgtccggttgtagaaaacctgaagttgaccttaattaaaatgaatcaaccgcgtgtgtaaccgtgatggtctctttccgacggagtccgggaagtgaacacggttgttggagttatgcttgacgtaggttgctataggatcacttgttgatcatacttttatcgaccgtgctttgcctcctcttctcgctctcatttgcgtatgttagccaccatatatgctagtcgcttgctgcagctccacctcatgcctttaccttacccataagcttaaatagtcttgatctcgccgggtgcgagattgctgagtccccgtggctcacagatactcccaaaaccagcttgcaggtgccagggataccagtgaagatgacgcaacccagctcgagtgggagctcgatgaagatcttgttcgttgtgttgtttcttttcatgttgatcagtagtggtgcccagttggggtcgatcagggatctagcagttgggttgtcttcttttattttggttccgtagtcggacctatgtgggtatctctgaatgatgtatgttttatttatgtattgtgtgaagtggcgattgtaagccaactatgtatctcttttcccttatgtattacatgggttgtgtgaagattacctcacttgcgacattgctttcaatgcggttatgcctctaagtcgtgcttcgacacgtgggagatatagtcgcatcgagggcgttacaagttggtaatcagagccttccccgaccttaggagccccactgcttgatcatttttagcggccgagttgtgtctagaaaaatgttttnagtcatttaggattatatatatcggagagttaggaat

SEQ ID NO: 31473 - DNA, 1676 bp, Triticum aestivum
  Clone ID: PAT_TA_31473
ccgggtcgacgggaggggttgttttcttctctaagtcctttttcctcataacatatgcccttgttcaccgcatcgtaactttgcacccgtagctccgttttgggcgtgtagcatatcaaattgttcatctggatatgcacttcatttcattccattgtaccatattcatttgaggtcatcttgatgccctaaatgctgttgcaagagtgctatgtaatgttagtttcagattcttaccagattatcgacatttgtcatttttgccatgtttaatgatgaggacatgactaccttggatatgaccaaaaatattgcatatatgcatatttgtcaggtgatttctagtgcaaactattcaataatctatttatgttatccagaacaaaaatacttcacacacttttgtgttttgtctaattgcaggtgtatgcgacatttgtacaatccacatatgaagataagggagaaagagatgtttacttgctgttcaaaaagttctctcacgtcacttttgggccaagagaagatagagtccaagtctctcacgttctggattcagattcggactgcacagacatacctgactcaaaacgccaacaactttttcatacggactccgaattgggtgattctttttttgttggaaactagatttcgtgctctttccaacacaattggattcacctttaaattcgtccggagcattgagttatggtcgaaacaatctgacgttgcaccagaatccgagtcaaactacaagtccaaaggtgttgcatcacctccacttgggcccatgtgccttgtacgacctagggttggttttaggctgccttgggacgtcctcccacctccttggccgccaccccttgctcctatataagtagatccatctagtagcttttccttgggttttgttgagttaaaagttagccattgcaacttcgtgtacttcgtttgtgtccaacgaccagaccaagaccgcttacggatccccaccattatcaatacttcatatatattcgcaatattcagattgcttttatcatattcttgcttgttcttcgattgcttgcaggaatagaccttcgtggtcaggttgatcatgctccagcgtggtcaataacctctcggagttggtttagcgattgctaaggcgcaacgtcgttgcacgtttgtagtcggatcgtcaaagtcgtctccaccaaatcgatagttatcatctcatcgaaacatcgggacacctttgcctctatcaagtggtatcagatttccaggttgctcggtgagattttacagtttttcgtagtttagatcgagtctgttcttcatacctacagtccacgaaaaagccacacaaaaaattagggttagttcatcatatccgaaccaatctgagcctttgcataatctttttagggttttgctttgttgaatttgcggttgcatcgtcgtgtctagttgctggtcttagagtctagtcttttagagtttcgagttctggtcataagttgtcacgccgccgccgcaccatcatcatcgcccctgtcacctaccaccaccgctctgaatccgtatcgatcccatccaccaatttccaccacgtgctatgcactgttcattgtcataatcatagttgaggtcactcacatcttcgcctgatcgaatctgcatcttat

SEQ ID NO: 31474 - DNA, 789 bp, Triticum aestivum
  Clone ID: PAT_TA_31474
ggagattcgtatatgcatcactgctgcgtctccttgtcttgaagtttgtcttgagcatgtcagcaagtaaggatgtgcttgcacttgcttcccttgaggttgatctatccagcattgaacccggcagcacagtgactgtcaagtggcgtggaaagccagtcttcatcaggcgacggacagatgatgacatcaagctggccaacagcgtggatgttgcatccttgcgccacccagagcaagacgctgagcgtgtgaagaacccagagtggctggttgttattggggtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaagagcctaaaaccagtacctaccgacatatattctcgacaggagtgaattcctgttgcgctgttattttgttttcaatgtggctaggagtttttgtttcaggactatcgcaacggtgatccactgttacctactgaagttcatttgcagtgcgaaataattgtttctcctatgttgctactggattgtaagttgttttatactgattttctgagaccctatcggaaggatattgtatacctcttctggtccttgctccctatatatttgataaataagcaaacatactattcttcatcttttgtgtctataacaatgttattcatt

SEQ ID NO: 31475 - DNA, 1929 bp, Triticum aestivum
  Clone ID: PAT_TA_31475
acaatttccgtggctgtaaatattgcagcaggagaagagagacacgagctctccctccggaggccacgagcctccccctctgttcgtcgtcccctctccaacgcccgcgcgcccgccaacaccattccccgctccgattcctccgaatttccggctccccatggcttccccagatatctcctttgatattcgcccagagtttaactcatttgatcatctaagaagcacgggatatatttcaacagatagaccatggttgaaactatatggaataagagttccacccgtgtcaccgttcaacagtttgagcagtacgcccgatctggcactcattcaccagtgcttacctgatgaactgcttatcgagatatttgggagaatgagcccatatactttagggagggctgcttgtgtctgccgcaagtggaaatatactacacgcaatcctactttttggcggaacgcttgcctgaaaacctggcagaggaatggaatagaggcaaacttcaggatggtgcagtcgttatatgattcttcctggagaaaaatgtgggtgcagagaccaagaatccgaattgatggtctttatgttagtagaaacacatatattcatactggaattacagaatggcagttcaagaaaactgtcaatgtggtttgctactaccgttacttgagattttttccaaccgggaagttcctgtacaagatttccccacagaaagttaaagatgttgtcaagtgcatgcatctccgagcatcaaaaggcgatagtgtgtttaaaggcgactatatactgtcaggggatggccagatagaaatggcactcctatatcctggacatcggtacacacttgttaggatgcgccttagggttagaggcactacaattggtgcaaataacaggttggatgtcttaaagatcctaaccaccggggtgaatggaaccgaactgggaaactggaaaggcaacatacttgaacttgttgaggactgggaggagaacgagacgcacgacccagacgtgcctgctgtttcccacagcaggggtttgactccctttgtgtttgttccatttgaggagtctgatacttcaagtgctaaacctgccaatgggagaaagatggattactttgtccctgggtgagcagcaccgcctaaagacgaccgcggtgatgggcaatggagatggtcgataatctcatcacaggctgatattatgctgcggatggagacgactggcttatttcgttccataccgagttaatgttggaacgatatgtacatacacagtacttgtcttgtttcctttcgggttgaaggcatgttgtattgtaatgtactccctccgttcctaaatatttgtctttctagagttttcaacaagtgactacatacggagcaaaataagtgaatatacactctaaaatatgtctatatacatccgtatgtggtagtctatttgaatctctaaaaagacaaatatttcggaacggagggagtagattagttgtgttttaagttgatttgtttgtttgttgggaggtgttttttcctgcttgtgtttattaaagaagtttattcattgatgtggaacaggggtgggaggggtgaatgaattgctgccaccaacttcttttgtagaaatataaagataaaccaaagtactttctattattactacttgcttagctcctagcttttgatgccttcatctaataccatggctctttaaaaaatttcaggcatcatttcttgcagtgccctacaacctcgttaggcaagaattttgaaaagcttgtccagtgtgatcagaggctacatcagttgagtcaacaaacggacgtcatcttggactcttcagtttttgaacccagatgttctatatttgaggatccggtggaatcgaagtgccatgactttgctaat

SEQ ID NO: 31476 - DNA, 1500 bp, Triticum aestivum
  Clone ID: PAT_TA_31476
aagaatcacaacacacaataatttatttacaatgcaatgacattatatccaacttgatagaacacgattcatattcgatacagcctgttacacaaaacaacaaagcacgatggcagcacccacccagtccactattgattacacagtatatattccacaaattaaaggaaatatagaccattgattccatcatttgaatttctcaaacatataggtggaactaagaactaataacagtaatggtttgcttaataactatactttgaatcaacataggcatcattgtttctattctttctgccacctcttccgaaagcaatcagaccaattgtcttctcaatccttgcagacatcacgtagagcttgatatgcctccataaaggtgacatgaccagagaagctccaataattccagtcttagcaccttcttgcataacaggaagtacttgcttaaaatcgccactaacaacaacaacctttcctcttaaagggaagagtgaccttgagctatcatatactgcaagtatatctctgaaaattctatcaagagcttcgaaacagtgacagcgcaccattggagcttcatcccacaggaccaagcaagctttatcaagcaaaatcgcatctggggaacccttggcaaagtccacagtgcaaaagccaaccatattgacctcccgtttaatgaatccaatggcagcagtaatctcagctggaatcttagttttgcagaatccagtcatgcgcacaaatcctttgtagttatttattggcattatgccaggaacgatagggcaggttataccaatctgacggcagtcgttcacaaacttgagaaagatatcggtatcatagaaaagttgggtgactataacgtcagcgccagcatcaacctttctcttcaagtaagcaagatctttgctatatgcttcctccgtagccccttcctcgcctagtattacctcagggtgtgcctctggatagccagcgacagttatgccaaagtaatcaccatacttggctttaatgtgctccaccagatctagagcacaagaaaatccaccagcaacttgaacaaacttgtcctggccatgtggaggatctcctctaagtgcgagaacattttgaatcccgttggacttaatggtatccaaagcattatcgatcttctccactggcatgttggtgcacgtcaagtgcatcatcgtttccacgcataccatgttctgcatgcggttggcgatgtcgagggtgacgtcggcggtggatccgccggcgccccaggtgatgtcgcagaagtttgggccgtgcgccaccatgcggtccatccgctcgaagaggttctcgacgccctcctccgtcttgggcgggaagtactcgaaggagaagacggtccggccattcgccgccgcctcctggatcttctcgatcaccttcatcttcctctccctcttcctctagaaccttcccacggctctaatggcgtcgcccacgcgtccg

SEQ ID NO: 31477 - DNA, 1130 bp, Triticum aestivum
  unsure (1)..(1130): unsure at all n locations
  Clone ID: PAT_TA_31477
gattcggcacgagccgacctaggctatggctttcatcgtgtccaagctcgcgcgggcagccctcgcatcccgccccgttggagatattgctggtggcatctccccgtgtctctcccggctctatctggcggctagtaccagccgtcgcatgtttgcagctgcaggcggtcccaagtcaaaagaagcaccccgaatatttccccttgttgatgagaattccattaagtcgaaggaatccctatgggccttgtatgaatgctggtgcaagtattggggggtatcccgtgaccgtgaagagatggtccgccggttcaagtcatttgaggctactgcacagtgggtttacaaaatgaacaactctgggtgttcgcaagtgtctcaactgggcccgcatgcagatatgtcagagagtgagtttgatcaggtgtttcctccacttgaggatgatgatgaagacataaaagagatggtgccaggtgaagatttgggccaggagcttgaggagcccttaaataattaatttgagaaattatgaacttgtcttactccatccgttcccaaatataagtctttctagagattcaacaagtgactacatacggagcaaaatgagtgaatctacactctaaaatatatctacatgcatctgtatgtagtccatattgaaatctctaaaaaaagacttacatttaggaacggagggagtatgaagtattatatgtactgtaactggattctgtttcttgttaacagatactgcatctaaggcggcagctccattatttggctggttgtaaaggacaggaggcatgtcaagagcctccatccccttagtgacgctgctgcgataatctgctcacttgattaggagataaggcccttggagatcccacgagcatactatcgaggcaaaaatatatgattcaataaacagacttacttcgtgaggtaggaggacatactaaggatcaagtaataggattttgagagagtattggagccaagatagctggtaacatcctggttaccggtctcttttggttcactatatatgtaaattcttttgtgtttatataattttcttcgactatgtacccattcggttccattaaccanaacaccaagatttc

SEQ ID NO: 31478 - DNA, 2600 bp, Triticum aestivum
  Clone ID: PAT_TA_31478
ggccgcccgttgcaggagcgctcgtccccaagtcctgcgctgccgccgttcgagaggaggacgacggagccgcgccccgtgttgaccagtctagcaccagcctggactagtgccactcgctgcgcgaggcctcgtctgcttcgctcgcggcccagcatgcgccccgcggcctgcctccacctcctcaccgacgggctgaagcccatggtgagcgccccagcgcccagcagtttcagcccaatgtagttttttttcggtctgcgaatttgtctaatttccggggaattagcagatttgcagaaaaaccctcatacttcatgcatttaataacttctcaaccgtgcatcagattaaaacattttatatacgtaacatgcttagaattgcatctagtttcataatatgtcattttcatccatgtttaaaatgtttaagatgctgtttgtttgaattttgcttaaataacttgctaaaatgcttaaattcataactaaataaccgtagatcggtttctaacaaactttatatgtaaatggggaagaaaaatgcctagtttatcatgatggatttactttgcatgtttaataattctaaaattgtctttaggtcagaacaataccataaccaaaaatatgcacatgaggatttttccggacttgttgcttgttgttccggcctcatttaaacttgcctagataggtagttataatttgcttcaccctcttgccatgtttaacaacatttaatattgttgggtacataaacaagatcgaactaaataagtcacatgctgtttcgtcaatatgcaccgttgcatattgagctccacttaatttgtaggattgcttgtgcactttcgccatgccatgcttcattaaaccggacatgcatcatccttggttgtgcatcatgccatgtttatgtcgtggttgtttactatgttgtttgcttctttccggtgtgcttcttcgggttggtaccgataacgtcgtgtggtgaggattcgttcgtctacgtccgtttgtcttcttcatggactcgttcttcttccttgcgggatttcaggcaagatgatcataccctcgaaatcactactatctttgctatgctagtttgctcgctcttttgccatgccaatgctacgatgcctacatttgcttgtcagcctcccaaaatgccatgtcaaacctctaacccaccatgtcctagcaaaccgttgattggctatgttcccgctttgctcagcccctcttatagcgttgttagttgcaggtgaagattggaggccgttccttgtcgggacatttatttacttgttgggatatcacaatatatcttacttaattaatgcatctatatacttggtaaagggtggaaggctcggccttatgcctggtgttttgttccactcctgccgccctagtttccttcatatcggtgttatgttcccggattttgcgttccttacacggttgggttataatgggaaccccttgacagttcgctttgaataaaactcctccagcaaggcccaaccttggttttaccatttgccaccaagcctttttcccttgggagtcgcacatcccgagggtcatctttattttaaacccccgggtcagtgcttgtctaagtgttggtccaacccagagcaccgtgcagggccgtcccttggcaacttgggttacgttggctcccgtacgtttagcttatccggtgttgccctgagaacgagaaatgtgcagctcctgtcaggatttgtcggcacattcgggcggtcttgcgggacttgttttaacctgccgaatcatcttgttgtaccaaggtaccgagtctgatcggtgtgtcttgggtggaggtctattccttcgttgatcgtgagagcttgttatgggctaagttgggacccccctgcagggatcgatctttcgaaagccgtgcccgcggttatgggcggatgggaatttgttaatgcccggttgtagatgacttgaactaaacttaattaaaatgaatcaaccgtgtgtgttaccgtgatggccccttctcggcggagtccgggaagtgttcacggtgttggagttatgcttgcgcaggttgttctaggatcacttcttgatcatagttgttcgaccgtgcctttgctctctcttctcgctctcatttgcgtatgttagccaccatatatgctaagtcgcttgctgcagctccacctcataccttttacccttcctataagcttaaatagtcttgatcgcgagggtgtgagatgctgagtccccgtgactcacagatacttccagaaccagtttgcaggtgccgatgagtccgtgcagatgatgcaaccaagctcaggaggagctcgatgaagatcttgccctttgtgttgtttcgttctagttgatcagtagtggagcccagttggggtcgatcggggatctgtgtggcttttggggkagtcttcttttattttggttccgtagtcggaccttgattgtatctggatgatgtaatgctttattcatgtaattgtgtgaagtggcgattgtaagccaactatgtatctcttttcccttaatgtattacatgggttgtttgcg

SEQ ID NO: 31479 - DNA, 883 bp, Triticum aestivum
  Clone ID: PAT_TA_31479
gatcatctctccgtgtgtgctagcttctaattctctaatcgatcatgggtggaggccacgacatgcacggcggccacaacggcggcgtgaagggcttcgtgtccggcctcgttaacggcgggaaaggccacggctacggatcgtcatacggccaggggcacggctacggcggtggccacgtgcagggctacggcggccatggccagagctacgagcacgggtacggcgggcatgcgcagcacgggcacggcggctatgagcacgggtacggcggcggacatgcgcagcacggccatggccacgagcacgggtacggcggacacgtgcagcagcacggatacggcggtggccacgcgcagctcgggtaccctcctgccgccggtgcctaccctccgcacggcggttaccaggcgcacggctacgcgccggcggcctacccctctcacggggcgcaccacggtcacatgggatcgtaccacaccgggcatggcggcgggcaccaccacggcggcaagcacggaggcaagtaccatggcggcaagcacggcagtaggtggtgaagtactgaagtggctagctgcagccattgctggcgcgctctacgacgtccacgtacctgtgcgcccccatggccagttacgtacgctggcgtatctccatcatctgccttagttgattcaccatgctccgttgtagcgaccaataacgtcttacattactgagacgaagggagtactacctaaataaagagctacgcgtgcatgggcaaggtgtgtggtatgtaatgtctgtgtaccttaaaaaatgtaatgatctatgtggtgacctaagtctgtcgtgcgtgacttaataggagtactacataaacataatttttattttt

SEQ ID NO: 31480 - DNA, 2216 bp, Triticum aestivum
  Clone ID: PAT_TA_31480
tgttgttccgacctcatttaaacttgcctagataggtagttttctcttgcttcacctcttgccatgtttaacaacatttaatattattgcgtacataaccgagagcaaactaaataaatgttgtgaagttttgtcaatatgcaactcgttgcatattgagctccacttaatttgtagtgttgtttgttgcactttgccatgccatgcctcattaaaccggacatgcatcatacttgtttgtgcatcatgccatgtttatgcttgtgcatttaccatattgtttgtttctttccggtgttgcttcttagttccggtaatgttgcgattgtgaggattcactcgactacgcttggttcggtttcatccgttcgtcttcttcatggactcgttcttcttccttgcgggatttcagttgcaggtacaggttatgcgatgatcttgatgcgagagcgatgtttgcttgtcttggagttcttcttctgcttcttcttcgatcaggggataggttccaggtcggcagcctgggctagcagggtggatgtcgtttgagtttctgtttgtgtttcatccgtagtcggatggtgctctgatgtattgtgatgttgtattcatgtggcattgtatgccttctgtatgtatccccatctattatgtaatgttgatgtaatgatatccaccttgcaaaagcgtttcaatatgcggttctatccttggtgggaccttcgagtctctttaggatagtatcgcatattgggcgtgacagtttagttgatttggatcacgtgatcacttagattattagagggatatctatctaagtgggagttcttaagtaatatgattaattgaactttaatttatcatgaacttagccctgatagtattttgcaaataatgttgtagatcaatagctcgcgttgttgcttccctgtgttttatatgtgttcctagagaaaactaagttgaaagatgatagtggcaatgatacgaactggacccatgatctgaggtttatcctcattgctgcatagaagaattatgtccttgatgcaccgctaggtgacaaacctattgcaggagcagatgcagacgttatgaacgtttggctagctcaatatgatgactacttgatagtttagtgcaccatgcttaacgacttagaatcgggacttcaacgacgttttgaacgtcatggagcatatgagatgttccaggagttgaagttaatatttcaagcaaatgcccggattgagagatatgaagtctccaataagttctacagctgcaagatggaggagaatagttctgtcagtgagcatatactcaaaatgtctgggtataacaatcacttgattcaactgggagttaatcttcctgatgatagtgtcattgacagaattcttcaatcactgccaccaagctacaagagcttcgtgatgaactataacatgcaagggatggataagacaattcccgagctcttcgcaatgctaaaggctgcggaggtagaaatcaaaaaggagcatcaagtgttgatggtcaataagaccaccagtttcaagaaaaagggcaaagggaagaaggggaacttcaagaagaacagcaagcaagttgctgctcaggagaagaaacccaagtctggacctaagcctgagactgggtgcttctactgcaagcagactggtcactggaagcggaactgccccaagtatttggcggataagaaggatggcaaggtgaacaaaggggctacggattaagcgaggattggctaaggacgaggtgacgatgcacgtgggaaatggttccaaagtcgatgtgatggtggtcggcacgctacctctacatctaccttcgggattagttttagacctaaataattgttatttggtgccagcgttgagcatgaacattatatctggatcttgtttgatgcaagacagttattcatttaaatcagagaataatggttgttctatttatatgagtaatatattttatggtcatgcacccttgaagagtggtctatttttattgaatctcgatagtagtgatacacatattcataatgttgaagccaaaagatgcagagttgataatgatagtgcaacttatttgtggcactgccgtttgggtcatattagtctaaagcgcatgaagaaactccataccgatggacttctggaatcacttgagtatgaaccacttggtacttg

SEQ ID NO: 31481 - DNA, 1277 bp, Triticum aestivum
  Clone ID: PAT_TA_31481
ttgtcggcaacctgcagggaatacatcggaggagccatatatgtttgtggatttgaatgctgaggccccagaatctggcgacgacgaggaagatgagattgactgggaagaaggttaaagtacagcaacaagttgctctctcttgaattcatgaagtcagttcaaagtgggatgttaaatgataataatattgccagacgtatgcatatcaaggcttgcctgcaaaaaacatttttctcccagatttgtgaaaagttactataatgtgaagtatgatactctctccgttcctaaatatttgtctttctagagatttcaacaagtgactacatacaaagcaaaatgagtgaatctatactctaaaatatgtctacatacatccgtatgttgagtccatttgaaatgcctagaaagacaagtatttgggaacggagggagtagtaatatacaagcaagtcaattacatgccaccaccaatcgttgtgacaagtagaatgatcaagcgtttgcttcttccgttgataacttggcgtatgcagtatcccccagctggctgtcgatgttctccctgcgctcgtagtagaacgcggtcatggcgcagacggcgaacaactgcacgagtgccatcagaacggcgtacacaaaacctaggagcaacccaagagccacgctattacccgcgcaagtcgtcgcgagcgtgtgcaccggcgaaaggacgctggccagggcacaggtaacggcgacgtacagcacgacctgccacttcttccccttcgccagcctacacgccctgcataacgcggctgccccttggcagccgggctcggccaccgccacgacgacgctgaaagagcagacgaaggagaagtagacgagggagatggccgcggagaggactagcagcgacgccaggatgagcaacacgaagtactgcttcgccatgagaacaacgagaagtgcccccatcaacgccagaaacacgatgtagacgatctccaggacgtagacgaaggcgagcgtgagcagggggcccttcagctgcgccttagcttttcctaggagctcgctgaaggtagcacgctgctcgccggagtacgtcaagacggtggcgaagaggaggatgatccggacggcggagctgacgacgatcgcgaagaggaggtacaccgcgcctacgagcaggagctccttggtgtcattctggatctcctgtacgagcttggcgtactccaggctgccggggtcggtgccgtttagcgccttgacgtcgagctgga

SEQ ID NO: 31482 - DNA, 850 bp, Triticum aestivum
  Clone ID: PAT_TA_31482
tttttttttttttttttggggaaaaagctcagccccatccacctttttaccccacgggactttcccccacatgagctcacacacattttgaggacatacacatgcatggcaagaacacaaagagaaagaagaagaggaaaaagaggaacccagctactagctacgtacatccatgaatgaataatgaaacaatccgtggccagccgattggcaagaacgattgtttctgattccttttctcttgtcctaggaatcgaacaacagatgcatccaccccctaaacctagaatgaacgaattgcccacatcgcagcagcaatggccgatccaacagcaaccacgatttagcttgtgcttttgacgaggactcgagttttttttttttttttttatataggatataagggagtaacatatctccattcttcagcaagtgaaataacacaaaatcctcacaggtcccaacattacatctcagtctagtacatactcagaataaactcgtttactgaacacagacgctgctaaatccaacattcgcactactggtaaaggcatgatctggcttgatgcttcttaaacctcctggacgttcaaacctgggggggagggactgcttgagcttgttggccttgtcggtgtcgtggacgcagagggtgtagaggtacctggagcagcgcaccttgaacttgacggcgtccttggtcctcttgatccgcaccgaccgcgcgtccttccgccgcgccgtcaggaggaagtccttgatctcgtggatctgcttcggcatggtggacggcggaggtcggctgcgcagatcctaggggggcggcggcggcggcgggggaaggagc

SEQ ID NO: 31483 - DNA, 2012 bp, Triticum aestivum
  unsure (1)..(2012): unsure at all n locations
  Clone ID: PAT_TA_31483
gcacgaggctctctcgaatcattcgccgcgccgccggccgccgatccgatccgagccgacccgccccgcgcgccgccgtggcagggccggggttccgccgatcgacccccatggtgcagctcccggccatggggaagcgccagcacccggnngcggccgagccgcccatggcgccggccgccgccgtgaagatggaagcggacgagctccgggactatgagcacggcccgctcggcaagcgcgcccggccggcccagccctcgccgcccccgcccccgcaccaggacatgtatcacaatgtacttgatgaacctagcccattgggtcttcggctgaaaaaaagtccatctctgttggatctcattcagatgaggctttctcaagcaaattccgatgcagggcagtcatctacggacaatgctgagccttccaagaagaaagaccttaaatctggtacatcatcagctggtgaacggttgaaagcatcaaactttcctgcaagtgtattgaaaataggcaaatgggagtacacatccaaatatgaaggtgatttggtggcaaaatgttacttcgcgaagcataaacttgtatgggaagttctggaaggtggtctcaagagtaaaatagaaattcagtggtcagatataactgctttgaaggtaactttgcctgaaattggagatggatccttggatgtgatgctggcccgaccacctctctttttcaaagagacggatcctcaaccaagaaagcatacattgtggcaggctacttcagatttcacttgtggccaagcaagtataaacaggcatcatttcttgcagtgccctacaacctcgttaggcaagaattttgaaaagcttgtccagtgtgatcagaggctacatcagttgagtcaacaaacagacgtcatcttggactcttcagtttttgaacccagatgctctatatttgaggatccggtggaactgaagtgccatgactttgctaatttaaaagatgaatgtgaagatctgcctgggttttcagggtctgtgtcaccatgtgctggttcatctatgtctactaagaatgacacaaacgatttttttgggaagcaaccagaatttgtcgctcagccaatgaacccaggggctagtgctgtaaatgcacaaccagtcagcagaaacgtaaatggtgtagctcaagaattcaatatcccgaactggtggagtcagctgaaagtgcccgggcttagaccatcaatgtcagtggatgatctggtcagccacctaggaaattgcatcagcgagcagatcacctcaggcaatccttcgatggccaacaatgaggtgcctacaaaagaatcgctagaggagattgcgcagtatcttcttggtgacgcacagggcccacaggcgccagcctccgatgagcgactgatggcacgggtggactcactttgctgcctgcttcagaaagacacagcgccggtatctcagccgaagcccgagccaaacgacagcggcagcattggtggggtggactccgaaggatcagacgatgaattcagctcagcatcaacgaggaaaactgcagatgccaaccagcagccaccagccatgtcccgaaaggactcgttcggagacctgctgatgaacctcccccgcattgcctcgataccgcagttcctgttcaagataccagaggattccgagaactgaagctgcaccccagatgaagcaagtcagtcgctgtaaaaattgtacctgagcaataagtaagccctccctcgcttgttccgattcagcaagccgattccccgccctgtaaatgtgacccatttaggttccttcttaagccgtgtgatgattcgaatgggtagtcgaagattgttcgttggttcttttaactcagacttgtgatttcgttgtgcaagatcaagtgccaaattgtttataataatgttgtcaaaagtgtctgtgatgcaaccgtattggtttccagtaatgatatcagatcgaagtttgttt

SEQ ID NO: 31484 - DNA, 1399 bp, Triticum aestivum
  unsure (1)..(1399): unsure at all n locations
  Clone ID: PAT_TA_31484
tttttttttgaactatgaatgggccattttatttgtcctggaaataaaatgtcgtagacatacatgcgaaaccccaataaattgctgtatcacctacatatatagccatacaaccatacagaagaagagtacacgcacgtggttcactgcaactgtagtccttgtggttttatattcacagcagagtttcagtttctgtatcccccaatcttcatgtcttgtgggctgaaaacacgttattcatgtctggcgaatcgagacttggactcgtcgatttggcgcttcatgccgccacgatggggtaggacgcgcaggtagcaacagcacacatgttcttgcccatttccatcttgaagtaaccattgtcaccccagtcagcgccccaggagttcttgatgagccaatatgggacgccgttctccacaccatagccaaccgccaagacggcgtggttcacatcatcaggtgtagtaccacaatggtcactggtgtaaactccgctcttgtactgcctgaaaccgtcgatcacctcaaaggcgacactgactgggcgaaccaacccaacggcgttcttcagctcgtcctcagcattcagtgtgatgttaactgagtccaaaacctgaactacagcatttcagcctgtaatggcagacgccattgacaccctgtaagggtaggactcctcggtgtcaatgccaccattgtatttgatgtactcaaatgcctgggatggaaggcctccgctgcatccaaagttgttgaatccaccggcacagtcaaccagctgttgctctgaaagagagatgttctttccagtggcctgagtatatgctgcctcaaagtgcgccagtagtgctgaacgtccagcaggagccgcaatgggactggtcttttacggggctaacgatcccatcctccctccagtctttggtctccgggagcgcggcggcgtcgcgcatcaggtggttgccggcgagcgtcgccgagcaggtctgcgccgcgccgagccgggtcgcctggaactcctcccagcttcatgtcccgagaagccggttgataccgaggcggtaggggagccccttccggttggtggagcgcacctcctcgaggctcttcggaaagatccggaaccgcctccgcacctccgccgcgctctcgtagctcttgccgtaccgacggcgaagcgcgcgaagcggagggcgtggcgggtgcggccgagcgcggcgaggnggtggactcgagcgtcgaggcggcgcgctcggtgacgggccggatcgggttggagncggcgaaggaggaggaggcgacggcgacggcggccgtggccaggacggcgagcgcccaggagaggatgcgggcgtgggccatttcgccggcggatgggtggcagtagtttact

SEQ ID NO: 31485 - DNA, 1265 bp, Triticum aestivum
  unsure (1)..(1265): unsure at all n locations
  Clone ID: PAT_TA_31485
ctaaaatatgtnctacatacatcccgtatgtagtagtcatttgaaatgtctagcaaagcacaagtatttaggaacggagggagtataactccaagtaatgaactgagcttctgtcgtggcagtaaactgtattaccacgtatatacattaaaaaggcttcaactcatcattgggtaaaataaacctaggtaacaaataagctagacaagtggagagactgcacacgaaggaacacagatagaaaattcttattcatagagtggtttggataaatcgacagaaatcacgacaaatcatattacaggactctagcgaagggcggtcaaacgcagcatactgtaaggtctcatcgaaattagatctccttgaatgcagcaaagaggtccccgctgatgtagtcattgtccacgaggctgaccaagtaatagctcttctgaatctgctctagcaactccctggacgagtcgccctctgggaacaggcaggcccatcccctggaccagatctcaaacgcttcatctttccagaccatgaagctcgctgagtcaacgacggtaggctggatgatctccttgccgggggaacacaccccatgtgacagcattcacggcgttcgcagggatgtttgagatcgattccccttccttgttcacggcgatgtacgtgagggaagggaatgccttgctcttctcgatgagttggcccagcttctccttagcgcagaagaattcgacgtaggccttctggtaaacatagcctcctgggccgccccatccaacactaggagactcagatttctctgcatttacagcaggttggctgttgatggtaaggaaaccctttgagttaatcttcaccagctgatcgtcaattatcgtcgtctcgggttgaagaccatctaactcagaccatgggctgcttttaagttttccttcacagaagttcacgaaccgctcattaatgtcttgcacagatttcagtggaacagcccattcctcttggagcttcttaccacgtccacgtggccgtgtgaactggtgatcattaagtgcaccgtatgatgggttcctggaatcaccccaccgtccatgtgggtattgatcccaaccagtggtccttgaaatgtaactctttggtctgttggcccagaatatagggcgaacatcctctttgacacggaaaacattagttggtggcctccaaggtaatgttcttgaaagcttggactcctctattaagccaagattcatcagaattgctaaagc

SEQ ID NO: 31486 - DNA, 759 bp, Triticum aestivum
  Clone ID: PAT_TA_31486
tcttgaagtttgtcttgagcatgtcagcaagtaaggatgttcttgcacttgcttcccttgaggttgatctatccagcattgaacccggcagcacagtgactgtcaagtggcgtggaaagccagtcttcatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaagagcctaaaaccagtacctaccaacatatattctccacaggagtgaattcctgttgcgctgttattttgttttcaatgtggctaggagtttttgtttcaggactatcgcaacggtgatccactgttacctaccgaagttcatttgcagtgcgaaataattgtttctcctatgttgctactggattgtaagttttgtactgattttctgagaccctattggaaggatattgtacacctcttctggttcttgctccctatatatttgataaataagcaaacattcttcatcttttgtgtctaacaatgttattcaagtgctaaaaaaaaaaaa

SEQ ID NO: 31487 - DNA, 883 bp, Triticum aestivum
  Clone ID: PAT_TA_31487
atgaaagatatcctcctggagatcccagcaagcgtgcctttgcctactttgttctgagtggtgggagattcgtatatgcatcactgctgcgtctccttgtcttgaagtttgtcttgagcatgtcagcaagtaaggatgtgcttgcacttgcttcccttgaggttgatctatccagcattgaacccggtagcacagtgactgtcaagtggcgtggaaagccagtcttcatcaggcgacggacagacgatgacatcaagctggccaacagcgtggatgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaagataacaagatgctcataggctaagagcctaaaaccagtacctaccgacatatattatccacaggagtgaattcctgttgcgctgttattttgttttcaatgtggctaggagtttttgtttcaggactattgcaacggtgatccactgttacctactgaagttcatttgcagtgcgaaataattatttctcctatgttgctactggattgcaagttgttttgtactgattttctgagaccctatcggaaggatattgtatacctcttctggtccttgctacctatatatttgttaaataagcaaacatactattcttcatcttgtgtctataacaatgttattcattcaagtgctcgaatgttgtacttatgtgtgatct

SEQ ID NO: 31488 - DNA, 1201 bp, Triticum aestivum
  Clone ID: PAT_TA_31488
ctctaatctagctctgaactttattggaaagttacatacaatacatatgcacacaacatgcaagccacaagaacaatttcgtaatcgtcacttgtacactatcagtgggcacaacttctcgttcctctatgtgggcacttggttgactctcccgaccgttgtttggtggtccgccaattacgatcccttcctccaacgggtcaaaattggcccattagtggaggggtacataataattgatctcaagttctcaacaatggaaattaaccaaacaacaacagggaggggagggggggggcgattattgacgaagcatgcatatgattaagagcatggagtttattcaatcgtggatcaggaccgaggagcaatcaaaggtggcagcaaccggcctagccgatgtagtacatggggtcggggagcttgaaggtacgggcgccctcgggcgcgccgaggatgtcgctccactgatcgccgatgttgccgacgatgatgtacccggcgtcctgcaatttttgcctctcaccggacttgtaggtcacagcagagcccttgaagccgggctgcttcagcagcaagttcatccacccggagatcccctggcggcggaggttggtgacggtgatggccctctggtcctcggtccgtcccggtgaggaaaaccggcttaatgccgaccgagcgcagcttgttgtacaacctcttcgtctctggcaagcgctggcgcgctcccctccagcacgtacgcattgaagctcgtcgcgttgaacggtgtagccccgaagccgtgcttggcgtagtaggggaggttggagagggtggtctcgtcgatgtcgaagacccacacctccttgccgttgccggcgagcttgaggctgtcgacgtaggcgacggcctggtcgatgacgatcttggagtcacggcggaagtgcttaccgagcatgtagtggccgacgtagccctcacagctggcgggcaccgtcttccagtcccgcacgttgtgcgcctccacgcccagcacccagctgtcgcactccactccggcgtgcttgccggagcccagcagcggccggagcgcgtggatcagcggcgccaccaccgcctcgtccacggacgtcggcatccggatgttggcctcccatgcgctgcatgaggccgcgaggagagccgcggcgacgatgaggaggagcgtcggtgtccc

SEQ ID NO: 31489 - DNA, 1114 bp, Triticum aestivum
  Clone ID: PAT_TA_31489
ttttttttttttttttttaaaacaaaacagtggaccatggatccattgattaaataacatgcaacttctccacaaacacgttcataatagcaattaatctcaagttctcaacaatggaaatgaacgaagcaacaactgggaagggattattggcaaaacatgaatatacctaagagcatggagcttattggattgagaaatcaatggcggcatgcccgagccggaggcagcctagccgatgtagtacatggggtctggcagcttgaaagtgcgggcgccctcaggcgcgccgaggatgtcactccactggtcgccgatattgcggacgatgacgtacccggcgtcctgcagcttctgcctctcgccggacttgtaggtcaccgcggagcccttgaagccgggttgcttcagcagcaggttcatcccacccgggagatgccctggcggcggagattggtgacggtgatggccctctggtcctcggtccggccggtgaggaacactggcttgataccgaccgagcgcagcttgttgtacaaccgcttcgtctctggcagcgccggggcgctccccctcccgcacgtatgcgttgaagctcgtcgcgttgaacggtgtagccccgaagccgtgcttggcgtagtaggggaggttggagagggtggtctcgtcgatgtcggaagacccacaccctccttgccgttgccggcgagcttgagggagtcgacgtaggcgagggcctggtcgatgacgatcttggagtcacggcggaagtggctgccgagcatgtagtggccgacgtagctctcgcagctggcgggcacggtcttccagtcccgcacgttgtgcgcctccacgcccagcacccagctgtcgcacgccactccggcgtgcttgccggagcccagcagcggccgcagcgccgtggatgagcggcgccaccacggcatcgtccacggccgccaccgtcccgggcatccggatgttcacctcccacgcgccgcatgaggccgcgaggagagccgcggcgacgatgaggaggagcgtcgtcgttgtcctggcctttgccatttctagcgtgtgtttgtgtgcgtgcacgcctcgtgccgaattcctg

SEQ ID NO: 31490 - DNA, 1542 bp, Triticum aestivum
  Clone ID: PAT_TA_31490
atacgatgctgcctaaattggatacatttgttttgcttacaaatgaagggcctagcttggagaaggatgaacattggagcaagaacaagcatagagatgatggcatgcgcaaggggaacaagaacggagttacaagtgatgatttcaggtctttgaagccaccataactagtgcatgaagccttggacgaaatatacaagatgtcacttcataaattttgtccagaggctattataggtgctgcgtcacctttttattgggccgggcccatgtaatttcgaaatacataagtataggctatttttagagtccgtatgtgtggggaaacaagagatagggttgatttcagacccctccaccaagggccatgaaattccccctctcttcctccatatatacagcccttagggcaccgtttagactttgggttttgtttagattaaaagttcgccatagctgcaacttcgcgtacttcgtttgtgttcaacgaccagacaaaggcgtcacagaaccccaccttgatcaataaagctttcatcttatattcgcaatatccagattgcaatcttagtttcttgcttgttcttcgtttgctcgcaggaaacagaccctcgtggtcaggttgatcgtgctccggcgtggtcaataacctctcggagttggtttagcgattgctaaggcgcgacgtcctcgcacgttcgtagtcggatcgtcaaagtcgacttccaccaaagcgaaatccaccatctcatcgaaagacgggacacctttgcctctatgatgaggacatgactaccttggatacgatcaaaaatattgcttacatgcatatttgtcaggtgatttctagtgcaaactactcaataatctatttatgttatccagaacaaaaatacttcacacacttttgtgttttgtctaattgcaggtgtatgggatatttgtacaatccacatatgaagataaggcaaaaggagaagtttaggttctgttcaaaaagtcctctcacgtaacttttgggccaagagaagatagagtccaagtctctcacgttctggattcagattcggactgcacagacatacctgactcaaaacgccaacaactttttcatacggactccgaattgggtgattcttttttgttggaaagtagatttcgtgatctttcgaacccaattggaatcaccttaaaatccatccggagcggtgagttatggatgaaacaatctgacgctgcagcagattccgagtcaaactacaagtccaaaggtgttacgtcacctccacttgggcccatgagccttgtacgacctagggttggttttaggctgccttgggtcgttctcccacctccttggccgccaccccttgctcctatataagtagatccatctagtagctttttcctggggatttgtttagttaaaagttagcgattgcaacttcgtgtactttgtttgtgtccaacgaccagaccaagaccgcttacggatccccacctttatcaatacttcatatatactcacaatattcagattgc

SEQ ID NO: 31491 - DNA, 869 bp, Triticum aestivum
  Clone ID: PAT_TA_31491
ggccgaaacaaacaatttgcaaggtaaagcttgcacattcagaatcaagtctatggcagcaccacagaacacatgttttcctgtttcccttcttgttcttagacacaaactccaaaaaaaagtaagaatttattacattaacccgttggtgcaatccaaattgtttactccttattggtgcgcccacaacagaatggtatgaataatttaatacagatacacggagcaagtccacgaagaactcaatcaaagtgtgatgccccagttatcaacaaggttgctactcaacgcctatcagaagcaaccgagtcagcagaaaacagatacttcacacgagaaaggaccgagtcactcgctggatcatatggatggtccttggatggaatttccaatatcgcagggattggcttgttgtagctatccaccagaaacctaatcatgtttgcaatatattggctgatgagcacaatagcaatatcctcccttgcagtaaactctttaaatgcatcttcaatctgtttcactgtcgttttgttatctacaagaaggtaatttgttttcttgcgcagatcaacattgccaaccccagccatcaaaaacccagtgacagtgtcctcatcggcgatgatggcgatgagggcggagttgttcgccgggatattggacctccccgccattactggttcctgtcaaaaacctaccggctgcaaggaatcttgcagtagatatgcaagcagaaatcacaggcacggatccagacagaagaaagagcgggttggagatccggtggcgcaggagaaaaatatgggggcggagaggcgggttagaaggggactcggcacaggggcagaaccggaggagggaggaac

SEQ ID NO: 31492 - DNA, 1168 bp, Triticum aestivum
  Clone ID: PAT_TA_31492
tcgcgatctagaactagtttttttttttttttttcatgcaattgtacaagaacgaaattatgatggataacaacacatcaagcaacaatatcccgtggattgccaaagaaaagaaaagctgtagccaatgtagtagtggcaattgatatgaactaagtaaaccaaccaagcaagaacaacacagaggcttattattgatgcatccagcatgcagataattattaagagcatggagcttattcgtggaccacgagcattcgagcaatcaatggccgcaggcttagccgatgtagtacagggggtcaggcagcttgaaggtacgagctccctctggcgcgccaaggaggtcgctccactggtcgccgatgttgccaacgatgacgtacccggcgtcctgcagcttcttcctctcggcggacttgtaggatatcgcggagccatggaacccgggctgcttgagcgtcaggttcatccacccggagatgccctggctgcggaggttggccacggtgatcgccctcttgtcttccgtccggcctgtgatgaacaccggcttgatgccgaccttgagcagcttgtagtacagccgcttactctcccggcagcgccggcgcggtcccctccagcacgtacgcgtcgaagctcgtcgcgttgtatggcctagccccaaagccgtgcgtggcgtagtaagggaggttggagagcgtggtctcgtcgatgtcgaagacccacacctccttgccgttgccagcgagcttgaggctgtcgacgtaggcaatggcctggtcgatgacgaccttggagtcgcgccggaagtggctgccgagcatgtagtgccccacgtagccctcgcagttggcagggacagtcttccagtcacgcacgttgtacgcctccacgcctagcctccagctgtcgcacggcacgccgccgcggctgccgagctctccgctggagcccagcagcgggcgcagcgcgtggatgagcggcgccacggcatcgtcgaccgcagcagccgcagcctccgccgtcggcatacggatggtgggctcccaggcgctgcacgaggccgctgcggccacgagagccaccgcgatgaggatgggcacccttgccatcgccattgttactgctagcctagctaccctgtggtgctctgcttcctgca

SEQ ID NO: 31493 - DNA, 1990 bp, Triticum aestivum
  Clone ID: PAT_TA_31493
aaaaaagattgataacatgataatcattggccccaaaagaaggcatggcaacacacatttatttatgcaggcattatgccagtccagagattattagatgctacttgtgcagctcaacattcacaatcaatcagtgcagcaaacaaacatattattacagaaaacgaaacagaccacgagataacaacttttattgccagtttcttcttttgaggagagctgccaagcttagagcttggaaacaagggccccgttctggatggccttaggcgactctgcttccttgacatcggcggcatcagaagtgccaggaggcacatcaacagcaggcgagcagttgaagaatccatgtggcatgagcatgaagccgatgtgttccaccggcatgaccggccaatcttccagccttgggatgtgggtgagcccaaatacataccagagaacgatgtcagtttcctccaagggtctatccttcttcacccaagtagctaaaccctcgtgaagacgtggattctggttggggaactcccctccaggaaacttctcatcactcttgtatggtgtcacccaaagattgtgctttaggaacccggctcttcgaagaaactttgcctcggggcagagcaaatggcaaacagtttgaaccaggcacgagtctgaaaccagttggttgtccggtacgatttacagccctcgtgttcctaacaatccaatgtcgcgcagatgaagggtcacaatctctcattgcttgcaactcggatttcagtatcttttcttcagcatagaaagcattgttgtgcacattatttgtgcctgcactttcgactttgacatttacttcaaccacctgattatgagcttcgttaggtttgcaatcaatagccatgtccatacgggcaacaaagaaatgctggtggacaggtgcatacagactaggagcaatagttgtaccatatttccttgattccccaggcatcagagctcccaaactcagaattccagtaagttttacttcagcttctatcttaccatcctgataaaagtgccagtaaaaaccatattcatagttggcaactgtgcagataaatgacaccgtgagcctccttgatcgcctaacttctgctaaaccagttctccagtcttggtgtttccaaaggattccatggtcctcctcgtgcagacacacacagttctcaattgtctccacatgaccggtaaagttcgtgaagtgtgcatcaaaatacttgatgtaacccaagcagtcacaccccttcttaagagaatgagcatttttgccaagtccatcttctccagcatcaaaagcattcttgcgataatgtggttcacttggatctccataaggaacaaccatctcaacaaagctcagcctatgagctataggtctacgcccacggctaccatcaacatatgcaacagaatagatgaccaaaccctctttaggggtgaagccaatacggaaattccacttctgccattccacaaaatagccattaatacggaagcttgggccctcaggctgattgataataagaggtttcacatcacttcgatcaacaccacctctagtttctccaggagtgtagtttctcaaatgatctggtgggggcagaggaacaaacttcctgtcttcaaactctatgacaatattattctgcatatcaacaacaacatggatcccttcgacaggacgagcataaccattctccatgggactatcactctcagttcggcaaaagattagaggcctggcaagtctgcgactgggagcatcagcatcactgtagtagccagcacaccaggcatctaccatgacaagttccatatcgtccacacctcttttcttcatagcttcaacaaatggaggataatttttgacagtagcttcacactcagcatattccatagcatccattgcaggctgtacatctggaacaacttccgatgatatcaccttcccctcgtgccgaat

SEQ ID NO: 31494 - DNA, 1114 bp, Triticum aestivum
  Clone ID: PAT_TA_31494
acccaagaccctacatatagtccttgctttattgcgaatttcaagctggcagcacatgcacagaagtaacatagttcacatgttctactactttcagtgcgccatgttcttttggaggacgcaaacaccttacacaccactctgtaaacccactgcaaaacccaagaaacacaaccaggggttggctgatccactgcctgacagttctgagttgggacctacatgcatcttcccctgagcagcaaagcatatccatggcctgtctctaggcctcttcttcaagcagcatccgatcaaagtgccacaccccgtgtcctttgccgattctcctaagctgcgtcacgtactcggagatcttcttcacggcatcaacctgctcctgaagaaattgactctcaacaaagtcgctcagctgaggatcattgcaccttgttgccacagagtgcaggttgggcagcttctcattcacgagcttttcaagagctagagccaactccattgcatacagagcatcgcctttctcagagtggtcgaactctgtcaatggggtcacgatagactggagcctcacccgccctccacgtctgttctggtactccattagcatctccgcgtgctccctttcctcgtcgctcgattccttaaagaacttggcaaagcccttgagggcaacattgtcccggtcgaagtaggcgtagagggagtggtacgcgtacgaggcattgtactccacattgatctgctcgttgatggcggcctcgcattcatcgacgaacttttgcctggcgagcgactggccctcggcctgcggcacgagcgaaagctcccccttgagctcctcgaacggctggaacatcacaccgctgaggagcacctcctcttttttccccttccccgcggccctgcacgccgtcgacgacactttcgctaacggcggcagcctcgcataaccgtgggccgggcttgacgcagagagctggctagccgcggcgacggcggccggagacgacgcaatcctaagaagcatctcgaagagaagaagatggaggcgagtgtggggaactggaagtgggcgcggaagaccaaagtggagcaggaggagatggggcggacg

SEQ ID NO: 31495 - DNA, 1524 bp, Triticum aestivum
  Clone ID: PAT_TA_31495
gtctgatgtggtctccgcacgtgcgtaggccccactggaatactcgtaaagccagcccactggatgcgatttgctcttcccctctgcctctccgatttgccgtccccggtatcgctgccgctctggtcggaggctgtgagagagggagatgacgggactaggcggcggcgcggcggcccccggggactacgtctacttcaagtccgtcgtcccgctccacaagatctctattggatcaaaattgtggagatattatgattttggccccaaggctgtgccaccccttatctgcatcccaggaattgctgggacggctgatgtatactataagcagataatgtccctctctatgaagggttatcgagtaatatctattgatgttccccaagtttgggaatcaccatgaatggattcattcctttgaaaagtttttggactccatgaatatccatcatgttcatatctgtggtacatctcttggtggatttcttgcacaaatatttgctcaataccgcccaaggagagtaaagtccttggtgctatcaaatacctttcttgagacacacaagtttgctgctgctatgccatggtctccacttgtcagctggaccccttcttttttgctgaagaggtatctcttaacaggaatccgagatggtccacatgaaccattcattgcagattctgtggattttgtagtgggtcaggtagagacattatcaagagaagacctttcgtcaaggttgatattaaatgtcaatgttgcatcagttgggtcattatcgctacctgattcattcatcacaataatggatacgaacgactactctgctgttcctcggcagttgaaggaccaagtgaatgaaaggtactcaagtgcaaagcgtgcagtactgaggactggtggggattttcccttcctgtcacgtccagatgaggtcaatttgtaccttcagctacacttaaggcgagttggagtagaaccaagaccagatctagtccagggtttcacacgggatggtagctccggctcaaacgaccacgaagatggaaacagttttgatgaccatcccacagatgatggggaccgtagttcaggcagcggatggccgtaagacagagcactctgaatcagggccacctaattcagatggactggtaccaacaagcatagtgctaggcatggtcagttcagctctccatgtttccctatgtgcgtgctcatgatgcatcattactatacatccgttttgtatatttcttcaagccggttgtttaatgtatgaagttatgccttttgccggagtatagaactcgtcttctagaatatcagcagacccgtgagtggcgcgactgcattggaacaactgatggaattcattcatgtattttgtgtaatataggaatttcttctttattctgtgcttgtaggctcgtacattgatgaattatagatgcccgagacatgtgattgtggttgcttgtttttctttgaaccaaataaattgcataacctcgataaaa

SEQ ID NO: 31496 - DNA, 914 bp, Triticum aestivum
  Clone ID: PAT_TA_31496
ttttttttttttgcaaggtaaagcttgtacattcggaatcaagtctatggcagcaccacagaacacatgttttcctgtttcccttgttcttagatacaaactccaaaaaaagtaagaatttattacattaacccgttggtccaatccaaattgtttactccttattcgtgcacccacaacagaatggtatgaataatttaatacagatacacggagcaagtccacgaagaactcaatcaaagtgtgatgcccctgttatcaacaaggttgctactcaacgcctatcagaagcaaccgagtcggcagaaaacagatacttcacacgagaaaggaccgagtcactcgctggatcatatggatggtccttggatgggatttccaatatcgcagggattggcttgttgtagctatccaccagaaacctaatcatgtttgcaatatattggctgatgagcacaatagcaatatcctcccttgcagtaaactctttaaatgcatcttcaatctgtttcactgtcgttttgttatctacaagaaggtaatttgttttcttgcgcagatcaacattgccaaccccagccatcaaaaacccagtgacagtgtcctcatcggcgatgatggcgatgagggcggagttgttcgccgggatattggacctccccgccattactggttcctgtcaaaaacctaccggccgcaaggaatcttgcagtagatatgcaagcagaaatcacaggcacggatccagacggaagaaagagcgggttggagatccggtggcgcaggagaaaaatatgggggcggagaggcgggttagaaggggactcggcgcaggggcagaaccggaggagggaggaacgtggattgctcggccacgacagagatcggatcggagcagaacacgacgagaaccg

SEQ ID NO: 31497 - DNA, 1604 bp, Triticum aestivum
  Clone ID: PAT_TA_31497
aaacttgtcccccagctcctctcttgccttgtccgatcgatcaacagcagccaagcactaactagccgcgcgcagggatggctcgccaaggtatggtcacggcgctgttgctggtggtcctcgccgccggctgctgcgcgtcggcgggcgccgtggcgtacctctccaagctgccggtgaccctcgacgtcaccgcctcccccagtcccggccaagttcttcacgccgggcgaggacgtgatcacggtgacgtgggccctgaacgcgagccagccggccggcaaggacgccgactacaagaacgtgaaggtgagcctctgctacgcgccggtgagccagaaggagcgcgagtggcgcaagacccacgacgacctcaagaaggacaagacctgccagttcaaggtcacccagcaggcctaccccggcaccggcaaggtcgagtaccgcgtcgccctcgacatccccaccgccacctactacgtgcgcgcctacgcgctcgacgcctccggcacgcaggtcgcctacggccagaccgcgcccgcctccgccttcaatgtcgtcagcatcaccggcgtcaccacctccatcaaggttgccgccggcgtcttctccgccttctccgtcgcatccctcgccttcttcttcttcattgagaaacgcaagaagaacaactagatgtggagatcgaaaccgtggcgatgtgttcgtctgtgcgcgacttcttgtcctttgcaacgtactccctccgttcataaatacttgtctttctaggcatttcaacaggtgactacatacagagcaaaatgagtgaatctacactctaaaatatgtctacatacatccgtatgtagtagtcatttgaaatgtctagaaagacaaatatttaggaacggagggagtaaaacgcaaagcaggtgatgctgcacagcaacagcattcagagtcgcctccacacaggcggataccacagtgaccatccacacataataccactgtccaccacaagccaaacaagacactacaacgagatactgactcctaacagctattataggtaacataactccgggtagctcttattgttactgcgtcgggatgggctgcatctcaggagctgtggcaggcgcagtgtcggcggccgggttggcgaaaacccttgcaatgcgctcagttgggacgagcgggaggtaggtggcgacggagttgccacgcttagcgccatcgagcactgcagagttgtacttggctgagagctgtgcagctgtggggaggacggcacgggtcaccgaggggacgagcgggaggcggttcagggcggcccaggcttcggcagccttgcgctccgccacaggctcatagcgggtatacaagtcacgggccttaggctcagcgcgagcaatggccgacttggccagtccagttgctgtgcccattatgcctgtcttctgcacctcagctgctgcagagcgggcataggtcggcacctccttcacgactggtgggacacggcggtccagctcctggacagactcgtcaacttgcggtcgaggaattgaggaggtcgagcggcacggcgtggtagcggtcgtaggacggggccgacc

SEQ ID NO: 31498 - DNA, 1193 bp, Triticum aestivum
  unsure (1)..(1193): unsure at all n locations
  Clone ID: PAT_TA_31498
tacggcccccccctcgagttatttttttttttttnttttttttttttttttttgtcaagaaagaaattatgacagataacaacacatcaagcaacaataacccgtggcctcctaaagaaaagaaaaaaaacagtagcccatggagcagtagcaattcatatcaactagtaagcaacaagggcagagtggattattattattgagagatgcatcgagcgtgcagataattattaagagcataggcttattcgtggaccatgagcattcgagcaatcaatggcggcagccctagccgatgtagtagagtgggtcgggcagcttgaaagtacgagctccctcgggcgcgccgaggaggtcgctccactggtcgccgatgttgccaacgatgacatacccggcgtcctgcagcttcttcctctgggcggacttgtaggatatcgcggagccatggaacccgggctgcttgagcgtcaggttcatccacccggagatgccctggctgcggaggttggcgacggtgatggccctcttgtcttccgtccggcctgtgatgaacaccggcttgatgcccaccttgagcagcttgtagtacagccgcttactctccggcagcgccggcgcggtcccctccagcacgtacgcgtcgaagctcgtcgcgttgtatggcctagccccgaagccgtgcgtggcgtagtaagggaggttggagagcgtggtctcgtcgatgtcgaagacccacacctccttgccgttgccggcgagcttgaggctgtcgacgtaggagatagcctggtcgatgacgaccttggagtcgcgccggaagtggctgccgagcatgtagtgccccacgtagccctcgcagttggcggggacagtcttccagtcacgcacgttgtacgcctccacgcccagcctccagctgtcgcacggcacgccgccgcggctgccgagctctccgctggagcccagcagcgggcgcagtgcgtggatgagcggcgccaccgcgtcgtcgaccgcagcagctgcagcctcggccgttggcatacggatggtgggctcccatgcgctgcaggaggccgctgcagccacgagagctaccgcgatgaggatgggcacccttgccatcgccattgttactgctagctaccctgtggtgctctacttcttgaggtgcactgcccggaccggccggc

SEQ ID NO: 31499 - DNA, 2657 bp, Triticum aestivum
  Clone ID: PAT_TA_31499
ttttttttttgtttggccccaagagaaggcataacaacacacttttatttatgcaggcattatgccagtccagagattattagatgctacttgtgcagctcaacattcacaatcaatcagtgcagcaaacaaacatattacagaaaacgaaacagaccacgagataacaacttttattgccagtttgttcttttgaggagagctgccaagcttagagcttggaaacaagggccccgttctggatggccttaggcgactctgcttccttgacatcggcggcatcagaagtgccaggaggcacatcgacagcaggcgagcagttgaagaatccatgtggcatgagcatgaagccgatgtgttccaccggcatgaccggccagtcttccagccttgggatgtgggtgagcccaaatacataccagaggacgatgtcagtttcctccaagggtctatccttcttcacccaagtagctaaaccctcatgaagacgtggattctggttggggaactcccctccaggaaacttctcatcgctcttgtatggtgtcacccaaagattgtgctttaagaacccggctcttcgaagaaactttgcctcaggcagagcaaatggcaaacagtttgaaccaggcacgagtctgaaaccagttggttgtccggtacgatttacagcccttgtgttcctaacaatccaatgtcgcgcagatgaagggtcacaatctctcattgcttgcaactcggatttcagtattttttcttcagcatagaaagcattgttgtgcacattatttgtgcctgcactttcgactttgacatttacttcaaccacctgattatgagcttcgttaggtttgcaatcaacagccatgtccatacgggcaacaaagaaatgctggtggacaggtgcatacagactaggagcaatagttgtaccatatttccttgattccccaggcatcagagctcccaaactcagaattccagtaagttttacttcagcttctatcttaccatcctataaccaaggaaaaaactaatagttacattacaataactaaatcatactccctccgttcctaaatatttgtctttctagagatttcaataagtgactacatacggagtaaaatgagtgaatctacactctaaaatatgtctatatacatccgtatgtagtttgcattgaaatttctaaaaatacttatatttaggaacgcaggtagtattatcctaacatatttcctcattcaattctggtttggcgtacaaacagaatcatatgacctacatttttagtatctggcctattttaccttttggaatttacatcttctatacatagattgcatctgctcgtaatctctcctttctatgatgctctggaagctccaacatacagtgtctgatgttgcagaaatatgctgtacgatttacagtgaagagtgaagactactactccagtgcgaaatcgtttagccatataagcacctcgttcctcttcataaagtcctttgtgctaggatcattgtaacgtgcaagcaaacagccttttcgaggcttcaacccatctttgagtagctgggagcgtagctccttctctttcttggccacaatttcctcttctggtcgcccactgaattttttcactgcagcaatgcctccttcaacctttcgcaaggtaaccgcttctgtatttggagctggtaaactgttcaagtctttgttcattggcagagctatctgtatggatacgtctgagagtttgtcatcagaagcctgagtgaagacaggtgtagtcattgcaatcttttcagatgaagcattcttgccaaatatatacccagtaacattgttaaaacctgatgatcctgttagtttttctcctttcgcttctgctactgaaaacggtggatacttcctgacctcataatttgcagtctttttcagaacgaggtaacttggtgtttctatatctggggtcttgtagtatcgtagctgcttgaaaacttcaaccaatccttcaaaggagaagtattcattgttctgtattgaatcccaaatatccacatggctgcagaacttgagattctgtgggttgacgcccatgatcgacaacccggtgaagaccagctccggcttccacggcaggagagagaacttcatgaccatggtccacctcgtggtaatctcatacggccctgtctgcttgacgtcgtgcaggtagaagtcgggccggaagatgaccttgaggaggcggatgttggcgaggtagccgtcgatgtcgtcgtagcgggtgatggggtcgcggaagcggacgcggtcgtcgtacgcggagcggtcgatgcccacgtcgtcgaacaggtgcggcaggtcggccttcaggaactcctccagccgctgcgcctcggccggcgtcaggcccggcgcccctgttctctccggccggtgccgccggggcgaccgcgccgccgctcggcgccgcccctgccaagacggcgaggcgtggcctgtgcctccggtaggacgcggtgagtgctgcggcggttttccgtagcctgggagaagtggtggggacggcggcggcggtgggcgccggtaaatggatgaggaggcgggaggagaggcgtgtggccattggtgccgttcggacgcgtggg

SEQ ID NO: 31500 - DNA, 1078 bp, Triticum aestivum
  Clone ID: PAT_TA_31500
gcaagatgcaacaagtaaatttagcaagattagagcagaagactggcatttaagagcggggcacatctcccttcgttttatttcaaatcccaaacacagagcagttcagcagcatagcaccctacaaaccccactgcaaaaatccctcagaaccacatccagtggttggcttatctgtccactacttgacatatcacacctacatcctccattgcccgtagtcatcgtgtccttcaagctgcctcctcaagcagcatctgatcgaagtgccacactccgtggcctttgccgactcttctcagctgcgacacatactcagagatcttcttgatggcgtcaacctgctcctgaaggaattcgctctcaacaaagtcggtcagctgaggatcattgcacctcgtagctacactgtgcaggttgtgcagtttctcattcaccagcttttcaagagctagagccaactccattgcatacagggcatcgcctttctcaggatggtcgaactccgttaagggtgtgacaattgactggagcctcaccctgcctccacgtttgttctggtactccatgagcttctcggcgtgccccctctcctcatcgcttgattccttgaagaacttggcaaatcccttgagagcaacgttgtcgcggtcgaagtaggcgaagagggagtgatacgcgtacgaggcattgtactccacattgatctgctcgttgagggcggcctcgcactcgtcgacgaacttgtgcctggcgagcgactggtccttgccctgcggcacgagggacagctcccccttgagctcctcgaacggctggaacatcacgccgctgagcacctccttccccttcgccgcggccctgcagcagaccgccgaccctgccgcagacggcagggcccccggcagcctcaccgaaccggcggtgagccccgccccggagagctggccaaccgctgcggcggcggcggcggcggtggccggagacggcgcaaccctaggcaacatctcgaacccgaacggcggcggcgcgcttgctattccggaaattgtgggagtgggattgtcgacgcggccgc

SEQ ID NO: 31501 - DNA, 1076 bp, Triticum aestivum
  Clone ID: PAT_TA_31501
agattaagcaacatgcaacttctccacgaacacgtctaatttataatggcaattaatctcaagttctcaacaatggaaatgaaccaagcaacaagttgggagggattattgactaaacatgcatataactaagagcatggagcttattcgagaaatcaatgggggcatgccccaagccggagcggcctagccgatgtaatacatggggtcgggcagcttgaaagtgcgggcgccctcaggtgcgccaaggatgtcactccattggtcgccgatgttaccgatgatgatgtacccagcatcctgcagcttctgcctctcgccggacttgtaggtcgccgcggagcccttgaagccgggctgcttcagcagcaggttcatccacccggagatgccttggcggaggaggttggtgacggtgatggcccttttgtcctcggtccggccggtgaggaacaccggcttgacaccgaccgagagcagcttgttgtacagccgcttcgtctccggcagcaagggcgcgctcccctccaacacatatgcgtcaaagctcgtcgcgttgaacggtgtagctccgaagccgtgcttggcgtagtaggggaggttggagagggtggtctcgtcgatgtcgaagacccacacctccttgccgtttcccgttgactttgagggagtccgacgtaggcgagggcctggtcgacgacgaccttggagtcgcggcggaagtggctgccgagcatgtagtggccgacgtaccccttcgcagctggcgggcacggtctttccagtcccgcacgttgtgcgcctccacgcccagcacccagctgtcgcacgccactccggcgtgcttgccggagcccagcagcggccgcagcgcgtggatcaatggtgccaccaccgcctcgtccacgtccgcggccgaggtcggcaattccggaatgttggcctcccacgcgctgcaggtaggccacgaggagagccgcggcgacgaggaggagcgttgtcgtcgttgtcctggcctttgccatttctagtatgtgtgtgtgatgctgcttgcctgcagcccggggatccactag

SEQ ID NO: 31502 - DNA, 1769 bp, Triticum aestivum
  Clone ID: PAT_TA_31502
tagcacgaagggtcgacactcaaatacattttgcacagcacttttacagaaacactggactaaacaaaaacaaaaacttattttacatttctaattcatacagtcagcacaaatgacctaaataacacgtgatgaagacaagtatgaaagcccattcgtcaaatcatgatgctctgtctaaagagcatagtttttggtcactcttctcgaagtcattcagaaggatttcataaattcagatcgatgaaatcatgcacaagttgagaaaccatcattcagcaaatgtagccgacagccaaaacaaccaggtcatagcaggctcagtctgctggataaactccagttgtggtaccatttctggtacagaatagatattaccgtgccataagattcatccacagcagagcagcaggatctcataccaaccacagcagagcagcaggatttcataagttcagattgattaatatcatgcagaagtacataaaccatcattcagcaaaggtagccagcagccagggcatgacagattcaactcagcacggaaacagtctgctgggtaaactaccagtgcccaccgggagtaacatttgcagtacagaaaagagataaccgtgccgacagagtactcatcaagcattcggccatgccaaactgaaagttaaaacgcaaatacatagctcgactgcagcaacaggtcggtcactagtagcggtcgtcgaagcgccctcctcgccctggggcggtcatacggtgcaggcctctccctgtaacctcctcccgtcgtagcgactaggcccaccgctgccatagtcggcgccgcctccacgtggaccatccctgtcatagccaccacctatgccgccccttgggcgcgtccctgtcatagcttgcaccgccgccttgggccactcctgtcataggcaccaccaccacgaattccatctctctcgtagcttctctctcgctccctgccatagccgcctccaccaccacttggtgcataacagtctggggctgctccatacctgtctgcaccaaagcggtcaccaccagaggggtaccggtcactggcataacgatcacggcccccatcatatctgtctctgctgtcaataggctcacggtacccaccataacggccaccatcatagcgatcatccacgtaacggtcgccaaacctgtctgatccagaaaagcgatctcccctgccaccgccaccactgaacttggaagggaatcgcccagaacggccgccgccagggttagggcagtcacgagcccagtgaccagcacggccacactcaaagcaattgccagggggtggaccatcacccttgccaccacgataatccccacggtcaccaccaccaccactgctgtaccgagtgtcatctgtttgcatctttggctcagccctgttcactgaaatggtacgaccatctaactctttgttgtgcatatcgttgatagcagtctcaactgccctgggatctgaaaacgtcacgaagccaaagccacggtgccggtttgtgtgcctctccagcatgatctgggtgtcgacgaccttgccgaagcggcggaaggcgtcctcgagcttgcgctcgtcggtgtggaacgagaggccgcccacgaagatccggctgtcctccttgcccgccattttgccccgcgcctgcccgcctgcgcgcccgcggcctcggttcgcggggggggagaggggattagggtttgggtgcgaggaggaggaggcctcgtgccgaattcct

SEQ ID NO: 31503 - DNA, 1224 bp, Triticum aestivum
  Clone ID: PAT_TA_31503
attaaggttggaaccttttgggggccccctttttttttttttttttttttttttttttaaaatttttttttttttttttttttttttttttttttttttttttttttttttttttttttttttttttttttttttttttttttggctgcaagatgtaacaagatgcataaatttagcaagattagagcagaagactggcatttaagagcgtggcacatctcccttcgttttatttcaaatcccaaacccagcgcggcatagcaccctacaaaccccactgcaaaaatccctcaaaaccacatccagtggttggcttatctgtccactacttgacatatcacacctacatcctccattgcccgtagtcgtcgtgtccgtgtccttcaagctgcctcctcaagcagcatctggtcgaagtgccacactccgtggcctttgccgactcttctcagctgcgacacatactcagagatcttcttgatggcgtcaacctgctcctgaaggaattcactctcaacaaagtcggtcagctgaggatcattgcaccttgtagctacactgtgcaggttgtgcagtttctcattcaccagcttttcaagagctagagccaactccattgcatacagggcatcgcctttctcagcatggtcgaactcggttaagggtgtgacaattgactggagcctcaccctccctccacgtttgttctggtactccattaacttctcggcgtgtcccctctcctcgtcgcttgattccctgaagaacttggcaaatcccttgagagcaacgttgtcgcggtcgaagtaggcgaagagggagtgatacgcgtacgaggcattgtactccacattgatctgctcgttgagggcggcctcgcactcgtcgacgaacttgtgcctggcgagcgactggtccttgccctgcggcacgagggagagctcccccttgagctcctcgaacggctggaacatcacgccgctgagcacctccttccccttcgccgcggcccggcagcagaccgccgaccccgccgcagacggcaggggccccggcagcctcaccgaaccggcggcgagccccgccccggagagctggccaaccgctgcggcggcggcggcggtggccggagacggcgcaaccctaggcaacatctcgaacccgaacggcggcggcgcgcttgctattccggaaattgtgggagcgcccacgcgtccgcgcacg

SEQ ID NO: 31504 - DNA, 1160 bp, Triticum aestivum
  Clone ID: PAT_TA_31504
gcagagaatgtaggcctgaattggaggacacatgaaaacaaacagcatccatcaaaatcaagtgcctgaaggcgacggtttgatttgaacatcacgattgctcggtgcacgctctataatattcaaaggtacaagctctttaaatttcttcgggccctattgcatcagaacgagacaagggcaagggcgacaccgactgaaaggtcgcccgggtcgcggtgttattgcactctgccatggtctagacgcgattacggaaagggactggagcttctttggctcttctgaagacgatgcagcggttagttcacaccgtagatccacttctcctcgttgctggtgtaagagaccagctccttgggctggaaccagagtgcgatctcgtccttggctgtctccgggccatcgctcccatggatgatgtttcttccaacaacaacagcaaggtcacccctgatggttcctggctcagatttcgatgggtccgtggcaccgatcagcttcctcccgtacttgataacgccctctccttcccataccatggcaagcacgggaccggagctgaggaagtcgcacagtccactgaagaaaggtctttccttgagatcatggtagtgcttctcggcaaactgcttggatggaaccaccagcttgatggcaacaagcttgtacccttttctctcgaatcgggacactatctcagaaatgaggcctctctggacgccgtcaggcttgatggcgatgaaggtgcgttccatctcggcggcatgcacctcctgatcctggagcatgtacacggcggcggggatggcggcgatccatgcgtagccgtgggaggaggcggcggcgttggtgtggtgggcgtatgcggcggggagggtggagttccggccgaggttggcgagggcggcgagcgcggcgttcctcccgtctgcgaggacggaggaggcggcgcgcggggcggaggcggaggcgggggaggaggcgaggaaggacctggcggccttgcaggcggagtggaagagcttgctcatctcctgcttgtgtgggtgggagagggagagggagaccttgcttctctctcttatgtagatcagatctgcttttggttggttggttggttttgctttgctttgcttcagtagatcacggacgcgggg

SEQ ID NO: 31505 - DNA, 1586 bp, Triticum aestivum
  Clone ID: PAT_TA_31505
gtaaaccaactcttaatctttatcttattcagtacatgggatgtgtaaagattacccctcttgcacatgcctacaatgcggttatgcctctaagtcgtgctccgacacgtaggagatatagccgcatcgtgggtattacacttacaaacattaccagtacattgcatgcattattacattttacattacattcgtataaatccaaacaaattatgtcgatcgtcctggtcccacgctacacacctaattcttgcgtgtggacggagaagcacttgattcagctgtaatttattttttcaccctaatttaactaggaatatagtagaaataattcagacacgcatagagattgggacgatcactgagactcccaggcgccgagcgcgcgcctgggcgtgggcttgggtttgctgtccgtcttgacggcgtaggatgcctccatggcgatgccgcagagcccgccttcggcaccggaatccttctccaccctgatgtaccccttctccccccacgacgggccccacgagttcttcaccgtccagtacgccttgccgtcctccgccacgccgtacccgaccaccgcgacgccgtggtccagctctgttccacactcaccggtgaacaccccctcggagtagaacatgaacgccttcccgctggcatcgatgcccacggacacgggctggttcgccacggccttggccagcgcctcctcgctgttggccggcacgtcctggtgtccgtcgatgtgcaccaccatgggggagctcttggccaccttcgcggctttgcaggtgccgttggcagcccggtacgggtaggcggcctcggtggtgagcccgccgtttttcttgatgtactcaaaggcgttgtccatgagcccgccctcgcacccgtcgttgtccgccgtgtcgcagtcgatgagctcctgctccgacagcgacaccagcttcccggttcggatggcgttgatgccttccacggacaccacggtggagaaagcccagcagctgccgcacttgccctggttcttgacgccggtcaccgcgcccttctggcgccagtccacggaccgcggcaggtccgacacgttcacggcggcgtacatgaaccccgggaccgactgtggcctggggaggccgtcgcggcggcggtcgctgacgcgggagccggcgaaggtggcgcggaactcggcctggctcatgtcgccgaagcggttgaggcggaggcggtaggggcggttgccgcgcttgttgtgggagtggatgaagtggacgttggacttgaaggtgccgaagcggcggtgcttctcagcgtggtggcggggcacgcggtgcgcggtctgccaccgctcgtacaggtcccacagcgcctcctccgactccaggtcgttgtcctccagcgggatggcgccgcacagctccaccgccgccactgccagcaccgccgccaccatggacgccaccagaagcttcttgctaagctgccccatcgtgctgctctgctctaccgccggtacaccacgagctgtagtggctacctttgtactgcagacctagcagctgcttgggggctagttagcttcg

SEQ ID NO: 31506 - DNA, 1855 bp, Triticum aestivum
  Clone ID: PAT_TA_31506
atggcacaactgccaaggagacacaaaatactttaggcaaaaagcaactcttacagcccagcagggcgaaagaagaaacaaatttaggcatgtgaaaactatgggcatcatataaccaaaagaaattttacgtccctggcacacccaggaagaacaagtgtagatgaacatcacagaggggattacaattattatgtaaaggggctatcccaggacaacaccccagcagaatgcacacgaaaattacaggacggttaactcagcgaaggaggaccggaaggtttctgggaatgcgactggcgatggcggcgggcgtcgctcaaagatcctcagggccgttgatgtccttgttctcgagcacagctccgtctgggatctccaacttgactccagccttggcagcgatggtcacgttgcccttgagtacgactccagagccaaacgagacatcaccagagaccttcaagctgtcgagctcaacgatgctggggatcgacttgaaacgggcaaggaagttggcaacctttttgaactcaggaccaagctcaattgaagggttcgatggcttcactctggctgggttgcggatgacgtagccatcaaccaaggtatagagatcagactgcacaagcaacaaatcagatgtagccttcacgggcagaaaccttgagcggggaacgttgatgccgattgctttctcaaagaacctgatcgctgctccagcttgcggtttctagctgcaggactttcacgccatcaacttccttagggttgggaatgatttccatcttaagtgcttcagcatctacaagcctcttgatcgccttcaagttcacccacaggttattggtgttaaatatcttgaacttctcaatcgacttgaattcattcacatgctcatcagggacttgggcaatctccaagagctggactcttccttcgtatgagatgagggtaccacctttgacatcagccaatgtttttggagtaacttccatgcagtactcattctggttagtgatcaggtggtttagtatcttgatgtcaactatagcacccaagttgtctgagttcgccacgaagacatactcctttccctgtgacagtaaggtatcggagttttccactgttgttcaaagaggggaacacatcaccgtggcctggggggtaccagccatccttccctgtctgccctttgcttggaagtggcaaggagtttccagtaaccaatgcgagggtattggctctggtttgaaagtgtggaatttcaatgttgggagttggagtacttctcaacaatcttctgtgtgtcatcatgagtgttgaaagagttcattagaagcaaaggaacactgcatccatacttcttgttcagggactcaatctgaatcacaataaggtcaagaaatgtaaacccattgcgaacttcaatgacagacttggggccggtgcagcccatggtggtgccgagccctccgttgagcttgagcaccacgagcttgtcgatcaggcccgtcatgccgcagagatcttggcgtgggggcccacgcggcttctcggtgcgcgccgcaccacacctcctcctcctccgcctcagactcctccacctcggggccgttcttgacccgacgctgggcgcggcggcggttgcggctgcggcggcggcgaggcggaggcggcgtctgcggctgcagggagcatgcggtggccgccgtcgccgtcgaggcggactcgtcgaggtcggagccggagctccacatcgtggcggcggacgttgagctgcctgggctgctggctcgctcgtctcacgcggtggctccgcgtcttccgctgtctcggttgctcctcgtgccga

SEQ ID NO: 31507 - DNA, 1358 bp, Triticum aestivum
  unsure (1)..(1358): unsure at all n locations
  Clone ID: PAT_TA_31507
gtggccgaacaaacatttgcaggtaaagcttgcacattcggaatcaagtctatggcagcaccacaaaacacatgttttcctgtttcccttgttcttagatacaaactccaaaaaaagtaagaatttattacattaacccgttggtccaatccaaattgtttactccttattcgtgcgcccacaacagaatggtatgaataatttaatacagatacacggagcaagtccacgaagaactcaatcaaagtgtgatgcccctgttatcacaaggttgctactcaacgcctatcagaagcaaccgagtcagcagaaaacagatatttcacacgagaaaggaccgagtcactcgctggatcatatggatggtccttggatggaatttccaatatcgcagggattggcttgttgtagctatccaccagaaacctaatcatgtttgcaatatattggctgatgagcacaatagcaatatcctcccttgcagtaaactctttaaatgcatcttcaatctgtttcactgtcgttttgttatctacaagaaggtaatttgttttcttgcgcagatcaacattgccaaccccagccatcaaaaacccagtgacagtgtcctcatcggcgatgatggcgatgagggcggagttgttcgccgggatattggacctccccgccattactggttcctgtcaaaaacctgccggctgcaaggaatcttgcagtagatatgcaagcagaaatcacaggcacggatccagacagaagaaagagcgggttggagatccgcggcacgagctcgtgccgaattcggcacgagtgttgcatccctgcgccacccagagcaagacgctgagcgtgtgaagaacccagagtggctggtggttattggtgtctgcactcatcttggttgcattccccttcccaactctggagactttggtggctggttctgcccgtgccatggctcccactatgacatctctggcagaatccgcaagggccctgccccgtacaaccttgaggtgcccacctacagtttcttggaaagataacaagatgctcataggctaagagcctaaaaccagtacctaccaacatatattctccacaggagtgaattcctgttgcgctgttattttgttttcaatgtggctagggagnttttggtttcaaggactatccgcaacggtgatccactgttacctaccgaagttcatttgcaatgcgaaataattgttcncctatgttgctactggattgtaattttgtactgatttccgagacctaatggaaggtattgtanactcttcggggtcctgcncctaaatattggtaaataagcaaacantctcaaaaaaaaaaaa

SEQ ID NO: 31508 - DNA, 717 bp, Triticum aestivum
  Clone ID: PAT_TA_31508
cggaaaatagtgagatactaaaccaatttaggataagataatggatctccttctccagcaagtgaaaataacacaaaaatcctcacaggttcaaccacatagctcccaacattacattccagtcttgggacatcaaaactctcttaatgggggtaaacaaggagagcctgctaacagttactaaagcaagatggatagaacattcccgctactagaaaaggcattgtctggcttgatgcttaaacctcctggacgctcaaacctggtgggagggaatgcttgagcttgttggccttgtcggcgtcgaagacgcagagcgtgtagaggtacctggagcagcgcaccttgaacttgacggcgtccttggtcctcttgatccgcaccgaccgcgcgtccttccggcgcgccgtcagcaggaagtccttgatctcgtggatctgcttcggcatggtggacgactgtgcgcacccgaggagaaggaggaggcggcggcgggggtttgtcggtggggaggttcgacccgtactcgtcgcagtccatgtttttgtccgcgtccagattggcggtaaaaagaacgttattttttttgacgctactgctggtattgcccgtgctgtcagcattggcatgctgattgattaaattaaactagtgattcatccccattcattgtatacggaagcatgtaaatcagttatggggcaggccgagattcgg

SEQ ID NO: 31509 - DNA, 523 bp, Triticum aestivum
  Clone ID: PAT_TA_31509
taggggccttttttttttttttttttaggataagataattgatctccttctccagcaagtgaaaataacacaaatatcctcacaggttcaaccacatagctcccaacattacattccagtcttggaacatcaaaactctattaatgggggtaaacaaggagagcctgctaacagttactaaagcaagatggatagaacattcccactactagaaaaggcattgtctggcttgatgcttaaacctcctggacgctcaaacctggtgggagggactgcttgagcttgttggccttgtcggcgtcgaagacgcagagcgtgtagaggtacctggagcagcgcaccttgaacttgacggcgtccttggtcctcttgatccgcaccgaccgcgcgtccttccggcgcgccgtcagcaggaagtccttgatctcgtggatctgcttcggcatggtggacgactgtgcgcacccgaggaggaggcgacggaggcggcggcggcgagggaaagagtcccggcccggccggc

SEQ ID NO: 31510 - DNA, 880 bp, Triticum aestivum
  unsure (1)..(880): unsure at all n locations
  Clone ID: PAT_TA_31510
gaattcggcacgagcccctccgacctaggctatggctttcatcgtgtccaagctcgcgcgggcagccctcgcatcccgccccgttggagatattgctggtggcatctccccgtgtctctcccggctctatctggcggctggtaccagccgtcgcatgtttgcagctgcaggcggtcccaagtcaaaagaagcaccccgaatatttccccttgttgatgagaattccattaagtcgaaggaatccctatgggccttgtatgaatgctggtgcaagtattggggggtatcccgtgaccgtgaagagatggtccgccggttcaagtcatttgaggctactgcacagtgggtttacaaaatgaacaactctgggtgttcgcaagtgtctcaactgggcccgcatgcagatttttcagagagtgagtttgctgaggtggtgtttcctccacttcctgatgatgatgatgaagacataaaagagatggtgccaggtcaagatttgggccaggagcttgaggagcccttaaataattaattcgagaaattatgaacttgtcttactccatccgttcccaaatataagtctttctagagattcaacaagtgactacatacggagcaaaatgagtgaatctgcactctaaaatatgtctacatgcatacgtatgttgtagtccatttgaaatgtctaaaaagacttatatgtaggaacggatgagtatttggttgtggtaatactgtggtactgggattattgttgttgtctggttgttctcatggaaccaaattagaattgaaataactttgtgttattgctctaaccaaaaaaaaaaaaaaaaaaaaaaaaaaaaaaaaaaaaaaacctcggccgcgacnacnctaa

SEQ ID NO: 31511 - DNA, 1189 bp, Triticum aestivum
  Clone ID: PAT_TA_31511
acgaaaacataattaaaatggacttcagctacagtgacagtgaaaagtgcagagaatgtaggcctgaatttgggcaacacatgaaaacaaacagcatccatcaaaatcaagcgcctgaaggcgacggtttgatttgaacatcacgattgctccgtgcacgctctataatattcaaaggtacaaacaaactctttaaatttcttcgggccttattgcatcacgatgagacaagggcaagggcgacaccgactgaaaggtcgcccgggtcgcggtgttattgcactctgccatggtctagaggcgattacggaaagggactggagcttctttggctcttctgaagacgatgcggcggttagttcacaccgtagatccacttctcctcgttgctggtgtaagagaccagctccctgggctggaaccagagcgcgatctcgtccttggctgtctccgggccatcgctcccgtggatgatgttccttccaacaacaacagcaaggtcacccctgatggttcctggctcagatttcgatgggtccgtggcaccgatcagcttcctcccgtacttgataacgccctctccttcccataccatggcaagcacgggaccggagctgaggaagtcgcacagtccattgaagaaaggcctttccttgagatcatggtagtgcttctcggcgaactgcttggatggaaccaccagcttgatggcaacaagcttgtatccttttctctcaaatcgggacactatctcagaaatgaggcctctctggacgccgtcaggcttgatggcgatgaaggtgcgttccatctcggcggcgtgcacctcctgatcctggagcatgtagactgcggcgggaatggcggcgatccatgcgtagccctgggaggatgcggcgttggtgtggaggtggtgggcgtatgcggctgggagggtggagttcctgccgaggttggcgagggtggcgagcgcggcgttcctcccgtctgcgaggacggaggaggcggcggcgggggcggaggaggaggcgaggaaggacctggcggccttgcaggcggactggaagagcttcgaggaggagctcatcgtggcggcggcggcggcctgagaaccttccttgcttgcttgtgtgggagaggagaggagaggagagggagagggggagagatgtgggagggatcctcgtgc

SEQ ID NO: 31512 - DNA, 1598 bp, Triticum aestivum
  Clone ID: PAT_TA_31512
tacatgacacttcaccattatttgggactagaggaaggcattgggaagtaataagtatttgatgggttgctagagtgacagaagcttataccctagtttatgcattgcttcgtacggggctgatttggatccacatgtttcaagctatggttaggtttaccttgatacttttgttgtagttgtggatgcttgcaatagtgatgaggacatcaatacaattgttacacccacagcccctgctgctatacatactggaccaattactagagctcgtgcacgccaactaaattaccaggtactttcgtttcttggtaatgattctaatgttcatgagaatatgatgctgcctaaattggatacatttgttttgcttacaaatgaagggcctagcttggagaaggatgaacattggagcaagaacaagcatggagatgatggcatgcgcaaggggaacaagaacggagttacaagtgatgatttcaggactttgaagccaccataatgggtgcatgaagccttggacgaaatatacaagatgccacttcataaatttcgtcccgaggctattttaggtgttgcgtcaccttattattgggccaggcccatgtaatttcgaaatacataagtataggctatttttagagtccgtatgtgtggggaaacaagagatagggttgatttcggacccctccaccaagggccacgaaattcccccctcttcctccatatatacagcccttagggcgtcgtttagactttgggttttgtttagattaaaagttcgccatagctgcaacttcgcgtacttcgtttgtgttcaacgaccagacaaaggcgtcacagaaccccaccttgatcaataaagctttcatcttatattcgcaatatccagattgcaatctcagtttcttgcttgttcttcgtttgctcgcaggaaacagaccctcgtggtcaggttgatcgtgctccggcgtggtcaataacctctcggagttggtttagcgattgctaaggcgcgacgtcctcgcacgttcgtagtcggatcgtcaaagtcgacttccaccaaagcgatatccatcatctcatcgaaagacgggacacctttgcctctatcaagtggtatcagatttccaggttgctcggtgagattttacagtttttcgtagtttagatcgagtctgttcttcatacctacagtccacgaaaaagccacaaaaaaaaattagggttagttcatcatatccgaaccaatctgagcctttgcataatctttttagggtttttgctttgttgaatttgcggttgcatcgtcgtgtcaagttgctggtcttagagtctagtcttttagagtttcgagttctggtcataagttgtcacgccgccgccgcaccatcatcatcgcccctgccatctaccaccattgcttatccgccaccgctttgaatccgtatccatataccaccaccaatccgtatccatataccaccaccgatccgtatccatataccactaccgctaccatataccaccaccgctgccatatcctaccgccatatatccaccaccaatccgagttcctttcatattcggttggtttt

SEQ ID NO: 31513 - DNA, 1817 bp, Triticum aestivum
  Clone ID: PAT_TA_31513
agcataatatgttgcgcagcatggttatctagccatagtaaaatatggctattcagctagtttacacagaaggtctggctcccatctgctagataaattaattcactagccaccatgtcttcaaaggcaatatggcagtcatataccaccatgagcgagcagagtccggtcaccgggggataagcttggcgatagcgagagtgatattgcagagctggtcgacctcggtgttgcgcgccatgaggatgctctggtgttctggtgtgtcctggcaccccttctggcacagctttacctccgcctggcctgcagataccagcacctgcgactcgtcgtatgcccccatgtccagcgcgattgtcgcgtctgccagctgctccacggctgcctcataccgctccccacagtcctcgaggcattgttgcagctccgccgttttattgacgttttcatcttcatcgatgttcgtgaggtatgtggctgtctcggacgcgttcttctggacagccaggatggccgccctggtcaggcccacagcatcagccgtcaaggaggaccggtccggggagagccgtcgccatgcagaggtcgtagagcttggcggtctgcttgcaggcgtcctcgatggataacgacccggtggtcgacggcgccacggcaggggaaccagtagattggggcaatgcgatggcgaggaggaaggggaggatgaaacctatggctgcgtagaaggatgccattggtaggtttggtttgcgcgctttttttttttttttttttttttagagcagaagactggcatttaagagcgtggcacatctcccatcgttttatttcaaatcccaaacacagcgcagcatagtaccctacaaatcccactgcaaaaatccctgaaaaccacatccagtggttggcttatctgtccactacttgacatatcacacctacatcctccattgcccgtagtcgtcgtgtccttcaagctgcctcctcaagcagcatctgatcgaagtgccacactccgtggcctttgccgactcttctcagctgcgacacatactcagagatcttcttgatggcgtcaacctgctcctgaaggaattcactctcaacaaagtcggtcagctgaggatcattgcaccttgtagctacactgtgcaggttgtgcagtttctcattcaccagcttttcaagagctagagccaattccattgcatacagggcatcgcctttctcaggatggtcgaactctgttaagggtgtgacgattgactggagcctcaccctccctccacgtttgttctggtactccatgagcttctcggcgtgtcctctctcctcatcgcttgactccttgaagaacttggcaaatcccttgagagcaacgttgtcgcggtcgaagtatgcaaagagggagtgatacgcgtacgaggcattgtactccacattgatctgctcgttgagggcggcctcgcactcgtcgacgaacttgtgcctggcgagcgactggtccttgccctgcggcacgagcgagagctcccccttgagctcctcgaacggctggaacatcacaccgctgagcacctccttccccttcgccgcggccctgcagcagaccgccgaccctgccgcagacggcagggcccccggcaacctcaccgaaccggcggtgagccccgccccggagagctggccaaccgctgcggcggcggcggtggccggagacggcgcaaccctaggcaacatctcgaacccgaacggcggcggcgcgcttgctattccggaaattgtgggagcgggatttggtttgtgcggtg

SEQ ID NO: 31514 - DNA, 2695 bp, Triticum aestivum
  Clone ID: PAT_TA_31514
tctcaactatgaatatgacaatgaacagcgcgtagcacgtggtggaaattggtggatgggatggtggacagcggatgggataatgatgcagcagcggcgtgactaatgtgaacagaactcgaaactctaaaggaactagacactaagaccagcaactcgacacggcgatgcaaccgataattcaacaaagcaagcaatgaaaagaaaaattgcaaaggctcagattggttcggataggatgaatagatctaaccctaacttttttgtggctttttcgtggactataggtatgaagaacagactcgatctaatctacgaaaacctggaaattctcaccaagcaccctggaaatctgataccacttgatagaggcgaaggtgtcccgtctttcgatgagatggcgattatcgtttcgaaagagtagactttcacgatccgactacgaacgtgcgaggacgtcgcgccttagcaatcgctaaaccaactccgagaggttattgaccacgccggagcacgatcaacctgaccacgagggtctgtttcctgcgagcaaacgaagaacaagcaagaaactaagattgcaatctggatattgtgaatataagatgaaagctttattgatcaaggtagggttctgtgacgcctttgtctggtcattgaacacaaacgaagtacgcaaacttgcagctatggtgaacttttaatctaaacaaaacccaaagtctaaacggtgccctaagggctgtatatatggaggaagagagggggaatttcgtggcccttggtggaggggtccgaaatcaaccctatctcttgtttccccacacatacggactctaaaaatagcctatacttatgtatttcgaaattacatgggcctggcccaataataaggcgacgcagcacctaaaatagcctcagaacgaaatttatgaagtggcatgatgaggacatgactaccttggatatgaccaaaaatattgcatatatgcatatttgtcaggtgatttctagtgcaaactattcaataatctatttatgttatccagaacaaaaatacttcacacacttttgtgttttgtctaattgcaggtgtatgggacatttgtacaatccacatatgaagataaggaagaaagagatgtttatttgctgtccaaaaagttctctcacgtcacttttggcccaagagaagatagagtccaagtctctcacgttctggattcagattcggactgcacagacacacctgactcaaaacgcacacaagtttttcatacggactccgaattgggtgattctttttttgttggaaactagatttcgtgcactttccaacccaattggaatcaccttcaaattcgtccggagcgttgagttgtggacgaaacaatctgatgctgcagcagaatccgagtcaaactacaagtccaaaggtgttacatcacctccacttgggcccattgaccttgtacgacctagatttagttttaggctgccttgggacgtcctcccacctccttggccgccaccccttgctcctatataagtagatccatctagtagcttttccttgggttttgtttagattaaaagttcgacatagctgcaacttcgcgtacttcgtttgtgttcaacgaccagacaaaggcgtcacagaaccccaccttgatcaataaagctttcatcttatattcgcaatatccagattgcaatctcagtttcttgcttgttcttcgtttgctcgcaggaaacagaccctcgtggtcaggttgatcgtgctccggcgtggtcaataacctctcggagttggtttagcgattgctaaggcgcaacgtcctcgcacgttcgtagtcggatcgtcaaagtcgacttccaccaaagcgaaatccatcatctcatcgaaagacgggacacctttgcctctatcaagtggtatcagatttccaggttgctcggtgagattttacagtttttcgtagtttagatcgagtctgttcttcatacctacagtccacgaaaaagccacaaaaaaaaattagggttagttcatcccatccgaaccaatctgagcctttgcataatctttttagggtttttgctttgttgaatttgcggttgcatcgtcgtgtctagttgctggtcttagagtctagtcttttagagtttcgagttctggtcataagttgtcacgccgccgccgcaccatcatcatcgcccctgccatctaccaccaccgctccgaattcgtatccaccgctccgaatccgtatccatataccaccaccgatccgtgtccatataccaccaccgctaccaccaccgctgccatataccaccaccatatatccaccaccaatccgagttccttgcttattaggtttgttttcgggatcaatctagattccgattcgtgtttccttgcccggagtaggttccgagtcgggtagccacgctccgtttaggcccaaaatttttcgaaaacgcatttttcgaaaaaatttctggctatcctatttttaggtgtttctgagtgttttgagacaggtgccattataggaaagttttttttgacccgtttccagtttttggggtccgggcaagtcaaaaaaaaaaaattggtcaaaaaaaaatttcgtgcccatcctgtcagtttgggctacgaagaagttttgagacactccgccattatagg

SEQ ID NO: 31515 - DNA, 1268 bp, Triticum aestivum
  Clone ID: PAT_TA_31515
aaacaatgcatactgctcttgtaatagcaaataaaacagtgccaacagtcgatacacactcgcataaaaacagtaatgaatttacagatggtgtttcctgtaactttgattcaaagcattacacacagtggttcatgaagaacaaactaaaacacaaagcaggtgttgctgcacagcaacagcattcgaatcccctcaacagaggcggataccacagtgaccatccacatatagtaccactgtccaccacaagccagacaagacactacatcgagataccgactcctacagctattaggtaataataaaactccgggtagctcttattgttactgcgtcgggatgggctgcatctcaggagctgtggcaggcgcagggtcagctgccgggtaggcaaaaacccttgcgatgcgctccgttgggacaagcgggaggtaggtagcgacggagttgccacgcttagcaccatcaagcacggcagagttgtacttggctgagagctgtgcagctgtggggaggacggcacgggtcactgaggggacgagcgggaggcggttcagggcagcccaggcttcggcagccttgcgctcggccacaggctcgtagcgggtatacaagtcgcgggcctttggctcagcgcgagcaatggccgacttggccagtccagttgctgtgcccattatgcctgtcttctgcacctcagctgctgcagagcgggcataggttggcacctccttcacgaccggtgggacacgacgatcaagctcctggacagactcatcaaccttgcggtcgaggaacttgaggaggtcgagcggcacggcgtggtagcggtcgtagacggggccgacgacggccttgacggtcccctcgacgtggtcgacgccgaggcggagggggcctgcgccctgcttggcgtaggcgtaggccgcggcggccagcacgaccgcctgcgccgccgcctgctgcacgaactcgaggtacctcagcctggcctcctcctcctcgggcgtcctctccaccgtcacctcctccgccgcgggctgggtgctgatcggggcggcgtcgttgttgccggactgcgccatcactgctcttaggtgggggatcgacggagctgcgcttgataccgcgagagggagacgaagaactttttcgatcgaggcgatttcgctgctagggttttggggattcggtggatggatttggcagaggtggggaatcgggggtcttatagggaagagaagagagagacaatatgaaaccgc

SEQ ID NO: 31516 - DNA, 2117 bp, Triticum aestivum
  Clone ID: PAT_TA_31516
tttttttttcaaaaagttgtaagcaagcactcagactaacaatgaattacataagatacacgtaggtagcgattacatctcagtagattgctccactaactacttagtacttccactagaatcatggagccctttatttggaggcacctagtaaaaaccctatgaatgaagagaaacacaaatgatgtgaaatcgtgaaatgaagagactagagtacatgatgtgctccaattctagcttgttcgaaaaggaattttaagggtatccgccactgccagacccggatccgctacctccacagaaattttacgtccctggcacggccaggaagaacaagtgtagatgaacagcacataggggattacaattattatgtaaaggggctatcccaggacaacaccccagcagaatgcacacgaaaattacaggacggttaactcagcgaaggaggacaggaaggtttctgggaacgcgactggcgatgcagcaggcgtcactcaaagatcctcggggccgttgatgtccttgttctcgagcacagctccgtctgggatctccaacttgactccagccttggctgcgatggtcacgttgcccttgagcacgactccagagccaaacgagacatcgccagagaccttcaagctgtcgagctcaacgatgctggggatcgacttgaaacgggcaaggaagttggcaacctttttgaactcaggaccaagctcaattgaagggtttgatggcttcactctggctgggttgcggatgacgtagccatcgaccaaggtatagagatcagactgcacaagcaacaaatcagatgtagccttcacgggcagaaaccttgagcggggaacgttgatgccgattgctttctcaaagaacctgatcgctgctccagctgcggtttctagctgcaggactttcacgccatcaacttccttagggttgggaatgatttccatcttaagtgcttcagcatctacaagcctcttgatcgccttcaagttcacccacaggttgttggtgttaaatatcttgaacttctcaatcgacttgaattcattcacatgctcatcagggacttgggcaatctccaagagctggactcttccttcgtatgagatgagggtaccacctttaacatcagccaatgtttttggagtaacttccatgcagtactcattctggttagtgatcaggtggtttagtatcttgatgtcaactatagcacccaagttgtctgagttcgccacgaagacatactcctttccctgtgacagcaaggtatcgagttttccactgttgttcaaagaggggaacacatcaccgtggcctggggggtaccagccatccttccctgtctgccctttgcttggaagtggcaagaagtcttcagtaacaatgcgagggtattggctctggttgaaagtgtgaatttcaatgttggagttggagtacttctcaacaatcttctgtgtgtcgtcatgagtgttgaaagagttcattagaagcaaaggaacactgcatccatacttcttgttcagggactcaatctgaatcacaataaggtcaagaaatgtaaccccattgcgaacttcaatgacagccttggggccggtgcagcccatggtggtgccgaggcctccgttgagcttgagcaccacgagcttgtcgagcagcgccttcatggcgtcgagatcttcgggagggggcgcgagggtgtcgtagggcacccaccacctcatcggtgggggtctggatcttgctccactcgatctgctccgcctcgccgctgaggtagcgcgagacgaggctgatgaacccggccttctcgttctcgctgatctcgccgagcttggcgacggcgtcgcggaggccgtcgatcttggagtcggcggcgacggcggcggcggccatcgcgatccgggcggagaggagcgacgcgcacgctgcttcggggggagaggaggagaggacgggagcagatgtcagatgactggaagggagaggtgctggtgccgaattcctgcagcccgggggatccactagttctagagcggccgccaccgcggtggagctccagcttttgttccctttagtagggttaatttcga

SEQ ID NO: 31517 - DNA, 2135 bp, Triticum aestivum
  Clone ID: PAT_TA_31517
gaaccgagcttgctttcgtggcagtaatctgtattgtcacaaatacacattaaaaaagcttcaactcatcatcggggaaaaataaacctaggtaacaaataagctagacaagaggagagactgcacacgaagaaggaacaaagatcgaaaattcttattcatattgagtggtttggataaatcgacaaaaatcacaacaaatcatattacaggactctagcgaagggcagtcaaacacagcatactgtaaggtatcatcgaaattagatctccttgaatgcagcaaagaggtccccgctgatgtagtcattgtccacgaggctgaccaagtaatagctcttctgaatctgctctagcaactccctggacgagtcaccctccgggaacaggcaggcccatcccctggaccagatctcaaacgcttcatctttccagaccatgaagcttgccgagtcaacgacggtaggctggatgatctccttgccggggaacacaccccatgtgacagcgttcacggcgttcgcagggatgttggagatcgattccccttccttgttcacggcgatgtacgtgagggaagggaatgccttgctcttctcgatgagttggcccagcttctccttagcgcagaagaattcgacgtaggccttctggtaaacatagcctcctgggccgccccatccaacactaggagaatcagatttctctgcgtttacagcaggttggctgttgatggtaaggaaaccctttgagttaatcttcaccagctgatcatcaattatcgtcgtctcgggttgaagaccgtctaactcagaccatggactgcttttaagtttcccttcacagaagttcacaaaccgctcattaatatcttgcacagatttcagtggaacagcccattcctcttggagcttcttaccacgtccacgtggccgtgtgaactggtgatcattaagtgctccgtatgatgggttcctggaatcaccccaccgtccatgtgggtattgatcccaaccagtggtccttgaaatgtaactctttggtctgttggcccagaatatagggcgaacatcctctttgacacggaaaacattagttggtggcctccaaggtaatgttcttgaaagcttgaactcctctattaatccaagattcatcagaattgctaaagcagtcttctccatgtttagtgtgtacaggtgcaaagtcttgatcccactagccaaaattttcttgcacatctcagtaccaaggtgaattccatatgctttgacagcctcctcattgtctttaataggatccaaggcagcagtaatctcagctggtatcttagttttgcagaatccagtcatgcgcacaaatcctttgtagttatttattggcattatgccaggaacaatagggcatgttataccaatttgacggcaggtcgttcacaaacttgagaaagatatcggtatcatagaaaagctgggtgactataacgtcaggcaccagcatcaaccctttctcttcaagtaagcaagatctttgctatatgcttcctccgtagcaccttcctcgcctagtattacctcagggtgtgcctctggatagccagcgacagttatgccaaagtaatcaccatacttggctttaatgtgctccaccagatctagagcacaagaaaatccaccagcaacttgaacaaatttgtcctggccatgtggaggatctcctctaagtgccagaacattttgaatcccattcgacttgatggtatccaaagcattatcgatcttctccactggcatgttggtgcatgtcaagtgcatcatcgtttccacgcataccatgttctgcatgcggttggcgatgtcgagggtgacgtcggcggtggatccgccggcgccccaggtgatgtcgcagaagttggggccgtgcgccaccatgcggtccatccgctcgaagaggttctccacgccctcctccgtcttgggcgggaagtactcgaaggagaagacggtccggccattcgccgccgcctcctggatcttctcgatcaccttcatcttcctcttcctcttcctctagaaccttctcccccactgctctggctctgctaatggcgtcgcggcgggcggcggacgcgtggg

SEQ ID NO: 31518 - DNA, 1444 bp, Triticum aestivum
  Clone ID: PAT_TA_31518
ttttttttttttttttttttgaactatgaatgggccattttatttgtcccggaaataaaatgtcgtagacatacatgcgaaaccccaataaattgctgtatcacctacatatatagccatacaaccatacagaagaagagtacacgcacgtggttcactgcaactgtagtccttgtggttttatattcacagcagagtttcagtttctgtatcccccaatcttcatgtcttgtgggctgaaaacacattattcatgtctagcgaagcgagactgaactcgtcgatttggcgcttcatgccgctacgatggggtaggacgcacaggtagcaacagcacacatgttcttgcccatttccatcttgaagtaaccattgtcaccccagtcggcgccccacgagttcttgatgagccaatacgggacgccgttctccacgccgtacccgaccgccaagacggcgtggttcacgtcatcaggtgtagtaccgcaatggtcgctactgtaaactccgctcttgtactgcctgaaaccgttgatcacctcaaaggcaacactcactgggcgaaccaacccgacggcgtttttcagttcgtcctcagcatgcagtgtgatgttaacagagtccaaaacctgaactacggcattttcagccttgtaatggcagacgccattgacaccccttgtaagggtaggactcctcggtatcgatccctccattgtatttgatgtactcaaatgcctgggatggaaggcctccgctgcatccgaaattattgaatccgccggcacagtcaaccagctgttgctcagaaagagagatgttctttccagtggcctgagtatatgctgcctcaagtgcaccagtagtgctgaacgtccagcaggagccgcaatgggactggtcttttacggggctaacgatcccatcctccctccagtctttggtctccgggagcgcggcggcgtcgcgcatcaggtggttgccggcgagcgtggccgagcaggtctgcgccgcgccgagccgggtcgcctggaactcctcccagctcatgtccgagaagcggttgatgccgaggcggtaggataggcccttccggttggtggagcgcacctcctcgaggctctcggagaagatccggaaccgcctccgcacctccgccgcgctctcgtagctcttgccgtacctgacggcgaagcgcgcgaagcggagggcgtggcgggtgcggccgagcgcggcgaggacggtggactcgagcgtcgaagccgcgcgctcggtgacgggccggatagggttggagacggcgaaggaggaggaggaggaggaggaggaggcgacggcgacggtggccgtggccagggcggcgagcgccaggaggaggatgcgggcgtgggccatttcgccggcggatgggtggcagtagtttactgggttgggcaggaggggc

SEQ ID NO: 31519 - DNA, 1792 bp, Triticum aestivum
  Clone ID: PAT_TA_31519
ttttttttttgacagtcaaatacacactcatataaaaagagttatgaatttacagatggtgtttcatgtaactttgattcaaagcattacacacagtggttcaagcagcacaaactaaaacgcaaagcaggtgttgccgcacagcagcagcattctcgcctccatacacaggcggataccacagtgaccatccacacataataccactgtccaccacaagccaaacaagacactacaacgagatactgactcctacagctattaggtaataatagaactccgggtagctcttattgttactgcgtcgggatgggctgcatctcaggagctgtggcaggcgcagtgtcggcggccgggttggcgaaaacccttgcaatgcgctcagttgggacgagcgggaggtaggtggcgacggagttgccacgcttcgcgccatcaagcacggcagagttgtacttggctgagagctgtgctgccgtggggaggacagcacgggtcaccgaggggacgagcgggaggcggttcagggcggcccaggcttcagcagccttgcgctccgccacaggctcatagcgggtatacaagtcacgggcctttggctcagcacgagcaatggccgacttggccaggccagttgctgtgcccattatgcctgtcttctgcacctcagctgctgcagagcgagcataggtcggcacctctttcacgaccggcgggacacgacgatccagctccttggacaagattggttgaacccttgcggttcgaggaacttgaggaggtcgagcggcaacggcgtggtagcggtcgtacacggggccgacgacggccttgaccgtcccctcgacgtggtcgaccccggggcggagtgggccggcgccctgcttggcgtaggcgtaggccgcgtccgccagcacgaccgcctgtgccgccgcctgctgcacgaactcgaggtgcctcagcctggccgcctcctcatcgggcgtcctctccaccgtcacctcctccgccgccggctgggtgctgatcggagcggcgtcgctgttgccggaccgcgccatctctgctgctgctccgctggggatcgaccggtgcgctgcatacgctggattcaattcaactctgcgccagggtaatatcacacaccatgaatatatccaggttgggaaaggacgtgatgttggtttaaaccagattgccctgtttgaggggaaagttgccggaggtaacggcgagcaagttctgagtcgagacgtgtaccgcttggggcagctgtttgacttctttaggatgctaaccttcttttacaccactgttggttattatgtctgcacaatgatgactgttctaactgtgtatatcttcttgtatgggagggtgtatctggcactctctggactcgaccattcgatatctcgtcaagctaggtttctggggaacactgcccttgatgctgctctgaacgctcaatttttggttcagattggagtttttacagccgtaccaatgataatgggtttcattttggaattagggctaatgaaggctattttcagttttatcacaatgcaactgcagttctgctcagtatttttcaccttttcacttggaactagaacacattattttgggagaactatccttcatggtggtgcaaagtatcgtgctactggacgaggttttgttgttcgccacataaagtttgctgacaattataggctctattctcgaagccactttgtgaaagcgcttgaggttgctctcctgcttattgtctacattgcgtatggct

SEQ ID NO: 31520 - DNA, 1534 bp, Triticum aestivum
  unsure (1)..(1534): unsure at all n locations
  Clone ID: PAT_TA_31520
gaattcactagtgatttcgagcggccgcccgggcaggttcgagnttttttttttttttttttttttttttttgcctaggtgaactatgagtgggccattttatttgtgctggaaataaaatgtcgtatacatacatgtgaaaccccaataaattgctggatcacctacatatatagccatacaaccatacagaggaagagtacgcgcacggggctcactgcaaccgtagttcttgtggttttatattcacagcaaagtttcagttcctgtataccccaatcttcatgttcttgttcgggctgaaaacacgttattcatgtccagcgaatcgagactggactcgccgatttggcgcctcttcatgccgccacgatggggtaggaggcgcaggtagcaacagcacacatgttcttgcccatttccatcttgaagtaaccattttcaccccagtcggcgccccacgagttcttgatgagccaatacgggacgccgttctccacaccgtacccgaccgccaagacggcgtggttcacgtcatcaggtgtagtaccacaatggtcgctagtgtaaactccgctcttgtactgcctgaaaccgtcgatcacctcaaaggcaacactcactgggcgaaccaacccgacggcgtttttcagttcgtcctcagcattcagtgtgatgttaactgagtccaaaacctgaactacggcattttcagccttgtaatggcagacgccattgacacccttgtaagggtaggactcctcggtgtcgatccctccattgtacttgatgtactcaaatgcctgggatggaaggcctccactgcacccgaaattattgaatccaccggcacagtcaaccagctgttgctcagaaagagagatgttctttccagtggcctgagtatatgctgcctcaagtgcaccagtagtgctgaacgtccagcaggagccgcaatgggactggtcttttacggggctaacgatcccatcctccctccagtctttggtctccgggagcgcggcggcgtcccgcatcaggtggttgccggcgagcgtcgccgagcaggtctgcgccgcgccgagccgggtcgcctggaactcctcccagctcatgtccgagaagcggttgatgccgaggcggtaggggaggcccttccggttggtggagcgcacctcctcgaggctctcggagaagatccggaaccgcctccgcacctccgccgcgctctcgtagctcttgccgtacctgacggcgaagcgcgcgaagcggagagcgtggcgggtgcggccgagcgcggcgaggacggtggactcgagcgtcgaggcggcgcgctcggtgacgggccggatcgggttggagacggcgaaggaggaggaggaggaggaggaggaggcgacggccacggcggccgtggccaggacggcgagcgccagggggaggatgcggccgtgggccatttcgccggcggatgggtggcagtagtttactgggttgggcaggaggggcaggccagtagggagctcgcgtcccg

SEQ ID NO: 31521 - DNA, 2080 bp, Triticum aestivum
  Clone ID: PAT_TA_31521
atctaaaatgccacaaccaagtgtgggttacgcatggcacaactggcaaaggagacacaaaacactccagcaaaaagcaactcttacggcccagcagggcgaaagaagaaacaaatttaggcatgtgaaaactatgggcatcatataaccaaaagaaattttacgtccctggcacgcccaggaagaacaagtgtagatgaacagcacagaggggattacaattattatgtaagggggctatcccaggacaacaccccagcagaatgcacacgaaaattacaggacggttaactcaacgaaggaggaccggaaggtttctgggaatgcaactggcaacggcggcgggcggcgctcaaagatcctccgggccgttgatgtccttgttctccagcacagctccgtctgggatctccaacttgactccagccttggctgcgatggtcacgttgccctcgagcacgactccagagccaaacgagacatcaccagagaccttcaagctgtcgagctcaacgatgctggggatcgtcttgaaacgggcaaggaagttggcaacctttttgaactcaggaccaagctcaattgaagggttcgatggcttcactctggctgggttgcggatgacgtagccatcgaccaaggtatagagatcagactgcacaagcaacaaatcagatgtagccttcacgggcagaaaccttgagcggggaacgttgatgccgattgccttctcaaagaacctgatcgctgctccagctgcggtttctagctgcaggactttcacgccatcaacttccttagggttgggaatgatttccatcttaagtgcttcagcatctacaagcctcttgatcgccttcaagttcacccacaggttgttggtgttaaatatcttgaacttctcaatcgacttgaattcattcacatgctcatcagggacttgggcaatctccaagagctggactcttccttcgtatgagatgagggtaccacctttaacatcagccaatgtttttggagtaacttccatgcagtactcattctggttagtgatcaggtggtttagtatcttgatgtcaactatagcacccaagttgtctgagttcgccacgaagacatactcctttccctgtgacagcaaggtatcgagttttccactgttgttcaaagaggggaacacatcaccgtggcctggggggtaccagccatccttccctgtctgccctttgcttggaagtggcaagaagtcttcagtaacaatgcgagggtattggctctggttgaaagtgtgaatttcaatgttggagttggagtacttctcaacaatcttctgtgtgtcatcatgagtgttgaaagagttcattagaagcaaaggaacactgcatccatacttcttgttcagggactcaatctgaatcacaataaggtcaagaaatgtaaacccattgcgaacttcaatgacagacttggggccggtgcagcccatggtggtgccgaggcctccgttgagcttgagcaccacgagcttgtcgagcagggccttcatggcgtcgagatcttcgggagggggcgcgagggtgtcgtagggcaccaccacctcatcggtgggggtctggatcttgctccactcgatctgctccgcctcgccgctgaggtaacgcgagacgaggctgatgaacccggacttctcgttctcgctgatctcgccgagcttggcgacggcgtcgcggaggttgtcgatcttggagtcggcggcgacggcggcggcggccatcgcgatccgggcggagaggagcgacgcgcacgctgcttcgggggaagaagaggagaggacgggagcagatgtcagatgactggaagggagaggtggcgctgtggtgagatgcgtgtgaggcgacgcggctccgttttcttataggggtcgcgccgcggtctccgtcacggcatggacggaatgcgcaacggaatgtgcctgcggagtgacggcgccggggcacgtggcgggcgcggagggggccggccgtcggctaacggaagagggtggagggcgtgcggcgtcgagatcggggcggacgcgggg

SEQ ID NO: 31522 - DNA, 423 bp, Triticum aestivum
  Clone ID: PAT_TA_31522
attcgccggccgacgggtggcaatgccaacgatatgttgatcttcaatgattttatccgcacccagtcgctagttgaactacccatcaagggtaggacgtacacgtggagtaacatgcaggatgaccctttgctggtgcaattagattggtttttttcctcagtgcactggtcttcttcctaccctaataccactgtatcgcccttgggcaagcctgcttcagatcacgtcccctgcgtcattggcattgatttgtgcatcccaaaaagcaaggtgtttcattttgaaaactactggatacaacattcagggtttcacgagatagtgcaatgctcttgaagccaaccttgtcatgcggctaactcagcggctttgatctgtagaaagctaaagaagctgcgttacgctttaaagtcctggagc

SEQ ID NO: 31523 - DNA, 970 bp, Triticum aestivum
  Clone ID: PAT_TA_31523
tctcggacaagcagatcagtactggtcagggctccatccttgaggaggacgatatgatgggcagccgcactggtcttggaacgggttatggccagaccaagtgggtttcagagcagcttgttcgtgaagccggacgaaggggtcttcgcggtaccgttgcacgaccaggatacattctaggtgatattgagactggtgtctgcaacactgacgatttcttggtccgaatgctcaagggctgtattcagcttggcgttcggcctcacatcgtcaacacagtcaacgctgtacccgtgaaccacgtcgccaacgttgtcgtggcttgtgcgcttaaccccctgcctaacggtgttcacgttgctcacatcactggtcaccctcgtctgagaatgaacgaatacttgtccagtcttgagtactatggttacaaggcccccgaggtcgattacactcagtggaaggacgagttggagaactacgtcacagccggtggacaagccaaggatcaggagcagcatgctctgatgccactgtaccacttctggggcaacgatctccctgccaacaccagagcccctgagcttgacgactcgaacaccgtcaagatgctcaaggaagacgccgagcactggaccggcatcgacgagagctcaggatacggtatctcacgaaccgatatcggacgattcctgcattttttggccgagactcagttcgtctcttggcctacaggaagaggcaggccccttcccgaggttaacctgacagcagcacagctcgaggctgttggtgctgtaggtggccgtggtggtaacggtgctcctgctgctactgctgccgctgccaaggtttaagcgatagctcaggatactaaaagttatttgattcagcggctgctttgtttctcgactcagttggaaattgtctgagttgcatatgtagagatcaacccaatatacagaattgtggt

SEQ ID NO: 31524 - DNA, 756 bp, Triticum aestivum
  unsure (1)..(756): unsure at all n locations
  Clone ID: PAT_TA_31524
ctgggcgcgccttccctttcctctcctcctcctcgtagcttctcttcccggttcctcctctctctccccgtcccgtgctcggccatgccgggcgctagctcgccgagaggccgcgccggcgccggcaggaggtggtgtgcgcgcggggacctcctgaccgtggccgtcgccgcgatgctctgctcggcgacctactgcttctccatatggcacaacgggcgcaacgcggcggataagatcgtcatcgggcccgcctccttcgtcgtcgcgggcgccgcgctgtgcgggggcgacgccacggagctcgactttgcggcgcaccacaccgccgagcgggccgggctctccgtgtcgtcctcgtcgccgacggtcacggggcgacgggcattgcgcgcggtcgcggtgcccatggacggtaccgggcgccgtggcttggtgttggcggggaactcggttggcagctcggaggccgccgacgccaagaagagggcacgggtcaacggcgataagttccggtcaacacacgccggtaccgtccgcgcgtaggccgtaaccatctcctgtctcgtcccggcgatggcgacgacggagccatgctatcctgccggtcttggccggggttcccaagacgtggtcgtgtgttgcatttcgaagctatactatagtaaataatttactcaaggtgcagtcctttttggatccaaagattgtgaanataatataaatccgggggctgttttcncgtnaaaaanaaca

SEQ ID NO: 31525 - DNA, 749 bp, Triticum aestivum
  unsure (1)..(749): unsure at all n locations
  Clone ID: PAT_TA_31525
ngnattgccccgnaccatcggcccgnttgagatcgggctgagatggcgttccgccgatcatnccgggtttntcntggggttgcgtntctccgcttccccactttcctttttgaggangagagaggaatgnccgttnctcttgttgagntgcttgagacgcggaaccncccgtggccttccnggacgccctgttggcgccagggggggcagcgagggcggcgccgacgagtcgtggtcgtcggcggcggtggcggaggaggcagcgacggaggtgtagtcgtcgggcgcggagacggaggaagataggttgttgtggtcggagaagactggggcaggagcccacgcgtccgcccacgcgtccgcccacgcgtccgcggaaggaggaggaggaggagatggtggagaaggccatcttgctggaagatttcgcgtgagctttcctttagcctgatgagatatttccctagtactttgttgtttgtttgacttgtaatgtagtgaatcttcctatatggaaggcaagagtgaatttatctcagatgtagtgtttaattttaagatcattactaatgtggtgtttgattttaagatcagatgacagtatgttagtctctaagtggcaagctacttagcatcaatggtattcgatttagtgcactgctgatgattgttgtngttttcctggtcaattgntgaangganttagtgacaagctgcgaatgcaacattattggctntngtaaggggnn

SEQ ID NO: 31526 - DNA, 979 bp, Triticum aestivum
  Clone ID: PAT_TA_31526
cggacgcgtgggcggacgcgtgggtgccaacagttacgagagttggcagtttgtcttctgttgttttatccaagctctccagcaacgcatacgacacagcccaccttgggcccccacgctcataatgttgaagatatggtctatgaaaaaggagcagaaggatgcggaaaatgctgaaggccaagcttctggtggcaagaagaagaaggtgaccgctgctcagttgcgcgtgcaaaaggatctttcagaactttccctcggctcgacgatgaaaacagagttccccgaccctgacgatatcctcaactttgtcctcacaattgaccccgacgagggcatgtaccgaagcggtcgattcacattcgactttgccattaaccagaacttcccacacgaacctcccaaggttcgatgccgagaaaagatttaccatcccaacatcgaccttgagggcaaggtgtgcctaaacattctgcgagaggactggaagcctgtgttgaacttgaacgcagtgattgttggcctacagttccttttccttgaaccaaacgcatcggacccgctgaacaaggaggcagctgaggacctacgaaacaaccgggaaggcttcaagcgcaatgtgaggactgctatgggtggcggagtggttaagggcacgaattacgacagggtcctcaaatagagagagcgagcagcaaccacattttcgagatgaacacctacggaggcaaataacctaatcagggattttgagatgaatgaacgactctagcgagcgttttggtacagcgaacgacaagcgtcagagacgaaagagcaccaagtggcgtcctatgggtctataatctggagcaggctttgcttgtcatccccacggcgttctgtgtatggcttgatgaggggtgtgtctgctgaggatcttaccgaggcggggtagagttggagatatatatacagataaatttgaccgcctcaagct

SEQ ID NO: 31527 - DNA, 776 bp, Triticum aestivum
  Clone ID: PAT_TA_31527
ctgggcgggccgcctgcactgtggactcgacgatgcgtgccacacggccgcggctgcttgctgagatcatgcggcgcggggtcaagatgaccatcaccggctcgctggcgccgccccccccggcccagcaatagcagcagccgccgcggcttctcacaagccgttgccgtggcgcagctgcccccgcccccccgccaccagaagcaccagcctgccaccagcccccgcggctgctcaccggagcccccgctgccgccgctcctgcgccggcccccgcgcccatgcccctgcagcggcacccgcccccgcctcccggcgcaagccccggcggtgcctccgcagcaagccgccgccgcagcctcacataatcagcccctgcggtggctcctccgcgacgtggcttcggcaactggacggcggccatgggagccgtgtgcccctacttcctgtggaccaactgaaccaacgaaccagggcatgagactcagattcacaatcctgtgtaactcagctgttagtgttaatcgtgcgagccatcagaatcagagtgtagctcggctgattctagcctagtctaggtgttgaatttggtctttagggctatatgtgtccgaattattatattatcaatagaaatttcattttagttgaacatcaccaatggggcatgtaattggtgtctgaattattagtagcatcaatataaatttagtttgagtgattactactgttaatagaagatttgttttaccttcaaaaaaaaaaaaaaaaaaaaa

SEQ ID NO: 31528 - DNA, 1074 bp, Triticum aestivum
  unsure (1)..(1074): unsure at all n locations
  Clone ID: PAT_TA_31528
ggccccagtacttcttcctcgccggcggggaggtctgctgctccaccgcgcagctgggcttcttctacaccgcggcgccgcgccccacaccgtgcaggggctccgcactgggcccgcgctgctccgcgcccggctgggaccccatctgagctctttacgctgccccggcattgcgctcctcaaatcctcctccgcctgctgcccgtgtggatcaccagagtcatcgtgtcatcggccttctcgcagatgaacaccacgttcgtgcagcagggcagcgccatggaaatgaccatcctgtcggtgccggtgcccgcggcgtcgctggcctccttcggaggtgatctgcgtcatgacatgggggctcctctacaattaagggtgttcgtgccggcggtgtaggagcttctcctcgagcggtgacggggagccgtcgcagctgcagcggatgggtgccgggcggctcctcatggcgcacaccatgtcagtggcagcgctcgtggaaatgaagcggctcgacagcgcggcgcgtggggaagagatcagcatctcgtggcagctgccacagtacttcttccttgccggcggggaggtgttctgctacatcgcgcagctcgagttcttctttgacgaggcgccggacaccatgaagagcatgtgcacgtcgctggctctgctcaccatcgcgcgggggagctacatgagctcctttatctacgccatcgttcgtgatctcacgccgacgggtgaaaggatcccattaatctctaacgacacattaaacgggaaagtcgactacttcttctccgaggtagctgctttttgcacgcaacttgtagccaggttccagttgcatagatacacactacacgctaggaagaaaaatgtaagatatgcttgtttttttttagtcgtgttaattgtaagttgacttagttaagtcccatttgatacttagccaagaacatatacaagcatcccacagtaggaacatttttcttttcatggccgtagtgtaatcctatggcaggaacattttttcgaattaaaaaaaaaaaaaaaaaaaaaaanaaaaan

SEQ ID NO: 31529 - DNA, 851 bp, Triticum aestivum
  Clone ID: PAT_TA_31529
cacagaacgtgggacattcgcacaaacatcttcagccccgttgatagcggcgagctgacgactgcgactttcgactgtcctggtgaagctgccattatgcgctggcgcagttgttccgtccagagcctggacaatgtcctacacagcggcggccaaaaaataccgccccaagatgaggaatacgacgaccatgatggcgaatcgagcacgtcgcttgctttcgtccgcaaatcagaccctcaagccggtggcacatatatcatcctcgacgtctcacagacgcgggctttgacatgccacaagggtcaactacgactcgaacccgtccacctgagcgacgaccacatctcagaacaagctcagtggttctgcacagcaaaaaacggctttaaaggtttcaagaatgtcgctgaaggcagattcctcggccacgatgtctggtgggacttttgcgccaacgcttcaagtcacagtctgtgggagtacttcactatcgccagacgtccaggaggtctgtattggatgcagattcttcactggtggacgcagtggcaggtcactgtgagggaagacgggagtggtgtgtatgcagaaaaggatatcggaactgattgggaatttgtcaaggttttgagcatgagcgattgaaactgttttctttgttactcggcatgattggatggtttgcagcatgattggatgaatttgtctttggctctttagattccttttgtttgtttggagtttgatcacgacgcattgtttgttcagatttatgtttatggctttatgactgttcagttatgtttacgatacctagaatgaatacgatggatatgttggactgatat

SEQ ID NO: 31530 - DNA, 765 bp, Triticum aestivum
  unsure (1)..(765): unsure at all n locations
  Clone ID: PAT_TA_31530
gagnnnnttggnncntttctttccgccctgcccgtgggggtcccggccactccgtccaaatccccgtgcgcctccgcggtgccccccgcgcgtgggcctctcgggcccccccgctgctcggtttcggcaccaccttccttgtgggcttccctcaccgccgtcacccagcgccgtccaccacccagaccccaaccccgccccctcctccacctccgcctcccacctcccccgtcgcgccggcgaccccggcctcctctcctccgcgatgtatcctttggaaatggagggcaactcgaacccaaagacgaccaacaagcccaagtattccaagttcacacagcaggagcttccagcatgcaagccactactcacacctgaaatcgtcattgccgccttcgcgctcattggcgccctgtttgttcccatcgggcttgcgtcgctgcatgcatcacggcaggttgtcgaactggtgcatagatatgatgcaagttgtgtgcccgtggatgacaaggttgggttcatccagaactccaggactgacaaaacatgcacagtaacaatgactgtgccaaaatacatgaagagcccaatccatgtctattacctgatcgacggcttctatcaaaaccatcgaaggtatgtgagaagtcgaagtgacaaacaactgcggtataagagtgctgcacatttgacatcagattgtgtgcctgaaggtgataccgctgatcatgctccaattgttccatgtggccattgtatgatagg

SEQ ID NO: 31531 - DNA, 888 bp, Triticum aestivum
  unsure (1)..(888): unsure at all n locations
  Clone ID: PAT_TA_31531
cgagcggccgggccacatctccactctcgaaccttccaagctcctcccggtctcccctcgcttccaccgagtccctccgatccgatggcccgcaccaagcagactgcgcgcaagtccaccggcgggaaggtgccgcggaagcagctggcgacgaaggcggcgcgcaagtcggcgccggccaccggcggcgtgaagaagccgcacaggttccgccccggaaccgtcgccttgcgcgagatccgcaagtaccagaagagcacggagctgctgatccgaaagctgccgttccagcggctggtgcgggagatcgcgcaggacttcaagacggacctccggttccagtcgtccgccgtgtcggcgctgcaggaagccgcggaggcgtacctcgtcgggctgttcgaggacaccaacctctgcgccatccacgccaagagggtcaccatcatgcccaaggacatccagctcgcgcgccgtatcaggggcgagagggcctgatgaacgaattctctctgtctctgttctctgccgccgttgatgttcttggtgtcgtcgtcgtgtgttaggatttagaaaatgttgggttgtcgcctgctgcttaccattactagtatcttgtagcgatggttcgcctctggaatgtcgttcaatggaatgttaccgctgcttcattgcttttgcatggcttagccataacacagatgtggatgacaaggttgcatcctggtgggactatggttatcaaacaactgctatggctaacaggactgtgattgtanacaacaatacctggaacaacactcacatagcaacagttggtacagcantgtnntccccanaaaaggcagcatgggagatctntgattctttagatgtanaatatgtgnttgg

SEQ ID NO: 31532 - DNA, 1231 bp, Triticum aestivum
  Clone ID: PAT_TA_31532
ttggaatggtggctgatgcgcagagctcagattcaatggctggcagctcaggttctgctgccgaaaagcacgttgacaggtgtcttgacaaaagagcccaggaaaaggctccaaagaaaaatcataaagctgaacgagagaaacttaaacgtgaccagttgaatgacctttttgttgagctcagcagtatgctagatcatgatcgacaaaataggggaaaagctacagtattgggtgatgttgcacgagtactgcgagatttaattactcaagttgaatctcttagaaaggagcaatctactcttctaactgagcgccaatatgtcggttcagagaagaccgagctgcaagatgagaatactacactcagagcccagataatagaactacagaacgagcttcgtgcaaggatcggaaacagtagcctgaatctaagcagccttgcggtgccacatccaatagggagcagctgcactagtaatttagcaacccacccaacgccgcatgatacatggagcaatgcttctaatttaagcaccatgcgcatggtgccccccaaccaacacaccatctccactgcagaatcagcagcatcactctgttgcttctggtcaggttgcatcacggcctcaggagctccagctctttcccgggtacatcagcatcaacggaccgagaatgttccgggcatagaagcaacccagctacttcgagccttgcggattccttgcctggacagcttcgcctcagccttccaccaacatcccaagaagaaagcagcggcggcggcggaggcgcaccgggaaatagaaaaggacgaggtaccagttaccgggtcgacgggttacaacaaatcagttcttggtgataacagctctcttgtaaataccaacaagctactcaccttactggtccaaacctactagttgctctatatgtttaaaataactttacaattatgttttgatacaattttgcagcaggctaatcagatttgtaatctagaactcactagtcggtgatatgttttcgccaaggttttcaactgtaataagaacatatacaactggactgtgcaagcgcgcccccctaagcgtcggtgacggacagtgtcgagcggcacctcatttgtccatttggacaaccactgtgacgcctggataattaagctacagtgaacttctgctaaaaaaaaaaaaaaaaaaaaaactcgagggggggcccggtaccc

SEQ ID NO: 31533 - DNA, 949 bp, Triticum aestivum
  unsure (1)..(949): unsure at all n locations
  Clone ID: PAT_TA_31533
ttgtgcacggcgcggcgggccagctctaacattcaacctccaacgcagctgatcaccaccagcatttaaatttccctcctcgtcctcgccgcactctgtatccccgattgtccgtcgcagctcctcgcagccgccgtagccatgggcaccctcgtcggccacgtcgcgccgggcgccggcttcctcctcatcggcctgtggcagctgttcaaccacatccggctcttcgtgctgcggcccggctcctacgtcgcgccgctctggttccccgcgcgcggcgtccgccacctcgagctcatcctcatcatcgccggcacggtggcgtccatcctgatggagctcgtcatcggccccgcgaggcaccagccgttcgacgacgacggcaccatcccgtccgaccacctccacaacttcgagcacgcgtccatctcgctcgccctgctcgcgttcgccgcggtcaccatccacatggacagggtccgcgcgcccatgcgggacgccgtgtcgcagctggtcgccgcggcggcgttcgcgcaggagctgctcgtcttccacctccactccacggaccacatgggcgtggaggggcagttccactggctgctgcagaccgtcatcgtcgtcacgctggccaccacgctgctgggcatcccgtacccgcggagcttcgtggtgagcctggtcaggtcggcgagcctcgtgctccagggcgtgtggttgatcgtcatgggcgtcatgctctggacgccggggctcgtctccaaggggcttctccctcaccggcctcccccccccccccccggcccccgccgcccgcccggggcgccctaccgcccccgacgcccgcggagggcgccgccccccggccggcccgggggccgccggggccccgacccccgggcgcggttgggggccgcccggnnnnnnnnnnnnnnnnnnnnnnnnnnnn

SEQ ID NO: 31534 - DNA, 726 bp, Triticum aestivum
  Clone ID: PAT_TA_31534
gcactaactgggttcatacccttctttgggtcatcgccaaatttggaggaacttgatttgtcatacaacaggctagaaacaggaaaatggggatttatgtcttcactcgcaaattgtaccaggttggctaagctgctgttggttgggaacaatcttcaaggcaaaatgccaagttcgataggcaatctttctgatagtcttgagtggctttggctaagggaaaaccaaatttctgggtctataccaccggagattggcaatcttaagagcctcactagggtttacatggattacaatcttatcactggaaatatacgaccaactattggtaatttgcaccacttggtccatctatcctttgcacacaacaaactgtcagggcaaatcccggatactatatattggtaatctggttaagctaatgtctttgaaactggatgagaacaacattagtggaaggatacctgcaagtataggaagttgtactcaactcaaggaactcaacctttgtcagaactcgcttgatgggagtatactgtaagaaaaactgtaatgcggaaactttaatgtaatattgttttgcacaaagtgatccaacccttttgatctctcctacttacatactttgatgagcccataatttatgcggaatacccagaaatccatgtgaaatcatcggcacagtagttgtgtagccgactacgattagcagagtgttttgtcttc

SEQ ID NO: 31535 - DNA, 585 bp, Triticum aestivum
  unsure (1)..(585): unsure at all n locations
  Clone ID: PAT_TA_31535
ggtgaacacgatggagcatggcgggcagatgggcatgctattcgagctgctccgcaactgcgccgggttctaccgcaagatccaggaggacatccaggccaatctcagcgagcccgacgtggagcggagggagcgcggcgaggtgttcgcgaccaaggtggcgctgaagctcgggcggagcctgtcggacctgaagcagttcaggaagatggcctcgccgtccgtcaaagacgaggacatcagggaattcgccgggaaactcttctaaaccaccgactctgactcactttagactttagagtagctgactgatgaattctcttgtaaaggtagaaactgaaatcacaattatttgattcattcattcttatattttcattcccaatttgcacaatatatagttatatactcgcgaaggtagaaactgaatggcaattttttggatccatttttcattttcaatcccaatgcatatccnggtactcctccgttccgggaaataacctccggnagaatgaatgttccctanactatttttgttccnanaacacccatttttaanaattccccnnacaattnttccgn

SEQ ID NO: 31536 - DNA, 1188 bp, Triticum aestivum
  Clone ID: PAT_TA_31536
accaaaaaatcgcttcctttcaatgagatcagatttggattacatacaggcaatcaatgaaaacaactatggccagactaccctcaggttatggatcagcaaaactgcagcttgctagaacggcatttccaagctgcacaagagcgatatgcgcttaaaaacgacaggcgcaagggtaaactcatctaactctatagtatgtacaggggtaacacggacaggtatacacaggattgggctactaggtctaaatgtcagctgtcaccgctatctacaagcatggacacaaaacgccacgatttttctcatccggcacatgcaccgatcaattcgcgccatgcaacctgctgactggaaacgttacctcctctttctttgctagcaaaaacattgccttctctcatcagcttgcaagtagagcgccctgatggattccagcacattcaggtccaagtgcatagctgctgcatcataaatcccagctataggtgtaatgctcttagcaaataccccatttcctggtcttcttgaacccacagctgggactctgtgtcactcggccccaaacgcagcagctgagaggcacagtaaccagtagcaaacgcatggagtctcaatcctgccctaaacagcttctagtttgattggtgcttttgtaaaaactgacaaaacaaaaggtgcttcctcccctggatggatagttgttggcacaattgtgtatcctttcggataaggatccaacttcgattaggttttcatctccattttgtaagcataatctgcagagccggcgcgttaattcatgtaagtgttgagaacaagcgcacagacccttgtagcaagtaaggtggtactatgtcgccaagaaagttcagttataagaggtgaacctaagccaatgtcattctaaagaaacccgcacagtgggtggcgctattggtaaaattagcagtttacagtgcctggtcttgtgttttggtaacaattgtgggagagttttaactccctgatttatattcccggcacccccttgcaccatatatgggttagtaggcatgatgagcatagggtaggttaggtgcattcacctgaaatgcggtaattatagaaatttgcccttaaatttttggccaaacaaaaaaaaaaaaaaaaaaaaaaaaaaaaaggcgccgctcgcgatactagaac

SEQ ID NO: 31537 - DNA, 1348 bp, Triticum aestivum
  Clone ID: PAT_TA_31537
ttttttttttccttttgccaacgcttaaccaaacagcttcacagtattagaatatcaagacaagtacgattctgttcaatccaagacatgaaaacacactccatcccgaaaaactgcaacttacaacaagcggccctacaaaggcgcatgacgaacaccacatctcaaagcacagcaaaaaaaaggaaacagctcttcctacattccgacgaacaccactcacgaacaggctacatacagttagcaagtcctctccatcacagcgacgctactaccagcaagcttaaatatacgtccctctagggaacctactcctatgcagttagcagttggaggtcgccctcggtcttctcatggctcggcgcgagcatatctcctcccgcgttattgtttcgacgacgagttacagcttcttggtgtccccggatttcggcagctgtagttgatacagcggttaggggttgcacgagatgataggctcgctggttcacacctaggccgggctccaacacatgttagttcagctaccaacaactcatcagcatcatgtcccgtcttcgtcgaaaaagctagagtaacagctagagatggtatcatcccgtcgaaaaagctagagtaacagctagagatggtatcattccgtcgatggtaaacggaaatagtgatgtcactgcggtctcgtgacgcataatcgggccttcccagggttaagaagtgactccgacattatccaaccctgttcttttgctttcttcctgaatgttctgtaagacgacgacacaattttgcaagactctgcgatgtgtgccaggaaatgcgggttccctgtagtgatcttgatcgattggagctcatcctcttccgttcatgtgatacattgatgaaatgcagcaacacatgggcatggaaagcagctttgagaatgtcatctggctttgcttggtccttgagcaacgcatatactttatccttcgttgggttatatgttaccatgtatcgctcatcctcaaacaaaggccttgtggcaacaaatgaaacgggttcttgaaatgcttctccaaatcgtgatcctattgaaactggctcatgccgccaaggatgaataaatattgtctcctgcgagtttccttccttcaacgagggaacataccctgtcttaataaaggaatccactgcaacagtaaaccttgccctgtttagggtattcagcacaacagacctcacctcatgatatgaactcaggagatatccacatgacagcagggcaaatgagctcaccaacgatgggttccgctttgtgataagatgctcaaaccagtgcccagcctcgtgccgaattcggcacgag

SEQ ID NO: 31538 - DNA, 666 bp, Triticum aestivum
  unsure (1)..(666): unsure at all n locations
  Clone ID: PAT_TA_31538
ccctgtttttgtcttttagggggcgggcctgctgctaatcaagatgctacattgctaagtctcaaactgttctcaataatatacagtcatacatacaagccagcaaatgtttaaaactctgtacagtttggttcaataatacagatcgatgtcgatcaaagataagtacagtaggaaattgatggatggttggtgaagaagacgaccatgcatgtagatgtagctcttaggaggaggaggagaaggagaagaaggagcgcttggtgggcagcctgccgacggccttcatgaagttggcgaggtccatgaccctggccgtcttggtcccgcgcgccgcctccgccgacgcccgcttcccctccgccttccgccgcgcccgcgccacctcgttctgcgccttctccgtcgccttggcgcgctcctcctccagcttcctctcgatcttgctgaggtaggtggtggccgtgtggatctgctggttctcccacccgttgatcaccacctcctcccgcttgaacttgttgttgatcttggccaccatctccacctcccacgccttaaccttgttgttgatcttggccttcttcacctgccggacctccaccaccttcgnagncgccggcgccgcgcacgaggacgacgacggtagcagcgggcggccggtgt

SEQ ID NO: 31539 - DNA, 1150 bp, Triticum aestivum
  Clone ID: PAT_TA_31539
gaaggcggccgaaggcgagtcaaggcggagggcggccaagggcgacggggagaagaaggaggtggcgcatcagcagctactgggggatcgagcagtcgaagaagctggtgcgcgaggacggcaccgagtggaagtggtcttgcttcaggccatgggagacgtacaccgcggacacgtcgatcgatccgaccaagcaccacgtgcccaacacgatgctcgacaagatcgcctactacaccgtcaagtccctgcgcttccccaccgacatcttcttccagaggaggtatggctgccgcgcaatgatgctggagactgttgccgcagtgccggggatggtgggcggcatgctcctccacctgcgctcgctccggcgctttgagcagagcggtggttggatccgcgcgctgctggaggaggccgagaacgagcgcatgcacctcatgaccttcatggaggtggcgcagccgaggtggtacgagcgcgccctcgtcatcgccgtccagggcgtcttcttcaacgcctacttcttcggctacctcatctcgcccaagttcgcgcaccgcgtcgtcgggtacctcgaggaggaagccgtccactcctacaccgagttcctcaaggaccttgacgacggcaagatcgacaacgtccccgccccggccatcgccatcgactactggcgcctccctgccaacgccaccctcaaggacgtggtcaccgtggtgcgcgccgacgaggctcaccaccgcgacgtcaaccacttcgcatcggacgtgtactaccagggtatgcagctgaaggccaccccagcgccgatcggataccactgaggctggccgtgttctgctgagttttgcatcgctgctactactaccaccaagcaaatgagtgtttcgttttggaaggcagaggaaatgagagctctttagctgtataggatgttgcaattgttgctcgtttggtaactattccgtactgagaaataagcagtgtgcttgtcagttacgtatctaggatattgttgaaccaccatgtcgctctaagatgaacctatttggcgtacgccacgatgtcttcgttatcagaccaccattgatctacctcgctatgtacatatcccttatttgaaaaaaaattcctaaaacggccccta

SEQ ID NO: 31540 - DNA, 606 bp, Triticum aestivum
  Clone ID: PAT_TA_31540
gatcagaacaacaagctaggttaaataataaacaaatcaaagggaccaaccacgaacttcacccgcatttacgggtcagttcactcggggaaaccaaatccacaaaagtgaaaaaaaaatacaatctacagcacaccaatcctactgaacatatacccactgtaacatacgacactgcatattgaccgttccctccgttcatcgttcacacggcatacggcttcagttttacctctctacctccatgggttttgtgccaccgctgaccacgtgcccgtagccacgcttcgtggcctccaggtcctcctcgtcgtcatcgtcctcgcgatcgtccccgatgctgaaccggccgccggcgtgtctccccttgaccagcggcaagtactgcggctcctcggggtacagcctgctgacctggaggtagagcacgacgacgaacaccatggtgcccgtcaggtaccagctgaactgcaggttgaccagcgccttggcgcggtggagcgcctcgtcggtgcggcactggaccacgtcgtggccgtcctcgtgattgaggaagcaccccttggagacgagccccggcgttcagagcatgacgcccatgacgat

SEQ ID NO: 31541 - DNA, 925 bp, Triticum aestivum
  Clone ID: PAT_TA_31541
cccacgcgtccgcccacgcgtccggagtaatcgaagcagtttggatactatgtctatccaggctattttgaatgatccgctggagtctgaggtggagagcgaacctgagtccaagatgaagaaagtaacggtggtccctccaccagttgaaccggttgcgccaattgcaaccagtattgaggcagttgaggagggccaggcggctgatgcggaacagtcaaagcggaagaagcaaccacgccgtgtccacaaggaagacacaccgccagctcgagtgcgaacaccgggcgattacctccttacaccgctgcttttatcagagcctgagatggcttggattcagtgcaccaactgcgacgagtactttgtacaacagaacgcatactttacacgagcttcgtgtcctcgctgcgaacgacactcaaagctttatggatacatttggcccaagacagacaaggaaggacctaatgacaaggaggaaaggatcttggatcaccgcacaattcatcgattcttggatcctgataatgagcgaagagtgagaaatcgcaagagctttggagcctccaagacgaacacggaagaggcagaagatgttgagcgaggacgaaagcgattcggcacagctggtttaatgggaaggaatgcttccacgacagaagactcgggtcaccgaaggagtggaaggctacgaagggtgaacagcaggtttcttgacccatgatatgctaattggggggcgttggactgaacatatttacattttttggggcgagcgggattagtaattgcatatttacggattcaacaaacacaaccaagctacactaaatcttggtctagtatagatagttgacccaccatctgggcaacgttatttattataaatgcttcaacgttaaagactgcccattccgatatc

SEQ ID NO: 31542 - DNA, 514 bp, Triticum aestivum
  Clone ID: PAT_TA_31542
ttcgagcggccgcccggccggcgccccgccggcgcgccgccccgccgggccgagcccggtccgcgcgaccgggccgtggtggtgcgccgggtgcgcgcgctgccttgtcgggctctgggccggcccggccaagtgcagtcaacgggaggaagcagctgcagcctgcaggagcttgacttactacctagactctgtaactttcggtactcgtagccgtctgtttttacttttttttttacacggagaggtgctcatcttttttcgctgctgtatgcatgggtagctgtcagtggcatgttgcagaaaaggaaggcgactgaattacatactgtaagtagaagtagcagtggatgggaggtcccgttgggagtagggagcacagccaagttgacagtgttgttgatttcgacgtgtaaacttgctagtactaagctgctcaattacagtagctcattatgaagaggaattgagcggaaaaaaaaaaagaaaaggaaaaaaaaaaagcggccgctct

SEQ ID NO: 31543 - DNA, 943 bp, Triticum aestivum
  Clone ID: PAT_TA_31543
cgctcttctccccaccgaaactcctccgccgcacccccgccggagattcgccggaaccgccttcgcccaagtcagatgatggacgtgaggggcttgagattgggttatttcttggtcctatgcctcgtgcctttcttgcgccatgccgtggctattcgctttgtgatggacaggggagagtgcttctctcacaatgttgattatgaaggggatacagttcatgtatcatttgttgtgatcaaggcagacactccatggcactatagcgaggatggtgtcgatctcgtggtgaaagaccctaatggcaatcaagtccatgattctcgtgccaaggttagtgataagttcgaattcatagttcagaagagaggtgtccaccgtttctgcttcaccaataagtccccgtatcatgaaactgtggactttgatgtgcatgttggtcatttttcatattttgaccagcatgccaaagatgagcattttggtcctttgtttgaacaaataagaaagttggatgaagatctgtacaacgttctgtttgaacagcactggctaactgcccaaacagaccgccaagcaatattaaatgagaacatgagcacgagggcaattcacaaggcactcctcgaatcagctgcccttattgcagccagtgctgtgcaggtctacttgctgcgacgcctcttcgagcgtaagctgggtacatctagggtctaatttctacctctagctctcctcacactcaccaacccgactggacttcattactacagtgtgtggtttcaggatgttctacaccctgttcagatattcatgagtttttttcttcgaggattttgtaatttggatgacacagtatggcgcagcattagagtgccttctgtgttcctagttgccctcctgagtttcagttcagctatgatatccgtcaacacttgcataa

SEQ ID NO: 31544 - DNA, 490 bp, Triticum aestivum
  Clone ID: PAT_TA_31544
atccggttcgagttccccaaaggaccagccgcccacccgttcataagggtcgccggtgacccatgaaaccagcccctccccaccaacgacgagactgttgtcgtcgagatctcccccctccgtcaggtccccatgctcgccaacggcccctgcaagtcaaaaagcgtcgaggagcccccgactccatcaagccatgggcccgagaacgacgacagcgccagcctggaggataaggacgagtggaagaaggggaggaaaaagtttggggctgcggaacccttcaagttccctgatgaggtcgccattgcgcattttagctgagtgattagtcgaggtttctgcgacttgttgatatggttcagatttcagaatgctcgctactgctggcagtgattattcccctttgttatctctactcctaagggagcagttggtagtcccccttccaggttttattttagtcccccttttcatgggtttttttcgcccc

SEQ ID NO: 31545 - DNA, 760 bp, Triticum aestivum
  Clone ID: PAT_TA_31545
cccacgcgtccgcccacgcgtccgaagccggactctgaaccagtcatccttgacaatgcaccatcttgtcccgtggtagtcttcatcaactctagaagcggtggccaacttggaagtggtttgatcaaatcataccgtgaagttctcaatgaagcacaggtctttgatctgtctgaggagtcccctgacaaggtgctgcacaggttgtatgccaacttccaaaggctcaagtccaatgctgacactcttgctattcaaattgagaagagcctgagactaattgttgctggtggtgatggcacggcaagttggctgcttggagtagttagtgatctgaagcttacacactcaccccctgttgctactgtgcctctgggaaccggaaacaaccttcctttttcattcggatggggaaagaagaacccagctactgaccaagaggcagtgaaatcattccttgggctagtgaaaggagcaagagaaatgcgcattgatagttggcatatcatcatgaggatgcgagtaccacaggaaggtccatgtgatcctattgctcccttagagctgcctcattcacttcatgcattccaccgtgtaactggatccgatgagctcaatgtggagggttaccacacattccgtggaggattttggaattactttagtatgggaatggatgctcaagtgtcatatgggttccactctgaaaggaagaaaatccagagagttcaaaaccagctaacgaatcagggtacatatg

SEQ ID NO: 31546 - DNA, 2023 bp, Triticum aestivum
  Clone ID: PAT_TA_31546
ggcatcccaaccccgaatccagtcggccccacccccctattagttcccccgccccccacaactcgcctaggccaaccgccgccccctaatcctctggaccccccgtccaccgcatccgccagacgcgccgcccctccccccacctttccgaacccgcccggcagtccaggatggactgcaggatggacggacgtgcgctcagcactaaggcctctggcagccactcacgcggtccactgcaggattaccagattccgaactagttccaaaaggcagagcctgaaccaaccttcatgaacgttgcgggcaatccacgcatggctgccatactcaagcatggacgaggagttctaacggctagggctccgatccaagcctgccgcccaggcactactgcagcccaggctactcaaatatcgtggagtatccccggaccacggtgatccacgggcaatatgatgacgtcaaagacatcatggactacgaggaccctgtggcaactcggaaggaggaggttcggagcctagtaggccatcttgctaagggacaaggacgttgttgaccttcttgactgaggtatctaagacaagggtactcgccacttgttggatgtggatctcgctgaacggtaaagcccactactgtttcgttatgtgattattacaatatctcagatcgtgagattaattcttgcgagtccttaaagcaagtagagtttggtgcttggagggggaaatgatataaagcttacacactcaccccctgtcgcttctgtgcctctgggaaccggaaacaaccttcctttttcatttggatggggaaagaagaacccagctactgaccaagaggcagtgaaatccttccttgggctagtgaaagcacattccgtggaggattttggaattactttagtatgggtatggatgctcaagtgtcttatgggttccactctgaaaggaagaaaaatccagagaagttcaaaaaccagctaacgaatcagggtacatatgctaagcttggacttaaacaaggatggtttgctccttccctaacccattcctcttcaaggaacatttcgcaacttgcaaaggtgaagatcatgaaaatacctggtggcaaatgggaagagcttaaaatccccagcagtattcgatcaattatctgtctcaatttgccaagtttttcgggaggattcaatccctggggaacccctggcacgaggaagaaacaagacagagacctgactgcgccttatgttgatgatggactcattgaggttgtcggctttcgtgtgcttggcacggtctcgtattgctggcccctaatggacatgggactcgtctagcacaggctcataggatccggttcgagttccacaaaggagcagccgaccacacgttcatgagggtcgacggcgagccatggaagcagccactccccagcaacgacgagaccgtcgtcgtcgagatctcccacctccgccaggtcaccatgctcgccaacggccactgcaagtcaaagagcgttgaggaccctatgactccatcaagccacgggcatgagaacgacgacagcgacagcctggaggacgaggacgagtggaaggaggggaggaagaagtttggggctgcggataccttcaagttacctgacgaggtcgacatcgcgcaccttagctgagtgattagtcgaggtttcagatttcagaatgctcgccactgctggcagtgattattcccctttgtttatggtgttaatttcggagcttaattaattagcagccttgtgtagaccggcaatattcactaaccgcaaaatcggcaagtgtttgcaatgcaattgttctcttgttggaagcgtcggtagtcttccttccaggtttttcttttgtccctccgggcgtggtgtggggccgtcctgattacactgcataggcagtcaggttcagtctgtagtactccatccgttcctaaatatttgtcttttgtatacccgcaaaaaaaaaaaaaaaggggggggcggt

SEQ ID NO: 31547 - DNA, 961 bp, Triticum aestivum
  Clone ID: PAT_TA_31547
cggcgcccgacgagaatccatccccagctatggcggcggcggcggcggcgagggcctggtggcggccggaaatccccgcgtccgccccggccgcggccgcccgctgcttcgtcccggcccggggcagtcacctcgttacaggacttcaaatgacaggcagagccagcagcatcctccctcacgtgaagagcggggaggcagcagaagggagcccgaacgccgacgccgacactgccatcgccaccgccccggttgtcgatgaggagaccctccgccacgacctggagacggcgatcgaggaggaggactacgggcgcgctgccaagctccgggatgagctccgacacctgcgagaggacgggcggtcgtcgctgctggcggcaaacgcgcggttctacgacgcatttcgggacggcgacctggcagcgatgcacgcggtgtgggcaaagggggagcaccggtacgtggtgcacccgtcggcggggcgcatctcgggctacgagacggtgatgcggagctgggagatggtgtgcgacgccgaccacgagttcccgctgcggttcgacctgcaggacgtggaggtgcacgtcaagggggatattgggtatgtcacctgcctggagatggtgaagacgaggggcagcggcggcagctggggcaagcagctcgccaccaacgtcttcgagaaggtcgccggcgagtggctcatgtgcgtccaccatgcctcccatctcgacgacgacgacgacgaatgatcatcgaagatggatgatgaccgggttcgagcacaggaggtttcgcggtacagacgtgagcgtagagttacaggccataccattcggcagagttgagagacgttttatcatttctagttcttccatttttgtatcaccatcaaatacatatgctatttttgtataatcaatacatatcctattttgaggaattatatactttttct

SEQ ID NO: 31548 - DNA, 985 bp, Triticum aestivum
  Clone ID: PAT_TA_31548
caggcaaagtgtcaagatttgccctctgatgcatagtgtgtgcagcaacgtaggagtgatcatccttcacagaattataatgcaattccgaaggattaatttgcatgtatttgaagaaaagaaacggggctattgaagatgaagcacagggagttatttccgaaggattaatttgcatgccatagattgaacttattttttggttgtttgcttgttttaatcttatcatcttcgtatgataaaagagtgttcataatctgtaggttccatgcacagcaatgtacctatggacgatgaagtgccagcaacttccatgctgaagaacacagtagatgctgatccacggagaaggcaaattttctctatcaatcctgatctagtctcatgtgatccagcggcaatggagtagattgatgtaagccgcagatgtatgcgacgaagagattttggcggcaatctgttggtacccgggagaaaaaaaaatgtccttttgctgattttctggaacataactgcaattacggagatacgctgtgttgtttgagggatggaggtccaccgggacacgtggtgatcgctggttcgccctacacgatagtgcgtgctgggaacccagcaggagagccgtacaccgatccagggggctgtcgaccgcgacggctgctcgtagtgtcttgatccaagctgttatggctgagcggagaacggttcgcctggattgggaccgacgggtcgggacccccggttgctacggcgaaggcgtatgtttttcttccctggcatgcatctttgtcctgtgtttatggctttgcgtcgatggccgtttgtgcagcaaccaaaatgtcatagtatatatatatatatattttaggagagtggttgcaaactgtcttatcatttcgtatgttcacagccttaatattgacatggtgagcaatcccgcaaaaaaaaaagtttcccaaagctggcgagactattctggttc

SEQ ID NO: 31549 - DNA, 2170 bp, Triticum aestivum
  Clone ID: PAT_TA_31549
aactactcctccgcatcgccgccgcttccccccctccccccccccccctcccctctctctcctcgagccgcatcccacctgcctgcctgcccggggggtcctgcagcggccgccaatcccgccccatccaatctccctgcccgacccctccgccgccctgatctcgtcgccgtccgaggggcaccgcgctccgggtgccgcagtgcctgccctcgccggcgttcgtctccgtcgcccggttccgcccgcccgctcgctgcggccgtgtcggcgacctgcgacggcggcgggggcgagccgcgggaacacgcgcgtcggcgatggccacggcctgagattgaggatgcgcacagagggtttggactcttgtgtataggctccctcgctgttgaaatattgttgtagattctgacggaatgttggagggtcaatcttgcctgatctcgaggtcactgcccagctcctgcgaacaggaatccagattagcttatatgacttaccacctccttgagatcacgaggactaagcgcccatctggggtcctggctattgaacatgatggaattgctgtggcggcagtgctggcaaagcggcctaagtctgaggatagccatgatgctgtgccggtagactgtcaaggtggtaatcagggctattctgattcaagcacactgataagttctattggcagagataattcaatcaattgtctagcccgctgctctcggtctgattatggctccattgcatcactgagccggaacttccgttcccttgtccgtgatggtggtctgtacagagaaaggcggaggttagggattgcagaacactgggtgtatttctcctgcaatgtgcaggagtgggaggcatatgacccataccgtgaacggtggatgacgctcccaaggatgccacctaatgagtgtttcatgtgctcagacaaggagtcactagctgtgggcactgaacttctggtgtttggcaaggagattctatcacatattggtcttagctatagcattctgaccaactcatggtcaagaggcgttgaaatgaatgcccctagatgtttgtttggttcggctagttttggagagaaggcaattatagctggtggcatggattcttttgggagtgtgcttagttctgctgagctgtacaactctgaaactaaaagttgggttacacttccgagcatgaacaagcgtaggagaatgtgttctggagtcttcatggatggcaagttttatgttattggtggaatggccagtaacacggaggtgctgacatgcggagaagagtatgatttagagaagggtacctggaggttgatagagaacatgtcagagggtctcaatggtgccagtggtgctcctccccttgttgctgtagttgacaatgagctatatgcggctcaatatgcaggaaaactagtaaggaagtataataaaagtgataacacatggacaactcttggggagttaccagagcgcccagaagctgtgaatggctggggcattgcattccgaggatgcggagagcggctcctggtgattggtggaccaagagtgctgggcggcgggatgattgaactccattcgtggatcccaagggagggccccttgcaatggaacatgatcggaagcaaaccttctggcaactttgtttataactgtgctgtcatggggtgctgatttctgtgccaccacccacccgtcgaacatacttgtcaacaagaaagatttgtgatattggtttcgcaaatgcgcataaaagcactgattctgcctgattggtaatctctgccttctttttttccttctcctctggacatttcagattttactccatgttccatagattagtcagtcacatccttccttgtattcgttaacagttacactgttgggtctctgttttccgtgcatttggtttccagttgggaatttgtacctggtctggtccgtatactctgtcgaactgagaatttcctgagatggatgcatctaggtgacaaactgtaattgatgtagccttgcatctggacaaaattgtactccattggactctgaattgtcccagcttcatagtgctcctgtgcaaaatgcctgttaacaaaaacaaaactaaataaaaaaaaaaaaaaaaaaaaaaaaaaaaaaaaaaaaca

SEQ ID NO: 31550 - DNA, 1328 bp, Triticum aestivum
  unsure (1)..(1328): unsure at all n locations
  Clone ID: PAT_TA_31550
ccncccgggcaggtgagagagagagagaacagtctcgttttttttttttttttttaaaagctcaaacgtatctcttattataatttcaccagcggaaaacaaatagtattacatacatacaaaggtaaatcctctgaagagtatgagtggcatctcgcaatttacacactatacaaaaggaaagaacactcagatagctagcatggcgtagccgatgcctgctgcaagcgtgccgatcaggcctgccgtcaccggagcagccgcgcttcccggcgtggtcgagttcgccccgtcggcggccggcgccggcgggctgctcgtgtcggatccaggggtgcccggcgatgatccgcctccaggtgtacccggcgacggagctggacctgccggtgatgctggcgagaccggggttgtcccgggagcagccgccggagtcatcgggctcggcatcggttcgctggacggcggtgccatggaaggaggggacatcgggctgggcatcggcgcggcggacggcggtgtcatggaaggcggcgacatcgggctgggcatcggtgcggcggacggcggtgtcatggacggtggtgacatcgggctgggcatcggcgcggctgacggcggtgtcatggacggtggtgacatcgggctgggcatcggcgcggcggacggcggcgtcatggaaggaggcgacatcgggctgggcatgggcggcgcggacgacggcggcatggaggggggagggggcggcggcaggaggcccggcggcgtgtggtcgacggagagcacgacgacgatgagcttctgctccgccttgcagctggcctcgttgccgctgatgaagaagaaggggccggagcggtcgagcgtgaagacggtgctgccgccctggaacttgctcacgtaggtcgtggtgttgcacgcgttgtacgccgcctggtccaccagcagcaccgagtcagttcaccatgcatggccagggggcgccctcgtttgttcgatcgttgggcttggggtagcacgaacggagctggtcgccgatgatgaaccgcatcctcgacgaccacgtgttcagcggctcggcgccggccgccggcacgctccacccccgctgctcgccgacccggtactgcgccgcgctcgccgccgcggccgcgagggcgaagcagaggagccctgccagaccacgaggactcgccatgtctggaagattactagttcctaactgcactgataaatatcaaccgtctggctcgacacgagtgctagagcactgcaagttctgcttgtgtgcgttgtgatcggcgtgtgtggtgcgggagctgggagag

SEQ ID NO: 31551 - DNA, 452 bp, Triticum aestivum
  Clone ID: PAT_TA_31551
attcgcgggccgacgggcagaacagcctagatacatttacaaagctttagttaacatgcatgaactattgtctcgttcatataaaaagatcaatgtacgagccacgtagacaccgacatgacaaaactaaaaagacattagaacatcagccttttgcacaaaggattatcagccaagaaagaggattacaatcaggaccgactacatcctagagcttgagtcaaaacgcacatcacttgcctccggcaacatcacagcaaccaccaaagaaaaaaataatggatcaccttttcacccaagctcaatgtggctccaacgctaatatgcaatttttcagtcctccaaaatagcttaccaaatgatggtgtcccggctgaggggcctctcaccatgtcgaatcctggcctggttgggccaacctgaggaccccttgtcggtttcgacttgggcca

SEQ ID NO: 31552 - DNA, 625 bp, Triticum aestivum
  Clone ID: PAT_TA_31552
atgttgccaacatattatttcgaggtgctgcataactgcatcagcgaggcgtgaagatgattcattttccaaatagcatggaggcattaaacttgttactaccaccagagagaaggagattatcaaaaaataaaatggcgtacaggacaaaagaacgtactcctatctataggaaataatgagaccaataatgagaccgcttgaggctagctatcaattcttcggtcgaactatgagttacaacaacaatatcccagagcagcagcttcagttattctgtgcgaacagcgaaaatactcttgaagtaaatttgtcgtcagaaacagtctgtgagcggaaccaactgagctctggcaaattagagatcggcccaactgcagcaagggcaacatccttgtcaattataaactccttggctgttttcattactgtatcgcagtcaacagcatcaatccgagcaaaaagctccaagaatggcattactcgtccataagtaagcatctggcgaccattattttcagaaactgcagttgatccatcaaagtgaagcaaaagagaggacttcaactgattacgagcacgagcaacctctgtctctgacactctgaatgcaagtcttctaaat

SEQ ID NO: 31553 - DNA, 935 bp, Triticum aestivum
  Clone ID: PAT_TA_31553
gaaaaaaaaaaaaaaaaaaaaaatcactcacgccacaatcacaaacagaaacacaggagagagaaaaagatcagatggcatcatcctcttccttccttctccttgctgttcttcttgcgttggtctcatggcaggccactgcctccgatcctagccccctccaggacttttgtgtcgccgacatgaattcaccagtacgtgtcaatgggtttgtttgcaagaacccaatgaaggtcaacgctgatgacttcttcaaggcagccaccctcgacaagcctagggtgaccaacaaggttggatccaacgtcactttgatcaacgtcatgcagattgctggactcaacaccctcggcatctcaattgcgcgcatcgactatgctcccttgggtcaaaacccaccacatacgcaccctcgcgccactgagatcctcacggtgctcgaggggacactgtacgttggctttgtcacatccaaccagcccgcccccaacagaaacaagttcctctccaaggtgctcaacaaaggtgatgtgtttgtcttccccgtggggctcatccacttccaattcaaccccaacccccaccagcccgctgttgcaattgccgcgctcagcagccagaacccaggggctatcacaattgccaatgcagtgtttgggtcagacccaccaatatcagatgatgttcttgccaaggcatttcaggtggaaaagaatacaatagactatctccaggctcaattttgggagaacaaccacaactaagtcagacatttgttgattacacggaagattagtgcataaaccaaggatttggttgaatttctcgagcatccttatctataaaataaatggagaatatgtcatgccgctgtgtgtctgtaagccatgaatgtatttcaatgttatgaataatcaacaatatcttttttcatc

SEQ ID NO: 31554 - DNA, 958 bp, Triticum aestivum
  Clone ID: PAT_TA_31554
gccggccgggttccggatcactcacgccggcacgagcaatcacaaacagaaaaacagagaaaaaaaaaatcagatggcatcatcctcttccttccttctccttgctgttcttcttgcgttggtctcatggcaggccactgcctccgatcctagccccctccaggacttttgtgtcgccgacatgaattcaccagtacgtgtcaatgggtttgtttgcaagaacccaatggaggtcaacgctgatgacttcttcaaggcagccgccctcgacaagcctagggtgaccaacaaggttggatccaacgtcactttgatcaacgtcatgcagattgctggactcaacaccctcggcatctcaattgcgcgcatcgactatgctcccttgggtcaaaacccaccacatacgcaccctcgcgccactgagatcctcacggtgcttgaggggacactgtacgttggctttgtcacatccaacaagcccgccccaaacagaaacaagttcctctcgaaggtgctcaacaaaggtgatgtgttccgtcttccccgcggggctcatccacttccaattcaaccccaacccccacaagcctgccgttgcaattgccgcgctcagcagccagaacccaggggctatcacaattgccaatgcggtgtttgggtcagacccacaaatatccgatgatgttcttgccaaggcgtttcaggtggaaaagaatacaatagaccggctccaggctcagttctgggagaacaaccacaactaagtgaaacgttggctgattacacggaagaccagtgcgcaaattagggacatgtttgagtttgtacatatgcatcctaatctataaaagaaatggagcatatgtcatcccattgttgtgtctgtaatgagtgaatgtatttctaccttcttaataattgacaatatcatttttatcacaaaaaaaaaaaaaaaaaa

SEQ ID NO: 31555 - DNA, 1056 bp, Triticum aestivum
  unsure (1)..(1056): unsure at all n locations
  Clone ID: PAT_TA_31555
gccggccgggttgggatcgtcactcacgaccacaaacacaaacaggaagacgaaaaagagaaaagaagagccaagaaactaaaatcaaatggcatcctcctcttccttccttctccttgctgctcttcttgccttggtctcatggcaggccactgcctccgatcctagccccctccaggacttttgtgtcgccgacatgaattcaccagtccgtgtcaatgggtttgtttgcaagaacccgatggaggtcaacgctgatgacttcttcaaggcagccgccctcgacaagcctagggtgaccaacaaggttggatccaacgtcactttgatcaacgtcatgcagattgctggactcaacaccctcggcatctcaattgcgcgcatcgactatgctcccttgggtcaaaacccaccacatacgcaccctcgcgccactgagatcctcacggtgctcgaggggacactgtacgttggctttgtcacatccaaccagcccgcccccaacagaaacaagttcctctccgaaggtgctcaacaaaggtgatgtgtttgtcttccccgtggggctcatccacttccaattcaaccccaaccccccaccagcccgctgttgcaattgccgcgctcagcagccagaacccaggggctatcacaattgccaattgcagtgtttgggtcagacccaccaaatatcagatgatgttcttgccaaggcatttcaggtggaaaagaaatacaatagactatctccaggctcagttctgggagaacaaccactactaagtcagacattggttgattaattacaacggaagaccagtgcacaagtgaaaggacatggttgagttcctagatatgcatcctaatctataaaataaatggagcatatgtcatgccattgtgtgtctgtaatcagtgaatgtatttctaccttccgaataattgacaatattatatttgtcacaaaaaaaaaaaaaaaatgctgnnttggaagggggggggatacacaggagacagttgcaattaggaacatgttgagttctagtatgcatctat

SEQ ID NO: 31556 - DNA, 2110 bp, Triticum aestivum
  unsure (1)..(2110): unsure at all n locations
  Clone ID: PAT_TA_31556
nantnnnaactgacatgnannaanntggggtgggttatctagttgtgactgcagcgttacggctgacgctcgagcaacgagtggttgctgcccgtcccgtatatgcacctgctgtgaagcagtgtgacgtaaacgttcctgctgctctggccccacgtagtggtcgggctttggggagggattccattgttgaagcaccccgggggaaaaatggcaatgacagcataaatctgaagctggcgcaggtctaggcgcagcgggggcgaatcgttggtacactacaaggtgagatggctgtcatttgcgaggatgtgtctcaactcaagcaaatagtggatgagcgcttatcttggagcaagttgcagcgctcaacaatgtcaagtctctcctcttcgctgcattcttcgcttcacagaacagctagtacggcagataggaccactaacgcagttgattatgttgcacaaaaccatgcagaagattttgagttcacagtcccagttggccattacaattcccaagataagcctgtgaaaattccttataatcatgcagatgttgttaactccttatgttccaagacttctactggtgttcctaacagcgtagtctcacgtaaatttctcagtactgaaaaaggaaacccttgcacctgcgctggattttcctattccagacacccaagaatcctttgttggttctggtggagtcttagtacacatggataacaattgtgctgacgttgattacaactccgaggatagagttgagcatggtgacacattcttgtcttcttcaagtgagttgatacctgatttgaattcgaatcactttgcctccatggcttcaactcattcaagccactctgttagtattgagtcacttgcggattccattgctgatgcaaaaaacaaaaagaacgatctgttaccctcacttgagctggttactaagatgatagaggatgtagaacttcttgaagaaaaagctaaagtagccaagcgtgaatcatctatttctggtacaagcattctcaccaaagttgaggagctcaaagaaatgttgaatcatgcaaaagaagcaaatgatatgcatgctggtgaggttttcggtgagagatctattttgaccacggaggcgcgggagctccaatctcgacttcagcggctgtcagacgagaggaatagctatctagttgttattgaagagataaggcaaactctcgaggaaagattggttgctgcacaacaggaatatgaagcagctgtgaaggaaaaagacgaaaaggaagcttctgctcaggcactacttagtgaacaggaaaaggagatgaattccattgttgaagaatcaagaaagttgcagaaagaagcggaggagaatttgaagctgaaggagttcttggttgagcggggtcgaattgttgatacactacaaggtgagatggctgtcatttgcgaggatgtgtctcaacttaagcaaatagtggatgagcgcttatcttggagcaagttgcagcgatcaacaatgtcaagtctctcctcttcgctgcattcttcgcttcacaggagtgctagttcgtcagacaggaccactgaagccgttgagtctaaagataaacatacagtcgctgaagttgcaaggccagtggctgaggatccggatgtcgacgggagaaaggttgaaatgttagatggctgtgacagtgaaggtgcaagctcagtgggtgaagacaacagcaagcagcggggttccaacgaggatggctgggaactgtgctgaactgaagatggctgaagatcgtcagggtttgcctgagtttgctccatataaataaataaaaatggcggtaataatcatttagaacgtctctattttgtgcgagcaaaattagtgaacttgcgggacttgtcatggaattgctttgccttttgggaggcgactgaatatcagtatttgagtaagttaaaatggtgctgacatgatatgtatataccgagattctagcttaatctatagtataaataaatgattggtgccatgtcaatgccaattttattgcacaaanaaaaaccnaaccaaaggaaaaaccaaaatcaaccccaaacaa

SEQ ID NO: 31557 - DNA, 1359 bp, Triticum aestivum
  Clone ID: PAT_TA_31557
gcggggcctcacacaacacacatcgccattccacctcctcttcttcatccaacccgatctagcccacgaacagcttggcctagccttcccactgtgcgcaaccgtggtggctggcggggcccagcccaccacccccccctgccagtgacctaccccgtgtcgacgccctgcacgccgctctcgtcctccgtcccccctcctggccgccagccccccagctgttccccgcgcccaggtggccgcccactcctccgcgtgcgcgggcgtggtggctggcgggggccagggcagcaaccccccctgtcggtgaggaaccacgagaggacgccatggatggcgctttggagctgcgtcgcccgatctggccgccagcccagtatctgatccctgcgttggcttcggctcgattcggacgtccacagcctctgccacctgcgcatgcccccctaggtccggccgatgatctcgcgccgcttcgtctgctcgcgttgaccccgagaaggccaacgcctcgtccagccgcggcccggcctgtgtcggcggcggcgacggcatccccgtgccgtggtggtggagctctccggtgggtggctgggcgacaggggatgcggggctggctcggttgctcgccagatcggcaggcctgtgtgggaggcgcgggggaggcggtctggcgcagcggtggcctactgtgtgtcggcctcggcaggtgcctggcaggatgcttgtggtggtgccgtgtgcactgcggctgccaatggtatcaatgtttttctgtattctctcagctctgtttccatgaggattattagaaggaatgtcaaattcgccgccgcgaccactgttttttgttggattcatgcgccgttcctctttgactcgtgctcgcgcacacttctttcgttggcttgttgattcttgcaatttggaaagtatataagttgctaggatttgatgtaaagttgcggggtgggactattaattcgaatctgaaattttagcacaaactctgactgctgcagcagggagggagaggagggcgatgcgagcgggtgcgggtggatgcgggtgactcctttttttccccgacgaaccgttattttcacttatgcacgtgactgcgggttaattaccaacaaacaaagggacttttctgtaaaaacgccgccgacgtacgacataaacccaattctctttattattaggtaaagaggtaaagataaagataaagattcaggaatcctgtaccgtaatgttgttacttattttctaacctaactttttttcatgtgacatgtcattacagagcagatatattgcctttgaatttacttctatctggagagggacaggtctgta

SEQ ID NO: 31558 - DNA, 728 bp, Triticum aestivum
  Clone ID: PAT_TA_31558
gctgatcgcttccattccccggtgcgctcctgtcgtccaggcatagcgtcgagcacatggcgcgcgccctcctccgccgccgcggcgcgctctcctctctcctctcgccggccgcccccacggcgcccagtctgctcccgtcattctcctccgccgccctcgcgcagctgcgctccccgctcgacgaacgcctgctccgcctcctgcgctccgagatctcctacgtcgccgaccgccgccctccccaccagccgccgacgggcttcaagtccttcgccgtggaggaccgcccgggggagcagtgggtgcgcctccgcgccgcccgccgcggcgccggggtcggggccgaggaggaggccatcaagatcgacgccaccttgttcgacggcgtcgcggagctgccccccgacgcgtcccttttcaaccgggtcgaggcgctcgagcaagggccgcgcctccacctcagcctcatcgtcgaggtggcccgcgccgaccgcgtcctggggttcatctgctccgcctggcccgacaaccttaccgtccgccacgtgctcaccctcaggggcgccggcgccgccactgacgaccgcggtgcccgcgacttcacgaagctggagcctgcagagagggaggcggtcaagaagttcctgcaggagagggaggtggacgccgagctcgcggagttcttgcacgactacgtggcgaataaggagaggatggagatgctc

SEQ ID NO: 31559 - DNA, 727 bp, Triticum aestivum
  Clone ID: PAT_TA_31559
gcgtccgccccgcgtccgcgctccaccgctgtccgctgcttccattcactactgtaaaagctcgtaagagaagaaatatggctcgcgcagcagctgctaacatcgtggtggtcgctgtggttgcggcgatgctcctcgcggcggcgcacaccgccgacgccgccatcagctgcggccaggtgaactctgccttgggaccctgcctcacctacgcgcgtggcggcgctggcccgtccgcagtctgctgcagcggcgtcaagagactcgccgctgccacccagaccactgttgacaggcgcgccgcgtgcaactgcctcaagatggccatcggccgcatgagcgggttcaaggctggcaacatcgccagcatcccgtccaagtgcggcgtcagcgtcccatacgccgtcggcgcctctgtcgactgctccagggtcagctgatctggagaatgcagatcacccgtggccggcgtttagctcgatcggtcgacgccgatgagttaaggttacacctctataaaatatacgtgtctataccgaataaatgcttgggtctccatgcatgatgggttgtacgaacgtgtggtgtcaggccctgcgcggggtgtgcatgcatgtacgtcgagccagctctcgacggccacgactgaatcgatgtttactctttatttccgtgtgtgcggcaaaaaaaaaaaaaaaaaaaagggcggccccttttaaaaggatcc

SEQ ID NO: 31560 - DNA, 634 bp, Triticum aestivum
  Clone ID: PAT_TA_31560
cgtcgctatcctatttaaacctcctcctcctcctcctctctcgactctgtctgcatcgcatccatccatccatccagggctggccaccgtacgcctccttctctcccgtctccggcaacgaccaactccggcggatcctcctcgctcctccgccccgccgcgcattcttcagtacagggagaagctaagcaggagatcagcaggggactaaggaggagacttgatcctaccgacatcaggactgggaagatgggtttcctgtcactgctcgtcgtggcttccatgcccatcgtccaggtcctgctcatcggcgtcatcggagccttcctcgcctcggggtacagcaaggttctcaccgccagcgctcgcagggacatgaacaaggttgtttttacagtcttcaccccgtctctcatcttcgccaacctcgccaagacggtcacactgtccgacgtcatctcctggtggttcatgccggtgaacatagcaatcacattcctggttggcagtgctctaggctggctagcgtgcaagatcctgaaaccgccgccgcatttccgtggcctcatcatggccttctgctcagcaggaaacctcggaaacttgctgctgatcgtcgttccggccgtttgcg

SEQ ID NO: 31561 - DNA, 562 bp, Triticum aestivum
  Clone ID: PAT_TA_31561
cgaccccgcgtccgaaaaaaaaaaaaaacaacctcgggggctcccgcgatcacccaggcgatctggcggcgacggagttcgagcgtgtgtagatggcggcctcggcaccgacaccggcggccccgccggaaaaggggtctatctctcctgaagccggcctcgtcgggggcctcttcagcgaagagtgggaggagtttcggcggagatcaaggcgaataatctagtgggcgaagaatcccctacggtgcctcagcaatcaaggagaagaatggagaatttgttctgcaatttggaaggtgagatcccctctgatctatatggggtagaaccgatcgggacggaaggcgccataacttccacggattcggtggtctgtgatttggaggaaaatacggggataggggaggatgtgtctttgttacctaatgttttggtgatttattcccctggattggaaagtagtgagcgaaatcagggggttcatccatatcattgattctatctatggaagctgcaaaattatggtggatttcttgtgcggtttttatttcttttgttgaca

SEQ ID NO: 31562 - DNA, 1007 bp, Triticum aestivum
  Clone ID: PAT_TA_31562
gagatgtggttttttgcttaccaaaactaccggccacttgcagcgccgtttattcccagttcagattacaggtttttattctcagtataagttacagaaaactgtctcactgaaaggggtgggagataaagaaagtctactccttgtatacacagttttttcacctactaggacagcaaaatatgcacatcagatgatggattatacgcatctgagattaacaacaacaaaaaagagtctcagctcatgtaaagtataactaatctatggtgatcctacacaacagctctgtcttccagctctactggatccgggagcatctcctgtgaagccttcttgaaggagaaggaattttcctcctcgtcgcttccttcggattttgctgactgcctacaggtaagtactttccctgatgtttgcacctcggagtactggtacgagtgcccatggaaagcagaacgccaagagcttcgggatgaggtacttgtgagccgagctgaactggggctcgagaagagctcttcccgcaccacccctagcgggttctccagcgctttcaagatgtaccgagcaagaggccgcctggagggctttggattcaggcatgtcttcgctacaatggagactgcccatacttcttctaggtggtcttcgtccacaacaagtgaagggtctacaatatttatgacattctccttgtcatgggtttcaatgtaatctaaagtgcttgccaaccactcctctgagtcggtgtcgtttgagccactcacgccaaatttcccggtgattagctctagtagcacctttccaaagcagtaaatatcatatgtgcggctagcaggtggacctgacatgttcttgtcgagagactttgatgatctcaacatcctagagaagaaactcctgctgccatcacttggttgaaggcaaatttcactcaaacttccaaggcacacttcaaatttgtcatcaagaagaacactgcttgcttggatatctctgtgaac

SEQ ID NO: 31563 - DNA, 281 bp, Triticum aestivum
  Clone ID: PAT_TA_31563
tacggctgcagacaagacgacagaatcgacggggtcgatcgtgggatcgctggaataagtcgcctgcttggtggttgggttcatctggggcttcacacggttctacaggtgttcgtgtgagtttcacacggttttgtatgtctgtaaatcatgtacggtacgcgtgtgtatgtacatgtttctgtctgtctgtaaattcttttcaacttcacgtgtgtaatctgtgtcatcaaaactgaaacagagcattaaacacggcgggtgtggtagttaaacaccgg

SEQ ID NO: 31564 - DNA, 873 bp, Triticum aestivum
  Clone ID: PAT_TA_31564
gcccgcggtcccggcgggcgccggcgggcgcacggccgcggccaccgacgcgacgggcacggagggcgcgcctggcgcgacgtacaccgacatgatcaagtccgcggcggcgggcaccacggagtacggcaagaagctggcgagcacggtgtacgacatgatcaagtccgcggtggcgggcgccacggagtacggcaagaagctagcgagcacggtgtacgagaaggtcgccggcgtcggcacggccgtggcgagcaaggcccagcaggtgacgacatccgccggcaccgcggtgcttcacggcgcggctccaacgacaaacacgaatgtggtgtgaagtgccccaggcgcgcgaggtgtgcgcagaggtcgatcgtgggatcggcggctggatcaagtcgcctgcttggtggttgggttcatctggggcttcacagcccaccacagaggggaacatcgggttcgacatgtgttcgggtgggcttgacactctcggcgaggccccgaggaccaacacgaatgtgatgtgaagtgccgcagcgtgttgatcagttcggtcggttcgtgggatcgctggaataagtcgcctggctggttcaggtgtacactgactggtgtttgggttcatctggggcttagctgcttttatcgttcgtgtatgtatttggggcttgtgttccagaagtgttcgtgtaagtttcacacgttttgtgtgttctgtaaatcatgtacggtacgcgtgtgtatgttcatgtttctgtctttgtctttttaagttcttctgaacttccttcctgtgtaatctgtgtgttcaaagttcaaacacgatgtttcttcgtctggtttggtgggctcgtcgtttccaaatgacaa

SEQ ID NO: 31565 - DNA, 606 bp, Triticum aestivum
  Clone ID: PAT_TA_31565
taggggccttttttttttttttttttcttttttttttttttttttttttttttttttttttttttttttttttttttttttttttttaataaaaaagtatcttgtgttcattcaaaataagccattttaccttttgcagtctacaatcaatttccttgatatcggcctattatatatataccctcagtcggaataagaaccacatgtccaaataaataacttgtatcgaagcaaaagaaaagaaagataaattaaaagaataaatgtatcatagatattgggatttgtgtagctcctagaatgtttggcaccgataggtccgtccacttaatccatgatattgctcgtagtcttcttgatgagatcccaagcacttctcacatgcctgtcctcctgcaacgacgacccaatggcgaaccggagcacgaacttgtcaccgaccaccgggtgagcaagataggccttgccagttttgttcagattctgcattagcacgcggttgacctgggtaggatccttctgcgtggtggctgcgctggccttggtccgatagccacagtagcgaaggtgctgagtgctaccacctgagacctgggatgggaatgg

SEQ ID NO: 31566 - DNA, 435 bp, Triticum aestivum
  Clone ID: PAT_TA_31566
tccgggcccacgggggagaatctcgcccgccgcctgacgccaccgtcgtcgcgtccggcgctccgtggaaagaagagaaaacccaccgtcagccatggcgaactcggcgtcgggcatggccgtgagcgacgagtgcaagctcaggttccaggagctcaaggcgaagcgaaccttccggttcatcacgttcaagatcaacgagcagtcgcagcaggtggtggtggaccgggtggggcaaccgggcgagacctacgccgacttcaccgccaccatccccgccgacgagtgccgctacgccgtcttcgactttgacttcgtcaccgacgagaactgccagaagagcaagatcttcttcatctcctggtccccggacacgtccagggtgaggagcaagatgctgtacgcgagctccaaggacaggttcaagagggagct

SEQ ID NO: 31567 - DNA, 899 bp, Triticum aestivum
  Clone ID: PAT_TA_31567
gaggacccgcccgcccgctcacgccaccgtcgcagcgtgaggaaggacgtaagtgaaaaggagaaagcaccaaccatcacgcattccgcgtccggaatcgcccttggcggcgagctacgaattcaagctcaagtaacaggagcagaagcggaagctcagcttcagggtgatcaagatcaatatcaaggtgcagcaggaggaggtggagagggacggggtggaacacccgggcgaggctgacgtcgcagtctccctccccgttcacgactaccactaccccctgtccgttttcgacttcgtctctgttacgaacggcaagtagcggaagagcactgtcatctcctgcacctcttccccatccacggtcagggggaggagtcagatgctgggcgccagctccaggtacaggttcaagagggagctggacgagtagcagctggaggtgcacgacaccgaaccgagcgacatggcgttggacaacgtcaaggccagagccctctgaacaaatttctcatcgcatcgctcctttcaggctccacggccacgcagctggatctacaccacgccctacgtacctgcgcccccgcaccctcgtatggtgtttcccctcccttgtcgcttctcggagcctccccctccttgtaaactagacatagatagtcgctctcgttctctttcccttctccttgattttagacggcatgcccgatcttatttccccccttgttgctgtgaggcgtactacgtaaatttgtcccggtgtccgttgtgaagcgacttggttcaccacgggccacacggcacttattcacgaaaagacaaacattgtggtctgttttgctcctgttctccttatgtgctagttccaaaagaagccctcatgcaacactatccaaaag

SEQ ID NO: 31568 - DNA, 833 bp, Triticum aestivum
  Clone ID: PAT_TA_31568
gctctatggtatgcgcaattctcttttctagttctgttattaactgcatataaacatatgttccttcttctgagccacttcaccatccacaccaggaaggtaatgcagttcagtttctacgacgtttatatagtacccattttttttccaagtatatatacaatttgtgtgagttctaaagatacattccatgtacataacacaacctaacacggattagaaggatagataataaagcccttccttccttcctgatcgctatcacgaattatccatcatacacacgtgcagcaggagaagggccaacccaaatcaaatgtacatacataccggcggctcctgagtctcctcctacaagaatatatcgtcgacacccacggcggtcgacggtggcgcctcgtcctcctcctcctccatctccggctcaggctccatgccaaactcaggggagtcgatgtcggcgaggttcttgaggtcaacaatggagagctcatcgagccgcttcacaacaaggtcggcggctccgagctcgtagacggggtgcttgctcgcgacggccacgcacttcatgcgggcgtcgtgcgcggcctccacggcagagttggagttgccgaacacgacgcagcgctcggggatgaagcccagcagctgcgcggcgtagaggaacagctccgggtcgggcttgccccggtacacgtcctccgccgccaccacggcgtcgaagaacccacgtgcgccgacagcctcgatggccgcctccacggccttgcggggccttctggaggcgacggcgagggggatcttgtagttgaccagtgtgctcatgaactccc

SEQ ID NO: 31569 - DNA, 1091 bp, Triticum aestivum
  Clone ID: PAT_TA_31569
gccggccgttaagcacaatctttatactcagaaaggcaaaaccaacaccgcgagaatcgccacctgcaccgaacccggagcaaatctccggcgagctcgagccgaagcggcggacccgcgcgagcaggagagatggatccggacgaggtgaagtcgaagctccaaggcctggccttcggcaacgtcctggccgccgccgcccgcgactacaagaaggaagttatagctaaagagaaggctcaagcagcacctgcgatccatgatgaagtcgatcttgatgagttactggatgacccagagcttgagaaattgcatgctgaacggcttgctgctcttaagagagaggtcgagaagcgtgaggtgctaaagaggcaaggtcatggtgaatacagggaaataactgaaggggacttcttaggagaggtcactcgtggtgacaaggtcatctgccatttctaccatcgtgaattttaccgctgcaagatcatggataagcatttgaaggcactcgcaccggtctatttaggaactaaattcgtcaagcttgatgccgaaaatgctcccttctttgtggcaaaactagcaatcaaaacgttgccatgtgttatattgttcaagaagggtattgctgttgatcggttggttggttttgatgaccttggaagtaaagatgatttttcaaccagggctttggaaaatgtactgaagaggaaaggtataattgaggaaaagaagaaagacgatgatgaagaagatgatgagactgacatgtcaaaggataggagggttagatcttccactgcttatggttcggattcagattgaagagatggaagtgatatgatcctgtcttttgtaacattataagtttgtctcttttgtactctagttctcgagagttctttatgatttatgtgtgccgtattgtacctaaaaagagaactggaggctggatgtatcagtggtctgtcaatagctccagttttacatgatctgggttatagttcatcagctatcagagtacaatacatatgtatgactaagtattagtgctgcaattatgcttcagtgttaggcatttcagcttcctt

SEQ ID NO: 31570 - DNA, 711 bp, Triticum aestivum
  Clone ID: PAT_TA_31570
gagaattaggttcccggcacagcgtgactggcgtccagacgctttatcacgccgacaaggcgaagacggaggagcacatcctcgagcttgtggtgctgctccatcatctcgtggtccaggtgaagagccgaggctatgtgcaaaacatgcctacaaagcaggaccagtctccatctcgtaagttatcatcagaaccgcaagctgataccaagcactgcatgtctgacacatctccgacgaacaactgtgagatctgcccaagcccggtgtcggacagcgagcgccatatgctggaccccctaagcttgaggagatgtgagcctcagcctggcaggggggacaaggcgcaccggagccatggcagctcgccggccagggagttcgttcgtagtcgtagctcggcctcggaccgtgagctggtgaaacatctggatgtaatagatggtctagcagactgaccatcgttttggtagagtgaagacatttggttgcaagcacagagtagctatttgttggcttttggctccaccgtctggctcgtcgatcagatcaaactcggaatttttcaagtattttttcttttgacttcactgttcactgagatcagatgagctcgggagccgaaatggatagtcaattatactggcagtatataacaatgttacagctgggtgggtgatttgagtggaaatacagcaggatcacaagtga

SEQ ID NO: 31571 - DNA, 1919 bp, Triticum aestivum
  unsure (1)..(1919): unsure at all n locations
  Clone ID: PAT_TA_31571
aggaatcctaacctcccctcctcctgcgattccactcgcacccttcctttcaggaggagaaggtccaaggggggatcagttccattgcacttgatcccattttctcttcctggtttgcttttgccatttttttgattcgtgaggtcaaatagagcccggttcctccccccttccctcagaggcgctgccgcctttcttggcttcttgattgggttccggctgctgctacattcttgattcacttggaaaatgatcaagtgggggatcagcagcgggacgcccgcggattcgtactacgagatccgctccgattgcacagacgatgtgcccaaaagcaagttcaagatcaaggctggcaaaacactgagtgttcggaaatggcaagctgcatttaatcctgatggctgtcttgacattgtctcggtcctaagccggatacaaaaaggaggtgttcacccgactgtcaggggggaggtttgggagttcttacttggctgctttgatccgaggagtacctttgatgagagggaggagatcaggcaaataagaaggctacaatatgctagatggaaggaagaatgcaaagagatggattctcatgttggtagtggtaaagttatcacagcaccacttatcactgaggatggaagacctattaaggatcctttggttttacttgaggctacttcaaaccaaaacacctcagagggtgcttcaactagcaaccacaatggaattgaagtagacgaatctgcagaacgtattactgacaagcaaattattgaatggaagcttacattacatcaaattggacttgacgtgctacgtactgaccgcaccatggtattttacgagaacaaggaaaatgtttcaaagttgtgggatattctagcccgccttgcatggattgacaaagatgttggttactgtcaaggaatgagtgatttatgctcaccaatgattgtgctactcaacgatgaggcagatgcattttggtgctttgagaagttgatgcgtagattgcgaggaaatttcagatgcacagatcaatctgttggggtggctaaccaacttcagcaccttgcatctattattcaggtgctggaccccaagctacatgaccacctagaaacacttggtgnnaggtgactatctttttgcattccgtatgttcatggttctatttcgacgtgaggtgtcatttggggactccttgtacctgtgggagatgatgtgggctctcgaatacgatccggatatcttctttgcagcatgtgaagaagcaagcggtgcacataaaaaagtatcggcctcgtgggttaggggcgtgcgccaggtcgccgactgggacaaggacaaggatgtctctgaggaaactgatggcccagttcccatttcagttttcatggttgcaagtgtgctcaaggaaaagagagaaaaactgttacaagaagctagaggactggatgatcttattaggatattgaatgatgtaaatgggaatttagatgcgaaaaaagcctgcgctggagctctgaaacttcacaagaaatacctcaaactggtacaggcaaagaaaacctaaaaaggcaccggaagatatgcttccactgagggattctttaccatttgaatctacacatacacgaccatatttggcacagaaacagcgagtgaaggttctcatgggtggtcataatcggaagatggccccggatacaggatagatgcaacttctgtatgtaatgatatcacattctctgtatcccacataagttcatatgcttgtacagacatggtgctgtgggtaccttgcaaaaataataatttcaattcaagttgaaatgtcatgcatgttgagattcacctggagagaatattgtagccacagaagtacagaactttgttccaagaaaatt

SEQ ID NO: 31572 - DNA, 450 bp, Triticum aestivum
  Clone ID: PAT_TA_31572
ttcccgggcccacggggatcgcctcatcgcactctcctctcctgcccccggcacttccagaacgctcgatcgatcgtagctcgtgttccctctccttttcgcggcgatggcggtggatctgaccccgaggcagccggcgaaggcgtacggcggcgagggcggcgcctactacgagtggagcccagccgagctgcccatgctcggtgtcgcctccatcggcgcagccaagctctcgctcgccgccggcggcatgtccctccccagctactccgactccgcaaaggtcgcctacgtcctccaaggcaagggaacctgcggcatcgtcctgcctgaggccaccaaggagaaagtagtcgccgtcaaggagggcgacgctctggcgctcccgttcggcgtggtcacctggtggcacaacaacccgggggtcggcaacggagctcgtcgtcctct

SEQ ID NO: 31573 - DNA, 1072 bp, Triticum aestivum
  unsure (1)..(1072): unsure at all n locations
  Clone ID: PAT_TA_31573
cgacccacgcgtccgcacgccctccagctcccggcagccttccaaccaacccccaaccgaccgaccgacctctcgatcgatcgtagcagcttcctctccttttcgatggcggtggatctgaccccgaggcagccggccaaggcctacggcggcgacggcggcgcctactacgagtggagccccgccgagctgcccatgctcggcgtcgcctccatcggcgccgccaagctctcgctcgccgccggcggcatgtcgctccccagctactccgactccgccaaggtcgcctacgtcctccaaggcaagggaacctgcggcatcgtcctgcctgaggccactaaggagaaggtggtcgccgtgaaggaaggcgacgctctggcgctccccttcggtgtggtcacctggtggcacaacacccctgagtctgccacggagcttgttgtcctcttcctgggcgacacctccaaaggccacaggcccggccagttcaccaacttccagctcaccggttcgagcggcatcttcaccggcttctccacggagtttgtcggccgtgcctgggacctcaaggaggacgatgctgccaagctcgtctccagtcaacctgcgtctggcattgtgaagctcactgccgggcagaagctcccagtgccggtcgatgctgaccgcaaggacatggcgcttaactgcctcgaggccaagctggacgtggacatccccaatggtggccgcgtggtggtgctcaacaccgcgaacctgccgctggtcaaggaggttggtcttggtgctgaccttgtcaggatcgatgcccactccatgtgctccccaggcttctcctgtgactcggcctaccaggtgacctacatcgtccgtggcagcggccgtgttcaggttgtcggccccgacggcaagcgtgtgctggagacccgcattgagggcggcagcctcttcatcgtgccccgcttccacgtcgtgtccaagatcgccgatgcctccggcatggagtggttctncatcatcaccacccccaacccgatcttcagccaccttgctgggaagacctttgtgtgga

SEQ ID NO: 31574 - DNA, 1799 bp, Triticum aestivum
  Clone ID: PAT_TA_31574
cccccacgcacaaaccacaatctcatcgtctcgtcaacaatggtgcagcgcagctccaacgcccccggggcgcccccgcggcgccatcacaccctcctgctcctcccggcaacctccaaccaacctctcgatcgatcgtagcggcttctgctttttcgctcgcggcgatggcggtggatctgaccccgaggcagccggtcaaggcctacggcggcgacggcggcgcctactacgagtggagccccgccgagctgcccatgctcggcgtcgcctccatcggcgccgccaagctctcgctcgccgccgccggcatgtcgctccccagctactccgactccgccaaggtcgcctacgtcctccaaggcaaaggaaccgttggcatcgtcctgcctgaggccaccaaggagaaggtggtcgccgtgaaggaaggcgatgctctggcgctccccttcggcggggtcacctggtggcacaacacccctgagtctgccacggagctcgtcgtcctcttcctcggtgacacctccaaggggccacaggcccgggccagtttaccaccttccagctcaccggtgccacgcgccatcttcaccgccttttccacagagttcttcgggcccgcgcgggggctcacaggggacgatgccgcgaagctcgtctccacccggcctccgtcggccgttatggagatgactgctggcgggaagatccccctgccgcggcgctgctgaccgcaaaaacacggggcgtaaaagtgctgcggcgcaacgcggcacgggcacctcccaaggggggcgcgcgggggggcgcccaactgcggatcgacgccggctccatgaggtgctggtcgttgtcctgcttttcagggtcgcagcccactccctatgtcctccgcagcggtcgcctgactctcgccatcccgggcgacacacctcgcccgggggcgcgcctgtgcaggggttgccgccccgatgggcagcgcttgcttgaggcccccaatgagggcggcaaccctttcattgtgccccgcttcccactccttgccccaatcgctgccgattcctgcatggagtggagcgcctccctcagcatccccaacccgatcccgatcctcagtgccggggagagctcggagcgggaggtggacgcgccggtcgtgctgaaggggtcgtacaccacgatcccggacatcgccaagcacttccagtccaagcggctcgactcggagattttcttagacctcaattaggagccattcgtctcgcatcggctggttgccttatgcaggaataaataaatttagttaggatattgaaactctttgagtgtgagtctgtcagttgagctgctggtggttttaatggatcacctatgataatctatcttagttgcccctggcagaacacaatgttactgtcaggtcgccatcggttatatcgagtgagtgtttgtggctggccgagctggtctgagaactgctgaatgcaatctatccttaaatttggtaaaaaaaaaaaaaaaaaaataaaaaaaaacaaaaaaaaaaaaaaaaaaaaaaaaaaaaaaaataaaaaaaatgaaaataactaaccataataaaggaaaaaaaaaaaccggcaaaaaacaaaaaaaggggccccccaaaaggttcaaagctaagttacccttcaatgaaagttcaaacctcttcaaaggtgcccccaaatttcatttcaggggccttcttttaaaaacttggtaacggaaaaaaccctgggtttacccaaattaaacccctttaaaaaaaacccccttttcca

SEQ ID NO: 31575 - DNA, 833 bp, Triticum aestivum
  Clone ID: PAT_TA_31575
gcattcggtgcttggcagatgattcctggagcaaatgtatcacgcatactggcaagatcaggagtcgattgggtcctggtagactgtgaacatggcaacatagatgatggtgcaatgcacgacgctgtgccagccattgcagcactaggagtctcacctattgtgagattgcctgacatgcaaggatggatggtaaaacgcgcactcgatagcggtgcccatggtatcgttgttccgctgctgaggacacccgaagaggcgagacagcttgtccaatttgccaagtttccccctcaaggtcgacgaggtttcggatctcccattgctcccgaacgattccatcctgagcctactttcacgcagtatctgcaacaagcgaacaattccctcctgactatcgttcagatcgagaccaaggaggcacttgagtctattgatgacattgctgctgtaaatgggattgatgttctatttatcgggccatttgacctaggaaacgccattggccatcctataatcgaaggagtgatggcctctgaactgaaaggcgctattgccaagattcttgctgctagccagaaggcaggcaagaagacaggagtgtactgtacaggaggagaacaggcgaaagtctatgccgacatggggtttgatatgatgaacgtggtaacagactatacatcgttggccttggtggccaaagagcagctcagctttgctgatggaagctctgcaccggccagaggtaaggggtattaggaaagctcattcagcaattgggacttcagtccctttctgccttatccatttgagcctcaacttgttctactgtg

SEQ ID NO: 31576 - DNA, 1691 bp, Triticum aestivum
  unsure (1)..(1691): unsure at all n locations
  Clone ID: PAT_TA_31576
anaatgtgacgcagtgggggacgctgcgcgttcagctcnacaaagggatagaaaattctgcatgcccggcccacatggttcacgtatcaaagtcattgcagctacatcatcagtggccgcatttgtggttcttttgttaacggtggccactgtgctttatctttcactcaagacaagatataatgcagagatacatttgaaggttgaaatgttcctcaagacatatggcacatcgaaacccacaaggtacactttctctgaagttaagaagatggcaagacggtttaaggaaaaagtagggcagggaggatttgggagcgtatacaaaggtgagctgccaaatggagtgcccgtggcagtcaagatgctagagaactctacaggagagggagaagcattcatcaatgaagttgcaaccatcggacttatccatcatgccaatattgtccgcctcctgggattctgctctgaaggaatgaggcgggctcttatttatgaattcatgcctaatgagtcactggagaaaacatattctctgacgactctaatatttttcgcccgacaggcgccgcggatgtttcgaatcgtccccggccccttgcactgcccgccctgcccggataccggacgaaggatcatagcgtggtcgcggccgaggtacagttttggcatgctattgttggaaatggtgagtggacggaggaactcagacccaagtattgagaaccagggtgaggtatacctcccagagtggatctacgagaaagtaatcagtgggcatgaatgggagctaactttggaaatgacagcaaaagacaaagaaaagatgagacagctgaccattgtggccctgtggtgcatccaatggaacccgaagaatccgccttcaatgacaaaggtggtaaacatgttactatagggattgcacaagctgtggaatacctgcatcaaggttgcgtcctctgacattcatcactttgacatcaacgccacacaaaatcttgctcggaactacaactttaatccaaagataccaaactttgggcttgcaaagctctgttcaagggaccaaagcatcgttaccttgactgcagccagaggcactatgggatacatcgcaccagagctatactgtcggaactttggaggggtgtcttacaagtcagatgtgtacagttttggcatgctggcgttggaaatggtgagcggacggaggaacacagacccaagtgttgagagccagaatgaggtgtacctcccggagtggatttatgagaaaataaccactgagcaagaatgggagcttaatttggaaatgacagcagaagacaaagaaaagatgaggcagctgactattgtggcactgtggtgtattcaatggaacccaaagaatcggccttcaatgacgaaagttgtaaacatgctaacagggaggttgcagaacctgcagattccacctaagcccttcgtgtcttctgagaatcatcctatgctgcaaaacagggcgaacacatgaagacacattgtgtatttgtgtagtattattacatacacgtttgagggaattgaactcgcatctgcaataagctgtaatattaatactgtatcagtatcttaccatatattgtaatactattagtggattctgcaacggttgaataatgtgatgtgaacccgtgaggattgatctt

SEQ ID NO: 31577 - DNA, 1758 bp, Triticum aestivum
  Clone ID: PAT_TA_31577
ggacgaggaaggaaggaaggatggcgaagtggacaccacaacgcgtcgccgcgccggccgcccccgcgcccctcgccgccgccgcctccccggcccaattcggcttctcggccgcccggccggcgctcccgcggcaggccgtcgccctgccgcctctcgcccgcaggttccccggctcctccctcctcgcctccccctcgtggaggcgccatgccctcgccaccgaggtcgagggcgtcaacatcgccgaggacgtcacgcacgctcatcggcaagacgcccatggtgtatctcaacaagattgtcaagggctgtgtcgccaacgtcgccgccaagcttgagattatggagccctgctgtagtgtcaaggacaggataggaatcagtatgatttccgacgctgaagagaagggcttgataacacccggaaagagtgttttggtggaaggaaacaattggaaacacaagcatgggtcttgccttcattgcggcttccatggatatataagttgatacggacattgcctaaatctgtcaacatggacaggaatgagcatggagaggcttagttctactcaattgtgctggcagatgacgcaagatcaaagatgctgcaactagaatgagatacagagatcttgaataagacacccaattcatacatgcttgagctcatatacgcccctgccgtttgacaaccctgccaacccaaaactgcgtcagaaatctgggaggattcaaaagggaaggtagatatattcattggtggaatcggaacgggcggaacaatatctggtgctggtcgtttcctgaaggagaaaaatcccgatgtcgaaaaatcccgacgtcaaggttattggtgttgaacctactgaaagtaacatcctctctggtggtaaacctggcccacataagattcaaggcattggagcaggatttgttcctaggaatttggacagtgatgttctcaatgaagtaattgagatatcaagcgatgaggctgttgagacagcaaagaagttggctcttcaggaaggattgctggtcgggatctcatctggggcagccgcggccgctgccataaaggttgcccagagaccagagaacgcagggaagctgatagtggtggtgttcccgagcttcggcgagaggtacctgtcatcagtcctgttccagtccatcagagaagagtgcgagaagatggaggccgaagcgtgaggaccatttccacgcttggcgaagaagcttttctgctccgtcttcctctccgtcgaaccgaataagaataaggcggcatgggaaacgaacgaacggttgacctacgcccgtcgctcacattttgttgggattgattgatatgatgatgacacgcatggttgtttaaggaaacaattacatctctttttctggatgagcaacgctcactcactcgctcaaagcagaaatcaggcagcctgtgtacattgaaaggcgaaaatgggagtgtttccttggccttcggcccatccccaccctttgctggggagttgtttcccgctccggctgctccgccgggtcgaaggaaaacaatgcggcacctttttgggcggacgcacgccccaccccccccgctcaaacctggaatcctagccacccgcagtcaccggaatttgcaaggctttgggttgggggtttaaaaaaaaaaaaggatgagcaacgctcactcactcgctcaaagcagaaatcaggcagcctgtatacactgaaatttgaaatgct

SEQ ID NO: 31578 - DNA, 1300 bp, Triticum aestivum
  unsure (1)..(1300): unsure at all n locations
  Clone ID: PAT_TA_31578
gaccgatattntgttgaaaaagcacatacagaagatatcactggggttaagttttctactgatgggcagattcttctgcctggtcgcggccgtggtactctaaagatatgggatttgaggaaaatgaagactcctttgaaagtgttcgacggtctgcctaataactatgcggagacaaatgcttcatttagttcagacgagcaacttatttttacaggaacctctgttgagaaagatggcagaaatggaggcctactttgcttctttgatagaaggaaactagagcttgtatcaagggtgggaatttcaccacattacagcgtgataaggtcactctggcacccaaggattaatcaggtgttcgcaacagttggggacaagaaggaaggtgggactcatatcttgtatgatccttctgttagtcagaggggagctcttgtatgtgttggacgagcaccaaggaaaaaatctgttgatgattatgaggtgcaacctttaatacacaacccacatgcactgcctctattcagagatcaaccaagccgtaaacgccaaagagagaagatgatgaaagaccccctcaaatcgcacaaaccagaagctcctgttagtggtccagggtttggtggtaaaattggcacaacaaaaggcagcttgctgacacagtatctcatgaaggaaggtggtttaattaaggagacctggatggatgaagatccaagagaggcaattttggaatatgctgatgctgcgaagaatgacccgaagtttattgcgccagcatatgctcaaactcagccagaaaccgtcttcgcagagtctgattccgacggcgaagagaaaaaataacatatggattgaccgttaagtttcttgcatgagtcctgcaacatgtacttttactggggacaaactatagaatgtgaattagcaaccatcgggagctcggttttttctgaagatacccagggaaaagttgtcgcacaggaaaactgttacaataagacgggtccatcaagctcctttgtcaagtgaatgaagattaacaaaccagattcatgttacaacaggatgaggtttttgctgtaccttcagtttaccagccattatccatactctgcacgcttgatccagtgtatcgccattagcccacgagaaagctgtactgttttttccttccgtgttgttgtcgtctttgtgatgattgatgtgacgtgtagagtagacaaggaagaccgatttgcattttcaaaatgtcattctacctgatccgcgttttacagtgcgggttcgtatccag

SEQ ID NO: 31579 - DNA, 504 bp, Triticum aestivum
  unsure (1)..(504): unsure at all n locations
  Clone ID: PAT_TA_31579
attcgcgggccgacgggggcatgattcgcgggcacaagaaggccgtcttctgcctcgccgcggcgggagcgctcctcttcagcggctccgccgacaacaccatcatggtctggcggcgcgacgccggcgtgcactcctgcctctccgtgctctccggccacaccgagccgatcaggtgcctcgccgtcgtggagtacaacaaggaaaacgtcgcggccgccgccgcagagactggagacaacagcggcgtggggcggtggatcgtctacagcggcagcctggacaagtcgatcaaggtgtggcgcgtgaccgacgagcccgacggacacgctgctcgggggctccggcgaagggatcgcanatgttcgaccggtaccccgggcgaaccgttcggggcaaacaagctcgaaatcntttccgctaaaggtcgtcgaaaanttacgnccccaaacgggnacgcaaaaagttttttgaacatccttggacggggtnaaaccnaaaagg

SEQ ID NO: 31580 - DNA, 1013 bp, Triticum aestivum
  Clone ID: PAT_TA_31580
gcacgcgcagaaaccccagattcccaaattcctcctcgacctccatcccgtggaatccaaccaacgcggggaggcacccagcacgccggcggcgatgatccagctcctgttcgtggtgctcgtcgccgaggcggccgtggcgacggtgctgctcttcaagacgccgctgcggaagctcgccatgctgggcctcgaccgcctcaagcgcggccgccgggcgcccgtcgccgtcaagaccgtcgccggcgtcgtcatcacgctcctcgcctccacgctctacagcatggccgagatcagcgcccgcgccggggaccccgaggccggaggcggcgccgccctctctcccaccgaccaggtcctcttctcgcgccacctcctcgaggcgtccctcatgggttacactttgtttcttgctctagttattgaccgactccaccaatatatcagagaactacgtgggctaaagaagaatgtcgaggctgtatcgaagcagaacaaaacgttagaggaaggaaaacatggaagatctcaggagatagcgaaataccaggaagaggttgccactctgaacgaggagatgaagaaactgaagctgcaagtacaagagaagaccgaggaggtccatgttgctgaggacaaggcacttgctattcaaaagcaatctgaaagcttgctgcttgaatatgaccggctcctggaggataaccaacatctccgggagcagctgcagtcaattgatctcaggctctccaatccttcctgagagaagaatgtattgaagtagaacattatcctatcgtgaacctacttcgtgcttgaaattgtctgtttcacttttggaacgaagttgagtttactctttccgtaggatgttattacccagatgacatgctaatttagtaatgcctctcttatcagttttattgtcttacctaacaatatgttgaaacatgtatgctagtatgctactcccttgtcccaataaaaaaaccactaagtcagaggggacccgg

SEQ ID NO: 31581 - DNA, 1870 bp, Triticum aestivum
  Clone ID: PAT_TA_31581
ttttttttttatccttaatttcggattaatttaacattcagtgccgtggtgccatttatttccagttaatttaacaggcagtgctgtagtgtcaattaatggcaggaaaactgttccacagttctgttccctgtcttaggggattggttggcgccaatagcacttacaaatgacaacagctatggccatccttatattgtgaaagttctgcatggaacttaaactactgaactgccttggtgagctggaatcgtgtggtgctggtcgtgtctcaaaccaaatgtatcgggatattacatatcgctgcgtagatcagacagcacaggcattgggctcccggccaagaatgatttgatgagcgtaagatcatgcttgggaagatgaggaggaagcacctttcggtccagccataatgtccgaaagtttcaacctttctaccattgcgccgagccactatcctcgccatcatcatcataccaagcatgccacgggatcactgttggaagcttgagggcatcaatgctgtatctagttgatgttactggaattactgcatctgtgtctccactgaacatccatatacgaagcccatattgaataagttcatgatagatatgcagtacagatctttcacagtccttccagttggtgttaataacttcactgcaggtctcccacttgagatttgccaatgaccggattaacgtgaagtgccttctgcacctcatgcagattgaaatatacgattgaatgttgttcagtgcatggatcatattgctctcccatttttccaacagaccgaagccttttcaccactttgttccttgaggaggcaaaagatgaatgacaagtaggtgtgaagatgctatatgaatcaatgttcccagcttcagtgctagcaatgtcaagattcgtgtcgctctgtccacttccaggtgctgacaacgcgtgatcacagaaaatgttcagtagcttgtatgtttgatcagaaatcaagccagtggtccacatatattgaaatattccatagtggtcatggaaatcatcagtcagggcatttcccaccatataacccttgagattgattgttttgtctccagtggcctcgtggtgcctctttatggcttgagccaactgaggaacgtagtgtccagcataactctctccagttaaataaaattcacgctccttgtattgaggaaatcgttcaagccactttgttaggaacaccaacgaatccttggcagtcctctcatccccattgcttaaaatatcagcagaggtgtttgaatatgaataaccaacgccaaccggtgaatcaatgaacaagatatttgcaacttggttccaagagtaaggattcatatgcacaccctttccgtcggcattgacatggaaaggacccacttcttccccgagaccaaaagcgattgatgagcaaccaggccctccgttgagccagagcacgagcggcttggaggccgggtcgtgcgcggcctcgaagaaccagtagaagagcgcggcgccgcgctcctcgctgacggtgacgtagcccgcgtagtgcgcgaagctggcgttgaacgcctgccccggcacccgcggcacccggtcccgctcctgctccgcccgccaagactcccccttccccgtcgacgacgcggagacggccgcgacgaggacgaggagcagaacggccaggggcccggaggcgcccgacatcgcgggctggtggcgacggcggcggcggcgccggagtgagtgtagctgtgcaggctgtgggtctcgcgcgggcggcgacgtggggactggtggttggcttgggtcaagaaccaaagcagtggttaatagtggtgagtggtgtggtgcgggt

SEQ ID NO: 31582 - DNA, 611 bp, Triticum aestivum
  Clone ID: PAT_TA_31582
gatcggtctgcagatcgcatctggaaattattaacctggactgtgtccgggccggactgtgcacagacaaggcaacgaacagataatagtttccccgataatcacagataagctacggctagttttccagattatttaagtttcgagatattaatcacaacacacccattgtttctcgcccaacgatcgctgtgcgactccagaaggtattattgctcttctgacgatgatcatggtcaggcttggtgtggcttcttcttcttcttgctgatgtcctcggctatggactcggcgtcctcgcagctcccgtagaggcccctcctcaccatccccgcgcagtagaggccgttctcccccttccagtgctccgggaagctccgccgcgccatcccgtcctcgccgatcagcccatcgtcactcttgagccacttcttggttgtgctccggtagccggtggcgaagacgatggcatcgaacgggtgccgcttgccgtctgcaaactccacgacgttcccatgcacagccttcatcgccggcaggacctggatctcgccggtcttgatcttggcataggtgccgacgtcaacgacagggtaggctggggtgtggat

SEQ ID NO: 31583 - DNA, 775 bp, Triticum aestivum
  Clone ID: PAT_TA_31583
ttttttttttttttttttcataaaaattatatatacatgtacaagtcggccgctccagtccgccccgcacgttcacaccccgccatccccggccgcccgcctccgccactcgcgtcccccggtcccggcgaaaaagccacccccagctgcttcactcaacgtccgacaaagccacgccaaaccacgctgaacgcccgacgaagcgaagcccaactgctccaatcaacgtcagaagaatttacaccaaagcacttctggcctaagcttggacactatgcaaggcaacaatgaagtacaacacaatggagaatatgtgtccaacggagttccttaacaacatgaccttccaaggaattccaaaccatcagctaaaactgaaggtaggttagccggtgatgctcatcttgctgatattttttcctccgcgagctccctcaatgcctccgcagccccaacatccagagcctccggctacgataagtttgagcagcgtagcccacgttctccctggacatctccgtgaccgcgttgccagactcgacgaggtcgccgagatccacgcactcaccctgccacatgtgccaccaccaaggaagaaaaatcaggagaaaggaagcgacatgtggatctgggatagcatgaggattagtttcctgatgaggcacggcgacgtcgtccttcgccggcggcaaatcggaagaaatggcggatgtgcaggaggagcctggtgggggatcgtacggggggaaggagagagagttcctcgtgccgaatt

SEQ ID NO: 31584 - DNA, 1218 bp, Triticum aestivum
  unsure (1)..(1218): unsure at all n locations
  Clone ID: PAT_TA_31584
ctcgtgccgcgagttttttttttttttttttagcataaatttttattgccatcttggtccacctcaacatgtagatgttcaggcaactccagtttgaaaaccatgtacaagttctcaagagtacaggcaagcatgttcacacacacacaattatgttatcattcagactatcaataaaagcttatttgtcagtcatccacaagcttggtacttgggactttatttcttaaggaatacacattctttttatcaggccaacaatcggtctcccttgtataatgaactgggatagaagtttgttgaagtatggcaatagtttacagcagcctatatcatcggagctgctcttcagctatcaagcaactttgtgtgctcgacgatgagaaccagacgcttcatccttctttgctccttctggtctcctagcccaggctggggcttggtccggtccataccggtaatcatagaagagttcggcactagcttcaatatgctcccttgcatagataccaacccgatggtcaccggccaccatcatcacctttgcatagcagttggggctggaggagtgatttgcgaacttcaatttatcccccttccgatatgcatccaatacaaactgatcatttaaatcaaagaggaatgaagagtttgcccggtcataaattttgccgcgtttgtctgcttctttgtgagaaatcaattcaccagtgtactctccaagatagtcattcttatgcacagggttcttaatgaacgcaccccatcctgcaacgtccgattttccaagcaaaatcctttgttgttgttttaggaggagcttcatgtttccgcacntggtaaccatcacctctttctggtggctcgcctagtgaaccatctccacagctcacccagcagtttctgcaaacatccggatcacattcccgactggcagcaaaacatgggcattgcctgcttctgcactgactttttgcacaatgacagcctctaaatctgtttttgcagcttttgcaacacccacagtatttctcacagcatgtcccattttccacacaggggcaatttttgttgcacatttcctggcacccacacggtgtatactgtctgtcacattgcttcccatcaccaacttttttcctaatggctggatgccctgcagccttcgaaggatatttgtgcctccgagttctgccccttcgaccggacgcgtgggta

SEQ ID NO: 31585 - DNA, 992 bp, Triticum aestivum
  Clone ID: PAT_TA_31585
cgtcggagtccccgttgtccttcttctcagccgccgccgaagccgcttcttccgcagctgccgccgccttcttgcggctcagagccgagttcttgccggggccgcgggtcttcttcgtccccgtaccccacgccttgcccttggccgccgcggccacggcggccttcttctcgccgtcgctctcagcctcctcctcaacgtcccgcttctccgcggcctcctccttcctagcgacggccgccgccgcggcagccttggcgatggagctcctcttgcggcagaagatgagcggcttggcagctttctggatgagcggcccgacgatgtcggcctcggccctccgagggtccagccccaccgccggcgccggtggggggttggcgccgctcggcggctcccgcttggtcggggactcgcggagcgaggcggagacctgcgcggagacgaggcggagggcgttgagcgcggcggcggcgtggtcgggcgcgtggcgcgggaggtagacggcggcgttggcgcagagcagcagcaggtcgcggtagagctcggcgctgctggcgtagcccgccgcgccgtccagcttccggcgcatggcctccaggtccacgtgccgcctgatcgtgccccggtacgactcgctctcctggctctcctgcagctgctcgaacacggggccgaacctggcggcgaccctgtcgagcagggcggccagcggctcgtcggcctcctcctcggcgctcgccttccgccgccggcactgcaggctcaccgcgctctccttggactcgcccgacagctcctccttggccgcctcctccgccttggcggcggcgccggggcgcttcagatctgtggagttggactccctgcacgaccgcccgggctcctcgctggacacgttctcgtcgccggtcacgccctccggcttcgcctcgccgctcgacaggctccgctcccgctcctccttcatcagctcggacgcgtgggtcgac

SEQ ID NO: 31586 - DNA, 715 bp, Triticum aestivum
  Clone ID: PAT_TA_31586
gacgaacgaaatgtataccacaatgtgcagttataacgaaatgtaaaccacaatgtgcagttatactttttaagtcaactcacagaactcacagtcaaccatttagtcaactcacaggactcacgttcatatggacaccggatcactaaactcctaagatccgcaggacaacagtttgtaacagactcaaccttttagtttgacaactctatgcagacaaccttcatcttcatggaactgtatgatttctataaaccaaagaatacactacctgttgctggcaggccctcctctgctgaggcggccaatccagatggagccggggactgaagcggcggtggttgttgaagctgaagtggtggctgttcaagcgctatagcggtctcaggtgacttgggacggtccggaacgggggcggcgacatggatagcgcccatctcgggcatatcggcagaaattacagcgggcatggtaacatcctcgctggagggaccagctggatcagccgtcttctttgccctcttggccctctcggccttcttcgccccagacttcttggcccgacgtttcggctttggtgctccatcggcagtatcaccttcgcccagcatgctcttcctgtgtgcagagcagaaatccacaccccactttgcgctggcgctgcatccttcaacttgcagcgtctgccaccaccatgcttgatgcagttatcact

SEQ ID NO: 31587 - DNA, 967 bp, Triticum aestivum
  Clone ID: PAT_TA_31587
acatgcaacacttattctaggatacaagaggcactcccgagctcaatgcaccctccggattaggacacttttcggcaatactacaagacaagacttgaacacgctccctcccttgttaaaagactaactattctacacccatgaaactaaaccataggagagaatacagaaacatgatacaagatttacaggactactctgctgcgacaactatatacaggcggtaggcacacaacaagtgcaaagaattagttggctggccggccatcaacatacggccctaaacctctactaattacacaagctaatggaaccagccgatgcccagcccagagaagacggggcagcggcgctctagcactattccaacaaggctaacactactgtggtggcatctgccctctccgccgatgttgtgccatctttgcatgggccatcctttcatcagccttcttcctatcagcatacatcgggagggaaattatctcagtgatctcttctagaagcttgtcttcggttatattgtctgtgatgctcctcattaccttgcgatatgtgttgatatcattaggagtcgatttatcgaatctaacgcgcatgcagacccaacactgttgttccttattccaagagcactcaacaatcctcccagagatagatgatggatcttctccatttggaaataccatccgagaaccatccatgagtttctttttgcctctctcgcaaagaaaaacgagctggcgattatcattgccaacctcaaacaaaaagtcaactgaattcacggccggctttcagggtatttccacttaagaagaccttcatgggtgcgagttacataaggatcatcccagccctgaaatatcaggccatcagcatcatggcaaagtgatgggataaactccttcagtaccctttttgctgtatgcagaagccagaaatcctttctccgggccgaaaatag

SEQ ID NO: 31588 - DNA, 764 bp, Triticum aestivum
  Clone ID: PAT_TA_31588
gaccgacggggaaccgctacatcgcgccgccgaacctggcggcgaagctgatcacgaagcggctgtacgcggaggaggcggagtggaagaactgggtgtggcactcggagggggacctgatgctcaacgacgccgtcttcgccgacagcggcggccccaaccagaggaagttcgagaaggatgacctcatcccgcccaagccgggatcgtacgtcaccaggctcacgcgcttcgccggctgcttgccgtgcaagcccggcaagccctgctaaaccttggtggccccgccggccggccggagccgatcccttccgaatcttcaattctatagctttgttcaattcttttactcaaagattcgtgtatgtattactatgacatttgagtagtctacggggttcagatcagagggccctgtaggttgttcttgtacgtgcattcgccgtgtcagcggccaggcgacgcggaggggatgaagggcagagagagaacatgtttctgtctaggtcatcctgcttacttaggggaggtggagggcccgacagaaggcatgcaaatattgaagagggccgagactaatttgttaactgttattttaaggtttattgtctgtttatttctacaattttatttcaactttctatacatgcatacatgcaaaatacgcaagtgaacatgtgtgcaattttccccgcgccgatgaaaacatttttcgaggtcatccctgcttagcttaggggaggtggagggcccgacagaaggca

SEQ ID NO: 31589 - DNA, 1524 bp, Triticum aestivum
  unsure (1)..(1524): unsure at all n locations
  Clone ID: PAT_TA_31589
tcaataatcacagtgagtgtctggaaaatgccttggggtatacacttccctctaatctgtaatcagttgactgcactcaggcaaaatntaccaatatcgttcagaaataatccagacctttaacaaaaccngccagtggaaaaagaggggantttcttttgttccgatagtgcataaagtgttatctcgaccgacacctggaaaggtgtctattcttaacgatggatccattgttgttgaagttggaggcattgagttaggccaggggctttggacaaaagtgaagcagatggcagcatttggtcttggacagttgtgggctgatcgaagccaagacctgttggaaagagtaagagttattcaagcagacacgttaagtgtggtacagggagggtggaccacagggagtaccacatcagaatgcagctgtgaagcagttcgacttgcctgcaatatcatggttgacaggctgaaatcactcaaggagcaattgcaagaaaagcatggcaaagtttcatgggatggactaatttcacaggcaaaaatggctggtgtggatttgtcagcaagagaatattacattcctggggcttctggttcatacctaaactacggagctgctgctagtgaggcagagattgatcttctcacgggagcaactacagttttgcgcagtgatcttatatatgactgtggccagagcttaaatcctgctgtggacatggggcaggtggaaggggcctttgttcagggaattggttatttcatgagtgaggaatatgtgaccaatacggatgggctggttgtctcggacgggacttggacatacaagatcccaaccgtggacaccatccctaaacagtttaatgttgagctgcgcaacagtggattccacaagaagagagtgctgtcttcaaaagcatctggggagccgcctttgctccttgcagcttcagttcactgcgcaacaagggatgcaattgccgcagcaaggaaggaactccactgttgtgggtctggaccgtcttcaccttcgttctttgagttggaagttccggcaatcatgcctgtggtgaaggagctgtgtggcttggacaatgtggagaagtatttggaaactctagtgggttccaaataaatacagacgaatttcacatttggcaaagtaaattataatgatagcattataaggtatacttcttgcatagtactctgggcatactagaaggtactgtgtgatccacttgttaacgcatgcaccattcgactataacagaattttgtttggttgtgccacatttgttcgataatttcattcagggacggacttacaggacatagttcttaggtaacattttgtactagactgatggatggatacaggtatttgtgactcaaataggcaaaacgatgagagtaaacaaatggaagatgtatacttggagcatgatgagacatggtcatgggacctccctatgtgtctcgtcgacgcggccgcgtagtttgaaaaagtttttttttcag

SEQ ID NO: 31590 - DNA, 614 bp, Triticum aestivum
  Clone ID: PAT_TA_31590
aaattcctcttttttatttcacctcacaccaatccttaccgtcctttgccctcgcgtgctctcctacaacccaatccgggctgctggtccttggatggactcgggtctcgactagctataggccctgctcggcgcggagggcgcgcgacactcactcctagggttcttgccccggggcttctccaatggtgctgcggcgcttcgcctggcccttcggcggccagcgcgcctccttctgtggcagcttcaccggctggagggagtgccccatggggctcgtcgggactgagttccaggtggtgttcgatctcccaccagggctttatcagtaccgctttttggtggatggtgtctggagatgtgatgacacaaaacctattgtacgtgatgaatatggcctgatcagcaatgaaatgcttgtcacacttgtggagaataatacacacccggctgtacagctagagccacctcccattagaagaatgaatttggatgagggtactatcttgacaacaatgccaccggaaccaccatctcgaaactcaggcatgcagattgcagttttccgccatcgggtctctgaaatactattacataataccatatatgatggt

SEQ ID NO: 31591 - DNA, 1791 bp, Triticum aestivum
  Clone ID: PAT_TA_31591
gtctccccccccttcctcggtcgcaagttcgccagctctacgcctccctccctccctccctctccctcctcgcaccagagttcctctcttcatcccacctcgcactactccttaccggcttttgccgtcgcgcgacctgctacaaccccagctgggctgctggtccttgggtggcctgctccgtggcttctcgacaggtgctgctcggcgccgagcgggcgcgctacgccctgctcgtcttcttggcccggggcttctccaatggtgcaccgccgcttctcctggcccttcggcggccagcgcgcctccttctgtggcagcttcaccggctggagggagtgccccatggggctcgttgggactgagttccaggtggtgttcgatctcccaccagggctttatcagatagcgattttggatgctcggcttcctgtcaaacaagcatttaatattatgcatgatgagggccttgctttggttcctctttgggatgatggccaagaaaccgtaacaggcatgctaactgcttctgattttgtattaattttgagaaagttgcagaggaacattcgagttctgggccatgaagagcttgaaatgcattcagattctgcttggaaagaagcaaaactgcagtattatggaggggtctgatgtcgcaggcatgcaaagaaggccattagttcatgttaaggattcggataatttaagggatgtggcactgactataatacaaaatgaaatatcttcagtccctatctttaagtcctcgacggatatatcagggataccgttacttaatcttgcaactcttccagggattttgaaatttctttgctcaaagctccaagaacaaccagaaggttatcccattttgcgaaatcagatttccagtattcctattggtacatggtcgcagcatactggaagggcaagtactagacagcttagaacatcgggactgagtgctcctctaattacttgcctggattttcttctggaagatagaataagctcaattcctatagttgatgataatggatcccttcttgatgtctactcactcagtgatatcatggctctggcggagaatgatgtttacgcttgcattgaacttgagcaattgaccgtggagaatgctttggagctgcaatatcaggtgaatgggcggagacagtgtcatacctgtttgagcacgagtacgttgctcgaggtgttggatcaattgtctgttccaggggtgcggcggcttgtcgttattgaaccgatgactagatttgtgcaaggaattatctcattgagagacgcaataacatttctccttggataacatttgtgtagccatttcatacatgaaagcctgttgtatttgattgggacaaaataaaaatgttgttttggcagatgcaggagttgttcatatcttccattgtgttttcactctgaaacttacaatatcatgaattatgcacaaccgagcctttttggcaagaacagaccatgccttggaagcatgaagacaggaccgactggatcagtaccgccgcaaccttttcctgctttgctgatcggaatgcttcaaggtgctgttgaggcttggctactgtaaagaagggggaacaagctcagattgagatttaagagctacagaatcattttgaagatttgatggaaatcatggggcagcttgcattgttcagtaatgacctatatgttctcatgacatggcatgatttctactgatgagtttcagacaaagccctggcaactcaagaaactggatatagattc

SEQ ID NO: 31592 - DNA, 847 bp, Triticum aestivum
  unsure (1)..(847): unsure at all n locations
  Clone ID: PAT_TA_31592
gacagtccaagatgccgncattattgatcccgcaaaccctccagaggtcgcaccgattctgaaggatgccattcaagcgggcaagatcaacttgacagctattgtaaacacccaccaccattgggaccatgctggaggcaacaagaagctgcttgccgaactcggtacccccaagttggatatcatcggcggcaaagactgcgagggcgtgaccaagactcctggtcacggtgagaccttcaagctgggtgacatcaccttcaaaggtgtgcacacgccgtgccacactcaagacagcatctgcttctttgcgcaagacggaaacgacaaggctgttttcaccggcgacactctgttcatcggaggatgtggacgattcttcgagggtgatgccaaggagatgcacaaggctctgaacgaacgacttgcagcgttgcccgatgacaccgttgtttatcctggacacgagtacaccaaggccaacgttcagttcgccgcatctatttctaaaaaagaggctggccactgcctgcactcatttgctgagaacaacaaggttaccactggcaagttcaccattggagatgagaaggaacacaatgtgtttatgagagtcgaggaccctgagattcaaaagcagacgggcgaaaccgagcccgtggcagttatggccaagttgcgtgagatgaagaacaacttcaagtaaagcacctgcgccgaaaatatgagcgatggggattactcggggcaaaaacaggcacgaagcattgggcgcgttgtagagcgaatattctgagtgaatgatatcggattgaggttgatattatataaacattattttctattg

SEQ ID NO: 31593 - DNA, 584 bp, Triticum aestivum
  Clone ID: PAT_TA_31593
agcaacgcggagctgcgacggacggtcggcgtcgcagcagtggtgacgaagaggccgaagccgacgacgaggatgcgtcgtctcgcgtggtcgctccggggacgggtcaatgtagagcccggccgaagagatggcggcgacgtcgtcgcggagatgacgaagatggcgaggccaacgacgaggacgtgccgctcctcgcggccactccgggggcgtgtcgatgtcgagcccccgaccgctgctggagagacggcgcgacgccacggcggtgaagacaaaaaatggtcccgcccggactgcgaaaccagcagcagaatggtagcatagtaccgccccacgatggacgccaaatgtcgggagttgggtgcggcatatgccaacggatggcttatcatggtgggcaagactgctgccggaatatccagggacgggtatgcgagtagcgcgcgctagtttacccaggttcggggctctccggaaagataacacccctactcctgcatgtttgagtatatgtagtatatctgatacagagtgctcctggagctgtatctgaaagtagtgccacaggcagctggtttctt

SEQ ID NO: 31594 - DNA, 850 bp, Triticum aestivum
  unsure (1)..(850): unsure at all n locations
  Clone ID: PAT_TA_31594
tgcggcggctggcagggcggccgtggaggagacggggacggcgacggcgacggaggtgaccgcggcgccaccgacgcgcactaccggcggatgatcagggccaacccgggcaactcgttgccgctggggaactacgccaggttcctcaaggaggtgcagggggacgcggcgagggcgcaggagtactacgagcgcgccatcgtcgccaaccccggcgacggcgacgccctggcgatgtacgcgggcctcgtctgggagaccagccgcgacgccgagcgcgccgacgcttactacaaccgcgccgtccaggccgcgcccgacgactgctatgtcctgggatcctacgccgggttcctgtggggcgccgagggcgaagaccgcctcaacgacgggggggctccgccaggcccaccgtcgttctatgggggcgtcttacactcctacatcagctgcgtaatcgttaacgaaagaaccaatctcaactgccgaatgaacaaacggcatccgaactctgcaaggaagcgagagatgccgccatgcggtcgccggcccgggcgcggcagaccgtagtagagtgaatgaaccaagtccagcatacctgtgtgtaaattaaccatgtaaaggctaaataagctcgagggcaaaaagaatctggaaaaatctaggataattttctagtggaggcaaatgcagcattgctgtgctaatatgtggcctaagaaggttctgctgtgcttgtacatgtagaatgttcatgataccatgtctcagtcgaccatgctacctcttgtgccattccagtaattcccaaaaaaaaaaaaaaaaaaaaaaaanctcgngnctagttcnc

SEQ ID NO: 31595 - DNA, 741 bp, Triticum aestivum
  Clone ID: PAT_TA_31595
aggatcagccctcccttccctggcctcagtagttagccactagccactgaacactaccaggagggatcagaaggctaccatgaggcaaggagggggcggaggcgacggggtgagccccggcaatgtcccggtgtgctactacggcgcgggcgggcgagtctcggccaccctggagcggcgggtgcgcgccgccgaggtgctcctgcggtgcgcggcgtgcggcctggccgtgctcgccgccgccctcctcggcgccgaccgccagtcccgcaccttcttctccatccagaaggtcgcccggtacaccgacatgcagtccctcgtgatcttggtgatagcaagtggaatggtcgcctgttacagcctgctgcagggcgcgaggtgcctggtgagtattatcaggggtggcatccttctcaacaggcccttggcatgggcgatcttctcctgtgatcaggtgatggcgtacgtgataatcggggcggtggcggtggccatggaggcggcgctgctggggaagaccgggcaggtggagttccagtggatgaagacgtgcgagctgtaccagcggttctgcacgcaggcggggggcggcgttgcgtgcgccgtcgccgccagcgccaccatgccaggggtcgcccgggtctcccgcttcaacctattgcgcctataccggcacagcaggggcagcagcaagagaacccaaagccctagctgagagcgtgcgtgcatgcatgcatg

SEQ ID NO: 31596 - DNA, 1254 bp, Triticum aestivum
  Clone ID: PAT_TA_31596
gccggcccccttgaaaaaaaaaacgcgtccggcttagcggaaagtaatcgagcaaactcacacacttccttccttcctgttgtggctcctgtacatgcgcgctagcctcgcctcgtacgcgcaagacctcgccatgcctgccttggacgtcatgccggagaaggcccaccagccggccatgtcgccgtcgcaccacggccacgggtgggacgccagcggcgcccccacccccatgcacaagaggctggacggcaaggtggccattgtcaccggcggcgcgcggggcatcggggaggccatcgtcaggctcttcgtcaagcacggcgccaaggtggtcatcgcggacatcgacgacgccgccggcgaggcgctggccgcctcgctcggcccgcacgtcgccttcgtgcgctgcgacgtgtccgtggaggaggacgtggagcgcgccgtcgaccgcgccgtgtcgcgctacggccgcctcgacgtcttctgcaacaacgccggggtgctgggccgccagaccagcgccgccaagagcatcctcacgttcgacgccggcgagttcgaccgcgtgctccgcgtcaacgcgctgggcaccgcgctcggcatgaagcacgccgggcgcgccatgatggcccgccgctacggcagcatcgtctccatcgccagcgtcgccggcgtgctcggcggcctcggcccgcacgcatacaccgcctccaagcacgccatcgtggggctcaccaagaacgccgcctgcgagctgggcgcgcacggcatccgcgtcaactgcgtctcgcccttcggacgcgtgctcatcaacgcgtggcgccagggccacgacgcgtccgccgccgacgacgccgacgccgacatcggcctcgaggtggccgtgccgagcgaccaggaggtggagaagatggaggaggtggtgaggagcctcgccacgctcaaggggtccaccctgaggcccagggacatcgccgaggcggtgctcttcctggccagcgacgactccagatacgtgtccggccacaacctcgtggtggacggcggcgtcaccacctcaagaaacttgatcgggctgtgaaaatcgcatgaccgacctcgcatcaaggcacctacgtagatcagtaggaggaacaaggacgattgtttagtctgcaataactgtacgcaagttctttggttggttcgttcggttaattggttgattgattcagtgtgttattcgtccgagcattgttgctttcgtgttgc

SEQ ID NO: 31597 - DNA, 653 bp, Triticum aestivum
  Clone ID: PAT_TA_31597
gtcgacccacgcgtccgaagagaacaccagaaaaactatcctcttaccgtggttccttctagaggccccccgccgccgtggaaacccaaaaggggatagagttcgccgaggccgctgtagcgggtggcggcgccaccgcgtgtgctccaccgtaaagctactcacggatggtcgcagaaggaatggagttcctactggatgcggttgacaggttcccggtgcgggaggagtttgctgacagtcttgacaacccagatccggtcccgctcgcgtaccttctggagaagggcggtgcaaatccggagtttggacggggagaagaccactctgggattgctgatatcctgtgcgacggtgtgctaactgacgcccaagggggtgcccatcaacgacgtgttgagtctccgacgaggtcgggccaatcgacgggcagggttaatccagaggccccaggctggaccaaaaggtgagtctctggaagtgcgccattcagtccatttctctgctttcagctgttaggccagtaagatgttagacagtgatacgacgttggtataactctgctatattttacataattagtaaactataatttggtacacctatcgtactggaactgataagtaagcgaggaaatgaatgtttcatgagta

SEQ ID NO: 31598 - DNA, 540 bp, Triticum aestivum
  Clone ID: PAT_TA_31598
atccctttgaggagagcaccttccaaggaccccaagtcaccaaggcccagtatgaaagaatcttatccttcgttgatgttggtaagaaagaaggtgccaaactggctcttggtggtcaaccattcaaggttggcgacggaaagggttactttgtcgaaccaacagtctttacagacgtcacacccaagatgcgtgttttccaagaagaagtctttggcccatttgttgttgttaccaagttctcttctgaagacgaggctatccacttggctaatgatacacaatatggccttggaagtgcgcttttcacaacaaatctgacaagggcgcatcaagttgccaagaggatcgaggcaggtatggtctgggtcaactcgagcaatgacagtgactggagaattccctttggcggagtaaagcagagtggtattggtcgggaattgggagaagctggtcttgcggcttattccaacatcaaggctgtgcatgtcaacattgcggcaaagctatagatataaatgcgagagattggaatcgtag

SEQ ID NO: 31599 - DNA, 580 bp, Triticum aestivum
  Clone ID: PAT_TA_31599
atatgagataaagaagttcaccattggttgatttatttttacattaaccacccaactttttaaatttgacacgagttacattatcaatcactagggggataatctcactagttggttcatcaagccactcccaagcatatgagcaacaacattacattatctaaaacaatgttggaaaacagctacacaaactaaattatagcagtcgtcaaagatggctgcaggaatgcctgctgatcttccaacttcttgcatgatgctcatgaaatctgagttgttcgaattggttacaatacaatcctgtttcagccgatggactgtgccaactgtagaccgagtttcagaacggtagcttccgcagataagacgtccacgtggagatcaatcttccagtttcaggccgcaacgaaaattccattggcgtcgcgaattacagcagcagacgcgcccgcaagaaggtctacatcagaagcagcatcgacattcaacttcacctggcctcgtggtggtctgatccagccaccatttcttttcttcaccgtgggtgtctgctgctgcagtttaatttgcagtaagagca

SEQ ID NO: 31600 - DNA, 561 bp, Triticum aestivum
  Clone ID: PAT_TA_31600
ggtcggggggtgattaattaggcatagggggagctaggagagtccaaatgtaggtgccaatgctggtcttggtgccggtgcaaatggaaatggtggtgctggtcttggtgtcggtgcacataaatctattggtgctaatgttggtgttggtgcgaatggaggcgctggtgctggtgttggtgctggccttggagcaaacgtaggtattggagcaaatgtaggtgccaatgctggtcttggtggcggtgctggtgctggtgctggtgctggtgcgaatgggggcgctaacattggagctggcattggagcaaatgtaggtgccaatgccggtcttggtgtcggtgcacataaaggtattggtgctggtgctggtcttggagcaaatgtacgtattggagcaaatgtaggtgccaatgatggtcttggtggcggtgcaaacggtggtgctggtgttggtgcgaatggaggcgctaacgttggatttggcattggagcaaatgtaggtgccaatgccggtcttggtgtcggtgcacataaaggtattggtgttggtggtgtttt

SEQ ID NO: 31601 - DNA, 451 bp, Triticum aestivum
  Clone ID: PAT_TA_31601
cccacgcgtccgcccatgcgtccgcccacgtcgtaaaaagaggagaggtaaatcacacagagaaccatcagcaatggcgaagatttctagtagcaccgttgttctcctggtgtttctcgtctcgtcgtggggggcattgccggtgctgtcccgtggaggcctggaggatggaggaggcgggccaaacggtggtatcggtgctaatgttgggcttcaaaagtctgtcggtgctaatattggtgttggtgcgaatggaggcgctggtgctggtgctggtgctggcattggagcaaatgtaggtgttggagcaaatgtaggtgccaatgctggtcttggtgccggtgcaaatggaaatggtggtgctggtcttggtgttcgtgcacataaatctattggtgccaaatgttggtgttggtgcaaatggaggcgctggtgctggtgctggtgctgg

SEQ ID NO: 31602 - DNA, 2304 bp, Triticum aestivum
  unsure (1)..(2304): unsure at all n locations
  Clone ID: PAT_TA_31602
gcacaaattccaagaatgcttagtggacccttgttttctcgtcctgctgagggcgacgggtgggaccctcctcccgcgtgctccagacacatcgggcaagcgggggcctagggcgacaccatgactggccggggggggaaataacctccttctgtcctcaaggcgcagcaccaacaagagagtccgggcaagcttgcgatgggctggaaggagggctggtcagggaatggagagggcgggcccggtcactgtctcgaggaaacccgctcccattataagctcttcgctgccggcgataaaggtaccgtgcgggcaggggcggcggccccggcggcggcggctctgaagtcacggaccaatggctcatggtgttcaaagtatggaagatgagcgatcgtggaggagaggtcgccgtgcacgtccatctttcctaggagtgccccagcacccgaagggaggctgacctacgatatgttggaaagacagaagttgttgatgacaaaggagttaaataagataggcaagaacttcaggctcgagttgcaagtaactacaatctgttacttgaatctgatcggctgccacgatcgcttctgccggatcatcagatgcaagctcgtgcccatcttcgtgacactgagccttttgagcatgcctttggaccaaagggcaagcgtaaacgtccataactatccagtcgtgattatgagtctcggagctagaaagctgatgattgccaaggtgcgtatgagggtaaaaatgcttgtctaggtttgggtgaacgtaagggtatgggtgcttgtgctgggcgttgtggacatgtaattataggagcaaatatagatgccaatgaaggttttggtggcggtccttaaggaagtgctggtactcgtccgaatggagtcgctaaagggtgagtgggcgttggaggatatattggggccaagggaggtctagcagtcggttaaaagcaatgtcgtggtgttctcccaagggacggacaccgtagtatgcttaataaatataagtgatctaatacttgtatggacaacaaacgtgaggatgagtaaatcgatccagggacaatacctaaatatcattccatttaagcataaacaagtaatttcaagaaactatctcgtctatctatagtaaggcacatgacctgtttaaagtatgacaagatagtcatattttttctattttttggatatcccaacgttgggaattcctcagttatcaatacattacgctccaagcctgtttgcaaggtagctcccattcctggggagactaaggtgtggcaatacatcaccatgactaaaagaatcttcttaattgattgccctggggttgtgtaccaaaacaatgatacagagactgatgtagttcttaagggtgtggtacgggtgacaaatttggatgatgcttctgagcacattggggaagttctaaggcgtgtaaagaaggagcatctacaaagagcttacaaaatacaagactgggctgatgataatgattttctcgtccagctgagcaagatgagtggaaagctactcaagggtggggaacctgatctgacaacagcagccaagatggtacttcatgactggcagaggggcaagatacccttttttgtgcctccgccgcagcagaatgaagatggtccttctaagattactgaacctgtggagggatctggtgaggaagtggtcagcagtgaccgggctgctgctgccatgaaagccattgcgggaattatctcttcgcagcaaactatgaatgtcccctgccagaaggaacttggcagaaatggcgaagacagtgaactcccggagcaatcagaccttttggtaaaagagtgaaagggtagcaatcctgcatgagaagatccctggtatttttgcccgcaaacatcttcatgagtgccagcgaagttattcactgtttgccatgaaggacacagttacgcaggggggacaatcctttgatatgtatcgttcatgttatctgtagctttctaatggattaggtagagcgttgttggcatctacatcaaaacttgtcttttgttcacctcaagttctagttggatttcacaccctgttttatacatagataaataccatttggttcaaaatgcaacttctgcaagtatgcctttctaatttttgttttccacttgatgttgacacacgtggaactgcgttacccttaccttatgatactatatcatttctcaaattggcggagaaatgtagggagagatnnnnnnnnnnnnnnnnnnnnnnnnnnnnnnnnnnn

SEQ ID NO: 31603 - DNA, 1793 bp, Triticum aestivum
  Clone ID: PAT_TA_31603
gtgttttttttttgagcgcccaaacctgggtgcctttttcattttaggctttgtatagataatagttagcccacgaatgtcacatagtagctagtcgaagaaaggcgcgagaaacaagcagcaacctcgacacttccgcagtatctgttgcgttatgatacagcactccacactgtgggccgacccgaaatcccattttcattcagactttgtatagataatagttagcccagaatgtcacatagtagtagtgaagaaaggcgcgagaaacaagcagcaacctcgacacttccacagcatctgttgcgttatgatacagcacatggacggcactccacacgacggactcgagatcccaactcccaggcggctcttggtgctctttgaaaggcgcatcaccgtacaaggctttggtcggtcactccccgtagaaggccttctcgaagcactgcaggtactctggctcgagcgcgaacagcacggacacgccgtcgtccttgtcgggcgcctgcgtgacgtaggccgtgccgctgccgaacatctgcgccggcgcgacgaacttggggcagccccagccgaagtcggcgtcgtggatgggcatgcccagccagctcaccacccacaggtccgtctccggcatgaactgcccgcgcgccgcctggctgcccttctccgactccacctccaggtagtcgatgacggagcgcacgaaggcgtcgtccacccgcgcccaccgcgcgcttgatccgctccgccacgaaccccagcggctgcgacagcacgtcccccacgcgcaccgtcaccaggtcccgcacgatggcgttgccgaagtagttggccggcagcggcgggcgcaggcgctgccggatgttggccggcacgcgcagccgcgactcggcgtcgggggccagcccgcgggccacgcacatggcgcgccacaggtgcgcggtcagcgcgcagtaggtggacacgccgggcgcgcagctggacttgatgccggcgaggagcttgggggacacggcgtagacgcgggtgacgaaggggcggggcaggccgttgaggttgctcggggagtagaccgggtgctcgaaggtggcgtgcgggggggagcgcgcgcgcagcaccgtgcggtcgtgcaccggcggggtcgggtgcacggacgcggcgtccagcccgcgcgccagggtcgtccacgtccggatgaactggatcgcgcccgcgccgtccatggtcacgtggtgcatgcccgtgcccacggccacgccgccgcacttgaggaacgtcacctggaccatggcgaggaggcagggcgggtcgccggaggcggcgaaggggacgagcaggcggcgcgcctccggggagggctcgaagtcccggaacatctcgtcgccggtgaagtcggcccgcgcgacgacgaacagcgcgccctcgccgttgcagtcgatctcgagccggccctcggggcccgtcgccatccgccccgccagcgggtagaagggcaccagcgccctcgccagcgcctcccgcagcctctccggcgcgaagaacacctacctctcccccttctcgccgtcgccgtcgccggcggggggcgccgggtagtagtagacgagcggcgtgtgcgtcttgggcacggcgaggtcgaggttggagagccagagcgtgtgccgcggcgtcggctcgctgggcgtcaccagcgtcgtgtccaccacctccaccttcatctcgatctcgcgtcgcgcgctgcctgcccggtccctttcgcttgcttgcttgtgcgctgggcttggccg

SEQ ID NO: 31604 - DNA, 2001 bp, Triticum aestivum
  Clone ID: PAT_TA_31604
cccgatcctccgccgccgtgatcccaaccatccgccgccgctccctgccccatccaccgccgctccctgccccatccaccgccgctgctcaccgcattcaacctctcttgcatcccagcacctccgtgccaccgtaccatctctctcctcgctcctctctcttggatcacatgcggcgacggatgcttccggtcgtgtggcccagtgcagtccggttttctaacaaggacttggcggtctgtgtccctttcattgttcttcctccagctccaattcctcctctcccaccgatcgtgatgtcggggacaggcgctctgctctcctgcggcagcgatgcgtatggtgacaacaatgttcttttgtgcccctccactcttcggaccgctgatgcacggaagtacgcggagaaaatctcgctccgctcagcaaattcgtccatgtcctaagtggctgctcggcaagatcttttggcataattcagccttgctcccattgagctcctgaggatgtgatctgtaatgcggcttgaaagctgcttgacatagcgcatgtatttgatagttttctcaatcagatttatcccttcaaccacagctatggctaccacactacttcattgagatttctttcctacaggacatggatttataatcttttttcacacaagtacggtcatgcttcttatatttactttcagtcccgctctcatttgtgattttctatatgctgtcttactaaactgtgtgtgctaaaccaaccatatagtatatgcatgcctcttctatgcgtttgcccacttcgcttactcttcaaaatatgcggccgttttactgtttttgccgtgaacttggggagcttgggacagagtatggtgtcaataagcagtatataccaggacaatatttttgtgatattgtatatactaacttagtgataatggagtgtttaccacatttttgccatggactctatactgcatttttgaactggttagaatagctgacgccttttttatcttccttgtggtatatgctaccatcagagggagtatgtaaggtactaatttcaagtatatactattgtactatattttgtctatatacatctacaaccaagtagtatgtgcactgctctttgtgcacggcagtatatacatcattttttgtaaggcaatatataacaccttttttgtgaaccagtatactactttatttagtcggtgcagatgagccccgcccgtcctttagtcggtatatactactgttcttgatataaagggtaaagcagcgcacacatgacgcgcagcagccgttgtcgactagacggtggtgccgctgcatggatctatcagtgcatgccacgccgccaccgtttcttattgctgccgttgtcgatgagattggcagtgccgtcgcatgggtcgactcagtgcacaccatgctgccacgttgtcgacgagatggtagtgccgtcttatccatcgatgctatgtgacttgcttcaccaatggctttgcaccttgatccagattgttttcatgcaaagcctgtcatgtttgcctcctaatgaccacatccactaagtcagctctatctctctactactgcaactaactaactgtgatgatcttctccaggttttttggctggatactgagatggcaccattgtgctgctgaagttaaaccctgtttattgggacgtacaagcgggcggcaagcacacatggcggcaggagacaagccatattttaccaatgactgctgctaggattgatgtcctattgccggagaaacaatggcaacagtcgcaccgttttttcttagtttctttccaagctactcaattatcggcctcacgcgcgccgttgctgcccccccttcctgaatagatttgcattttgatctctgtagctttttatggatgaaacctaactatgttacatgcatgcctcatctatgcattttaccactactattttcttaaaaaaaaaaaaaaaaaa

SEQ ID NO: 31605 - DNA, 623 bp, Triticum aestivum
  Clone ID: PAT_TA_31605
ggctgagtcttttgttgtcatagggaggggtcagaggaagatgatttgcctacgcaattctgctgataggaacatgaagaaatatccaagcacaccaataattttgaaaaatgaaaagagattgaatgctactctcgaggaaggtactagtgaaacatgtcagcagttgagcagctcatcagaagatctctcagaggatgaacagaacattaaccctgacgtagatggagcatatgtgtttgatagccatctatacaagtgcagaacagaggtcgaggctcttcttgtctgttacttgtcgtgccctcttccactctctcattttgaatccctgtatgagcaacggtacaagaagactctcgactaccagagctgtggagttgatggtctggaggaactgcttaacaagttaaaagatgttgtcgaattgaatgtaaatgagatcagcaacatgaagttcatcaaagccaagtcaccaaaatgtagtccctcaaagccatgttaaatggtggttgtcttaatatcagtagtatagtcacttgagtacttaagattttgtttcctcgctgagcatgtttgtcaagcactgggctgacgtctaaaaaaaaaataaaaaagggcgg

SEQ ID NO: 31606 - DNA, 808 bp, Triticum aestivum
  unsure (1)..(808): unsure at all n locations
  Clone ID: PAT_TA_31606
ttttttttttttttttttggatcaaataatcttgcaactagccggtggtcaattacattaccagattaccaatagacaaaatataattaacgatagttaattatgaagcgggaaaccatacacaccactgttccagccagctacacatcatcaaaatagatacaacagtactacacacttccgtacgtgagtcaacaggagtcaactgatcagccaacaggactactagtaattagcaggcacaaactggaacgtgctggaagcttaacacgcgcgaatgcatgcatgcatgcacaccaaagtggaatatccgttcctccatccgtactacatccatgaatgcatggcgtagtacgtgtgatggtactagtaaattaattaattaaccagtagcggagtgggccagtaaccaattggtcccgtacagtagtagtgggagcaagcgtcggtccatcagcgggcgatccctgcgtggagcgtggcgttgtagccgacctgctcgatctcccaccgcagcttgggcgtcgccgggtcctcatcctgcaccgcctcgtactcctcgagcttgtggacgagttcgctggcgtcgggggcgctgacgaagatgtggcgctgggatggtctgatgaagccgtcgtccaccgccttgtcgatgaacgccagcaggaagtcgtagtacccatccacgttcagcagccccactggctttggtngtggatgnccgagctgcgcccagngtgatgaacctcgagcagctcgtccagggtgccatagccgncgggcagcgcgatgaaggcgttcggcgttg

SEQ ID NO: 31607 - DNA, 489 bp, Triticum aestivum
  Clone ID: PAT_TA_31607
gacactacatcgctttcttgctcctcttttattacgcacatagcagtattactgtctacaaacaccttgtggatcacttgacatcatatacagagaaaccggcctagcttttgtcccacacagcttcttcttatggctaacgcggactgacaccatgcgtgtcaacaccaacaaactacggtaaaaacgagcgacggcagctacatatgctacgtacgtacggttctctccccggactggatttggattcggtgtcgttaaaacctaatgcatgcacgcatgcacgcagcgagagggcggcttgggttcacttgctgctgcccttgccgtggccgtagaggcggaagaggttgaaggcggagacgagggcgaccccgaccatggtggcgctggcggcgacggcgcacgcgacgccgccccccgcctgcgtgcagaaccgctggtacagctcgcacgtcttcatccactggaactccacccacgcgtccg

SEQ ID NO: 31608 - DNA, 591 bp, Triticum aestivum
  Clone ID: PAT_TA_31608
aatcggaaaactacctattttcttatcaaaccgggccggccacagtgacactacatcgctttcttgctcctcttttattacgcacatagcactattactgtctacaaacaccttgtggatcacttgacatcatatacagagaaaccgggctagcttttgtcccacacagcttcttcttatggctaacgctgactgacaccatgcgtgtcaacaccaacaaactacagtaaaaacgagcgacggcagctacatatgctacgtacgtacggttctctccccggactggatttggattcggtgtcgttaaaacctaacagaggccggccatgcatgcacgcatgcacgcagcgagggctttgggttcacttgctgctgcccttgccgtggccgtagaggcggaagaggttgaaggcggagacgagggcgaccccgaccatggtggcgctggcggcgacggcgcacgcgacgccgccccccgcctgcgtgcagaaccgctggtatagctcgcacgtcttcatccactggaactccacctgcccggtcttccccagcagcgccgcctccatggccaccgccaccgccccgattatc

SEQ ID NO: 31609 - DNA, 1012 bp, Triticum aestivum
  unsure (1)..(1012): unsure at all n locations
  Clone ID: PAT_TA_31609
ttgaccgccccccgtttgtttttttttttttccgtgctaacccggatcttccggtcgctcggccggatacgtacaagtttctcctaatctcgtcactctgccgcgccagggactatatcccccgctccttattgttacatccatcgcctgcctgaaatccctacttcttacatgggtttactagcaccgcgaggagatggtttcgatggagcttagcttgacgataagctggtctggtaggcctgccaccctcgggcgcggaacccggccgggatcccggccgtaaagtacatagctaaatctatttctccgacaagtatttccgtactaatcggatcactctactttattctgagattttctgatacgaaggacctggtgacgctcctcgtactatactcccgcgctccttattattacatccatcgcctgcctgaaatccccacttcttacatgggtttagtagcactgcgaggagatggatgcgatgaagctttagcttgacaacaagctggtctgggtaaggcctccgccaccctcgggcgcggtactctttcgcggcgccggcaggatccgctcgccctctgatgaatcctgcgcccgtaccacgatcacgtcggccgcccctcgctcatttacgaccgcaatgaggggtgtcatacttgctgacccaggagaattctccctccggcaatcaacatcaaccacgggatcgacaacttggacgaacgccggactcggcgccggagctggccaggatgcagggtttaccgacaagaatccgataacgaaatcagaatgttgctcggcaaacttcacggctgttgcggtgtaatctccatgagcaaggttgcccaggtgagctcatctcagcaaccaagagtaacccttttccctttggcaaacccttcagcttcaagccatntacaattccaggtccaggaactacatgcacagtgacaatatcggcccagtntgatatgcggaatgttcctcnttcatattgcatagt

SEQ ID NO: 31610 - DNA, 1365 bp, Triticum aestivum
  Clone ID: PAT_TA_31610
gaacaaaaatttaagaactttaacaatacattccctgagaatctgagaggcctatgccagcttccaagcagatggatagatccatgcaaaaaaatatacagcaataaagatcagatatatgatccagcatttttcagactggctatgctttgttaggcactaagctaatttagccccatcgctcaactaagatatttagccgagtttaacctcaatgttgggttacgattcgtcagtctgaatctgagtcctctatctcccactgacgagcatctctgggttcaggatccgcgctggattcaggttgaccaaagagtgtcgtgctaagctttggacggcgacgtttgtcggtcttgtctttaggagcttcgtcctttggagtcttctgagctgattggatattcttgaaccatattgttccccatgaaatgcatgcaagcatcagcaaagctggaccaatccttgggtcagttaagtaatctctgaaactgaagccactgttctgaaccctctcttttaaacttttccctgccgagcggatacctttggtaccgcttaaccattccttatttgtttcttcgggtacaagatctggtaccttggaagtaaagtaaggaatttctctagtatctccatctttgataatctgagagacccacttgtttatctccagaattccatccgggccattatacctagccactagctgggaggcatcaggagtgtcctgtccctggagagtctctataagattattctttttgtcggctttcaacgcctcgtatgttgcatttctttggaaacggacaatgaatacttcaggcttatcattgtcatcttcaaaacctctaggaccacaggctccatggtaatcagtggcaaggtagaaggcacaaattttcttctgtaattctccatccaaccaaacaaaggtcagcctgtcattttttaaggcagttgcagcacttgctacctctactaaattttccaaattcccagtagcactttcaccagcagcactgagtagttggtcctgggccttcctcaaaatttgtctctttttacttaattctacaccagggcgacctgcagctattacacaataccatatcattatttctttcccagcgcgtgaatgacctctagcatcacaaccaagatccaaagatgtgtcacttcttagctgctggagttcttggtgcttatgctcctccattatctctgtgaactcggacttactaaaagttccatggtatacaacaggcttggcacctggccccttcaagaaaacaagtgcaggagccgattccactcctaatgaattccaccagatctgggattcctcttctttccataggacaaatg

SEQ ID NO: 31611 - DNA, 353 bp, Triticum aestivum
  Clone ID: PAT_TA_31611
cgaccggatgctcgtggagatgtaagtggaggccgatacatcgctcgcagatatagtgatttgtgtgttttacgttgcagattcgggaggcacttatggcatgacatcattgggggagacggaatataggttgggtacaatcatgtgacttcagaatcatgatttatgaacaggtttcatgagcatggtcaagcgcgatttgcgaatacgtttcgtgaccatgggtcattgtcatggagtaagccaatccattgacactcctatggacccatggatgatttacatttttctcttgtcccaattcatccacatatgtatccggttatccacacccttctaactcggccccatcg

SEQ ID NO: 31612 - DNA, 1229 bp, Triticum aestivum
  unsure (1)..(1229): unsure at all n locations
  Clone ID: PAT_TA_31612
tttttttttttttttttttttttttttgcaaattaaattgtatatatatctttaaacaataaaccgagtaaccgacagcagctactgccgaaattttccacagaatgtttacatgaatttccagtttctctgaacgttgtgtacaaatcctaacaaaatgttctatcctagcggctaaaagaattcggtgcatgtttaatttatctgtacccaagccaaggagagggccaggaggtgatttgatcagaaaaatgtggtgccggcgaaaccgcggtggaggaggttgtgcgcgatgctgtccctctcctgcttggcggtctcggagcgaacaggggtctccggcgtggtatcgtcgtcgaaaagcgcaaacgggacctccggctcgagctcctcgcggcgcatctcgcagatgttgtgcaggacgcagcaggcgcccagcaccacggggaggtcctggagcttcacctccgtgcgcttctggaggcacgcccaccgcgtcttgagccgcgcgaacgcctccacggccacgttgcggatgtcgccgaccttctcgttgaaggcgtgctgcgtccatgtcaggttctggtgcgtgtacggcacgagcacccagtccatgagcgggtagcttgcgccgccgacgaggcaagcgtcgtgcatcatacccgccgcggcgcgctggtgcagcatggatttctcgagcacctgatcgtccggcatggagcccggccagccgatgcagacgtcggtgaaggcgcggtcagggccgaccaccccctggagcgtgatggagtaggatgtcttctgattgcgctccgtgtgccgacggttgaagtaggcggcgacggagatcttgggcgcgatgatagggatgtgcgtggtgtacatggctccgatgacccccggaacaccgaaggatctctcgaagccctccttgaatctgccggcggcggcctcgtcgggccactggaggaaacgcggcatgaggacggacttgatggcaccgcagacctcgaggacgagcttgtggcatgtggagatgccgaggccgaagcgcttggagacgaggcggagcggttcaccggtggcgaggcgccagatgcagacggcgacgcgctggcgcacggggatggccgcgcgaagcatggtgtcctnccttggccaccgcggagccgagcgcctcgcagatncatgtcgaactntncccggcccatncctgaaggcgcgccgaa

SEQ ID NO: 31613 - DNA, 1092 bp, Triticum aestivum
  Clone ID: PAT_TA_31613
gcgtccgagtctctcttccgcccccagtctctccctatcgattatacgaccagggaatctcttgaatatggctggcaagggaattggctgcttggccgaggccatgggcgctctgcgggtatctgtcaagccggctacaatccctagagcctttacacgatcaatggctacacaagtctcgtcaagcgatgcctcgacagaaacaaccaaagataccagcaccacacagaccattctaggttcatggaagcccatcgaaaccgtacccgtcacaatccacaactttccctcgttggaacccaccgcactcgagcgatggtccgttgaccacctttacctccctctccgccgcgatctccttcaccttgccgttgtctacgaaggcgacaacacccgccaaggtaccgcctccaccaaaacccgattcgacgtccacggctcccaccgaaagatgcgacctcaaaaaggtaccggtcgtgcccgtatgggaaccaagcaaagtcccatactgcgaggtggaggaaaaacattcggtcctcacccccgcgactttggcacccatctgaaccgcaaggtctacgacaaggcctggcgtacccgctctgagctaccgctaccgacagggcgatttgatcgtgtgcgaggacggaatggatcttgtgctgccgacagactacgagatggttgctggaaagtacctcaaggatggactaaaggaggcgtatctcaagcgatacatgacaggagttatgagcaaccttggtttgggccgtgctgctggtcgaactctctttgtcaccggagaccgacgtgaggctctcttcgacgctatggagcagatcccttgggatggccgagcactaggcattgaggatgtcgacgtcaaggacctgttggagacgggcaaggttgttttggagcgaagcgtgctcaaggagttgatcgagaaacaccaaagccctttggtgagcagagtcgtcatgcaaggtcttgtcaagggcggacctgaggcagggacgagagtgatcggagcttgaatgcccgtgtagactatataaacttgtattattttgtacaatgcatgtcatgatc

SEQ ID NO: 31614 - DNA, 807 bp, Triticum aestivum
  unsure (1)..(807): unsure at all n locations
  Clone ID: PAT_TA_31614
ggaagatggaggaaacttcgagctccagtgatgtaaagcaaggagggaaagcaggtcctggaattttgggagttaatcttggcaagaataagactagtgaagatgctggtgctgattacgtgcaaggagttcattcgttgtcacagtatgctgattacctggtcataaatgtttcttccccaaatactcctggtcttcgccaattgcaaggtagaaagcagctgaaagaacttgtgaagaaggtgcaagatgcacgagatgagatgcagtgggctgaagatggtccaccaccattgcttgtgaagatcgcgccggacttgtcgaagcaggatcttgaggacattgctgcggttgctcttgcttccaagttggatggcctgattatatcaaacacaacaatttcaaggccacctcctgcagacgcacatccattagctcaggaagccggcggattaagtgggaagcctctgtttgacttatctactcaagttctcagggatatgtatatccgtacagccggcaaggttaccctgataggctgtggtggtgtaactagcggcgaggacgcagaccacctgttacgttccggcgcctccctggttcaactttacactgcacttgcctacggnggtccaactctcatccccgagaataaaaggcgagcttgcanaatgctttgggaaaaaaacggctcaaatctgtccangaagcagtgggagcaaacntcaagcccttgaagggctgagcancaaccgagatcntcnttgagacgctagcancatttttccntgaagnggcctttgccnn

SEQ ID NO: 31615 - DNA, 902 bp, Triticum aestivum
  Clone ID: PAT_TA_31615
gcgtccgcggacgcgtgggctgatgcacccgacgaaaccagctggcgtgacgccgaggtcggcaccgccgggcgccggagagtggcggccgtccggcgtcgtcaggctgctgcaggcgccggcggtggtggcgctggccgcggtgctcgccgtggcgtcgccggcgcaagctcggccagctggtgcaccccctccgacccctccgacccagcagaaggcggcggacacggcgccggaggacacgatgtgcgacgtgccgcggacgctgtccggggaggacggcaaggaggccgagcggatcaagcacccgaggtcgcgcgaggcggcgcggtgcacctccaagtgcgtcagcacctgcgtcctcggcggcgccggcgcgcccggcgtcggcgggcccttcaacgtccggagacccctcgtggtgtttaaggaaggtttccgcagtcgacagtactgcctggtggagtgctccgacgtctgcaacctaatcaaggacggagaagacgggcaatgaaatgatgcatggcgtctttaccaggcatgcagatagctcagaaaagatcaagacatccaactccaccttacccaatatatactacatgatcaattggctatgaatcacagtaactcttgctggaatagtgatgttgcacagttttctaaactgcaattttgggaatagcaatgtgcaattttaggtgtctccacaggtttagggaaatccaagtcaatttttggacgcatcacggggtgtctaaggtcttggatcctgggtcctggccacctaggtgccttcaaattttacctttttgacagtgttatattccctttgtgtttgtggacgttgatcgaacatgtacctgttagttccgaccgttcccgcaagaaaaaatgtgtattcg

SEQ ID NO: 31616 - DNA, 837 bp, Triticum aestivum
  Clone ID: PAT_TA_31616
gctgagagcccacccacacactcaacctaccccgcccacccacccccatcgttcctccccaacccctctggcctctcgcgggcaggaggacgctcacccgtggaaggccacgtcccctacgtccaccagccgatcaaggagcagggccgcagccgggggccgggcggcggcgtaccggggggccgacgtggacacggacgtgggccgcggcggcctggaccagaggcggcggtcgccgctcaaggcgccgccggccccgccgcgggcccagggccccggggggaccgggccgctgcaggggcggaccggctagctgggggacccgcgggggcgagggctgccgctgcccaaggccaggagcgtccgcgccttcgcctgcatcggcgccggcgccgcgtgaccgccgaacacgtacgtgcgtgcttccgcgtagacggaccgaaagcccggtagatgcttccttgcaattcaggctttgtgtgtcaagtgcatcagtaggacaagttttggtagaagtggtgaatactagggatgacaatgggaaaggtatggggcgggtagaacaataccatacccatacccgtgtagtcaatggatacaaaattctacccatgaattaacgggtagggtataggtactaactgtgggtataaaattgtgcccataccctgcccatgcgggatacggtacccgcgggttacccatacccataggtaaaattgccatccttagtgcatacgttggattcagttctatttctacatgacaggagttggagattgtaaaccaacagatacttctcgtttcaagaaaaaaaaaaaaaaaaaaaaaaaaaaa

SEQ ID NO: 31617 - DNA, 417 bp, Triticum aestivum
  Clone ID: PAT_TA_31617
cccacgcgtccggtcgctggtggacttcctgccgggctcggtctactcctcgtcgccggacctggccaacctgctgaggctctacacggaaggcaatggcaatggcgctcgtcggccgaaagagggtggtatcaccgaggaggaggaggagatcgtcgtcgccgtcacggccacatctgtttccggtttcgacggccgggacggtgaggaggccactagcgttgctgcttctttgccagaaagtggtggcgaccacgtccgagcagatcttgcacaggacgaagcagccgtaatgcgtgcatgatgtgtcgcattttaccaccgtgattgatttgtttttcatttaactgccattctttttatattatttattgtatgtacagtgctttgaattgactgaagtcttttggtcatttc

SEQ ID NO: 31618 - DNA, 1096 bp, Triticum aestivum
  Clone ID: PAT_TA_31618
ccccgcgtccggtcccttttgcgccatcctttcttctatttcctcgacgatctctcctatacgcccattcgtcttctcttcagttctccgattattttacgatcccgaataataaactacaaaccccagcaatcagttcaaaatgggcgagtcgagacaagaacttgttgcatggctcaacagcctcttgcaactcaacatcacaaaggttgagcaatgcggtactggtgccgccctctgccaggttttcgacagtatctacatggacgtccccatgtccaagggcaagttcaacgtgaactctgaatacctgtacatccaaaatttcaagggtctccagaacacatttgccaaacaccagatcgacaagccgatccctgtcccttcactcataaaatgcaagatgcaggacaacctcgagttcctccaatggacaaagcgcttctgggacctcaactttcccgatcacgagtacgatgcccgtttcccgacgaaagggcggctctatgcctcctagtgctgccgctcctaaacccgtctctgctactactggcgccgctcgccgtggaggcagcacccctagcggtggaccccgcgtagcaaaggccgctggacccgccaccgctgccctgcagcaggagaacgctacactgaaggagacagtggttggtctggagcgggagcgtgacttttacttcagcaagctccgagatatcgagcttctcgttcaaacagctgtcgacgaagaccccgagctggagaagctggaggatggcctcgtcaagcagatccaaacaattttgtactctacagaggagggcttcgagatccctgccgagggcgaggtggacgaccaggagactttctaatcgtgctgataccatcagtctctcgagagatataatgaacgcgaccacgaatgtgctttggggactactggtttctttgagcaggcaaaagggcataaacttggagttgcggacccatacttttgggagagatgttgagcaatagaagctgaatatttctctttacttgttccggaagcgtatttagttcctgaggatgagtgcaaaattgatcttgttggacaccc

SEQ ID NO: 31619 - DNA, 721 bp, Triticum aestivum
  unsure (1)..(721): unsure at all n locations
  Clone ID: PAT_TA_31619
atccgatatttcgcagccacgggngaaaatctcaagtatctagcactaagctggtgtcacctcggggaagatgaagatccgctagggatgcttgcaccacacctgcggaacctcacatatctgaaacttaacaacatgcgcagtgcaaatatcttggttctttctgcagattcctttcctcagctgaagacgcttgtgttgaaggacatgcctcatgtcaacgagctaaagatcatggatggtgccctcccatgcattgatggtttgtatgttgtttcgctgtcgaagcttgacaaggtccctcgaggcattgaatcccttggttccctgaagaagctttggctgctgcgcttgcacagggacttcaaaactcagtgggacatcaacgggatgcaccagaagatgacgcgtgttccagaggttcgtgtctgaatgcggcatagtggttcttttttctgcagtggcattctggtatggtgcatccatgtcattctagatttaataattctggcatgttacaattcttaagacaccatttgcgagtcttgtacttttgtatcgtgatacggtttctgttttgaaaatgccggtgttcattgccttcaggaggccctgtactttttttgtattatttcagttccatgctgtaaaactgatttcaggaaacagttgtgtcgaacatgtgagaaaacaatgttgtaaaatttgtttaaaaaaaaaa

SEQ ID NO: 31620 - DNA, 716 bp, Triticum aestivum
  Clone ID: PAT_TA_31620
tttttttttttttttttttttttttttttttttttttttttttaaaccagaaaacacgggcattatataacttttgcatagtgctagagagaccgacagaggcaaaatgcagcagcttcagatcaatatcctagcacaattcgtaaaccggccattgtttcaccacagggaaggaagcctggagatatacacatgagttaactaaaatttcttgtgcagctcgctcacaaggaaacaagaaccgaatgccatcatccatggatgcaccggtggcacgtagaccagtacgtacttactaaaggctgtatgattagtaacacaccctcaaaatagtttcgacttggtttcgcttgcttttcgagtagcgtccgagtgagtgagtagggcaaaagcacgctcatgggaaaaattctgctaccgtcccaaaggaggatctcggctggtgctcaggccttcaagggcttgaagtctgctcccactgcctcctggacagatttgaagccgtctctttccaagcattctgcgagctcggcctttattctcgggatgagagctggacctccgtatgcaagtgcggtgtaaagctgaacaagcgtggctccagaacgtatcttcttgtatgcgtcctcgccgctagttacaccaccacagcctatcagggtaaccttgccgcctgtacggatatacatatcccggacgcgtgggcggacgcgtgg

SEQ ID NO: 31621 - DNA, 760 bp, Triticum aestivum
  Clone ID: PAT_TA_31621
ttttgggcacaatagctcaaactcatcactgcggtcaactataatacaacaattcataaccgagccactgatctgatcactctggtcaactttattaccactacgcagaactacaaggccgaacagggaaacaccgacgaactacgtcgacgctggactgctgcacaccaccagtaccgaacatgctaacaagaatttcagcattccaatcccccccaaaagaacaaaaagaatctcagcacatcgaaaccacctactactctgataagcaaggcaagacatacagctagaccttacactctgtacaaaagaccatgcaccgaggcaagggccgatgcagttggagtcagtcacatggacaaaccaggggtctaatttacagcaatatcgtcgcacccacacagagcgcggcgggtagcgatgcggctatcaaggacgttcttgtttcccctcgaataggttgcccaggaacagctcaagctgctcgggcgtgtgcttgacgtacttcccaggcgctttgctgttctcgatgagaggcccgaagcgtttttggaaggatctgtacgcgggtaacagaatttctgcaactgccagtctcaatgactcacgcaactctgaatctggaacagaccagccacactgcttttgataaatctcttcaaattgcagattgaaagacctgaatctctctttcacagctgttcttgaagctccactgctattgccaccttcgcttcacacgcccgcccggccgctcgaa

SEQ ID NO: 31622 - DNA, 1745 bp, Triticum aestivum
  Clone ID: PAT_TA_31622
ttctgcccccttccaccaggccggcgtggcgccgagatccgtccccgctgattcattcttctggtctggttcccgattcgatcgctccatctacgcaggaaacgaaaccaaaaaggccacatccacgaaaccatgttgatttctctcactataacggcaaaaacccgagatcctttctggaagttacaatgttatgggcaggtaggaggaaagatgagaacatcacagtagggaaggtataagaagccactagagctgtatcccagaaaaagacgagagcgaaagttggaaagagtatgccaacttgtcctcctacaacatatcctgacagggcccagttacaggcattctaagatgtcaccggtacggaaaaattgaaagcagtggcttatttggattcaacgtttgatcgctgtcatcaggggcatgtataatgatgggccccacatattttgcctgtttatatgacaccgacaccatatgcagctgtgaatgttggagtctcactttgtctgcaagatcctatgccacctgtctcacactcatacagcccatatcctgttcaagcacgaaatgggacagttcaaactcctacacctggcgctggagggtctgagacagataagtcaaacaaaaataagcggaagactcccctgaagagatccaaaggaagcttaggtagtctggatgtagttacagtaaaagataaaacgccacctgcaaaacctttagtgtcatcctctaatgaaggttcttcacaaagcgagagtggaagcggaagttattctggaggaagcagtacaaattctaaaagtggttcacacacaaaggatggttctgagcacggcccggctaatgatgctagcaataaaggagtcactgctcagggcacagcagttgagcccacacaagtatcttctgggccagttgtgcttaaccctatgatgccatattggcctgttccccctcccatgcctggccaagcaactggtgtaagcatgggagtggattactggggtgctcctacttctgtacctatgcatggcaaagctgtcgctgcaccgacatctgctccttcatcaaattctcgtgatatcgttcttagtgatccggtcatacaggatgaacgagaagtgaagaaacaaaaacggaagcaatcaaacagggaatcagctcgtcgctctagattgcgcaagcaggctgaatgggaggaagtagccagtcgagctgatttgctgaagcaggagaacagttcactgaaggaagaattgaaacaacttcaggagaagtgtgataacttgacctcagaaaatacatctttacatgaaaagcttaaagcgcttgatagtgagaagccaaatggaaacttgtgaagcagtgaaggccgcggcttcactttctgactgctgatataaattggaggtgacatgataggccggagataattaggaggtattcatgtgtgcaattagatttttggctgagatggtaggattgtatcataggattcaacatgatggctacagattcttcgtcttctttgtccggacgtggcagctgccgctctatggtgttttcttttcctgcttttgtgtgagatgctaccttagcagtatgtaaagatccccaagttatatttgagactttgcgggattagcttataagatgcttgttgtagagctgctggttgaccagaactgatgcttgttatagttatgatttataaaaaaaaaagttactttacc

SEQ ID NO: 31623 - DNA, 987 bp, Triticum aestivum
  Clone ID: PAT_TA_31623
cctggccacacgaacgttcatcctttcttattacagcttcagggctaattgtaatcgaatgtaattaccgatgaagctccccaaattctcggcaaaaaaatccccagaaaaaaaagaacgagggtgagtcccaccggccagatatagcaaacccaaaatgaaaaaacacactcgtcatgcacctcctatgtttcactggtatatcccgcagaatcttgcgtacaccacacacatccatctaatattgtcgagctaatcaagcgtagtgcatactgtaataatcaccccaccgatcgatcaaaaccaccgaaaaatcgaagtgctctggctagccgcactccgatcagttcatcgcaccagtagctactacgtacggacgtatgctccatggccccacgcacgccggtcaatacggggaggaggcccccgccgggagccgggaaccggtggcgaggaagcggacgagccggaaccccgtcgcgagcgccgccagcgccaggaacgcgaacgccgcgaacccgagccccacggcgatgtcgctctgcaggcacgccgtgctgctgatattccgctcctggcctccgccgcacaacgccgcttcccgcgccgccgccgccgcggcggctagcgccatgtacccgaaaccctggtcgtggccgaagtcgaaccagagctgcaaggcctccgggagcagcgtggcgcccttggccacctcccacgccgccgcggcgacctcgaacaccgagtataccgccaggatcgcgttcgccgccagcaggaacctgaacggcgccagccgcagcacggcgccgtccgtcgccgcgaacaccgccgccgcgaggctaaagcacagcgccgccacccgcagcaccaggaggagcgtccccagccgcctcgactccttcctccgtccccccgccgccgcctgatccccgttacgcagcggcgacgccatccgaacaccctcagctcagctcggacgcgtgg

SEQ ID NO: 31624 - DNA, 802 bp, Triticum aestivum
  unsure (1)..(802): unsure at all n locations
  Clone ID: PAT_TA_31624
gcacgagggcgacccctacgcggccccggcgccgtacggctcgggcgggtacgggtatggccagcagcagccgtacgccgcgccgccgtccggctacccggccgcctacggcgccggcgcgncnncgnnncnngccgggtaccctgccgcctacggaggcggcgcgcagccggcgtacggcgccgctcctgcccccgcgtacgggtcggtgagtgaccctgctgcgaagaagaaggggatggggatgggggcggggctggcggtgggcgcggcggcgggggtgctgggcgggctggcgctggcggaaggggcgagctacctggaggacaagatcgaggacgacgtggcggagaaggtggaggacgacctggccggcggcggctacgacgacgacgactactagagaaaacgaaaacgatgggcacctcctgagagattgttgtacacgctggtgctgactagccagcatcttctttgcttttattctggccggatttgttgaataaatacgcgaaacaaattaacaacgagtgtagcagtacatccaattgaaatgttttatgtggccttggcacagaaaaaaaaaaaaaaaaaaaaaaaaaaaaaaaaaaaaaaaaaaaaaaaaaaaaaaaaaaaaaaaaaaaaaaacaaaaaaaaaaaaaaaaaacggccaccacaaaggatccacccaaaacgtcaacatacaaacaacctcaagcccctctcaatagggcaaccaaaattcaaaaaaaaagggcgcccttaaaaaagttcctgtctggaaaccccttggggtaaccca

SEQ ID NO: 31625 - DNA, 1054 bp, Triticum aestivum
  Clone ID: PAT_TA_31625
acagctaggaggggcatatatttatcaccaaataagcttactactccagggattaagtagcactgcaaattaaggagggctagtagtgtaaattgctagctggcatactagtacaaatcaagcacaaacactttcctggatggagcgcccgtgcctgatctatgagggaaggggctactaggggcacaaagggaaatattcaggggcacccattctttttccttgtcagcaagtcaaccaaggggatcctgggtggagcgcccgtgcccgatctcttcctgatcgtcgtcgtcttccacagcctgtccccgccgtactctttcacggggctcttccgtgtctcaactgccacattgtagaactcgcacacgccgtgtaggagcagcctctggaacgggtcctggacatccagcgcaagcaagtccttgtcgcccctcgtgtcttggatgaaggccctcactcgttcttcgtacatccgaagcaggtcaggcaggaagttcctcttgataacttctcttgtctggcgaccgatacggtgccaagcgttcagcgcaatctcctcgtcttcgtccagacgactgttcttccgatccgcgcatgattgtctcatgtgaaattgcaacaagtttgcctgaacatccatgtcgatggtcctgaagacatcccatgcagcagcagaacttgtcatgcagaatgcagacaggggcagctcctcaccccatggtggcggagcgaagaggcctttgatctcgtcggcgccaagacgggggaccagctccagcagcagccggtcgttgagccaccggcacgatctcctgttgctaaccttggtggcgccaatgtggtcttccagggcctggatcttgctttcgatcgtcgtctgtccagtgaagggggaagagccgaactgctccttctccctccgcagcaggcccgcagtcgccatggattcttggcacgaactgtcgctctctctcgcgctcttttttccggcgagaaggaagggcttcggtggccggagacggagacggcgggacagagcgggcgcccccgc

SEQ ID NO: 31626 - DNA, 919 bp, Triticum aestivum
  unsure (1)..(919): unsure at all n locations
  Clone ID: PAT_TA_31626
atgccaagtctacattgtaaatttcttcagttcaagaacaatcaacaccaaaggtgtttagcaaagattctataacattattgaaatagctactaaatacagctagatcaactaacctccctcccacggactatcatccgggctgcaaatcagcatgagcacaccatgacccaagaatattgaatttgaagaagaaaaagaaggaactatgcaaccacgtaatctagcatcatacccaaaaatcacagcacagcagacggcggcgaactccggcatgcaaatatagtagtcaaatatccgaaaagggtccccattcctcaccatctgatataaaacaggagcaccttcagaccgattgattgttgtggtttgaactctggaaacttgaatcaactcatgtgcaatatgtgatagtgcaacatgaaggttcacaaaatcaaattctgaaaaagtggtagtgctcttcctcgttgagtccataataaagcaactaacttggctgcatacaagcttgtatagctggacagatatgatgttggacggctaggttcagaatcatataaaatcagttcttcggaataaagcaggatcccgtcggcgctgccggcgatgccgaagcgactgaagtcaatcttcttccagttttcctgcatctcttcccaaaatcgcgtaccccttcttggtcatgtgaaccggcagtgactccttgcccagctcctcgctcctctagatcatatcagcggggtatattgtggaatcaaggttgtggatgatgggggctgcatgttctgggccagaaacataatacatcattatctagtgtgcctgcccttccttccaaaagaattatgcatctactttgcctacaagagcacatatctgaaaaagaatggtaaacatgtagttcctcctaattacn

SEQ ID NO: 31627 - DNA, 534 bp, Triticum aestivum
  Clone ID: PAT_TA_31627
attcaagggtcgacgggaaaacaaaatacggacatagaagcatcatgttgattattataatagcaacaaaattaaaaataaaacttttatcataggacttatatcatatacttctcatgaataattaatagttcatcacacaattgaagtataaagcaaaaactctattaaaaaccaacaaactatgttctcagtcaactttgcaactacaattcatcatgttttcaggaagggtcgcatatcggagcctttaggcaagtccacatactcaaccatcatatagtcttctatgattgctaacactcaccgcgtacacatgagcaaaacatttcaaccggacacatagaaagattggggcttatagtttcgcctcccagcgtattcacctcaagggtgatgtcaacaataataactcatgctatcatattcaactggacatatgtgccttgatctttcctcaccacatgatgcttctcaaaggagaaaaataaaaggaatagagagaaaaactttgactctcgcataaaagtaaat

SEQ ID NO: 31628 - DNA, 473 bp, Triticum aestivum
  Clone ID: PAT_TA_31628
cgtccgcttgttctcttcacagttgagttcgacatcgaaggcggtgggccgataaagatgaagacgaaggaggcgaacgtggacgggttcctgacggagcagcaggagaaccgcggctacttccggtacgtcgcgccgtgcaccttctacggctcgccgcttcccagagaggtcgcaccgttcgccgtcgacgactcgccgcttcccagtgaggccacggaagaggagaagaagaagaagccccagttcatgatggtgttcatgtgcatcccagtggcgccggggaagagcagggtgatctgggccttgccgaggaacgtcggcgtctggctcgacaaggtcataccgcggtggtactaccacatgggcccgaacgccctctttgactcggacatgtacctcctccacgtcgaggagcgcaacttcgccgcggccggcgtcgaaaactggcacaaagccgtgtacgtgcccac

SEQ ID NO: 31629 - DNA, 901 bp, Triticum aestivum
  Clone ID: PAT_TA_31629
ctcccgggccgacgggccactgaagatgaagacagcggaggcggatatcgccgggttcctgtcggagcaggacaatagcggatacttccggtacgtcgcgccgtgcaccttctacggctcgcccctcccaaaagaggaaaagggacaggagaagaagaagaagaagccgcctcagttcatgctggtgttcatgtgcgtcccggtgtctccagggaaaagcagggtgatctgggcgttcccgaggaacgtcggcgtctggctcgacaaggtcataccgcggtggtactaccacatcggccagaacgccatcctggactcagacatctacctcctccacatcgaggagcgcaacttcgccgcggcgggcatcgaaaactggcagaaagccgtgtatgtgccgacgtcgtcggacaacatggtgattgccttcaggaactggttcagaaaacactgcaagagtcaggtcggctgggccgccccgacggtcggtcagctaccagagactccaaccaaagacaagctcatggagaggtactggtcgcacgtcgcgcagtgcaggagctgcagcgcggcgctgaagggcatgaaggcgctggaggttgccctgcagattgcgtcggtggcagtggtcgggttcctcgccgtcgccaaggggacactggtgacatcggtggtgcaaaaagcccccgttgtgtccttggctgtgctgtgcttcgccgcgtcccgttggctggcgagcttcatcgagaagaacttctatttccaggattacgtccatgcccccaagtgaaggccataatcctgcgccttctgttgctaggattttgtagctcctgacttgatgcagctttaggaagtgtacatgaaacacattgctttatttgataccaatagtagctgt

SEQ ID NO: 31630 - DNA, 2811 bp, Triticum aestivum
  unsure (1)..(2811): unsure at all n locations
  Clone ID: PAT_TA_31630
ccacgaggcagggccccaacaccctcccctccatccaccgccaccaccagacgagcctggccgtgttcctgagcctgcccccgaccgtcatcccggggatagaacccacgcccgcagccgccgtcgacggcgtcactgctcaagacgcgggcgacacggcactggtggaggccctgacgctaccctccccaccgccgccagccccggcaggggcggatgcggcagctgcccaggcgggcagagcccggtagaggtcggccccagagcccagggggacgaccagtcgagctgaagacggcgggggaggacatcgccggggtccggcgggggcaggacaatagcgggtgctcccgggacgacgcggccggcaaaggcggcggctcgccgctgcccgacgcggcaaggcgagaggggaggaattcgaagccgcctcgagtaacacggctatggctgggcgcccccgcctcagcaatgcaaaccaggcgaacatgggggttcccgagaatcatcggcgttgggcgcgacaaggtctttccgtgatggtccttccccatcggcgagagagaaatcgttgactcagacatctacctgctccatatcgaggagcgcaactttgccgcggcgggtgttgaaaactggcagaaagccgtgtacgtgccgacgtcgtcggacaacatggtgatcgccttcaggaactggtgcagaaagcactgcaagagccaggtcggctgggccgccccaacaataggtcagctaccagagactccaaccaaagacaagctcatggagaggtactggtcacacgtcgcgcagtgcagcagctgcagcgcggcgcggaacaccatgaaggcattggaggttgcccttcaggtcgcctcggtggctgtcgtccggttcctcgccgtccccaaggggacgctggtgacgtcgggcgtgcagagagccgccgtcgtctccttggccctgctgtgcttcgctgcatcccgctggctcgcgagcgtcatcgagaagaatttctgtttccaggatttcgtccatgcctacaagtgaaggccataatcctgcgccttccgttgctagggttttgtagctcctgactcgtcgcaccctctcctctccatccatcaccaccaccttatcatcttccccatcatcgtcatcctctccaccaccgtctgcgtgagcacagtgccaacgccggcgtcgtctccactgccgccgtcgctcgacatggccaccactcaagaggagcagaagacgagcgtcgtcgaggccgtggagcagccttcccccgtggcggcggcggcgccggcggaggagaagacaagcgttaaggccgtggaggagccttccccggcggctgcggcgccggcggaggagaagacaagcgttaaggccgtggaggagccttccccggcggctgcggcgccggcagaggagaaaacaagcgttaaggccgaggaggagccttccccggcggctgcggcggcggaggggcagcggcggccgcctgcggctacggcggcgcgccgggcgggtgctccggccagccccttcgacttctccaccatgatgaacttgctcaacgacccgagcatcaaggagatggcggagcagatcgccaaggacccgtcattcagcgagatggcggagcagctgcagaagacggtggcgccggcgccggcggcgtcggcgtccgcgcggtcgccgcaggaggtggcggcggcgctggacccgcagaagtacgtgtcgacgatgcagcagctgatgcagaacccgcagttcgtggccatggcggagcggctgggcagcgcgctgatgcaggacccggccatgtcctccgtcctcggtggcctcaccaaccccgcccagaaggagcagctcgaggcccgcgtcgcccgcatgaaggacgacccctccctcaagcccatcctcgacgagatcgagtccggcggccccgccgccatgatgaagtactggaacgacccggaggcgctgcagaagttcggccgcgcgatgggcgtgggcccgtcgggcgccgccgccggagccggaaccgaagcagaggaggaggaagaagttgttgccggcgaggaaggggagtacgaggaggaatctatcatccaccagacggcgagcgtgggcgacgtggaggggctgaagaaggcgctggccgatggcgtggacaaggacgaggaggactcggaggggcggcgggggctgcacttcgcgtgcggctacggcgagctcgggtgcgcgcaggcgctgctggaggccggcgccgccgcggacgccgtggacaagaacaagaacaccgcgctccactacgccgccggctacggccgcaaggagtgcgtcgcgctgctcgtcgaccacggcgcctccgtgacgctgcagaacctggacgggaagacggccatcgacgtggcgaggctcaacagccaggaggaggtgctcaagctgctggagaagcacgcatacgtctagacgccgtcgccgtcgccatcgccatcgccatcgccatgccatcagtcgatcttgccttcagtttgcttaattttattattatttcagattatgcttattataatattttccatggaagaaaaaaagggtctctcttcggctgtaattcatatttcatcgatctgtatctattgagtgtgggtagaatttatctgggtttctggattgtttattatcgattttgcattttgctgggtcgtttcaaagttttgcttcgtgaataaagaaataaaattcatgtttctaataaagaaagagcagaaaaaaatcaacccggggcccggn

SEQ ID NO: 31631 - DNA, 889 bp, Triticum aestivum
  Clone ID: PAT_TA_31631
caaatcatagagacagtcaagaattaagctatttcaccaatagaaacacctagatcaaatggaaaatttctcagttgctagaagccatgcaggtagagattcatggcgtaataaccgtgcacatctagtaccgcggaaagctagccactacacttcataactttcagcccaaaagtccaagatgcccttcgtatcgcttgcagttttgcccactaagtaaacaagatccaacccactcctcgttatgccatacatattcgtcgctcatcgactggcgagagcataaggacggcaaagccgaggaatcggtcggcgaggtatccgaatattaatctcttatttttgcatcataagctggacgaactcgttgtagtcgattcggccatcaccgtcctggtcagcctcccggatcatctcatcaacctcgtcatcggtgagcttctcgccgatggaggtcatgacatgtcggagttcagcagcggaaatgaagccgttgttgtcacggtcgaagaccttgaaagcctcgcggatctcctcctcggagtcggtgtccttcatcttgcgcgccatcatggtaaggaactcagggaagtcgatggtgccgttgttgtcagcgtcgacctcgttgatcatgtcctgaagctcagactcggaggggttctggccgagagagcgcatgacggttccgagctccttggtggtgatttgaccatcgccatccttgtcaaacagggagaacgcctccttgaactcggagacttgctcttcagtaagtgagtcggccatgtttgctgtgtatggtatttgaagtagatagtaaaaaggtggatgtcgatcgcaagagaaggaagaagatcccggcccggccggcgccggcctcgagcgcccg

SEQ ID NO: 31632 - DNA, 1480 bp, Triticum aestivum
  Clone ID: PAT_TA_31632
gtttttttttttttttttcctccaacatttctgatttattgcacttctgagaatttaaagaatcgtttgttacccagttgtacacagggcgccccacggccgccacccccccccagatgttggtggatggatcgttccgtgctgtgatcttaccacacgccctgctcgacacctcacctaagccttcctgcatgcagtgacatccaactacatcctgcctcggtcgtcgcctccgccctgtctagtggcctccgcctccggggagatggcccacccccctggcgtccattcctcgtctcaacccccccccccctggcttcgccgcgccgcgccgggcttcgtggccggggcggtgccagtgccgctccccccccccacggcagtcaacccccaccccgttctttgtcacgggcactgccggccgaaaaccccgcccctgggttttgcacctcggggtgtgtcgccgcggggcgctcagaaatcccctgtcccctcacaggggggggcgcgcgccccttggggatctctggccgcgcggcctgcttcttcccgatccaaaacaacgaggaagtcgtcttcgaattcgaatgtcaagaacttgtcttgacaggtgtccactagatgagcaaggtggtggatgttctttatcatagttccatttagttttatgacttgttgattgcccatgtgctcgtacccgatgttgacatcgttcgccagtacctgagatacaattacgatttgctccccttcgaaggttgatagagagtatcgtgcctttgccaacagttttaaccctaaagtatcttcgcactcttcctctataaatggttctgttaaaggcgtgaagacaaggccggcaactatcagataagaaggttgacccccatcaacattgaatggcactaaatgttttcttggatgcaaaatggtttgcactttcatgacattgccttcccgaatgatacctagttgggcaacatcacctgcatacttttgacttgtgaggtagcggaaagcaatccgctcagtggaccgaaatggtactgttccttcacatcctaccgagacaccatcgaaacttgttatcacatctccctttcgcagaacactgcttgctggagctgtaggctcaacccggcggacaagaacaccctcacttgaaggcaccttcaagctttcgcgcagtgctgggttttcccaatttctgaagtaggacgcccaggcaaggaaatcctgtgtattttccatttttccgatagtcattcaagaaatgggatacgactgtagttggaataacatatccaatattttcagcttcatctgacctgaacacctgaaatgctactccaatgcattccccttgctcattaaaagccggtccaccactgtttcctgcgtttattgctgcatcaatttgaaccccaagaagatctgatgttccgtgcgcatatcgggcgcccgctcggcgtgatacaac

SEQ ID NO: 31633 - DNA, 2220 bp, Triticum aestivum
  Clone ID: PAT_TA_31633
tttttttttttttttgtctttgttttttttttctttactaagttcaacttcagacaaatcttatatgtggagtaaaaataaccagaaggggtactacacacaaggcagctggtatttaagcttccagagcttcatcatactcctcattgacaattcagctgcggtgcaggattaccatcacatttatttccgtgtacacgtctagcaaatgagatggatggtactacgtactacaaagcagatagtacttcctcatcatacacacagaccttacacctgccaaaagttgggccagaagtcaggatatgcacattgggttttttatgtacagtgaagtgaaacatcaatttcatcatggattggtgatggtactgaaacttgttggtaaatccttctgatttggcaggatccaagtgtcaccaaggcttttacggttgttcaggctgccagctgctttccaggtcatcatttaacaggggagggaggacacaggatagtggctgcccagtgctctgtcatcaacatagctggtgccagatcagctactttccatggccaatctttgcttgttggtgcatttcgagcatcctgcggtagtccagccttgcgacagggcaaccgacgatagccgataccctcgaaacagcctcactgacagctctcccctcccgttcctccccggcatcctcgtctctggcttcccccccctctggggcgactcccttcgccctgcccgcgaccccgcgcagaccaacgccttttcggaaccacctcagcatgatcttctcaaggatgccaacactttgaagtaactccttgtacttgtttctttctcggtgagctctgaaccgtgcctgaatcttgatgacatttttccgaactttctgatattccttacgtttcttccagcacctgaagttcttctggatagataatgcagctctttcgagcatagatggcgaagcagagctatctccattctgaagagccttttgtttcttcttttttaaggaaaacacacggaaggtagcttgtatgcacccggcagcttgaacagcatttcggatagctcctaaagaatccctcagtgcaagctggtcatcagttccaccatccacatgtgcgcatttatctgatactctatccacagcactagatgtactcactccaccattatgatctacgggtttcccattttcttgtgattccagagaatgaagggtactggttagttctgcttctgaaaggaatgcagagatgcctatgaaaccatatgcagacgctattgaagcaggtgtcttggcagcagggtcttccgctgttggatctgaaagtgcacccacagcagcgcctgcagcaaaaagaaccgccaccatttgttgccttccgaatcgtgcagcccaatgcagagcagtccatccatttgcatcacggtagtttataggcacgccattattaagcagcggtttcaaagcccagtcgtatcccaatgcggcaattgtatgtataacaccatggtattgcttaggaagcaaatactccccttcactggtctgttcaaatttggatgatagccagtcctggaacttactgttaagcatcacttccatgatgcaatttactgcattctcatggtccaactgctcacatgttctcccctataatctctgaggggttaactgggaatccagaccgagcatttgggagtggcaacctgaactttgagaagagttcacagccatgactatcaaaaagcatctgcacatagttaagaagcaacaacagctcattgtcacttttggtaggcctctgttggaattcaaattcccgtgcttcactgtagggtttcccgttcccaataatcattgtgttggtaggcttttcaacaaatccaaattctcgatcttgagtgcaaggtttcccattctcatcgagcatgcacattctcacctttccagcaccaaggtatgatggagtataacaacggatgacaccttgctggacaatttccgcaggtaccttaacatcaccaaatagtacccataaaatattggaggggaagtctcctgcaatgacaaccttagcactttcagaacaaaatgcccattctggagaaacctcatgaatatggaaccattggttttcatcaactgtcacaggagctgaatgcagaaaagaattaagttggtcctcttccaaccatgcttccgatcaagagag

SEQ ID NO: 31634 - DNA, 907 bp, Triticum aestivum
  unsure (1)..(907): unsure at all n locations
  Clone ID: PAT_TA_31634
tcactgtccgacctagctgcgtcggtcatctcctccctgccgggatcactctctccggagggcggccgccaccccttctggcccccgggcttgtccggcttcgctgccggcctcgcgtgttcctggcgaatctactccgcagctgcatgcccccgcgattttcgcgggtctgtgccggccttccgaagtgtttgcgaatctgggacggagacgggcccccgtctgcgcttcactggtgtttcattgctctccaaggtgctgcggagtataacttgggacgtttcattatgcccctccaaacaaccttgatggttatccttggcagaatagcacaaccgcatatgaatcaattaacacagcaatgggaagataaataattattctgactagcaaagaataggtcagttcacatgaaaaaataggccacctttctaaattctaaacctgcacaatagcaagctgcgcttgggatcttcgacgggcttcatctacttcatgaagatgaacaggacatcttcagatcttgaattcttaacatttgctcaaaggagtcaggttacaacagaaatggaaagtagcaaagtccgttggacatgtctttctattttcatatatataggaaaactgataaatctgtgacaatgtggccgtatggactggattagtgtgcaatgggaacgggcgttgagtactgagtgggtttgacgggatctggtggggggtggcggggcaaggtggtggtgtgtgcctgggagtgggggacatgggtttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 31635 - DNA, 1505 bp, Triticum aestivum
  Clone ID: PAT_TA_31635
tggagagtaggcgaggaggaggagggccggcagcggccgcagcggcggcgggcgacccgcgcgggccgatgccgggtttcggggctcctcagcacaccatcccaacaaatgtgaacgtcatgcagccttctcgagttgctgatttgggggcgctcgcccactctgctggattcagaatagaagatctcgctaatttcagtacaaataatttattcaatctgaagccaaatacacatgcatataccagtgacccccttcagtttggaaattacggaaagtccatttctccgactgatctagctactacggcggcggcagcagcagcggtaacagcagttgatcctcaggccctactacagcaaaagggagtgcaaccaaatctagtagctttaagaactcataacaatgataactggggagagtcaagtatggctgatacaagtcctaggactgatacatcaacggatccggatatagacattgatgaacgcaaccaaatgtttgaacaaggacagcttgctgcccccacagcttctgattctagcgacaaatcaagggacaaattagatcataagtcacttcgccgtcttgcccaaaaccgtgaagctgctaggaaaagccgtttgagaaagaaggcatatatccaaaacctggagagtagtagattgaaacttactcaactagagcaagagcttcagcgtgctcgtcaacagggcatcttcatttcatcttcaggggatcagtctcagtcagcgagtggaaatggagctgtggcatttgacatggagtatgcccgatggttggaggaacataacaagcatataaatgagttgagggctgcagccaatgcacatgctggcgatgatgatcttcggaaaattgttgatagcatcatgtcgcagtatgatgaatttttcaggctcaagggtgtagcagccaaagcagatgttttccatgtgctgtcgggaatgtggaagacccctgctgagaggtgcttcatgtggttaggtggcttcagatcatccgagctccttaagttactggcaggtcaactagaacctcttactgagcagcagcttactggcatatgcaacctgcaacagtcttctcaacaagctgaggatgctctttctcaagggatggaggcattacaacagtcacttgcagaaaccctagcatctggatccctgggccccgcaggatcttccggtaatgttgcaagctacatggggcagatggcaatggccatgggaaaacttggcaccctagaaaacttcctccgacaggctgataatctgcggctccaaacccttcagcagatgcaacgcatattaaccactcgccagtctgcacgagctctgcttgcgataagcgactacttctctcggctacgcgctttgagttcactttggcttgcccgtccacgggaataaattgaatcgattcataaatagcataataatattaggtactgcatcttgagtgttgcattagccagccccata

SEQ ID NO: 31636 - DNA, 314 bp, Triticum aestivum
  Clone ID: PAT_TA_31636
aaatcattaatttagtataaaatggggcattagggggcttttttttttttttttttctttttttttgtggggttgctattacaatcaatcattgatgacgatttgtatagataattacaacgagatattgaaagagagcaatgtgctcctcctcccaattaactatttacaatcaattaaggaatttgaatgttttgtgtagataattactgtacatagatagagaatttaaaagagagcaataatgtgctcctcctcctgacgaagacgatcggcgtgacgaaatcagcaagggtaaacccgacccggccggc

SEQ ID NO: 31637 - DNA, 1023 bp, Triticum aestivum
  Clone ID: PAT_TA_31637
gcacacagtaccgttcgtttttatttattgctaattgaaacgcagtgctctaagcttttatttattgctaattgaaatcctcaaatctaatatcgacagctcggtgttttacttactttttccgaaagctgcctgcacgacagggcgtaagcaagcgagcatgcattgcatggctgcctgtactctcttggattaattaagtaattaagcaggagccggtaactacacagctcccgcgctccagtcccagtccagctcgccgctgcgaggaggaaggagcctacgacgacgaggagcagggctgcggccggaacccgagccggttcttctccaggtcgtactccacgtggtagttctgctgctggaagctgcccaggatgatggccggcccgcccccgccggacaccccggcgccgccgctcgcgctcgacacgtccgacaccacggccaggcagatcgcctcgggggcctcgccggacgccgggcccgccgccaggaagtagttctcgatcgggagccgcatctcggcgccccccgtgaagcggagcgacagctcggggaggtccatggtcttggcgcccgccgggagcgcgaagcaggggcgcaggcccagcgcgtcctccacggccttggaccggttgtacctgccccccaccgcggccaccatcgccgccgccaccggcttgaacaccgtcgggtccaggtaggtgaaggtcgtgccggagtcgatgatggcgccgcccccgccgccgccggacacgggcgcgaaggcctgcgccgggagcgccacgctcttcccgcccaccgcgatgccggccagcgacaggtagtagtacacggagtatggcggcctggcgcccgcgttcttgagcagcggcgcgtactgcatcgccttggccttgccggcggaggaggcgccgaggacgagctcgccgctgacggtggcgtcgtcgtcgaagtggcgggagaggaggcagtaggagaacttggtgaccccgagctgcgccggcacggacggcgcgc

SEQ ID NO: 31638 - DNA, 734 bp, Triticum aestivum
  Clone ID: PAT_TA_31638
catggacagcactatctccaatgattcaatcaataaaccaagggaatacaaatttccaagtaccatcaccaacctccaactagtctataaagtataaacatacttggtactactagtctgtaaataaaatataaacatctctccagttttttcgcacgatccgccggtttaaattaatctatatcacgcgacaccccgggaaggtgtcattctggcttctgggtatcagaagccagaatgaccggtatggttccaaagaacaaagtattaaccagatccagatgtagagcccatcattccatcgctcaacttgaagtaaccgccttccctcccgagattatgagccgtatggccatggaaatgtctttgccacttttgaggactcacggacgagcacaatatgcattgcagcattgttcggaggcagctgcagaaggagaggagtgagcttcccgctgatagggctgcgcgtgcagacgatgagatcatcgatgcctgtttcctcttgtaacttctgggtgagctcctccaggttagagccattaaacgtgaatgagcgtctctcgatatcatcgtccacgtcgcccttatcgtctgcaatgtggtagtggatcgcacggccctccaccttgtgcaacggggcagagaaagaataccaaggccgcgccctggataatcattagtgaattttggccttgcgccacgggggcggcgcgtattcccgccgcggaggg

SEQ ID NO: 31639 - DNA, 820 bp, Triticum aestivum
  Clone ID: PAT_TA_31639
ttttttttttttttttttttaaagcatctctggggaaaaaactcatgcagtcaaaggggggcgcacggacccgatttccattattttgaccaaccattacgacttcaacgaactgcaaaacattttgctgagttgcaccacacagtcaacaaaccattttctagcacatcaccaaaagatagaaagctagaaactaaatgtggcgataacagccaccaggaccaccatcgcattcttattcagagaaccacaaaaggctttagaccaacatcacacgcaagcacgcattgcatctcagctctcaagtgtcgtcgctggtggaaactgcaactaatgctgcagtagatggaagcagcggcaaaggcttctggaaactgaaacggtctgagtaaggccattgctccgtgatgctaatttgatcacgaagtatgccacatgtactcaagatcttcaaaatcttgtgaactccctcatcaacctttctacattcaatgttgacaaccttaaggttcgagcacagaaatgattgttcaatcttttcttctgctcccgttgctctaacaagttccttagtgtcaccaagctgaagagtgagcgtctcaagaattggagagtgttggagaatgcacggtaggtcaatagtcgtaaaccactcattgattaatagagtctctagtttgtcaaatactgggcagtattttaaatcccagctgtagataaactgcacaaatagcaagcaacaaaatgaaactttgaaactctaggagatgaaataattttgggtagtaggaactttgggtagatcctttaatttcaaact

SEQ ID NO: 31640 - DNA, 1715 bp, Triticum aestivum
  Clone ID: PAT_TA_31640
tgggttttgccatgttgcttgttaaaaactcataacacagcccgtcctgctacttgaaccccgagagctcacgtataacaatgaaacatcatacatgttacagatcagggtaacgcatcaaacattcacttttgttcgctcctttattcaccaaatgtaacacaccatacacacccagtgacattctgttctcagttctgccacgcaactatgctagagcaccacagaatcatgtaactactgaaataaaacctggtagtaaaggacaggcatggaacatggatatacagcgcggcgggtctcgtaggggaagatggatagcatacaggcggtctaggaagcggtaattgcgctgtcccgcattaccttcatcttcactggttttgccgttggcttctccggtttctccttttcagtggaagtgctatatgcctccagctccctctttacaaacgttggcagaataaaagcagccctatgaatctctgaattgtaaaatctcatctctcgtccatctttagtagctccttcaattttctcgattgggttcacaggagtcaggaagtccaccggtggaccgtccttcgcgcatagcaaaaatccaatgacaccactaggatacgtcggaacactcgcccaggcatagtgcacgccacccttgaatacctcccgacaggcataaagcacgcccccgtttaatacctctcgacagatagaaagcatatcctggattagatgtgtgtgcagccacattcttgccctagcaattgtctgaaagaagggcttctccacaagctcctgagctggcccaattgggtctgatgaatcaacaataatggcatcgtattttccttctggagaatttctcaagaactccacagcatcaccaacatgaagtcggacacgagggtctttatatccaacatacagacgtgggaaaaaatctttacaaacatcaataactagctgatcaatctcgcatatgtctatagtctccactgaatcatgcttggctatttctcgtagtacaccaccatcaccacccccgacaaccaaaacatttttaggagatggaattgagcacagtgcaaggtgagtgaccatttcctggtatgcacattcatccttgtcagtcagctgaacaattccatcgagcacaaggacattcccataggttgaagactcgaatactaaaacttcttggtatggcgatttcccctggtacaaaatcttctctactttcaacgaatgagcctccccaggccacattggattgttgaagtactgcgctttgcttggtttaccagagcgtgagcgggttcctgtgaaccacccggacaccacagtagcgtggcacttggcctcagattccgccacagcagcctgcgccttgacacagcaaggaggcagtggcttgcgggagccatcatccccacttccctctgtctgtgctgccgctgcagaaacatttcttgcgcctccaccctccatgaaccctcttccgctttaaagttcccagcctctgttggacgtacacgcggacggcgagggggaggaagatgacgacgtgccgccgctgggaggccgcgccgtttccggcagagaaaagaaagagatctcccgaggagcagagcaggcaggctacaacctcggacggcacaggcaaacgaggcggcaacacgtacgcgagctcgccgaagccgaggttttttccg

SEQ ID NO: 31641 - DNA, 930 bp, Triticum aestivum
  Clone ID: PAT_TA_31641
gacccagataaggagaacctctgcctctacggccaccccgacgggacctgggaggtgtcgctgccggcggaggaggtgccgcccgagctgcccgagccggccctcggcatcaatttcgcccgcaacggcatgaaccgccgcgactggctctccctcgtcgccgtccactccgactcgtggctcctctccgtcgccttcttcttcggggcgccgctcaccgccaacgaacggaagcgcttgttcagcatgatcaacgatcttccaaatgtgtatgaaagtatggttgacaggaagcacagggacaggtctggtgttgatagcagtggcaaatccaggcactcatcaaagccaaagcaacgaactgatgatgtccgcccaaagaactccagggcagttgctcgagaagaagacgaggacgaggacgaagaagaacacagcgaaaccttttgcggaagctgcaccggcatatacaatgcaagcgagttctggatcggctgcgacatgtgcgagcggtggttccacggcaaatgcgtgcggataaccccggccaaagcggatcacataaagcactacaagtgccctgaatgcagcagctccaagaaaatgaggcagtaggccgtcgcctgcaagtctgcttcagccgtctctgacccatctgatcaaactacaccatgtttcttttctgcccaaggtcgcggctagcggatgtggattcctctagaaactgtgctccctcccatgtggtagtctcctagccgtaggtgctgtgaaagactgatacatagctcatactctcgtagcattatagatgtttccttggttgtcatttgatgtgttcattcccaggtgtggacaatgtcgttgcaacgcttgctgatgatgattgaattgtgccttggtaggcaatttccaaaaaaaaaaaaaaaaaaa

SEQ ID NO: 31642 - DNA, 539 bp, Triticum aestivum
  Clone ID: PAT_TA_31642
gaatccatatatgagaccaagttacttaatttcagtctcacaattcatgaaagaatcatacccttacacaaactccaacaaaagatatcaaaagggtgaccttccagtcccgggtaccattacaataacagaaattcatactagcagaaatcaccatgagactactaaatagcagtgcaccccacttaacaaatgctctcagcatcaatagaagtcagggtaagctgctaatattctagcaaattaattagcatccatagttgcataccgattacagagataaacacgcatcccagaaaagacaatcccaacagcattgacatattctggcaacatgaattcgtcaccactcctgagcatgccaacattaggaccaagcaaaccagaagcttgtgagaattggcaaatcagtgtgttaatcttcaggaacatacagaactttccccaccaaacagcggtgcacataaaattccatatgcagttccgatttggagaagcttcgtaacatctggcacaaccccttggcccggacgcgtggg

SEQ ID NO: 31643 - DNA, 594 bp, Triticum aestivum
  Clone ID: PAT_TA_31643
caggttcacatagagttcacatataatagtctaggttcacatcatgtcaaatacaacacatgaaggtcacatatagcacgtacaaaagcccaagttcacatatagattacatagacagctcaaaagtttccaaaatgaatcatgatatagaaagggatccaatgagaatcacaagctaagtctccttttgcttcgtgtgctcattgcagggctggaaggattcatttttttgcttcgtgtgcccattgcagggttgtcatgtggcaccatgggaaggtgtggcaacttatcagcaacctctttgctttttcttttggcatgtaatttcaaaacaacagatgctttcttgttggccacacaaatgggctgagttcttgatctttttgctactccggatccagatttactccctttccctttttccttagttgttttctccaacatttggctttttgatgctccagtaattgagttatcatgttttctctttttcatagttgaaggttccaagctttggcttggcagaaagcacatagaggatgctggagcatcatcctcgtaaggcacaattgatgctttggtgggtcttttccc

SEQ ID NO: 31644 - DNA, 888 bp, Triticum aestivum
  Clone ID: PAT_TA_31644
cataaccataaaagcttcggtataacacagggacaccaatgcactccaacaccttaaaaatccttcaacggggaagatgcgccaaaagctgggtgttgaacttgcggctcaacgccagctaccagactcccttcgaggacagcagagcaaatcaccgagcgagcctccagactaaattttggaaaacaccaacgaagatgaaataacatgagagaaaagacacaaccactcccaaactccataaagaaggaagcaacatgttgcctacagttccatacccatcaacatccacttcttgctcgtaacatcaagatcacgggcccagtgatccagggtagccatgtcgaagccaacccactgcaggctctttgacagagagtaaacgtcatctgcggggatacgtctgtcaatgcaagtgacaatgtgggcacagtccaaaggaccgtcagccaattcaataagggccataagagcctttttcaggtctcggccgagaacgccttcaatgtcgaaaaagacaaagagagatttctcctctccatcatcagcaacaaaggcacggaagctcgcaccgccggcatagtcccacatctccagccaagcagtaacgtcgtaggcaggtagcttttcatcggaaacaggcttgaaatgttcgggaagccggtcatcggacggcggcgttggtaaaaaaagcaccagacaggccggagccattcatcgacgaattcctctcaccgcggaacgtcgtcttcatggactcacaaaagaatctctcacattcttccctgatcgaaagtgctgccccccctcgtcggcccaggcgccggcctgggatttctcgcttcttgttcttgggcaagagagcgagctcgttagacgaggttaatg

SEQ ID NO: 31645 - DNA, 709 bp, Triticum aestivum
  unsure (1)..(709): unsure at all n locations
  Clone ID: PAT_TA_31645
aaaaatcaagctagctggacatactgatacttgtcaccaaacgagaagatcttacacacaaaaagggtgaagaacaaaactggggccagaatacagttgcagaaccaaaaaagttgaaaaaactggagccgtatgccgtgtttgtatgtagctcatgccggtcgagggacagggctggcatctgctggagagattgtcacggaccgcagtagctccagcgagctcgatagcccgagaaaatgcgagaggatggtgttggctgaagcctgaacaagaaaaacatccagagcaagaactgggctctggccagcggatatcccctggtagtagggcaccgaggaggtagtgagagcttttgctaccaaagcaccaacagtcgcctgcatcccgaggaccgcagcacccatcccgacaacgctgagtacaatactgttcctcaggtttttaaccacagccgcacgcggaggggccttttcaggctcggttgctgtcctcctgagcgttttggaaagacggatgtaaccaaatgaccggaacactggcataaaggcggcaacgatggcaagtccggtcgcatagaatgtaaagggagatgttgcattcccggtagcaactgcggagaacgacaagatcccagccgaaacggtcgtgcacaccaactagaccagaatgccagggtacccaaattcttaaataccgcgcnttttcc

SEQ ID NO: 31646 - DNA, 1072 bp, Triticum aestivum
  Clone ID: PAT_TA_31646
gtctcattaagtcaattattgatatggtctccctaggaccttttccatgacgcccaactccgagcctgcaatgcggtgtatctactactgctttatcctcttggtctcttcctccttttcttcgataacgtccgtcacatcctcggcgtcctttcggcttcgcttcagacccttcatcttgcggagctgcaactcgctaagatcctgcttgcccaagtgcacgcgaccaatcttgtcacccatggagtcagtcgtgatattcttcttggtgcgctcatcaaggccgcgaggtgtcttcatggcctccttgagcattgactcatcgggttctcggacacgaccaatacggaagtccatgcgaggcccaatctcctcaacctcgacacgtggaaggcgctggccagatcgcttagtgttgatggtgtaaactcggaggtggatcgcaggcttggcatcgccgtcaccagtgctatcctcagcgctgatggaaataatgtactgaagaccctcgacgtctatcttgtcggcaggctcgcctcggaaaaagtccagaaacatgctcttggcaagagtaaattcgttgctgacagggctttcgaatgcagtgccggcaaacagaaccatgggtcgcaggccgatagcgaacttcttagtcttgaactgggcaatggttcggaagctctcgggatcgaggtagagctcaagcatatccagaagcttgtatccaaatgtacgaacaagtgttagagtatggggacgcttcttctggctgctgccaaagacgagcagactggcatcgttcttctcggagaaaaactcgagcgaagcagcatcgtcaaaagggtggatagcgttcttcttggtgaatttcttagccaatggctggcgcatctggtgaaggtcgttgagggcgtcctggacgatctgagagcacgatgttccgcggaggaaaaggcatgtcttggggttttcgttggccttgggctcgcgcttctcgagcgcacgctttgaacgcgcattgcgaggtttgacttgacggagcatcttggcaatttgtggtattggatgtgcc

SEQ ID NO: 31647 - DNA, 561 bp, Triticum aestivum
  Clone ID: PAT_TA_31647
gagaggtgcttcagtttttagttaccctttgcaaaggctacctagtagctatacaagaatcacttaaccatcgcgtggtggttattgattcagctacacaaatggctggctggttcaactcaacgcaaaccccgaatctcgccacattcgtcagctgttattcctaagcacaaaaacagtggaaaataagaagaaaattgaaatggcatagccgttttcggtcttctaagtacgcgccagagttattctccggtggatgcagttatgcttgatttcgccgtgagcccgggaatcataatgttctcagcagtggtcttcgagtcaacgatgtcgtgttatggacaaacgcagccaagataaaaacatgccagctcctgattcagacaacgcgccaccttcgctatgtacatgtgcattgcgtgctgcttcgccaatggaaaaaatggtcatgcttttcccctcactttattcctctcctgaaccacgattttcggaccacttgccgaatgtgacgctcatgtttctctaacagttcatcaaccttgtgggtttgggacaata

SEQ ID NO: 31648 - DNA, 1065 bp, Triticum aestivum
  Clone ID: PAT_TA_31648
gtaacgatggtaggccaataattaaggtacgccaaatagcctgttagtttaaaaggactgccctgttcagaggacctccgctcccggactacactcccggagcggggggacttcctgttgaaaatcatggagctgcggtttcctggctctgcaactccggatattttgcggagctagcggaattccgaacaggctctaaatacatacatatatgttcgaacccactagcttaaacccatacatttattcaaatgttccaacctttgctcctcacacagaagcatgaattcatcctgtcgcctcattatatcctttgcatgtcatactttattttataatataagcgccatcacgatgcactttcctgtccagatggactataatgcatcaaattaggtattactgattgctttcctctcaaatgtagaaatcttgaagtttatggtttaaaacagcatctccttttatcaagatcttttgaagctccctcgcttatcaggccatatttttcggcggtatctatcttcttcttgagaaaatgcgtataaagccgagtacgtcttgggaacagcttattgagctcctcagaaatcatctttttgtaagcaccattcttaatgctttccttcgagggcaacttggcacgagatagctcaacgagatgatcaagcgtctcttctacaataactttatagtcatccacatctaggcgggcgaactcaataagatcgtagaaaagctgaacttgtccctcctggatatgcttgataacatcttcacgcttattgtttccgaaaacagtttcatacactatgtgataatacagctcttttctctgccacatcttctctccccggagcatcagttctaaacactgatcgacgccaatcttaatttggaaaaagagcatttttctgaaaccactccttgcaatggcgatagccctagcaaacaccatatctctggtttctctatatcttgttaactccaccagtttgtcaaaaaaaaatatgtactgaatatcaccttctaaggtggtaggtttatagtagtcgcagcgtggag

SEQ ID NO: 31649 - DNA, 957 bp, Triticum aestivum
  Clone ID: PAT_TA_31649
aattgtttagagatactgaatgtgcaagaactgcaccatccaaaggcgttgacataaaaattgccactaactatccaaattcaaatgttaagaaaatcgactaagagttaacaaaaggccaggaagcttacaaacaaatagcaaatgcgcgatactaaagcaaaatgaccagtgcaaggggcagcgccgctcgcaacagccaagagcaagcaaaatattatgatcaaattattggtgtaccatttccagcaaagcaatgtgtatgttcaccgacagctaatctgaatacagggctcatgctgttactttttaatcctcgccggcaaaaaattagacacaaacatatcagaacaattaagatatccgcacaaccatcttgttcttctttccggcagatagcagcagcaccttcccgtcaactatatcaccttcctcgaccaacttatcctcgctatcgatcttcatgttattcaagtatagaccaccctgctttataagccgcctagccgctgatttgcttgcgagcaaacctgtagaggcagccagatcaaccaggggagacttcaatacttggtcgtatcgtaaagaacacgacggtacatcatctgctattccctcaattgtttgtgagtccaactgtgtctgtgccccaggccgcaaggcctcagttgccttcaaggcctcctccagtccctcctggccatggacgaagcgtgtcacctcttctgcaagcctcctttgaaccgtgtttggcacatagccgggcttcttcatcgattcttccaactcatgaatctcatccaagctcaaaaatgtaaggattttcataaaccttacaacatcaacatccgggactgagaaaaagtactggtagaacttgtaaggggagagcatctttgatgagagccaaatcgccccatcttccgtcttcccaaatttggttccatcgctcttcag

SEQ ID NO: 31650 - DNA, 1159 bp, Triticum aestivum
  Clone ID: PAT_TA_31650
ggtggtcaagttgaaagcccactattcccgtttgaatgcccactattccagttaaactgcatcagcgcaaacaaagatccatggcattcacctggtctgtctgtattcctaggaaacccataggcgggtagattcccaacagataaattgataatcagatcttatacagcataacgtacaaaggttagaggacaacagaatctgtttcacagtgaactttgggagtaactatgtagattcctctaaggacccacaagtttcctgtgcacgtgtgcatggagagaatgctcgtcaccatcgtggtgatggaacacatatgtcagaaccccaacaaggcacagtactgagccaactaggaccttgtcatagcgttccacccagtgaaacttgatctggctagcaccataaaatgagagagccaccagggacgtcatcaccgtgatggtactgaagagaagtacaatgatcgcaagaatcatcatcgaggatgagttgccaacagcaagaaacactggaagagtagttgcacagggtgataatgctggtacaagtacaagaccagcgactgccatcttctccattggatgattatgggcatggctatgaccaccttttcctaacgcaaacaacagaatgtaacctgctccaagaaatattagcaacagcgaggcaagtttatgcactgtttcctcgcctgctatagtatttgccatagtaactgcagttatcccgagaagagcggttgatacaacatgaaggactgctccaaatgcagtgacgaggagggtgcgggagagcggccagcgctgggcgcgcccgacgatggagaaggggagccagtgcgtggggatgaaggagtgcagcagcgacaccgtcgcgatgcccccgatcgtcgaagcctcctccgcggtccactggaacccgcctaagcccccgccgccagcgtccatcacctgatacgccgacgcgtgacggacgccgccacccacccaccgccggtacgcgagctgcggtggcctctccccttttgctgttttacctctcgcagccgtctcgctacgtttctccggtgcgcgcggccgtgtggtggggagatctgggaggggggaaggaggcgtggagtgggaagcgggcgaaaggggactcgctgccgcctcgt

SEQ ID NO: 31651 - DNA, 377 bp, Triticum aestivum
  Clone ID: PAT_TA_31651
ggactacatggcgaggatggcggccgccgagtcgacggaggagtacttcgaggactacgccgccgccatgatcaacatgggcaggatggaggtgctcaccggcggcaacggggagatcaggaaattctgcagcgcgtacgttgactaatggagccggcggttggtcgatgtgagttggtgcgcgtgcctccatcgatcgtcatgtggacggggtcacgacggccggtgtgcccgccagccgcaaggcacttgcattattctaggggtggttagagaattgacaccgtcacaccgccacgcggcgaatcttccggtgtatgtaaaaaaaagtcgtctctttgttcttgaccgagtgcccattgagatttggcgagctg

SEQ ID NO: 31652 - DNA, 680 bp, Triticum aestivum
  Clone ID: PAT_TA_31652
tataggaggtttttttttttttttttttcatccaatcattgaattcattgagcgacttcatacccctgctttccattgccctatcacatcggggtctggcattcgctcccagttgtggcgttgaggagatttccctcaaccaagtggtgcagtagactagaacgaactctgcaactcccgctttagctgactctctggtctactccttcaaatctacaaactccatcttgagatcatcggagccagcgtcggtgagcatggcgccaagagccttgacaatatcctcctgacttgttggcgagatgatgattgaaacatcgtccgacgtcatgttccacaagtaaaacttgccacctgaagtgaagagaaattgatcccctccatcgctcaggctcaagcgcataagaggcgtggggttatccaagcctcgatacgcagctgcttgtttccctcgcacgccgtcggcccagtagtagtcgaggtccatctcgtcaggctcagttgtccacccgtccggtgcgttgatggtagatgccattgcggaaatgaagatggccaaagttgaagacgtgaggtctcaagttcgacagatgtatggatacctagattttgactgtgcgcgtggtatggttgtacagtgaagtgttaatgtagtcggtcccgacccggccggcgccggc

SEQ ID NO: 31653 - DNA, 831 bp, Triticum aestivum
  unsure (1)..(831): unsure at all n locations
  Clone ID: PAT_TA_31653
cnnnnttgtttnttattaattttttttttccaataaacttgtagccatcttaatctatatcacctaagtcaaatgatttgattgcaccacaatatctccatactacaacaccaatacagtaacatcatcatgtcaacgcgccatacatgctcttttgtgaggcttgtgccctacaaggtactacggtcaggtcctactgtacagctgggaagctaaatccaaaacctagagtagactaacaatttcccaccaatgggaagaacatatattctagccttgtagcttgatacatgtacatcttctggtgaaactacatcctgaaatccatgacgcagacagtattgttggagaagcaagctgctatcttgctgccttctttgttccagcacacttcaaaaatgccaccgctccctctgaaggtcttcaggatcctgccttctttgacggaccatatatgtaggctttgatccagcgacccactagccaggtactcaccatcagggctaaaggccaccggacgcgtgggctgcctatggccagccaagctgtacagaaggtgtcctttctcaacttcccatagcttgatagatgaatcaaacgatgcgcttgccaaaagcagctgttgattgggattatttgttcctggacctgtggggctccatctaatagtgtatatttccttggtatgctctttaaaatcatatacacatttgtcctgcttcacactccatatctttgcagtccaatcatcagaacaagaagccaacaaagaaccagttggatcccacttgatagcattaacttcactttgatggccacnaatgttttaac

SEQ ID NO: 31654 - DNA, 775 bp, Triticum aestivum
  Clone ID: PAT_TA_31654
accttaagggagcagattgatctattcaaaaatccatttctatgcgagatgttcttacaatggatcatactatttcacagagcagatcgaacgatagccttctaattttctacttaaaagcatttttaacatgagttgcattttcagttctaagttacaacagagcatcgaaccattcgagggatttgcacacggctgcagtcactgaaccgactagcatcaaaacatctaacaaacgaaccgaaacacacttgagatcaagaaaacatctcgaactgaccgggcttgcagatactgtcaatagcatggatcaattttctccggggtcctacggcaataaggcccatctctttcagctggctcattgtaagggagaccatctggtacatcccaataccttcactgtccaatattttgacaaaccatccaagaccgcaagtcaaaagccaattcctcagcccgccgaaccgagcaacccgtctctgaagaagtcgtgctcgcagtaccttatttgtgacatttgaagaaataactggcagcccaggatcatacatgtttccgagtggacttgttgctttctctgcggcttgatgggacaatccttcaacagcatgtttagtccattcagaccttacaacagcggcagcagcacttcgtgacgattctcccttcatctttgcatcgtcttgatgaacaattctttcagaagggcaagttcgagctttcttgatattggcgtcgacgccaaggccctccaaagatttcggacgcgggg

SEQ ID NO: 31655 - DNA, 1021 bp, Triticum aestivum
  unsure (1)..(1021): unsure at all n locations
  Clone ID: PAT_TA_31655
gctcgagcctcagcgatggccccgcgaccggctgcggctagtcagaccccatggctttcggcgcaattgggctacccccggccgacggttcccgccgccccagtctcccccggatacgtcggcttccccactagggcctagacatgtcggacttcatgctgcaggacggcgtgggcgcgccgccggcccagaacaagacggttacgaaggccaacctgacgggtggctccactcccacggccgtctacatgctctgcgggcgccacggctacttggcattcggcaacgacgcgccggggaacatgctcaccggcttcggcttctacgagccctactggctcatcgacttcgccaacgtgtgcatcgtggtgcacctcgtcggcgcctaccaggtgtactgccagcccatctacgccgccgtggagagctgggcggcggggcggtggcccaactcggagttcgtcgtccggcagtaccaccccttctcgggcaagttcagcctcaacatgttccggctggtgtggaggacggcgttcgtgatcgtgagcacggtgctggccatctcgctgccattcttcaacgacatcctcggcctgctcggcgcgctcggcttctggccgctcaccgtctacttccccgtggagatgtacatctcgcagagcaagatgaagaagtactccaggaagtgggtggcgctgcagaccctgagcttcgcgtgcttcgtggtcaccgtcgccgtcaccgtcgcctccatccaggggatcacccagtcgctcaagaactatgtgccgttcaagaccaagttgtgaaatggattagcttagctgtgagtagaaatcctttgacttggtgtttgtttaagtttttccccgagaaaaaggtgtcctccggtagactgtacctgtgtgcttagatgtttttagtgaagggggatcccaggggggaggcctgggaggacatggactaccaaccctgatgcgtgaatcncgttcctcaagcatgacaannnaaaaaaaaaaaa

SEQ ID NO: 31656 - DNA, 695 bp, Triticum aestivum
  Clone ID: PAT_TA_31656
acttatatattcttctcatcgtaaatacttaaaacaacatgggatctatgtacctatgccaaacccatcttgagcaacctgtttccaaattcaatcaaataataatccccataaaccagtccatgatcccagtatcttttgtaatcctttgcattgtgattcgccgtagcgttcttcagaatagcctcaaaatgactgttgggctccaagtcctggacttgaaaggttccgtcgagttttagcgcaaattttgacttctcttgtgatagagaaaagtcaagtgtgtctttgacgattctaatagccatcaatcgatacctttcgctgagttcgtacgaaccactaccggccaaagcttgtgagagcaccagcataccgttcgccgcaataatacccgcagatgagtctcgcaatggagcagaggtatcaatgggcgcatcaaaatcccaaagtggtacataacggcccttggtgcggttctcgccgggtataggtacctcgacacagtcgggggacttgaggagtctgaagatgaagtactcagcaagccctatagctgcatcgaggaattgggtatccttggtccagttatatgtttgcgagtatccgaggatgccccaggcttgtccacgggcccaggttgagtttgcggcgtatccttggccggtcctcttctccttgaccggacgcgtggg

SEQ ID NO: 31657 - DNA, 789 bp, Triticum aestivum
  unsure (1)..(789): unsure at all n locations
  Clone ID: PAT_TA_31657
ggcccgctcgaggcnncggccggcgctagaggccggccgggcaaaggagcaaatccaagacacacacacacacacacacaaactagcttagcaggttgtcactgatcaccgtggtcgacgagaagacgacgatggcggtaaggctgatgctggtggcggcgctgctgtgcgcggcggcggcggcggccgcggcgcagcaggcgaacaacgtgcgcgcgacgtaccactactaccggccggcccagaacaactgggacctgggcgcgccggcggtgagcgcctactgcgcgacctgggacgccagcaagccgctgtcgtggcggtccaagtacgggtggacggcgttctgcggccccgccggcgcccacgggcaggcggcgtgcggcaagtgcctccgggtgacgaacccggcgacgggggcgcaggtgacggcgaggatcgtggaccagtgcgccaacggcgggctggacctggactgggacaccgtcttcaccaagatcgacaccaacggggtcgggtaccagcagggccacctcaacgtcaactaccagttcgtcgactgccgcgactagatgaaatgaaagggtaagcaagctatgataagaataaaaggctagctagtagcgggctagctacgagtgagcactgagactgatccatgctgttgaataaaagctaccacgtgttgctgcattgtatacgtgtatacagtacgtacatggaaggaaataaagtggatcgttttcatgtttgaattttactacaggcccctaataaaaaaaaggcccc

SEQ ID NO: 31658 - DNA, 794 bp, Triticum aestivum
  Clone ID: PAT_TA_31658
gccggccgggtcgggatctctatataaactcatcatccgccgcagggcaggtcccatcccatccagtttcagctagcaacacgtcacaaacacacaaactagctatagcaggttgtcactgatcatgacgatggccgcacgcctgatgctggtggcggcgctgctgtgcgcggcggccgcggccgccacggcgcagcaggcgaccaacgtgcgggcgacgtaccactactaccggccggcgcagaacaactgggacctgggcgcgcccgcggtgagcgcctactgcgcgacctgggacgccagcaagccgctgtcgtggcggtccaagtacgggtggacggcgttctgcggccccgccggcgcccacgggcaggcggcgtgcggcaagtgcctccgggtgacgaacccggcgacgggggcgcagatcacggcgaggatcgtcgaccagtgcgccaacggcgggctggacctggactgggacaccgtcttcaccaagatcgacaccaacgggatcgggtaccagcagggccacctcaacgtcaactaccagttcgtcgactgccgcgactagattatgtatccgtcgatcaaaggctagcttgctatgataagaataagaggctagcttagctacgagtgagctcagactggtcgatgctgttgaataaaagctagcacgtgatgctgcattgtatacgtgtatacaatacgtacatggaatgaaataaagtggatcaaatcaaacgggttatatactaaaaaaaagaaaaaaaaaaaaaaaaaaaggcccccta

SEQ ID NO: 31659 - DNA, 945 bp, Triticum aestivum
  Clone ID: PAT_TA_31659
gcacccgaccccctcctccccctctggtacgatcaccctcctctgctccgttgacgaagacggccgcacacagccagcaacacgtcacaaaccctccagcttcagccagcagcaagtccaatacacacacccacacaaactagctagcaggttgtgactgatcaccgtggtcgacgagacgacgatggccgcacgcccgatgctggtggtggcgctgctgtgcgcggcggcggcggcggccacggcgcagcaggcgaccaacgtgcgggcgacgtaccactactaccggccggcgcagaacaactgggacctgggcgcgcccgcggtgagcgcctactgcgcaacctgggacgccagcaagccgctgtcgtggcggtccaagtacgggtggacggcgttctgcggccccgccggcgcccacgggcaggcgtcctgcggcaagtgcctccaggtgaccaacccggcgacgggggcgcagatcacggcgaggatcgtggaccagtgcgccaacggcgggctggacctggactgggacaccgtcttcaccaagatcgacaccaacgggatcgggtaccagcagggccacctcaacgtcaactaccagttcgtcgactgccgcgactagattacgttctccgtcgatcgatcaaagggctagctagctatgataagaataaaaggctagctaaaagtaagttgagactgatccatgctgttaaataaaagctagcacgtgatgctgcattgtatacgtgttacgtgtatacagtacgtacatggaacgaaataaagtggaacagaccaaacgggttatctattcataaaaagaaaaaattgtactactaccagtttactgaagcttctccaacagctcccgtaaataactcctggtaaaaccatttttacgggtttccgcaaaatttagtggaagttgacggttgaggt

SEQ ID NO: 31660 - DNA, 822 bp, Triticum aestivum
  Clone ID: PAT_TA_31660
gcacgaggagaagactcaggtgccagatttgcctcgcctgcatccagttccacgcgcgctccgcttcagctaaccggcgatgggagccggaattaccgccggcgccaccgcccgcctcgtcgtcgttccgctcctgctgctacccctactcctcgcgcgcggcgccgaggctgtcagcctctggcggccgccgccggaggccgggctcctgggctccgccccaggcaggttcctgacgcaggaggagcactggatgagccaaaccctcgaccacttctcccccaccgatcatcggcaattcaagcagcggtactacgaatttctcgattaccaccgagctccaaatggcccggtcttcttaaatatatgtggagaagcttcatgcagtgggatttctaacaactacttagctgtgatggccatgaagtttggcgctgctttggtttctcccgagcagccgtactatgggaagagttccccttttgaggatttgacgacagaaaatctaaggttcttgtcgtcgaagcaggctttatctgatttggctgttttccgccagtattatcaggaaacattaaatgccaagtataatcgctcaggagtagacaattcttggtttgtgtttggagggtcgtactctggagctctcagtgcttggttcagattgaaatttcctcacttaacatgtggaagtcttgcaagttcaggggttgttcttgctgtttacaactttactgacttcgacaaacagattggggagtcagctggtccagaatgcaaagaagcacttcaagaagtaacaaggcttgttgatggacaact

SEQ ID NO: 31661 - DNA, 1372 bp, Triticum aestivum
  Clone ID: PAT_TA_31661
ggctcaaaataacacttcaaaactacgaaactgtaaatcatgatacgacaaggcagatcttatagccacgattcaattattcctacccaaaccaacgcatcagctactactgcatctcacagacaataccaaacagaaagaaagctatagtatcatattctcagggcagggaagaaagctatcgtatcatattctcagggcagggaaacccttttgtgacggcgaaaacgtgccctggactgcagaacttgcgctccgatgcttcctccgtccggcgcggaaccgagaatgaagcaccatcactgcaaatatttgctcttcttccctgcatagatggccaggaggtatatggcggcgcaaccggcgacggtgccccaggtggtctcccagaacttcatgttcttgatcctcgccatctcgggggtctccggatccgccatcagctcgatatggatgttcatgccaaacaagctcacgacgacgatgcccgcggtgaccaccacggtcgccgtggtgagcatgacgcccatctgcagcagctggttctgcttcttgtccaacatcaggttgatgtagttttcagtattgtccacatagtcgcggagatggcataacttgttcagcgtgccatcgaactccacgaagtaagcttcaagaagcatttccaactcttcaacatgcttaacacaagcagaacttcctgggagctcgccgtatcaccgccacggtcttcttcctccttctcatgatcatgatcatgatcagggaatgcatgcttgttggaatccacattaacggacgactcgttgttgactccttgaaacgcaagcttcctcgtcagatacatctcgcacatatccgtgtcgtcgtctagcaagtgctcgatatcatccctcaccttctgcacgcggcctgatagctggaccaggcggttcttgatctgcctgacgtcatccaggttgctcgtgctaaccttggtggtcagctcgtccaaggccggatacgcctcactctcgaggaccgacgtctcggtttccatgcacttggatgtgtgttcgaggcagacctcgagcaccttgaactcgaagggcgggatcttggcactaccggagattggcacgttgccctgatcgtcgccgccgtcggttgccggattcgtggtaaccgcatccgggagcgcgaggcgggcgtggagttcttggaggaaggggcggaggcgcgggttgctggggtcgcggacgagcacctcggcggcggtgacgatggccctgacgtgctcgaggttgacgacgatggcgcggtcgcggccgaggatggtggacgggtaggagaggagcgggtcgagcatgcggaggtcgcgggccgggagccc

SEQ ID NO: 31662 - DNA, 1040 bp, Triticum aestivum
  Clone ID: PAT_TA_31662
gaattcactaagtgatttccgagcggccgcccgggcaggtttttttttttttgcaagaaatctcagaattttagacatttggcggttcaaaaccggcagtaagaagttcagaatcaacatttgtaaacttatgatccaaacattacatgctaaactgaattttgtttcgcaagtaggaaataccactctagcatttgcaaagtacagtaccatgtttagtactgatctgaacatatgatccaatcagtaaaccccaatatgatccaaacattacatttagcatttgtacactgaattttctttatatccaacatagtctagtagatgtgcaagaaatgcagaggtaatagttttctcttctcagtctttagcttcagtattgctttccgctcctcctccaaggtcatctcctatataatggtggccagagcacatgttatttcattaacaacatcagacatgacaaacatcagaaagagtgcaagcatgccaataaactaagctagagaaaccaaattgccagtcacttgatcagctttgccatagcttagaagctcaacaacatcgacaggaagaaaaactgcacacatacacaagaaagtgtgccacctacctacttttaatttctactatcagtcttagttatgaaagttcatttgtggatgataacaggcatagaaatatgtagctaatgctacaaaatatgtagctaatgctacaaaatatgtagctaatttcttcaggttacaacgccaccatttcttcaggttacaaccctaaaaatatcagccaaatcgtcagagatgtcaccactgaagatcattcgttagatattttttgttatctactcgtatttgtttcactttgctactggactcaagtcttcatccagtcaatctaaaggttaacacatacactgatcacttgggtagaatctgtttgtttctacccgcaaaaagaaagtatccatttgtttgtttctcttcgctactgaactcagacttacttgggtcaatctagaagacaaccggacgcgtggg

SEQ ID NO: 31663 - DNA, 1146 bp, Triticum aestivum
  Clone ID: PAT_TA_31663
gaattcactagtgatttcgagcggccgcccgggcaggtgagagaactagtctcgagttttttttttttttttttttaagcacatgttctcatcaacaatttattcagtacgtttacataaatcctgggcaatgtcaacagaccaaaaaactgcactagtatatcagccatcaatcgatctgtagctgccatcaggggtgcacgggcttactccagttcacggacctccggcaccgcgcgggcaccgtccatgtcacattcccgcccgccttcttcctctcctccggcgccatgcgcgtgtacctcttccagtcggcggcgacgtccttgaggtcgtgcaccttgttgtccacgccgacgcagcagtcggcgtgcatggtgcaggcgctggcgaggtcgtcgtggtactcgcagaacccgccgacctcgggcggcgaccaggcctctacgagtaccccccccgtctggacgagctcgcgcttgatgttgtggaacaccgactggtcgtgtgcgccggggaacctcgcccgcgccgccgagtagtcgtcggaggacacgctcatgtccgcgtacaccgggatccgccggaacgggttccggagcacgagcatgtcggtgtcggtgaagaggaagttgtagccgagctcgaggacgcgctgctggagctcgagcttggtccagaccagttcgaggtactgcctggacatgaaccgggcacggaggtgaggttcacggtggtcacctcgaggaggtagcagtgcgggtgcacggcgacgcagcggcggaagccggcggggtcgagggcgacgacgaggaggtggtcaaggaggtgcgcggtgtcctcgccgttgttgaagctctcgaggtagaggtcgaggagggagcccggccgcgcccacgcctcgttcaccgacgtgatgatcaccgtccggtcctccgtgcacaccttgggcagcagctccgcgagccccgggaatctctccaccgcatgttccagcggtgcaggcgccgccccggaagatccaccgttgctgtttcccagccagctgccggagacaccggacagctgctcgcccacccggtcggaggccaagacgaagaggaggaccgtggcagaattcccccgacgaggaaccggacgcgtggg

SEQ ID NO: 31664 - DNA, 1011 bp, Triticum aestivum
  Clone ID: PAT_TA_31664
ggcacgaggttttttttttttttttttctgtaatgaaaaactggaaattttcctttttacatcacacactcaacacatcaggttgtcaaaattgtcagggaaagatattcccaaccatgaagactgggcttatacatgcagctacactgtaacagatattacatcataacaagattacatcccccaaatttcgttgacgctgtagaattgaatgtataaaccataagaaaatgtccttggaagcagcaacaatgattgcccaatgcatcagtcaagggggcgagtcatcaaactttgtctcggctgatgggttaaaaagagtgctggtactgatcactgaagatcatatcaagtgtgcctgataatccaagatagctgccatatccatgagtacatcattccgacgccacagtacactgaaaccatcatgagaggtaggaacggaagtctatccccaaatacatggtgatggaatagtcgagaccagaattctatagcaaacattcctagaagatatcccaaactgatccatccagtgaattttttctcgactatgctgtctgatgcatctaatttcttccctcccggagcagggtttgcagcgaaatgggttgaaaaccctacccacatgagagcactgtaggtcaacagcagcagcacttttattgggtattcttggtcctcaaacagcaatgggaacagagagtagcatgaaactattgacaataagaagtaatgtctgatgtcgtccaagctatccatggcaattagggcaagtgggatggtgaaatgaagtgatgccttctcatgtacatgccatccaaacataaacccacatgaacaagcatatgccacccatctaattatgtgtttcggttgggggttagcgaatgctttgacaagacaaggagtcatagcaagtataaccaataagaaggtagttattggggtgacctgcaatccataaggttcaaataacaaagtttatcaaactatagagttcaacattct

SEQ ID NO: 31665 - DNA, 515 bp, Triticum aestivum
  unsure (1)..(515): unsure at all n locations
  Clone ID: PAT_TA_31665
aggggagcaaagttctaaatcaagaccagatcgagcattgcaattcaacatagagtgggggcagcgggatgattgaaatgaaaagtcggaattcaatccaacaacactactagtacttctatgcgctaagcatcaaccaagcttattacattccacctacttcactctgcaacctgatgctaattaaggctattgcccggtggcatgatctagctggaactagaagaggagcgcccacaccagtaaaagcgtagccagcgacacctgcgccggcgctggagctcccgagaacgtcagctggccaccgccgtcgccatggatgtcgtaggtcatcgtcctgccggtctgcagcaggctgcctaaaacggacccgccggtggtcgacggcagtatggtgaggcacgtctgcccgccactgacgttccanaagtagttctgcgccttgagctccatcctcaggtgggcgccggggaacaccagggccagcttgggaaccttgaacttagagaagtgct

SEQ ID NO: 31666 - DNA, 835 bp, Triticum aestivum
  Clone ID: PAT_TA_31666
acaatccaacaatactagtagtacttctctgagcaatctgatgctaagcaacacccaaggacggttgttacattccacctccttcactctgcaacctgatgctaattaaggctattacccgcatgatctagctgggagtctgggactagaagaggagcacccacaccagtaaaagagtagccagcgacacctttgccggcgccggagcacccgcgaacgtcagccggccgccgccgtcgccatggatgtcgtaggtcatcttcctgccggtctgcagcaggctgcctaggacggacccgccggtggtcgatggcagtatgctcaggcacgtcgtctgcccgtcagggacgggcaagaagtagttctgcgccttgagctccatcgtcgcgtgggcgccgtcgaacaccagggccagcttgggaaccttcagcttggagaagtgctgcgtgaggaagcacaggctgtggccggacgtagcgttcaacggagccaggccctgcaatcggatcctgctcatgagctcccgcctcagaaccttgtacgcggcctcctcgaggtaggtgaatggcagggtggtgctgaggaacaccccgccggagccgttcgcccggacgtcgaaggtccccgccgggatgtcggtgaggagctgcccgtccacctgcaggccgatgaggttgacgtagtacaagtacaagtgagggtcctggttgggcctggccaccagcagcggcgtgtggctgcccttagctttggggtggtctgcgactgcccagctcaagctaacgaaggccttgccgttgtcggggtcgtcgcccacgcgtccgcggacgcgtgg

SEQ ID NO: 31667 - DNA, 792 bp, Triticum aestivum
  unsure (1)..(792): unsure at all n locations
  Clone ID: PAT_TA_31667
ccccccctntngtttttttcagatangaccgcttgattattatcncaggatgcagataaaaacgcttgattattatcccgatggtttagaactacaaagcttttgtgtgacattctggtgatcacctttatgaaaaagaggaagcccaggcccaaacttaagcgggcatattatatagcaaacaaagaaacttctcagtatttctcgctatgtaaatactattattatgtacaccactaataaccatttcacggcgctaccaaactgatgctctgctcaagcaaaaccagaactatatatctgaagtgatgcatcactggattattaagctacggttttccgcaatgtcgtcgagccaggtgacaagctgctgcgacgtcggccttgacttgggggcagcggttacgcagaggcacgcaatctcgagcaccctcagcagctcgccttcattcgccttgtcatgcacattcgggtggaaaacctcagtctccctgtcctctttcctcatctgaagcacccacgacacgacgtccctgctccccttgggcctgcacatgtccacaggcctccggccggtgagcagctccagcagcacgatgccgaagctgtagatgtcgcccttgtaagtcgcgatgggcgactgggcatactctggaggaatgtagcccagggtcccaacgacatcggtggtgacgtgggtgtcgtatgcgcagacgagcctcgccagtccgaaatctgccaggtgagcttcaaagttctcatccaggaagatgttgcttgacttgatgtctc

SEQ ID NO: 31668 - DNA, 653 bp, Triticum aestivum
  Clone ID: PAT_TA_31668
gaacacaaacaactctttatttttcccacagaaaagtctttatttcaatgttgtttcaaattttagatccacacacacgcatcaatctaattaatgtccaccaaattaaacccacgcgagttcatgtggttcgctggttcatgcgaatctcatggggtacacgggcaatttgttggggtagaagagcccaaagttcctctccgtctcatccccgggcttcatgttctcgttgaacatggcgaacacataggcctcgatgggcccaggcctcttgggtgtgccgcgggccacatggtcgatcaggccctggttgtatgcccgcgcgttctccggcgtggccgcgaacccgccggccgacggccacccggtctccgacaccacaaccctcacggccggcgcccctgccttctcaagcgccgcgtacagggcgtcgatcatggcgtcgaagaggttggtgtacatcagcccatttcccgcgtccctaaccggcgtcgcgcccggctggaaggttgcgtagttgagctggatgtcgcgcgggctggtacggtaggcgatgtaggggtacacgttggcgagcagcggcgcgccggtggcggccaggagccgggccacgtcgcccatgtagggctgcgcgaacacggcggcggagggcg

SEQ ID NO: 31669 - DNA, 1202 bp, Triticum aestivum
  unsure (1)..(1202): unsure at all n locations
  Clone ID: PAT_TA_31669
cctggtngaagcactggggcgactatgtccgatgatgaagataaccaagtggatagtgagaccaacatgtttgatggaaacgatgggtcagatggtatgggctttggtcccctgatattgaccgagggtgaacggtctttgattgaacgtgttcggcatgagctgaagagtgagcttaaacaggggtacaaagaaaagctggttgatatcagggaggagatcatgcgcaagaggagagctggtaaacttcccggggatactgcagctacattgaaagcctggtggcaagctcattccaagtggccgtaccctaccgaagacgacaaggctcgcctggtgcaggagacggggttacaactgaagcagatcaacaattggttcatcaaccaacgcaaaaggaactggcacagcagcaacacagcttcctctagcgaaaagaccaagaagaaaaggtaatgacggcacctgcagatcgtggtagactgggccccggaagaaacaaactagatgtaaactatacttttatcatgaagatgctgcagtacatcctctccctctctctcttctctctcttgtggggcaactagatacgaagacaacgtgttcacaagccatgttcaaggaggcagtcattggcaaagaagtcatccatagttgaccaaaagtggtagtgacaacgggcgtacagtgtgagtgttttgctaatgtaatttgtataagcccgtgttgtataaccgaggaacggaagggagcattgtgttggtgtatgtacttgtatattcgattcatcttgtaacattatgttagacaaacacggattgggtgttctgtgggtgtgacatacggtgtggcacggtctgaaacgaaacctttctgtttaagcggctctggtaggcgtantacaatagtattgtaaactcanatacggtgatcacttgcatattacctgtaaagttgtggctccgcaaggtgcaagtcaaccgttccgcccaaggtataaactgtaataagagcanaaaagtagtttgnatnaantgctgggtgaataacaactgagtttttccaaaaaaangggggccggaccaatcnccaaatgngccatanccncnaaggcctccttaaantcttacgggaaaccgggtaccaattaacccttaaaaaccttccacnggtaanaaangccccattcctccaaatccacc

SEQ ID NO: 31670 - DNA, 969 bp, Triticum aestivum
  unsure (1)..(969): unsure at all n locations
  Clone ID: PAT_TA_31670
gaattcggcacgaggttgcgcctcccctccccccgagcgcctccgcccccgcccccgcccgcccccctccccctcgccacccggcgacgcggcgacggggggctcgatgtcgttccactacccggtccagcggctcccgagggacgctgcggcggccctcgcgcccggtggctcccccccaaagacgacgacaagccccggctgctgcaggagggggggttacaactgcagcatagcaacaattggttcatccaccaacgcaaaaggaactggcacagcagcaacacagcttcctctagcgaaaagaccaagaagaaaaggtaatgacggcacggagcaatcgtggtagaccgggtcccagatgaaacaaactagtatgtaaactatacttttatcatgaagattgctgcagtatatcctctccctccctctcctctttctttctggtggggcaactagatacgaagacgacccgttcgcaagcaagttcaaaggcaaagaaggtatcaataatagttgaccaagggtggtagcgactccggacgtacggtgtgagcgtttggctaatgtgttttgtggaagcctgtgttctatgaccgaggagcggaagggagctgtttgatggtgtatgatcttgtatattcgatgcatcttgttacattatataagccgattaggggttctgtgggtgggatgcacggtgtggcatggtctgggaacgaaaccgttttgtttgagatgaaagaaaagcggggaaagataaggtatgcaggtagttgcgctagaggaaagctggcgaacttccccgggatactgcaactacatttaaaacctgggggcaaacccatcccaaggggccctcccctaccgaacacgaggatgttgtgggctccgctcaatgggtcatccgttcctgccttgaaggtgacattacaatgttaataagatantatatgttntaaaaaaaaa

SEQ ID NO: 31671 - DNA, 791 bp, Triticum aestivum
  Clone ID: PAT_TA_31671
tttttttttttttttttttggagaagaagcaacttgtattattaggagagcatagaacaagcaaataaattgttaaaagagattgaagtggatactaggttttctatgaaatgtagtacaaatcaatccttagaaaaaaattgtacgaatccaatcctgcaaaaaacaacagacctgaaacccgtgagatcttgcaaccagctcatggttctcgcacgtggatcatgcacccttgtccatgactagttctttggtgatatttcaatctttcaggtctctttttacggactcctcccatgtgaagtttagtctatcccgacctcacgtgacattagcaacacactttaggcgtctgctatgcactggagtttctggaggcctgctttgtatatgactaaaccatctcagacgatattggacaagcttctcttcagttggtcctaccccaactctatcctgactgtatatcatcattactggctcgatccttccttgtatggccacacatccatctcaacagccaacactcggtgccatagaacattacaagtcgaatcaccgtcctataaaacccgccttttagttttttggcactctcttgcaagtcgaattgtatgcatacataatggaattgaaacaactcaaatgaaaataagtttgctgtggtaagatgggaaatgttcagcctgacaaatttattatccgcacttatctcacagaaagccacatttttaataggtggtaaattttagataaagcgcagaagaagaaactgaacccgctgatgagta

SEQ ID NO: 31672 - DNA, 643 bp, Triticum aestivum
  unsure (1)..(643): unsure at all n locations
  Clone ID: PAT_TA_31672
gagctactacattacttgatcttggtacatcagatattttagaattttccaaactagcacacaacatgactcttattttctctaaataaagcacctagcggcgtgatgttcttgggcaaatcaaacaacaaaagaacgctgctagacagctgacgagttctggacgattttcacaagatatagcgtatcaagctgtccatgcgttgagaaaagtgaatatcagtgttcaactaaaagtcggtgccatcggtgggaagctgctggtggccgggccggaccatgaacaatccctcatatactagccccgcgagcaggccaccgaccatcggcccaacccaatagacccactgactggcccaattcgccgaggcgagcgcgggcccgaatgaacgtgccgggttcatagacgcgccggaaaatggccctccggcgagcacgttggcgccgacgacgaggcccaccagtagcggtccgaggttgccaacgctccgacgcgggtccacgacggtcgcgtacaccgtgaagagcaccgagaaggtgagcacggcctcccagagcaccccctgcggcgcgcccaccccggcggccagcgcgtgcactggcatggtcaccgcgccnccgttgaggaaggcgaggaggaggc

SEQ ID NO: 31673 - DNA, 1784 bp, Triticum aestivum
  Clone ID: PAT_TA_31673
gtaggggccttttttttttttttttttgcgatagaaggcaaggaaagccttattacatggccaagataagagtgcatatgatacatgtagagtgaatcattctcaaaaacaaatatgtagtgaataatgtgtatatggtgatactactacgaagaggtcgcctgtagcttaatttgagcaccatgcatgggacgcaacatcattacggtatgtggcgcatgtgtatacgacggcgcgagctcaaactcaaaacgccgaagaatcatgcacaatgccatcttggcctcaagcagtgcaaaattctgaccgatgcagatccgtggcccccatccgaaagggaaaaatgctcccggttccttggacgccttggagatcccctccgcgaacctatcgggcctgaattggtggacgtcgtctccccagatgtccttgtcgtggtggatgtgcagcacggacatctcgaaaatcacgccaggcgggtatgtgacgcctccgatctcaatctccttgtatgtctgtcgggtgaacgcactagccggtgggtacaaccggagaacttcataaagaatcattgtcacggttttgagtcgattaagaccctcgtagtcaagcttatgttttccaaataggccaagaacctcctcccttgcacggtcctgccactctgggtgcatgctaagtacgaccatcgtccatgtgagtaatattgatgtcgtctccattcctgcaaagtagaacaacttgcactcctctattacctcttctatggacattccaggaatggattggccattttcattcatgtctgtcttgtttgactccagcaataagccgagtaagtcatcgtttgtgctctctccttgcatagcttgcatccttttcccaattagacctcgtagaatggactctatctcgttgttaatttgacgcatccttcgattatttttagtagggaaggacatgtaaccgggaatcataatcttgtgaatggctgccatgaaccgcccgacctgctcagactggagttgaaaaatccttcttccttcgagataactgctgccgaatgcggtgcgtgagatgacatctccggtgaggctctggagttctaaggaaacatccacctcacacgagccgtcgggaccaagggactgtgtccatttgttaacaagctcttcacaacacaaagagaaggcgggcaacatgatcttgagcttctcgacatggaacgcagggttgagtatccttctgtgcttgacccatttctcgccctcgtgggtcgccacgcctacggcgaggagcttggacagcgccgggaacttgaccttctggatgtgcccaaacttgttggacatgatctccctgaccaggttaggatcggtgatgctcaccttgggaaccggaccgaaccaggagatgcactgcttgccgtgctcctggacggtgctgtagaggaaaggcatgacgtgtgcgccgatgtcgtggcagcgcagcggcagaggcttggaccatgcctccttgttttgcctgccgtagtcgctcatgtcgccgaggaggaaactgtaggacgtcccacgaaggccctgggcgcgaagagcccgctccaggcgcctcggccgccaccatagctgctctagcagccgggtggttggccataggacaggagcgccaagcccaagaggccgcaggcgaggtagctccacggtagtgctgctggactcagtaccgattcaagattcattgcttccctctcgtgggcgtgcttggaaattggaatggattggatt

SEQ ID NO: 31674 - DNA, 1033 bp, Triticum aestivum
  Clone ID: PAT_TA_31674
atcctatttcctcatccagatcaatggcgtcccaaatgtcatcggcatgggccgctgtcgtcgtcatcgtctcctccctcctcgccgtcgctctctcgcatgatgaaggtggtgggcccagcttcgggtacacgccggggacccccgacggcccggagaactggggcaagctgagcccggcatacaaggcgtgcggcgacggcaaggcgcagtcccccatcgacatcggcatcgccaacgccgtccccaaccccaacctcgacaccctgacccgcgtctacgccccctccaacgccaccctccacaacaccggcaaggacatcgtcatgagcttcgagcagggcggcgagcccgtcatgccgggctccatcaacgtcaccaccgccgacggcaccgtcaaggagttcaagttgaagatgatccactggcacgcgccgggggagcacaccgtcaacggcaagcgcttcccgctggagctccacatggtccacgtcgacgaccaggaccacaaggccgtcatcggcatcctctacgagatcggcaaccccgaccctttctacgaccagctgacggagaagctgcgcgagctcaagacgacgcccaccgtggccgccggcgtggtggagctcaagtcgctgcagaagcggacggggagctacttccggtacatggggtcgctcaccacgccgccctgcacggagaaggtgatgtggaacattctgggcaagggcagggagctgagccaggagcagttacaactcatcaccgcgccgctgcctcaccaggacaacaggccgccgcagccgctcaatggccgccaagtcgccttctacaacccgccaaacaccatcatctccatccaatccctagtactccctccctaaactaatataaaagcttacatttgtttacagagggagtacaataagcaagacatagtacatactccctcctcggttccacaatataagaacgtttttgacactatacatgtcaaaatgagtaaacatctaccagaaaaaaaatcaggagg

SEQ ID NO: 31675 - DNA, 896 bp, Triticum aestivum
  Clone ID: PAT_TA_31675
aacatattgtattgtcagcattaatcaaggtatcattcgcataattatagggctatccttcttctcttggtcagccaagcagacagatagatgatcaatgattctcatccaaagccccgcaaaattcatcaccaaaaaagaacttttttttctgtcttcgttgcagaagaaacaatcgtcatctctagtggcagccgtctatctttagcggagctctccaatgcaaaagtaccgtaacgaggtctccggcctcgatcgttatccgatcaccttctaccaactaagtcgtagcaacaagaaaaagaagaccgagggaaaacatccctttcaaaaatgcaagcccaaaaaacaaaaaaggtaccggaaaaaaaggttcaaaaatgcgaggcatctcttggatgctgaacgaggatcatgtgatgtggaatgccgtaaaactcccaactcatttcttcgtttagtcgacctgcttctcgcagccaatgcgacccagcaactcctttcgatcgctgtggccgggtaggctgactccagaactgctggcttgcttcttgacgcccgatcggcgctcccagttgcgaaggtcaagcgcctcgacgccgacttcctcctccaaaggctgggcctcctcgtaaacaaactcctcctcctcttcctcctcaccaccctcgtcgtcacttcggacatcctcggcatcgccacccttgaggaccttgacaatgacgcggacgatcattgtgaaccagccgatggtgatggcctggaggaagagaagagggccgaggaaaccccacttgacagtctcgttgtaacagacgaggccttgagggttgatgaagggttcgacgaggtatccccagccagctggagggttgagaggaccaatcatgttctcg

SEQ ID NO: 31676 - DNA, 546 bp, Triticum aestivum
  Clone ID: PAT_TA_31676
tttaatatattcacatacacatgagggaaacaaaacgctcaaaattaacggaactgtaatcgatcccacaaacttaaaactcctttcctttgggggggcaaacagacaccaggacaaggtaagatgcaatgaaggggacgaccattgacaagaagccgtcataggtaaaagctgctgagccggtgtggggcgtgtcattctccttgaatttttcagtcagaccctgcatagaacaacacagcagcgaaaaatccatcagcaaacatttgaaactttaactacattgttgattattaattggggaagtaccttcacaaccattcccacccttcaagatcgaagccgaaatgcaaaacaaaacattaattagttctgtaagtatgttatagagtattggctgaattaaattactttgggtgggagatatacttgggactccatatacttactccacaaagttgtcgaagtctagggcgccgcggggggaaacaccattgttgtagttagctatgagaagatcaatgaccgaaggtggcaccgcgtatc

SEQ ID NO: 31677 - DNA, 742 bp, Triticum aestivum
  Clone ID: PAT_TA_31677
cgcgtgaaaatcagagacgttgctattttttgtttttggtccgaaacccgaaaaagaccattgatttcatgctagtgtattgagcaaggaaggtgaaagcatagccttcaatccccctcgtcgagtccagatagcccccgcgtccgtagtaaatggacgcacccgcatgaccaccgaatgcacgcagctgcagacataacagcagccgctccccaaccagcccgaggatatacacaagccaagccatgaatcgtttatttctccttcttcgccttggcacccttgacctttgccgtacctcggagggtcttttgtcggttcttgcgctgcttgcgctgctgtcgggaagcacgctcggccttggtggcgaggccaacgcgcaccaatcggtactgaggctcgaacttcttcatggcctcgggggagtcatagacgagagcgaagccggtggtcttgccaccaccgaactgggttcggagaccgaagacggagatctggtccttctgggccttgtagagggaaccgagcttctcgcggagctcctccttggagatgttggcacggttggggtggaggatgtcaacgaccatctgcttacggcccagcagagggttgcggatgaacttgcgagttcggagggtgacgggagagtcgttgtccgccatttttgccgattgtcgtgatggtctctgggtgtgttgacggtggagagactgggcgttgggggtgagcggacgcgtgg

SEQ ID NO: 31678 - DNA, 922 bp, Triticum aestivum
  Clone ID: PAT_TA_31678
aaaaattttattagggggaatggttccagttaggggccttttttttttttttttaggggccttttttttttttttttttgcgtgaaaatcagagacgttgctattttttgtttttggtccgaaacccgaaaaagaccattgatttcatgctagtgtattgagcaaggaaggtgaaagcatagccttcaatccccctcgtcgagtccagatagcccccgcgtccgccagcaagtccctgtaccctatgccaaagccggcgccgacgacgaggatggaccgtagtaaatggacgcacccgcatgaccaccgaatgcacgcagctgcagacataacagcagccgctccccaaccagcccgaggatatacacaagccaagccatgaatcgtttatttctccttcttcgccttggcacccttgacctttgccgtacctcggagggtcttttgtcggttcttgcgctgcttgcgctgctgtcgggaagcacgctcggccttggtggcgaggccaacgcgcaccaatcggtactgaggctcgaacttcttcatggcctcgggggagtcatagacgagagcgaagccggtggtcttgccaccaccgaactgggttcggagaccgaagacggagatctggtccttctgggccttgtagagggaaccgagcttctcgcggagctcctccttggagatgttggcacggttggggtggaggatgtcaacgaccatctgcttacggcccagcagagggttgcggatgaacttgcgagttcggagggtgacgggagagtcgttgtccgccatttttgccgattgtcgtgatggtctctgggtgtgttgacggtggagagactgggcgttgggggtgagatcgtttcgttgatgaagttgccacacccggcagggccccgagcccggccggcccggc

SEQ ID NO: 31679 - DNA, 703 bp, Triticum aestivum
  unsure (1)..(703): unsure at all n locations
  Clone ID: PAT_TA_31679
ttgggcgttttggtttccgcccccccccgttctttgcccctactcgtgccgccccccgcntcaatgcagcaaggtcccatttcaaaccaagagttatttgaaaataaatgcttgataatttggcaatgataaagatgcttttaataatgaaaaataaaagaaacatagcctcaaactatgtaatagaataatgtgggcattctctctatacaattttgctatgttagttggaacttaggaatccaggtcacgctttgtccttgatgcattgttggtaaattctcccctcccactcctctgggtccatagcattttgtccttcacagcccctttataggttagatgcattgtaattcctttattttttgaaggacctgaataaacaatgccttgcaaaatgtttgtcgtctcttcagtgatggagccactccctgccatctcttctttttttgaagggaactggacaaacaatgaccaacaccatgtttatgacatgttggtctactgtaatagaagtgtaaacatgaaattatgaatcaattctgggttgtcgtgtaagtggctgactggagtagcaaagctttctccagggcaccacacacaacatgaatatcctagatgtgttttccaagttatagaatccgcatgaggtaatcatgtgagtctactatatagaaatcggacgcgtgggcggacgcgtggg

SEQ ID NO: 31680 - DNA, 1412 bp, Triticum aestivum
  unsure (1)..(1412): unsure at all n locations
  Clone ID: PAT_TA_31680
taggggccttttttttttttttttttggatcagaaccaggtgcatggaccaaattttattcatttgttaaaaaaaaggggcggggggatttcgattcagaaagctacaagtttcaatcgcgtcaccattttctttcacagacgatccaactcaccaacactctttcggcccacagcaatacaggcgggatttacagtggtcttgatgcggatgggccatctacagtagcttcagcattttcagccgctcctcgtgctctggctcaagcttcggggccgagtagctgccgtgcagatcttccactacgtattcctttgtgagctctcttttggtcaggatgtgataatgtctctgccagatcctctggacggccatagtcgccgcgaggaaaccgtatgcaatcccaaggatagcgaaaacgacgatgaagagcaccaccagggcaaagcaggcctccaaagaagcagggagacagtccaggatgccccaaccatagcagcagttccggcacccagctaagcaaggatcttgattgttttttttttttttttagtgcactatcaacccggaaaatccaagcagcacaaagaaaaccacaacccctatgcagtagtagtacggtattggatgctttgacaagatacgatcccaaccatcactgaaactattccggaaacttccgtccctgtctagaaagtatgcaactgcactaatgatagcaatagtaatttgaactgcaagaaaaccaagtataacatctcttgccacgaagagccggaactttattttgcgccatgagttatcttccagagtttccactcgaagatggaactgagctttgcatgttgtgcagtgtgagaatgcaaatccttccttcacagacctccaatggtctaggcatgaacggtgaacaaactgctgagttcccttgcacatgcaaggtgatattagctcatcacctatctccgactcagcctcaaggcaaatgcggcagcatgcggcataagaaccatcggtctcctcatcctcaatctccagcacggtcacggttgccggctgtggtggcgagagctggagcaatgagcctgactgatctttcctatcgaggagagggtctgaatcactcatgatcgtctcttcctcgctcctgtccatccgccgcaaatgtcctntagtccagattttagcccgtacaataatgtccgtcgatagtttcaatagctaggtagcgtttgcatacaacctcacaaaaacaggtagaattggcatacggagtcacgagaaagccgaattccagatcaagaagacccaagagatgaacaaacgatgcgagaaatcgtcagcgcaaagggaacaagaagaagaagccctacctaaatccgcgtttgcaactttcctctcacgggagnttg

SEQ ID NO: 31681 - DNA, 2361 bp, Triticum aestivum
  unsure (1)..(2361): unsure at all n locations
  Clone ID: PAT_TA_31681
gcaacaacaacangaaaaaaacaccacacgatactccacagttccaacccgacccagccacgaaaccaaacgagccgaggagagaggatccgggccgggatcccaggcgggcgggcgatgccgatggcggggagatcctcgggccgcggcggcggcggcggcgggcgaggcgggaggacggtgctggggggccgcggcggcgggccgggggtggaggacgcggtggtgatggagctggcggcgggggacggggaggacaacgtcgtcaccgtcaactgccccgaccaggccggcctcggctgcgacctctgccgcaccatcctcgagttcggcctccgcatcacccgcggcgacgtgtcgacggacgggcagtggtgctacgtgattttctgggtggtgccacgctcgccgtccatcaacgtccggtgggggagcctcaagaaccggctcatggcgatgtgcccttcgtcatacgccatcccgttctaccctgaaatcaccgagccagggcccccgcagttctacctcctcaagctcttctcgaccgaccgtagggggctgttgcacgatgttacgcatatactgtcggagctagagtttataatccagagagtgaaggtgtcgaccacgcctgacgggagggttgtgaacctcttctttatcactgatggcatggaactgttgcatacgaaggagaggcaagaagagatttgctcgatgctgattgctaccttaggtccttccctaacttgtgaaatcctatcagcggaagggttccagcaaggattctcttctcttccaccaacaatctctgaggagctgttcagattggaactagatgaatgtgagagcagttcaggggcctctttgtgcagagatgaaaaaggtgcagaaggccaccattcactttgacaataccctgagtcctgcacacacactgctccaaattctttgtgttgatcagaaaggtctcctttatgacatgttgagaacactcaaggactgcaacattaaggtcacttatgggagattctggtcagacaagaaaggttttcgcgaggtcgatctttttatcaagcaagcagatggcaagaaggttattgatcctgagaaacaggatgctctgcggtctcgcatgaggtctgaaatgctgcatcctcttagggtgatgatcgtcaaccgtggacctgacacagaactccttgttgccaaccctgttgaactagccgggaagggccggccacgggtcttctatgatgctactttggctctgaaagcgcttggaatctgcattttctctgcagaaatcgggagacaggcagcgtcggagcgccaatgggaggtctaccgattcctcctggatgacagcaaagaatttcccttgtcaaacagcctaactaataggaaccgtgttgttgatagagtaaggaaaacactgatgggctgtttcaactgaagactcggtttatatctccataaatcaaaagcttaagaatgactgccatccaataggcatccattgtatccagttagttacctactgaaagctgaagcttgaagatgatcactgcagtgggtattgaatgtattgtggacggccagcctgaatgccaaacttgctggccaaactggtctttatagtgcctcataccttgcagttaccagcttctgttcatgtcatttgcagcgctgtgggcgtgtgaccaatttcccaagatcagtggtgatggaaaactgcagaaagcttcgtctatgatgccggatttcaaagtgaatctatggtcagcaaatgagcacaggacacaagacaaaacatgtcctttggatgcctcaaaaatatcttcctgggagctgtgttgtaaatggtgagtgggaatcaagaaatgaaggctagtgcatcaccaccgtcccgcattgttctcttgctcacccaaaaaacatgtttggttggaggctcaatcattgtgctttgtttgggtcaagggattgctggacgctgacgcagatcctacatcagtttgttgtagattaatgtagaatgtgccatctgcctgcctcacccgcctgctcccttcctgccttcttgtatgattactgctttgccaatagattactaggctgtttcctgatgtagggttcagtgtcgcctcctcacgttgcgtgttgtgtttccttgtcaccatgcatgttattatatatatatgaaaagaaggcactttgtctatgcagagtatgtgtacaaagttgtgaattaacaaaagaattctgtacttattgctgcactccactatgcttatagttggacaaagcacctggataattgggcttggtcatcatcagcagcatccctcatgcaatttg

SEQ ID NO: 31682 - DNA, 838 bp, Triticum aestivum
  Clone ID: PAT_TA_31682
cagctcaaaaacaactggcaacccttcgcgagcatgcgcgcgggggcacgcaatcaatggcgcttgcagcgatcgccctctccctcgtcctcgtcgccgcggcgccggccgctggcacctctcgtgaggagcttgctccagtgctccagtgccacccggcgccggcgctcacagacgccaccgacggcacggctttccgggccagcctcctcctgctcctcagcgctctcccctccgccgccgcgccgatgggcttcgcctccctgcactccgacggcgcgttcgcccggggggtctgcttcggcgaccccaccacgctgccttcaggctccgagtgcgcccggtgcctgtttgacgccgccaggaacctcaccgccggatgcggtgccaccagccgtcgagccggcatcttgagccagcgctgctcgctctggtacgccgacaccaacttttcctcgcccggccaggacgcgttccgagcgcgcttccacctcgcgctcccgagcgacgccgccgcccctgcttctgactctgagaccagcgccggggtcctctactcccccggcctgcacgacgagctcgtcgccatggcgcagctcatggtgcagcgcgcggccggaaggctctccaggccggcgatgccggccaccatgcgcgtggttcacaaaaccatcgtggagagaggctgcggctgcgactacgccatcgtgagcagcacggtctacgtgcgggctcagtgcgcccgcgacctcacggcggcggactgcgcccggtgtcttcaggactcggcgcaggccatggactgggacctggatgctgcccgcggcgacggtggcgc

SEQ ID NO: 31683 - DNA, 1209 bp, Triticum aestivum
  Clone ID: PAT_TA_31683
gctggccaaggccgtgctccgctgcccgctgctcgcctcgcctctcccggccggcggcgccaccgccgcctcgtgctccggttcccccctcccctctcgcgtccacatacggcggcgaaggtgcccgagtcccccgctcgccgtctcctccgactcctccaagcccctcgcctcctcctcgaccggcggcggcgccgaccccgacgaggagcccgtcctgcccctcctccaggaactcgcggattgcttggtgctcccgcccaaattcctgtccctgctgccccgcgaccttcgcctcgatctcaacgacgcggcattcgatctctccaacgggcctgttctcaatgagtgtggccaagaggtcggtgatctgctgctggacctgggaaaagcatgggagatggctaacacagaagcatcaaacaaccttgccaagcagctgccgtcgatggcgccctacttgaccgccagcgcgaaatcagcatttggcaagcggctggcatcagctggaaagaagtttcagactatgggccagtatggcaatggagagttcaagaagatttctgaaacaatgatcaagatcggtaaggttctatcaaaacgcccggtgattcaagctgaagtagaggccactaaagaaaaacgaaagctgaagtttgcaggagctgaatttgaattgacagcacaaaatgcatatatcggtgctgcagttggactggttttcgggtttttctcctggcagctggcccaaggcgtgcaaagcagtccagatgacagccagccgctcaaggtcccgctgctgcttctcggctacacttcgacggccctgtccgcggccgcggcggtggggctcgtggtgctggccctgcagatgaaccccgaggacaagtcggactaactgaactgtcttttagtttcttttttattttcttgagttggaactgcctttttcagttcctgaaaccgctgagcttgtgcggcgtcttaaccccccgtggaagactgtaaaaacctgcaatgctaccttgagttaactataaaatccgtttgccctcagaatgtaaaagaaaggcaaattcctcgctgcgtcgtcgctgttggaaaaaaattgtacaaatgataaaagcgtcctttgttcgtgtggaactggtggtgttgccttgctgaagtgaaaggggtgaaacaccctgggactgtaaaaaaaaaaaa

SEQ ID NO: 31684 - DNA, 561 bp, Triticum aestivum
  Clone ID: PAT_TA_31684
ctaacattggttttcatggagacaaaatgagaagcggattcattgaggtattggctatacaacagaggcttcccagcaatggcgatccatggtgacgaaacacaggaggatatatagaagtgcatttgtctacaaaccttttctattcttcatgggaatggagctgagcatgtgaaagctttaaatcttgcgctcatttctgtatgaatgggtagtgggctacatagtgctacccaacataatccgcgccatgacatgatgtgattgccatcaggagagttgacgaagaacctgaacaacagcctcgaaagattatatgttttgttgatgtaaactggattgtagtgcttcgtaacgttgttgtgtgatatatttagtgaatctatgttgtaaatgatcattacaaggtggatttgtaaactgctatgttgtatatacacatagaatttttttgagaaaaatatacacatacagtttgctgcatattgtgtgaactgtttcaaattactttctctttaggccaaaattggctaaaaaatatactgtgtcaaaattgggccg

SEQ ID NO: 31685 - DNA, 1134 bp, Triticum aestivum
  Clone ID: PAT_TA_31685
ctctgttgttatgctctattgcttatgcctggttttattcaagttttatattattacttcttctcaagccaagttcatagaagtgttgtatatggagagcaaccaagaaacagattggatttgtatataccagctggcacgacagggttgaagccagttgtggcatttgtcactggtggagcatggatcatagggtacaaagggtggggtgctcttttaggcagacggttggcagaaaggggcattttagttgcatgcattgattacagaaacttccctcaggggactattggtgagatggtagaagatgtatcccgaggaatctcttttgtctgcaacaatatagctagctatggaggtgatcctgaaaggatttatcttgttggacaatctgctggtgcacatattgctgcttgtactcttgtaaatcaggctatcaaagaatgtggcgaagatacttccacttggagtgttgcacagctaaaagcatactttggtatttctggcggttataatcttcttaacttggttgatcatttccataggcgtggtctgtaccggtccgtctttctcagcattatggaaggtgaggaatcattgaagaaattttctccagaagtggtggttaaggaggtagctgctagatctgcagtttctctattgcctcatatcatcctttttcatgggacaactgactgttcaatgccctctgctgaaagtgaagcattccttgatgctttacaacagcgtggtgccagagcgaatctattcttatatgaaggaaagacacataccgatttatttcttcaggatcctcttcggggcggtagggataaaatgctggaagagatagtcgccgtgatacaaaatgacgatccaggggcgtccgcgcagcaccttgccgtgcccgttgcacgccgtcttgttccggaattcatgctgaggcttgctgggagagtgagccctttctgaacatggtggtgattactggacacgacgactagcgaggcaatttactgtaagaaccgtatactagttagctacagaatgagtttggtggcctgatgtactgctaattaaccagagatgtatctcgctgtttcgtatgagttgtgtaagggcagaccttactgt

SEQ ID NO: 31686 - DNA, 1665 bp, Triticum aestivum
  unsure (1)..(1665): unsure at all n locations
  Clone ID: PAT_TA_31686
gaggagagctccggcttcccccgttcctatctccaagctatctccgttaccacccgagcgcccgacccggccgatccttggctcgccccgaaggaggagctgcgcccccccttagagaaccgaagaattgagcaagctaacctgttgaaaacaaacaatacgagtgtccagctagcgccccccgcggccgcctccctccccccccctcacggcaaccagagtgccgcggcagagctccttcctcgggttcaacagcgcggatatgggggcttggcggcggagagggtgaacctttcgccgctgcccaggaaggccgtccaggcacacaataacctgacacgcttttacagaccggtattaatggacatcgagggtaatctgacgataatgaaacatgaaactgatgcgacaattgtatgattcgcttgaggcgtggctgcagacctcggcgaggacaccatttgcaccacgaattggtcggcgtttgtgttgatgtgggtgcctaccttcactgggcagttcttagcttgtagagttccaccgccatagttgttcatgtgtgatgctgatagatcttttgtttatggagatgcatttggtaaaccaagtgagatgactaatgccatagaaaatgtgctacaggatttacaagctcagctaaagcaagagtcactgctaaggcaacaggagcagcaaaaactagctgaagagtccctactgaggcagcaagatcagcaaaggctagctgaagaacaatcccgtaccacttctcttgcggctgaaaagcgagagatggaagagaaaattgctgcattaacaaagaaatcttcagaagaggcttctgaatttgctgcacgccaggcattttccatgcaagatagggaaaaacttgaaaaccagttgcatgatatggctttgatggttgagaggttagagggcagccgccaaaagctgctgatggagattgattcccagtcattagaaatagagaatctgtttgaggagaactcagtcttgtcaacatcatatcaagaagctatgtctgttacgatgcaatgggagaaccaggtgcacgagggtctgaagcaaaatgaagagcttcgtctccacttagagaagctaagaattgagcaagctaacctgttgaaaacaaaaaatactagtgtcgagctagatggccaaagtgagaccagcatcccaccagaactggtcacagagaatctttctctaaaggatgaacttgtcaaagaacagagcagatctgagggattatcggcagagataatgaaactttcagctcagcttagaaaggcagtccaagcacagaataacctgacacgcttatatagacctgtattaaaagacatcgagggtaatctgatgaaaatgaaacaagaaacttatgcgacaattctatgattttgccgaggtatgagtgcaaacctcagcaatgacaccacttgcaccacaaattgatcggttttttttttttttttgctgtgtctgcctaccttcattaggcagttcttaatttgtagagttcaatcaacattattgtacatgtgtggcactgatgtatttatcatttatgcggatgtattttgtaaactgcctgaaatgatgaaaggaaaaaccagtntnccnnananaaaaaaagggggagag

SEQ ID NO: 31687 - DNA, 965 bp, Triticum aestivum
  unsure (1)..(965): unsure at all n locations
  Clone ID: PAT_TA_31687
cccagcgtccgaaacttggnaagtttctgaggcaagcagcagcagcagccatggagcctgccggtgctagcttggtctccctgagggcatccaccgccacgagccgcagctgcttctcatgtcgacagcaagggacgcccaagaccaggatgcttccggccatggcgtccaagtccggggcgaaactggtggcttcaggctgcaagacatgcagggggaagggtgcagtggaatgcgaaggctgcaaggggacaggcaggaacaagaagaacggcaacatcttcgagagatggaagtgcttcgactgccaggggtttgggatgaggaagtgccccacctgcggcaagggaggcctcacgccggagcagagaggagaacgatagaagaaacagccaagcatccatccatccatggcagatgcactctccaatgtcttatttatcatgctcaactttgctcgaattctgacaactatctagaagtaagtatcacccagaattgccaaacaaaatgaaaaccgaatatggtgatacacatatttggtctgagaaccagcagtataatgccaagcagaatgttgtgaggaaatcaactggtttctgcgcgtattgactggtctggaggcttttgaatctatatgttgtaagtattttttttgttctcttgaatatattcagtttgtcgtnnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggaccaaagtttacttccccgggcttgcaaagaaaaagtttttttatagggcccccaaaataaaatcaacgggccggggtttaacaacgtcgggacgggaaaaacccgggggtacccaaattaattcgctttgaagaaaatccccttt

SEQ ID NO: 31688 - DNA, 1025 bp, Triticum aestivum
  unsure (1)..(1025): unsure at all n locations
  Clone ID: PAT_TA_31688
ctgtggcacgcagcagcagaggccgggggaccttggaaggtttgctaggccagcaggagcgccagccacggagccggccgctgctcactcggcagcagcgagcgcagccacggacccggctggtagctgccttctcttgcgggcgagtcccgggaccaccaggctcaggtccctctcgtggagggcgcgagcgacgggggggacccggatgcttcagggcttgcaggccaagtccggggggaaactggaggcttgaaactgcaaggcgtgaagggggaagggtgcagtggaatgcgaaggctggaaggggattggcaggaaccagaagaacggcaacatctacgggaggtggaagagaggagaccgccagggggttgagagagggcactcccccacctcagggcaagggaagacacaacgccgcagcagaagcatgaaaactaccatgaacttagcattctctacagtcatatttctcgaagtcagcttcacaccgaaacgccatactaattattctaaactttaagtataaccccacaactacctagcaaaaagtagcaacccgaatcatgatataacatgtagttggtttgagatggtgcagcatattgccaagcttgagtattgtgcagaaatcaaccgatttaaattttgttgaggaaatcaaactggtttctgcgccgtattgacttagcttaggatgcttttgaatctgtatgctggaaagtattttttaattttttagaatatattcagtttgtcctcactaattttttgggaaacanttatncttctnnnntatnttcttntcagagcgtgcttttatatccggccggtggcccccttcccctttggccacccggttggggggaccacggatncgggggccccaatttncccctcccccggtgtccgttttcaanttcacntggccggtcnttttacaacgtntngaatngggaaaaaccttgngnttaccnaatttnaatncccttggcaanaaattccccttttgtcaattgcct

SEQ ID NO: 31689 - DNA, 845 bp, Triticum aestivum
  unsure (1)..(845): unsure at all n locations
  Clone ID: PAT_TA_31689
ggccgtgctcctcgcggtgtacaccatagcgaactggtccgggaccgtgcttgcacaagcagtctcgctggtggggcggagcgctccgccggagatgctgcagatgctgacctacctcgccatgaagcacgacgcgcgcgtgcagcgggtcgacacggtccgggcctacagtttcggcgctctctgtgtcgtcgaggtcgacatcgagctctcggaggacatgcggctgcgggaagcccacgccatcggggagtcgctgcaggagaagatcgagaagctgccggaagtggagcgggcgttcgtccatgcggacttcgagagcacccataagccggagcacaccgcccggagcaggctgccggcgaccgagccctgacgatggcgccttcccctccagcatttgccagattttgtacagcgaaaatacacacctgaagctacagtacttcgtcgaggtcgacatcgcgctgaccccgaaaaacacagcagcagaggcgcacgccaacggggagtcgctgcaggagaggatcgagaagctgccggaagtggagcgggcgttcgtccatgcggacttcgagaccacccataagccggagcacacggtccggagcaggctgccggcgaccgagccctgacgatggcaccttccgctccagcattcgccagatcttgtacagcgaaaatacacgcctgaagctgcagtgttcttgttgtttttctcttgcgctgaccccgaaaaacacagcgacagagccatctagaagatggatgtctctgtggaataatacaggattcgccatttttatgggagctgttccttccttctggtaaanaaaaaaaaaaaa

SEQ ID NO: 31690 - DNA, 225 bp, Triticum aestivum
  Clone ID: PAT_TA_31690
ggatgacagttacagactttcagaactattatgaaatgaagcaaatgagcagttcaactgaaaactacatttccattcattcaagtatttaaaaaaaattacacaacatgtaagcctggttgctacgtttattctgccgaaagctaaaactttaaactatacgcaacacacaaataaatcaactggtcgatgagaagggtgatcatatcttctcggacgcgtggg

SEQ ID NO: 31691 - DNA, 523 bp, Triticum aestivum
  Clone ID: PAT_TA_31691
attcgcgggtcgacttcatggaggagaagttaaagcattacccagccgccgtcaacgatgaagggatgtatgaccattccaaggaagtggccgaggccatgctcggggaagctaatgtgaaggtggctccccggagcatgggtggtgaggacttcgctttctacgcgcagagagcggcgggtgcattcttcttcatcggcgtaggtaacgagaccgccatggacagggtgcatccggtgcactccccgcatttcgtcctcgatgagggtgttcttcctattggagctgcgtttcacaccgcggttgccattgagtacctgaaccgctcctgaaaactacaggagcatgagtgaaggtccgtcttggattatggagtgaaaattctctgatgtccgtatagtgttagatatccagaatcgtcttcatttgcttgatcggaagctatatatgtgtgtatagtatgttatgtgagatatactattcatatgtagcatgcatgataattaagacagttcagtaattt

SEQ ID NO: 31692 - DNA, 1337 bp, Triticum aestivum
  Clone ID: PAT_TA_31692
caacggctattgcgtaccaatacaagttcaagataatgcaatttcgttcatagacgaacaagtacactgaagctctgtacacaaggactacacgctcactgtattaactactccctcagaatcatataatatgcttaaagcacacacagaatacgtgtggttttcatcaggattccgggttgttgatgttgcttcccaggtgtcctgctcggagcatcgacatgaggaccccaccgtgcaccctcccctccggcacgacgaacccgtagctccggttcaggctagcaccaccttcccagtcgtcctcattacccggcaggttaaacgaagacgatggtttctgcagggagcctgcaggaagcagcagctgtggcggtatgagcctgccgccctgcaagtgtttttccggcgactcgccgcagcagtctgaggaggcgccgccggggagagaagaagagatgacacggtccatgccgccactgcccaccgtcgaggaagaagagacgacgatcccgccgctgaagaggccatgcccgatgatcatgcttaggccctgcgttgaggccgtcaggtttgcatgagcagagcacaggccgctcctccccctggcaaacttgtcacagccggcggcgccccaggcgcaccgcttgcccccgccgtgcgccttgcagaagtcggtgctcccctgcgcgctcttgccgcacccatcggatttgcagcgcttgccaccgccatgcctcacacagcaatcggtgcgaccacgagcgctcttggtgcaccctggtgccacacaccttttgcctcctccctgcaccacgcagacagcagtcccggcgaccacgcgctcaggaggtgcaccctggtgcggctcaaagaggcacctcttcccgcaccaatgcccttcgcatagcaacgtgctgccctcggcgcctttggtgcaaccttcggatatgcaccgtttgcccggacgcgtgggcggacgcgaggaacgtgctgccctcggcccctttggtgcaaccttcggacacacaccgtttgcctccaccatgggacttgcagaacagggtgccaccctgtgctcccttgctgcagtccgggtactggcaccggcgacaacctccgtgcgcgatgcacaccccgggatacccttcggcgctcctggtgcagccctccgtcatgcacctcttccctccgccgtgttttatgcaaaatcccgatcttccccgcgctgctttggagcactcccggaaccccgaaccggtgccaaccgccgtgagcgatgcagaactctgtcttcccctcggcgcttttggtgcagcctagctcttggcaccgga

SEQ ID NO: 31693 - DNA, 636 bp, Triticum aestivum
  Clone ID: PAT_TA_31693
tttgaaaagaagtccaattgtttttatgatattggccggaggctgagttgtgctcaggtattgggaaacgacaaaattattggttcattcctgcatactgagaagaagtcctgccaaggatgcccgctctgcatggcctcgaggatcctgtcaggacacacttggacgggcaaaagttgtaacaacactgaatttccccagtgcccctgacgacacaaccttgtgctgggcggacaaaatgtttgtttcatgtaaaattcgactgttttcgcttcagctgccgatggtatggcgaaagaaaatcaggcatactgtatacaccagctgttgtgttacactcactggtcctagagggcatgtgatgtaaattatttctagcatatgttctcaaaaggaaaaagggaaattccggtgtcctctagatgggcattgagatgcatatgctgtactttgactgagagtagccgattcggaaagataccattttgttgatgaaaaatgacttgcgtaaatcggtggatttgtggatgtaatttttgttgtttcaagtcttgtataatgtccactttgtatgtccatctttccctcaaaaaaactttgtatgtccatctcgcaaaaaaaaaaaaaaaaaaaaaa

SEQ ID NO: 31694 - DNA, 665 bp, Triticum aestivum
  Clone ID: PAT_TA_31694
gctgctcccggtctcctcctcctgcgcgccaggcatcgccgtgcgcacgctcgccgcgcgcccgatctcgcgccgcgccgggtgcgcccccgcgctccggaccgccgccgccgcctcctcctcgcccttcgcggtgtcgcgcgccgtgcccgagggcggacccgcgtcgccgctgctcgccgtgcccgtgcccgacgacgaggacgccgacgccgccatggacggcggcgacgggggcgagcagcagaccggcctcgcgacgcgcccggtggtggccccgccgcgggcaccgaccgagcgggacttcgccggcacgccctacgggcccgtctacgtcatgctcccgctcggggtggtgagcgtgaacggcgacgtggcggaggccgaccagctggtggcgcagctgcgggtgctcaaggcggcgggcgtcgacggcgtcttggtcgactgctggtggggcaacgtcgaggcgcaccgcccgcaggagtacaactgggccggctacaagcgcctcttccacatcatcagggacctcaagctcaagctgcaggtggtcatgtcgttccatgagtgcggaggcaacgtcggggacgacgtgtccattcctctcccggaatgggtgatagagatcggcaagagcaacccggacatctacttcaccgaca

SEQ ID NO: 31695 - DNA, 1213 bp, Triticum aestivum
  Clone ID: PAT_TA_31695
cccacgcgtccggaagcttccgagtagaatttgacgagtattttgaggatgggatcatttcagaaattgaggttggactaggtgcttgtggagagttacggtatccatcttatgcagcaaaccatggctggaaataccctggcattggagagtttcagtgctatgacaggtacttgcagaaaaatctgaggagggccgcagaagcacggggacacgccatgtgggcaaagtcaccagacaacgcaggccactataattctgaaccaaacaacactggattcttctgtgacggaggagattatgatagctattatggccggttcttcctcaactggtacgcccaggtgttgctggatcatgcggaccgcgtgctgatgctagccaggttggcctttgaaggctcagctattgctgtcaaggtgtcaggcatacactggtggtacaaaactgccagccatgctgctgagctgactgctgggttctacaacccatgtaaccgcgacggctacgctccaattgcccaagtattgaaaaagcatggtgcggctttgaacttcacctgcgttgaactgcgcaccatggatcagcatgaggtgtaccccgaggccttggcagatccagagggcttggtatggcaggtgctgaatgctgcgtgggatgccgggatacaagtggccagcgagaacgccctgccttgctacgacagggacggcttcaacaagacactggagaacgccaagccgcggaacgaccccggatgggcggcacttgttcgggttcacctacctgaggctttgcagcaccctcttcgagggacccaacctccctgagtttgagcgtttcgtcaagaggatgcacggcgaagcggttcatgacttgagggcgtagattgttagcgtgttacatacataagtacatacacacaagacttttttgttgtcccagggctcattatggttctcattgcggaaccacatgtgccatttttgtctcgcgatagcttgatatttgagctatatattgaaccgaataacgcctctccaagatgtaaaccatatcttcctgtgcatatagtcctagttatcaagcatgaggatcagaagttggttgccgtcgagtggctgacagcaacgccgtgagccgtagcttctgtgaaaggtttgaggctgtgcaaataaaaatgccgatgctgttctctctctaaaaaaaaaaa

SEQ ID NO: 31696 - DNA, 610 bp, Triticum aestivum
  Clone ID: PAT_TA_31696
ttgccggggaggaagcgcggggtcggtgcggcggcggcggagttcgagatggctgcggccgggccggacgggcagagagagcggtccatggcgctcaacagcgaaggccttgagggtctagtaccacgggcaaagctgttactatcacttggtggtactttttccctggcatttggtcctctgattattgtcacggtttctctatttgctggtctttatctgtattttgggcaaagctttgtacatgacgggagcaagaaaccagtggcgccaccaccatacattgatccatatgagctactggaagacgatatgatctcccggccctcccttgatgtgttctgaatctccacgacacaaggatagtatttgtagatagctcaataattttcttgttttactagatatgtacctgtaaatgcaatagctgtagactgttattatctaaaactttacaataaaatttgcgaaaaatctcgcgccaaaatccagttgtggtgaaatctttcccaacctttctttgttctgtaactctctcctctgctgtcggtaatgatataccgagaaattccaaatgaatgtcaagctgccagctcctccaaaaaaaaaa

SEQ ID NO: 31697 - DNA, 433 bp, Triticum aestivum
  Clone ID: PAT_TA_31697
cgggaatccctagcggatcttgttactcttgggtgtttgagcatcctagacggttgaggtcaccgcgaagccatagtccattgtggtgaagcgtcatggtgtcgttgggagcctccaattgagttgtggagattgccccaacctcgtttgtaaaggttcggtcgccgcctccaagggcaccaatagtggaatcacggcatctcgcattgtgtgagggcgtgaggagattacggtggccgtagtggcttcttggggagcattgtgcctccacaccgctccaacggagacgtacttcctctcagagggaatgaacttcggcaacacatcctcatctccaacgcctccactcttggttgtctcgtgcctttacttgtggaagcgtagttgtttcagatatcttgcttgcttgtgttcctatccgtgttgcatcata

SEQ ID NO: 31698 - DNA, 922 bp, Triticum aestivum
  Clone ID: PAT_TA_31698
gaattcactagtgatttcgagcggccgcccgggcagtagtaccgctcgtgcacggactgagcacataacggttggattcgggagctcctatataaggggtcttcttccccatgcaaccttatcctttgagctcgtgttcttcccccattgttgaccttctccgagtttgctatctctcaatccctccatggattcttgctagttttgagggggggagaggagatctagatccacatttccaccaatcactttctcctctatgtgaggggaacccccttggactctagatcttggagttcttggggttctccttcttgttcttcctctcatttccctccctagcattagttgctttggtgggatttgagagaggaggacttggggcactccgtgggcccttgccattgcatttggggcgtcggttcgagttctccaccgtgttacgcggtagttccaagttgcagcaactttttaccttggggtgcttgggtgcccttgagcttgttcctcttgggtgcttgggcgccctagacgttggtgggtgttcggagctcaatcattgtggtgtaaagctccgggcaagcgtcgggtctccaattaggttgtggagatcgccccaagcaatttgacgggtaccggtgaccgcccccaagggttgccaaagtgtacgggttcggtgaccgcccccaagggtcccttcatggaaccacggcatcttgcattgtgcgagggcgtgaggagatcatggtggccctagtggcttcttggggagcattgtgcctccacaccgctccaaatggagattagcatccgcaagggtgtgaaattcgggatacatcgttgtctccccgcgcctaggttattccctccctgagctctttacttatgcactttactttgtgatagccatattgtttcttgt

SEQ ID NO: 31699 - DNA, 1041 bp, Triticum aestivum
  Clone ID: PAT_TA_31699
gctacggttctcaagctcaagagtggctgaggaccttgctaaacaatggaacaaggagcaaaagaaacttctaggcgtagatcttcaatcaataagagcatctgctttaggatctgcaccgcctccccatatagcagaagattatgctggaagcagttcgtgcactggatgctcaaagcctccatttcttgcagcccaatcagacctttccttgggcgacgtgcaccttcggaatgcttactcttcagatagaggccaacattatttgtcaaaccttggcaggtttaaccttcatggaatcgacaatgtgccgagaaatttgtctctgggaggcttccctggagcttcttcctcacaggggagaactgggagcaggcgtaggaagacaaccaagcttcaaaagccatactatgacaacaggtcgccctggtgccaagaactaccacagaggatgccggctcagttccttcccatcaaccaacagccaatcaacagccttcctcagtggcttaccaagggcgccgagaccggtaaaagctggctcaacccggagatgtggtcgagcgcgttgcaggcgccaggccattctgtcgcagatccactgaatgacagcctgagggctgccgcctttctgttccccgacgacaagaaaccacatgccatgcctgacgcctctttgaagctggcgctgaagaggaaagcggagtggcgcagtctaggcaagaagcttttccggaccagtggtgacaccttggatctaaaccagagggccgctgctatggcggcagggccgagcggcgccaccccgagcgacaccggcgcgtcgtctgaagagacggtgtcagatagctgagctatgatcttgcgcatgttagtcccctccgttgtgtctagttaacaaacttgttgtcttcgatgctgaagttggtggaacactagttgagtagcagggaatgttttgctgcatttgcctttaaaaaaatattctagcataactggaaatgatggttaatggacgtaatacaagctatctacatcccc

SEQ ID NO: 31700 - DNA, 3139 bp, Triticum aestivum
  unsure (1)..(3139): unsure at all n locations
  Clone ID: PAT_TA_31700
nacgagggtnntatatatagatagagaaagaaagaagannnnnntagaaagnnnaagaaaattatgatgtggaaaagaagacaggaattgtgtacaatggcattgtacaacaatttaatttngaaaagggatgtagcgcagcttggtagcgcgtttgttttgggtacaaaatgtcacaggttcaaatcctgtcatggaattcactagtgattagcgtggtcgcggccgaggtcgacgagatcaattaaagtaaagtgggtataacttgaatttgtggagactatacgtacgtgagatacattaggaatagaaaaagattttctttttgaatgaatgaaagcgctcttagttcagttcggtagaacgcgggtctccaaaacccgatgtcgtaggttcaaatcctacagagcgtgattccatctatcttatgtcgaagcagagtaaaataacttaacaaaattgaattgtaactccaatttcaatttgacctcctctctggtctggaggaggtcaatcaaaaaaaaatgactcaatcaaagatccaactgatccccacgcctgtattgcaaatacgcagtcacgaataatcccgctaaagtaataggaattaggcctaagacgattccaaatagaaaaacttcaatcatttcgatttgttcgaggggataaaaaaagaggtacgatctatccctaaatagtactctaaattatccacgaatctcaatgaccaagaaaagaattcctaattagtctggaaaagagtcgtagaatgccaggaatcccaaagaaagatttttcttttctgaattataattattcagtcaattcaaataaggcgtatcttgttcaagccaataaatagagctggggttatagttaaagcagccagtagaaaaccaaaataactagttaaagtaagcatgaaagagttaaattccatttattttttttttactacactacatatgttggtaaagcatttacctaagttatggaaaattcataattcatcagttattttagataatactaaaaaacaagatagagtaagatacagaagtgtaaaagaaagtggattcatcagatgatacatgagtccctaattccgaatcaagagatttgttgtggaatttgtcaattgagtaaagtaataatattaagaactagatcatctaaccccattgaatgaaaaaatgaaattcgattttcaaggaaatttttgaataagagataaataaacaattgaattgaaaaaaaaaaacttctttctattttggataatttctttttcaataggaccctctttttggagtgaacgatcgaatattcccctattccttcttattttaactgattgtattccatatggaataagaggagaacaaaagcattccacgacctgccaaggggctgttaaaaaaaaaaagaaagctcttccttgaatttactttatttttattcctttttcgaactccaaccaaagtagattcgaagacaagtcacttcaattatccttttaagttctattctatcttctgtctttccctatttcagcgtggtcgcggccgaggtcgcagtttggtcaagaaagttagacctaatccaacaaacaatacaaggattaattacgaattatgaaaggatagatttcacatatacttgtccttgtattgtgtcagtatgagaatatccttcctaaattatttatccaaacctattgatcattaacttagattttcccaagattttggctgctattccgaattactctattattccgaagccaatgaaaagtaagtagaacctacaaaaatggggttttctattgatgccttgaataacatatagcttacctatagacaaaaaaaaaaaaaaaaaaaaaacgagaatatttttcccccccccccggggggggccgaaaaaaatatcgcatcccccgccaagcgcggggggggcaaaaaagagcaccgccacccaaatccccatataacacggtagtgattacagtaattttctatttactgctcgatcccatcttttacggaatcaattccttttttgaatgtacaaaaattttgggagttcagcatgtctggaagcacgggagaacgttcttttgctgatattattaccagtattcgatactgggttattcatagcattactataccttccctattcattgcgggttggttatttgtcagtacgggtttagcttaagacgtgtttggaagtcctaggccaaacgagtatttcacggaaagccgacaaggaattccgttaataaccgaccgttttgattctttagaacaactcgatgaatttagtagatccttttaggaggccctcaatgaccatagatcgaacctatcctatttttacagtgcgatggctggctattcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagactaataagaattctcttatcccatttggaaggataccatccttataactacccatgactgtttttgtctctagcatgaccaattgataaaatgtggaggaaagtaggggaaatggccgatactactggaagaattcctctttggctgataggtactgtagccggtattgctgtgattggtttagtaggtgttttcttttatggttcatattctggattgggttcatctctatagtaatcggagggaccagattgtaaacatgaaaaagtaggagcttagcgggtccttacccccctttatctgattagagcggaaaggacccgcggaatttttactcttataacgcgaattgattctattcgattcactcttatgaagcaacaagaaaaagagatcactcgaggggccaatatcttattccacgaaggaagtatcctgaaaatccttgatttagtttcgagtaataaactaataaaaccttaatcaaaactattcaactagcctaaaaaaaaaaaa

SEQ ID NO: 31701 - DNA, 649 bp, Triticum aestivum
  Clone ID: PAT_TA_31701
cccagaaggatgcccccgcgtcaatggcgttgaggaaccttgcgatgagtggcgtgttgcaacgttgcgatgagagtcttgttgctcctggcggtggtgagcgcggcatatgctgccaaaggcaaggcggagaagaaggagagcgcagatggtccggcggcgtccggtccggcggcgtccggtgagggcggggagtacccgacggcacaactcggcgccaagcccgacggcacaacggactgcaccgaggcggtggaggaggcatgggcctcggcatgcggtagcaccgggaacccgaccatcatcatccccaagggtgatttcctgactggagctctgaatttcacggggccgtgcaagggcgacggactcaacatcaagctggaaggcaacctactagctttcaacgacctggcaaagttcaagtctaactggatcgagatcatgcgcgtgaagaagctctctatcaccggcaaaggcaacatcgacggtcagggcaaggccgtctggaccaaaaacagctgccaaaagaactacaactgcaagatattgccaaacctcgttggtgctggacttctgcgacgacgccctcatcgaaggcatctctatcatcaattccaagttcttccacatgaacatcttccagtgc

SEQ ID NO: 31702 - DNA, 868 bp, Triticum aestivum
  Clone ID: PAT_TA_31702
gtcatcatcatgacttcaaacatcggggccgaccacctcctcaagggaatcaagggcagttccacttccatggagcaagctcacggtaaggtcatggaggaggtgaaggggcatttccatccggagctactgaatcgtctggacaaaattgtcatcttcgaccctctgtcccataagcaactgcgcaaggtcgctcgacgccatatgaaagatgtggaagcccgtcttgcagagaggcgcgttgctctggtcatcactgacgacgccctgcacgtcatcctgtcacagcctcacgatccaggccatggtgctaggcctatcaagggatggatcgaggacaatatagtcaccgtgctctccgtgatgttgatcaacgaagagattgctgagaactccacagtttacgtagatgctgctcccaacaaaaatgagctgacctatagggtcgacaaggatggaggagtggtgaatgcgcaggcaggccatgaatctgatatcgtcatctatgtgcctagtggtagtggagcaattgggaaataagggtacgtacgtggcagacatatccatggaccgggacatttaccaatgaattctcgtgggcagttaccactgaactcgcaggttacatatatgcgcatagattttgatccagtcatagccatgtgatatccgtgttatatatgttcacacacacgtatatgaatgtagcaggtatgtatgtatgcatgcatgtatgtatgtggggagagggtgctttccctcttgtcaaaacatatatgtatgtttgtatgtatgtccgtaatttgcagcaaaaaacaaaaacaaaaacatatgtgtctatattatttaaaaaaaacaccccaacccc

SEQ ID NO: 31703 - DNA, 1004 bp, Triticum aestivum
  unsure (1)..(1004): unsure at all n locations
  Clone ID: PAT_TA_31703
cacaagtgtcttatgcatttcattctcagaggaaattgcacccagagaaattcaagaatcagttgtctaatcagaaacagtatttgaagctggcatgcacacaaggatggttctgtgcctctttaagccatccaatgtcacggaatattgctcaccttgcaaaggtaaagataatgaagaaatctggaaaatgggaaaccttggaaattccacagagtatcaggtccattgtctgtctcaatttacccagcttctctggtggactgaatccctggggaacaccaagtaagaggaagcaaagaaaaagagacttggtactgcctccacttgtggatgatggccttctggagattgtgggtttcaaagatgcttggcatggccttgttttgttatctccgaaaggccatggcactcgtcttgctcaggcccatcgtgtccgattcaaatttcaccggggtgcaactgaccatgcctacatgagaatcgacggtgagccctggaagcagcctcttccacaggaggatgacggcaaggtggtcgtggagatatcccacgctgggcaggtcaagatgctcgcgaccaaagactgtatagctaaaggcatcaatgactcccctggtatggcaacagcctgcacagattccagctccagcgatgactcggacgatgacttcacagaggagcggaggaacttcggcgccgccttgtcgttccggtacatgaatgatgtgaaaaaaacagtagaagcttgaatctctatttgggcctgtacagtttgtcctgcgtaggagatagatcgttgcactgattttgtggagcagtggacgttgcccctgtaagatccttttgctggcaaggctgtttgtgtatggcaaagttgttgtggcgtatggtgcagtgggtttttacttactggcagtcatcataagcactaaccgacccaatttctccgctccnctgcagtctnctagtaaggggcaacacataaactaagaaacaacagt

SEQ ID NO: 31704 - DNA, 1002 bp, Triticum aestivum
  Clone ID: PAT_TA_31704
gccaagtctcattgcttgaccagcttgttgaatttaccccccaatgtgccctagagcgcacggcggcgctgcgatggtgagagcgagagcgagcagtgctgctagcgcgcactcgtttgcggaggaggagtacatcgacctggatctcagctcctgcggggagtaccagttccgggtgtgccggagcaaacccgcggcgccctgcccgtgcccggacgagctggtccggcgggccaggcagcacaaggtggcgccgaggccggggggcaagctgcttgacgcggacgccggcgccgcaggcggctgcggcagaaggggcaccgccacggtcgcgccattgcagcactcctcgcatgctccaccgcacgcgggccggcgcaggaagcccggcaaggccatgcaggcgaggctgcaggcgtcgcgggccttcctccggtccctgttcgccaggacctggtgctccgacgaacggtgccgcggcgttcggtccgggagcagggccacgcatgacagggacaagggcgtcggcgtcagcggcaagtcggcgtttgggcaaatcaacaagagctacgtgagcggcagcgcggccccgacgacgctgaggagcagcattgagcgggagaagctgatggaagaggaggagcacgtccggcaacgcaagtccttctccggcgtgatcaagtggcgaccgacgacagcggcgtcgtcggcgcggaggaactcgtgcgggagcgccccggccctgaagaggagcagcagctgccggtcggagtcggaggggctgatccagggcgccatcgcctactgcaagcggtcgcagcagcagcgcgtgctcctcgccaggaagagcgtcagcgacgccgccctctgctccttccgtgccccttcctagtcctcctcctgtagcccaattccttcccgtcagagctgtgtagtacgtgtgcatgaaaaatgactgatcataatatgataataatgtcaagtgtcgctttcattctacgt

SEQ ID NO: 31705 - DNA, 680 bp, Triticum aestivum
  Clone ID: PAT_TA_31705
tgtgaggaggtccgaaaccagtgttgtaagcaattgaggcaaacgacgtcgcgttgccgttgcaaggctatatggacatcaatccaaggcgatctaagtggcttcaagggccttcaacaaggtcttaaagccagaacggtgcagacggccaagagccttcccacccagtgcaacattgatccgaaattctgcaacatccccatcactagcggatattacttgtgatgtagcttccattggtgaccaataaactatcacataccactgtatgtgaccaataaatgtgaccatggaataatatatactttagtttcccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcggataaaaaaaaccaaaattatttaacccggcaaaggaaaaaaaaaaaaatttacaaggggaaaaaaaaagggagtaaatgcctgaaaaacaaattccagggaaatataaaaacgcttggagaaacacccccttttcctttgttttaaaactcctaaaagagcggtggtcgaccggcaaaaaggcccaaacaaatcgccttttcaacaatttaggcattctatattgggaaaggttacagccc

SEQ ID NO: 31706 - DNA, 1019 bp, Triticum aestivum
  Clone ID: PAT_TA_31706
ggccactaccaaaacaacattggcaacatgaagaccttcttcctcctagctttccttgctctggtagtgagcactgctattgcgcaatatgcggaagttcccagcccagctgcgcaagctcccaccgcggatgtttttggggaatgggttgcgatagcgcctagtgcgagtggttttgaggattgcgaggaagagcatccaaagctagattcttgtagtgattatgttatggatcggtgtgtgatgaaggatatgccgctctcttggatctttcctcggacttgggggaagagaagttgtgaggaggtccgaaaccagtgttgtcagcaattgaggcaaacgacgccgcgttgccgctgcaaggctatatggacatcaatccaaggcgatctaagtggcttcaagggccttcaacaaggtctggaagccaaaatggtgcagacggccaagagccttccctccaagtgcaacattgatccaaaatactgcaacatccccatcactagtggatattactggtgatgtagcttccactggtgaccaataaactatcacataccactgtatgtgaccaataaatgtgaccatggaataatatgtactttagttttccttacttatgtatgtatgtgtttctcttacaaacatctaatcatgcatgtgtctatcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggttcaagttttacaaccccgggaaataaaaaaaaaaggggttttttttttgggaccctaaatcaatttcccggcccggggtttaaaaccgtttttttttggaaaacccctgaattacccaactttatccgcttttaaaaaatcccccttttgcaaaattggggtttttccaaaaagtccccccccgtgggcctttccccttttt

SEQ ID NO: 31707 - DNA, 2441 bp, Triticum aestivum
  Clone ID: PAT_TA_31707
gtgaactagcgatttctgttgctaaagaagagagatttgcttcagcagatgattacgccacaatgatattggtacagcaggataaggatgttcgtcgtctgtcattatgtggatggaaagatgacactgcagtgaaagttaaacttccacatcttcgaacagtactgtcacttggagcaacttcaccctgccgtggcatgttatcttctattttgtcagaatccaactaccttgctgttcttgagctgcaagactctgaaatcactgaagtgccaacatcaatagggtctatgttcaatctacgttacatcggattacggcgcaccaaggtcagatcacttccagactctatcgaaaatttgtctaacctccacactctggacatcaagcaaacccaaatagagaagctaccacgaggggttgtcaagatcaagaagctgcggcaccttttggctgacagatatgctgatgagaagcaggcagagttccggtactttattggagtgcaagcacctaaagagctatccaacttggaagaactgcaaactctcgagactgtggagtccaaccctgacttggcagagcagctgaagaaactgatgcaactaagaaagtgtgtgggattgataacattagtgctgacgactgtgcaaatctgtttgctaccctgtcaaccaaacgttgacaacaagaagaccttcctcctcctacctcttgatggatcttcttcctcctagctttccttgcactgggagtgaactccgctattgcgcaatatgcggaagttcccgcgctcagctgcgcgagatccgaccgcagtatggatctcgggaaatgctttttccctcccagctttctgttgcgcgggtagtgagcaatgctattgcggaatgagcagaagttccccaacccagctgcgcaagccccaaccgtggtattgttttggggaatgggttgcggtagcgcctagtgcgcagtggttctcgataattgcgaggaagagccagcaaatggtaggctcttgtagcgattgtgttatggatcggctgtgtgatgaaggatatgccgcctctcttggttctttcctcggacttggggggaagagaagttgtgaggaggtccgaaaccagtgttgtaagcaattgaggcaaacgacgtcgcgttgccgttgcaaggctatatggacatcaatccaaggcgatctaagtggcttcaagggccttcaacaaggtcttaaagccagaacggtgcagacggccaagagccttcccacccagtgcaacattgatccgaaattctgcaacatccccatcactagcggatattacttgtgatgtagcttccattggtgaccaataaactatcacataccactgtatgtgaccaataaatgtgaccatggaataatatatactttagtttcccttatgtatgtatgtgtttctcttacaaacatctaattatgcatgtgtctatcaagaaaacaatgttatttgtgccaatacaaaaggaatgtgtggaagaacctcacatatcttagactaaacaacatgcacagtgccaaaactttggttctgtctaaagactcctttcccaacctgaagacgcttgtcttaaagcacatgcatgatgtcagtgagctaaaaatcgttgatggcgctcttccctgcattgatggtttgtacattgtgtcgctgtcgaagctcaataaagtcccccaaggcattgaatcccttcgctcccttaagaagctctggctgctgagcttgcacaaggatttcagaactcaatgggacactgaagggatgcatccgaagatggtacatgttccagagcttcgtgtctagatgtggcaagttggttctttctgcagtgccattcttggatggtgcatccagtccagctgcatcgtgctttaaatcattccaataaatttgcgattatcgacatcaccggcagcatttggtcggtacttctatatcgtaacacatttatattcctcaaggattggttcgtgtgcattgccttccagaggcctctgtaccgtatgtcttttttttgttgaccgtggactgtaccgtttctgttgtttaagctacacactcttagtagttatttcctgtaaaggtatgtattgtttgtatcgaacatcttgtgtgattaatcatgtcaaacatttcattttgtaaaaaaaaaaaaaaaaaaaactcgacgacattgacagccagtttcttctggaattaaccgagctgcgtaaattatttacttactctgttccataattactgttgtggttttagttcaaatttgaattattgtcatggtttcaattcaaattatgcaacagagggagcacatgggcttggtttccatttttgtgatacgtttcactatgtatctgggatattgagactattgtgctctacaaatatatggcgtcg

SEQ ID NO: 31708 - DNA, 802 bp, Triticum aestivum
  Clone ID: PAT_TA_31708
gctgcgcccccgcgcgagagcgccagctgcggctccgggacggcgatttttcctccggcgaagagctcgagctcgaggtcctgtccctcactcccggcggtagggggaaagcagaaaaatggacccaggaggtacccccaaagaggggcgtccgccccctaacaagcccacaaagcccaagttcaaaccgaaagggcccgtcgccaagccaaaaaaacccccctgcacaaaagccacaactggaagagacaaaaccaattgatgaagagttaatgaagacactgaggacgggacgaggagatgcaaaaactttgcgagttataaaagatgagcaatcggcacagaattccgactcgaagacgctttcttctgcagccggagttagcttccaagcggcacagtcgggaaagcacaagcaaccaaaaaattctcagggccctccaaatcccccgggcttccccgccaattccccaaaggtgttccgcggtgaagaagatgacgaggacgaagatgatgaatatgatggtcgtgcgggtggataagatggtgattgagttgagtcactctctcccaagcccaaccgaatgtgaatcttccctccctcccgcccagcggctcagcccgctcggccccgacgccacgacaaggctgggctggtctcggtccccgtgccctcttcccctgctctgctcaccctccaccctcggtcgttggaatggaagggccattgtcaaggaggtgaaagaagggtacagcttgcccttcatgaacggcctctggtacctcggccgcgaccacgcta

SEQ ID NO: 31709 - DNA, 1216 bp, Triticum aestivum
  unsure (1)..(1216): unsure at all n locations
  Clone ID: PAT_TA_31709
tggtcccgccttgcgagtaccggcggcggccgccggtccgggtccacttcttttttgccaaagcccaccccccccccccccccctttctcctctttctctctcttcctcctcctccccgttgagagtccccttggtttccccggctcctctctctttctcctccggcggcgccgctgcttggagtggggatgagaggggagcttgggctgctcatgtctatagtagtagtaggtgtaggtttgccgttttagtggtgtttggccttgtgccgtggattggcgtcatgccgtcggggagttggtcaccggagcttgcaagcagcttctggtggtcgccgttggagccttctgctctgcctccatggtggaggcctaaggaaggagccggatctggcgaatccccccataataagcttgttgggccactggatcaaacctctgtggttattctctcgcttcctaccgtcgcggtggcggagcttccgacgagggtggtgtcgttccctgatcgagagaagggcttccggtgtgaatctggaggcagacgatggggatcctgagcacaatcagcagtggattcagagaagctacagcgccctccatggctggccggccttctctaacgatctgctgaatcttcaggctgaatggcggctagttttattcctccagggcttgatgccaacaagggaggcagtgctgcttgaagtggagtctgtggtgcagccgcagaggtctcgccggaccaagtggttcgtccccggcgccggcgatgattggatccactggagagcagtttggacccggtcgctttttccttccagtttcgaagtccttttcataagtatcagggacttgcctgtaattttcagtttctttggagtcctgtttgtaagatgtgctgcgcactgctttgaataatgaagttctgggtccttcgaggcccttcactgttcaaaaaaaaaaaaaaaaaaaaaaaaaaaaaagcaccaaaagaattaacaaaaaacgagcctaattaaacaacaaaaaagggtcgttttnaactccntacgggnaaaactngggtaccaanntaaaccccntgganaaaacccctttttcaaaanggggtnaaacaaaaaggcccacnattcccttccaaaaatntccccccaaagggaatggaaccccctttngggnanaaccggggggtgggtaccccacntcccnaaat

SEQ ID NO: 31710 - DNA, 665 bp, Triticum aestivum
  Clone ID: PAT_TA_31710
aaatcacaagatcaaaaaataaataaataaaatgtcttcattctggcagggtttaccagccggcacgagtatcaacaagacaaataaaagccaaaatcgtcaaaactacatggatcaagtggctctgagctggcacatacatatatttgtgttagctacataaaggtaagtgatcaatccatgaagtaaactaaatgacgatctcctggctttgctctgtatcttctctcgagtcttgacagagaaatgaccgagatcgcaaaaagaagaaaagaacagagaggactagtacactaggtggattcgaaaatggaaataccgagaaaagaaatcatgtcgggcagggtggtataatggttcaggcgtcgcatgtgttggccttgtcgactcccgtggcggtgaccttgacgtgggtgcagacagtcatggtcttgttgttcttgccggagtactcgatcttgacgtcgtacattgtgacgccttcgcagggcttcttttcggagcgcagcaggctgagtcgatcaggggtggctaaggtgccggtgatgtttttgcgttctcgttccttgtcttggaccctaccggcgtcgcccttagaggtgcaaagtttgttggggcagtacttctggtcgatgatgatcgggtagcccgagtcgtccatctcg

SEQ ID NO: 31711 - DNA, 719 bp, Triticum aestivum
  Clone ID: PAT_TA_31711
agacgacgaaccggagaggaacatcagcatcgcgagttttagcatcgcgatttccctagaagcgtctcgcggagaaattttgttggatttggtccccggattccagcgcaaagatgccgcgcattcccatgatcagattccccaagaggcatctcaaagtcccatccccagcagcggcgcagcctgccgaccaagcacgcgaccctcatgtcccgattggtgagctaaagtagagagaccatcttttgtcagagaaaaaaaaattaccgcttttagatctagaattgtgccttccggcaccttccataataatgttgttagggggaaccacgcttcatacgccagcccaagcgccaaaccagtatctgagtaaggagattgaatgctatcatgcgaggcggtgtcttctgcatatttgcttccgggccagttgtcaccttttgaggcagcaccactcagccccacccccgcgctgcattcccgcaccgctctgctcaatgtagattcgttatgttttcccttcccgttaggtcccaagccccaacccccgctgcccggattcctgccccctcactacccactacctaaatgtggctaaccaaggaaaggtgaactatggacgtgtgatgtacgtgggggtaccatgcaatgcaaaaataatttcatgaaccatccttttttgaaactttataagatttttttctcgtgtaaaaaaaaaa

SEQ ID NO: 31712 - DNA, 446 bp, Triticum aestivum
  Clone ID: PAT_TA_31712
cgggcatcactaaatactaagccaaatgagaaaaagattccacggatgagatattttatgatcacagatattttttaccacaaccataacattaaagttgtctaacatgtaatcaagacttcaagatatagctccctttgcaccaagagttcaacaaaacagtttgcaggcaggaaaagttaaagctctagaaaaaatcctttatgaagttcccatgactaaaaagattcctcaatgaagttccattagcaccaagttataacttttcactggctaattaaggcatgaatgatacccacgactacaaaaattacgacctctcaaacaacaacagaacagaaactttatatgtccattggcctagagcaaggaagaacctctatgaagttggtggaaaaggtaatgtaagttggtgggaacatagatcacatacctgaatctaatac

SEQ ID NO: 31713 - DNA, 752 bp, Triticum aestivum
  Clone ID: PAT_TA_31713
gttcgtctgaaaacaataaaattcacacaaccagaagtaacttgctcatcaaagaaacgacactatcgtatttagttgtaacttcacagtattccagaagaaacaaactcatttcctcttctattgcctgttgtaaactacagtatacatgagaagaaagagggcgtgtattattctggttttgtttgtaccaaggcgcaagtgatcttgcagcgtcaggccgcaaggttgaagtaaaccgtgtagaattcgtccctcaggctgtaaaacggctccaggaggaagttcctctttacccccttggcgacgaagcttactgggtggtactgcctcagcggagcggcctgtgcaaagcttgccgcctgctcgagtatcccgccgatgctctggacagaactcttgcagctaacctggatctttgccccggcagagtaatctgccccagacaccaagaagcaccctggtttggttccgagctcgagcgaaaccgagtttggcttcccgtcgagcccgggtactatgttgaagaaggaaccggcgctcttttgtgcggacaaggtgaggttgttggtgatcaccgttcctggcatgtcgaatggctcgatctgcacagaggtgtctttcagggttgcaccgtaggtgccatgcagcattgctgcgtcctgaggatgcaccctgaatgtcgcgtggacggcagtgtctgtgccatcgactgcaggccgttcttgcattgtcagagagccgttgagctc

SEQ ID NO: 31714 - DNA, 1627 bp, Triticum aestivum
  Clone ID: PAT_TA_31714
cgtccctggcttgcagttgccggacactcggtacgatctggaggaggttcgtcgcgaaccgcaaccagcgcagcactccagttccttgcgttccaggttgctagctccatcagggcctgctacactcttgtcatatacgtggaatgagacgccccttcccctaagtgcgcaaccagcgcaaaatgagccggggaacagatacgggcccttcctcgagcttgttcaacagtgactcgggcgtgctcaccttagccgaccttacacgagacagactgtccgacaccggtgagcttccatcccatggaagtaacaagcatccaggtgcgctaccttctgttgctgatgactttgaccatgaccgtcgatcgacctttggttggtgcatcggtctctgcatcatcagagatgcattacctcatcggccggagcagcctcgccatgggattcactgtgcagaccaagccccctgccgttagccattcatccagcgctgctgaatcagaatctgactgcgtcgagcctgatgcggaaggacccaacacccctacttggcaacacattcgacgcagctcgaggtaacgctaagacgtcatagtcaaacctcgcggtgatgttagtggtagaactggatttgggtgaggatagtggcagaactggacttggaaccgaagatacaggcgacagcaggcgtgttggctgtgaacttgatggtagtagtgatggctgctgaatttgatgtgagcttgatggccccaatggtgcaggtacagtggggtgtgtgcgtgggtgcaagcttgatagtgatgggttccctgggggtattgcctgtgggcatgattgtcttatatttagtgcagtcacaggggtagaccgtgtccttgcagacgtgctctcgagccaaattggaggctgctgctgatttgcatgtgccatcgaatgcacctgtggaggcaacctgtgctgaagatgaggagcaggtgcacgcgttacttcactctggactccaaagtttccccgtggcagaactggcgcgagaccaaaagtagttgatgttgatctgtcaatgctttgtagtacggaggggttaggtgaagatggcgatgatgatgatgtcggtgatggttgatcgacctgtaatggttggacatgatgcatctgcactggtggtcgaccagctgtcgacgatgcagttggtgatgcagtcgatgccgccgctgaaggcctcatgggaacttgctgagaagcctggggtctctggtgatttggagggctgtgggctctagcttgcgctccagaagaagatatgaatttagcccgaaaatcgtcagctagtgactggttgaggataactttctcacataaactatcaagcaccttcctttgctgaagatgagtggaatcattttcttcaagtaacgaattatacttttgtttgaccttctctatttcctggctacactcggtcataagttgtgattgctttagttcgtgggctttattacgtgagtcaatgtataaccgtaatctgtgcaactcatttttcagtggttcatcaccaactggtggatgattaaacatcattggagcccccagaaagagttgtgctgaagaacccggtgcggcctcc

SEQ ID NO: 31715 - DNA, 609 bp, Triticum aestivum
  Clone ID: PAT_TA_31715
gcccgccctttttttttttggtattaagaaaaacgtcgatataactcaaacaacaacgtgattatacacggacgcggcatactgccgcgccttctgcctgctagtaagatacaagggtactcaagatacaacactcatcagctgcaagcagcatttctagactactgctgcgacacgagtgctaccaacagctacaggctacagctacaaatttacatttataatcatgcagttaaaacgcatacgttattctagcatatatgcacaccatatttgccaagctattagaattgatcggttcgcgggttgcaactagtccctattgtcattcagcagggagttgacatccggggtcaccacgacatgctgtctttcgatctccccaagctggcagcaatgtttccttctagtgttcaccgctactgcgtgctgctgcatcccgcattccgtgcctgggctcacatcgaacacggcatctcccagcttcatcttgaccttgccgctcttgtacaccagcatcttgcccatgtacccccctggcagatcattcaggttgtacccttctttcacctccttgacaatggcccttccattcctatgaactacagt

SEQ ID NO: 31716 - DNA, 649 bp, Triticum aestivum
  Clone ID: PAT_TA_31716
aaaccaagataaggtcatgcatagataaacccttcgagaagttgctcacgaaatagagtctcacataacagctccaaccctcaaatgcttctatactgagtaaagtaaaacatgttcacataaccggggaaatccatgatcaacacaaagacacaatataacacacgacacaacgcatgcccttgttatttagggtatatactataaggcatgccagttttaatccaattcgtgactctccagatccatcttcctctggcacatgcacccgcgccgcatgcatgcagctaaccttccacgggacgcggcatgatgctggcggtgacagcgaggtccacaacgccggcgacgagagcagcgatccgcacacgcaggcactggaagtggcacggcgcgaggacgctcagggtgccgtgggccaggaggtaggtggcgacgaacacgcagagggagctgcccagcatccgcccgagcttggacgccgtcggcgccggggcggccttccgccgcgccagggccatggcggagagcacctgcacctccatcgtgcccaccgcgtagacgcagaagacgaacaccgcgctatagatgtccatggccacacaagcaagcaagaccctagctagctgcagatggattttggctgggt

SEQ ID NO: 31717 - DNA, 773 bp, Triticum aestivum
  Clone ID: PAT_TA_31717
tttcgtccgaacgtaattcttatattactcacatccgtcgtggttgcatagatacgagcaattttttgtaccaaagaaagaagacgagataaaccaatacaagatcatgcatagataaaacccttcgagaagttgctcacgaaatacagttcacatgacagctccaaccctcagatgcttctagtactgaataaagcagaatatcttcacgtaaaaccggggaaatccatgatcaacacaaagacacgatataacacacgacacgacacatgccctcgttatttaggatatactataaggcaggccagtttctaatccagttcgtgactctccaggtaccgaaatgcttcatcttcctccggcacatccgcatgcatgcagctaaccttccacgggacgcggcatgatgctggcggtgacagcgaggtccacgacgccggcgacgagagcagcgatccgcacacggaagcactggaagtggcacggcgcgaggacgctcagggtgccgtgcaccaggaagtaggtggcgacgaacacgcagagggagctgcccagcatccgcccgagcttggacgccgtcggcggcggggcggccttccggcgcgccagggccatggcagagagcacctgcacctccatcgtgcccaccgcgtagacgcagaagacgaacaccgcgctgtagatgtccatggccacgcaagcagagcaagaccctagctagctgcagatggttttttgccgcagctttgttgtgcgctcgtgccgaatcccgg

SEQ ID NO: 31718 - DNA, 524 bp, Triticum aestivum
  Clone ID: PAT_TA_31718
ccgagatatggccctacgtgccctacagccaggtcagccagccctacgtcgccggcacctacgacaagcgggcccccgccggctacgtcaggagccaggagcccggctacggcaacgtgtccggccaggtcagcaggcaggacgaccagctcaccgacatgttcaacgacgacaacgccaactcctgcgccgtcatgtgatgtgatgagaggaaaaaaaataataacctgtgctgatgttctgcatgcggctggtgatccctggaaggaagtgttggacaatgtttgtgagttcatctcaagtagtagcagcgaaactactatgcagtagtagtgctgaagtatgaatgttactactagtagtagtttggagtgctgattaggatcagtgttgacgatccaaccctcggactgtcacgggtatgagtcgagaaacccatggatcgtttgggtaacttggtcgtgcagaaagacatctcaatgtttcgcaaaaagagagagagagaaagacatctcaatggcctg

SEQ ID NO: 31719 - DNA, 1000 bp, Triticum aestivum
  unsure (1)..(1000): unsure at all n locations
  Clone ID: PAT_TA_31719
ggtttgcaggaaccggaagtctagtattaagacagtcaagcacaggaccaggccaccaaccacacaagagccgatcaagacaccagcaatggccggaggaggaagcgacgaagtgaagctgctgggcatgtgggcgagcccgttcgtccttcgcgtccagctcgcgctcagcctcaagggcgtcggctacgagtacgtcgaagaggacctcaagagcaagagcgagctgctcctcaagtccaaccccgtgctccagaaggtgccggtgctgatccacgacggcaagcccgtgtgcgagtcgtcggtcatcctgcagtacatcgacgaggctttcgccggcgtcggcccctcgctcctcccggaggaaccccacggccgcgccgttgctcgcttctgggccgcttacatcgacggcacgctcgtgaaagcgtcgtcccaggcgtccatggccaagacggaggaggagaaggccgaggggaagaagcaggtggccgccgcggtggagaccttggagggggccctgagggactgctctaacggcaaacccttcttcgggggcgacaccgcggggtacgtcgacgtgatgctcggcggcctcctcgcatgggtgcacgcgggcgataagatgaagggcgtcaagaccttcgatcccgccaccactccgctcttgggctgccgtgggcggacaacttcggatcgttggacgcggtggaggcggtcatgccggacgtgggcaagctggtcgagtttgccatggcgatgcacgctcgcgccgcagccgccgctacaaactaaagagacgtgcctacaatcatatattgttttctgtatatcgtttgtgttatctctgtggaatttgtgtgcctatccatataatacgtcaatatgtcacattcgtcgactttaaatgttgaattttgtgtttcatgtttgaagatataaaaaagggtttgtccccggaccaattcccnaaggagtgtatacgccnaatggctcttaa

SEQ ID NO: 31720 - DNA, 913 bp, Triticum aestivum
  Clone ID: PAT_TA_31720
cgggaaattcctaaaaaagagccagagtccacgctccggaagaaaaagacaccacctttgttcgcccttctcctccccctcgtgacaccactcccagagaaagagagagacagatggcgatgcgggcggtggcggtgctgctgcttctggcggtggcgagcgtgctggcggcgggcgcggcggcgcagtcgacgggcacgccggcgtgcgcgtccaagctgacgggctgcgccggctacatgaacggcacggacgcgcagaagccgccggagacctgctgcggcccgctccgggacgccgtgaagaacgagaagccctgcctctgcgcgctctacgcctcgcccgagatcttcaaggccttcaacatcaacgtcaccgacgcgctccgcctctccaagcgctgcggcgtctccgaggacgtcagcagctgccccagcacctctctgacgaagtctcctccaggttcgagttcttctccatcaggtggcgctccatcaggtggcaagagcgccgggcaccctaccatgtcggccagcttcgcggggctgatgagcctcttcctggtcctgtggtctgcactggcataagaaatcggcgattcggcatgctagacatgttcttctttcggcttatatcccatggtagatgagctgcagctctggtggtagttcttggtggtgtcgccgcgtttgtttttgctgtgtattggtttggtgttgccagttcagtagacttgctgtgaataaggatttcggcactctcttcagacctgtgatgaccagagcagagtgggcattgtgtgagacgtatttcggcttcactattttcttttcttttgtatttgtgctaatgagaggatcttttttaaagaatagggcaccgccttggccccattttataaaaaacctcgtgc

SEQ ID NO: 31721 - DNA, 955 bp, Triticum aestivum
  Clone ID: PAT_TA_31721
gcttcgtggcacgaccggtcgcctgcgttgcgccggtcatgggcagcggcagggccagccgatggctgcgggtcaagccgaccgcggtagcggcttatctttgggagaggaggagaggggagaaaaagtccaggcctggcggcgactgaggaggtgctacgcgccgccacctccacctcgacgcgccgccagatctccacctcgacgcgccaccggtcatctgcatccacgcgccaccggaaactccgccttgaacttcggtttttgtggtgtttccctccagtttgtcatgaaccacagaaggacgcacaggagcagcatctggcattcagagcctgacaggtttcatggttgcacacaagcgatgggtcaaaggagcctgcgaaatatttttggtcctaggtaagccgctgcgtgtatgacggcctaagatgccatggccggcgtggtgtgatggtggtttacagcggatcaagattgttggcaaggacttcccactgagtatgagaggccggtgaccatccgtccatgattcttcctcggtatgccactctgaggatgtcgaggccttcccaatgagtatttcagttcccgaagtctctctttctgatggcaagggactggtgaagcacaaacatgcgacatggcttggagtagacaccaactccatggttccattctgcaagatgtggcttggattaccgtgctgctgagaacagtggctgcgcttggttttgaaattgggaaggtttaattcaagatttttatatcttccccctgtttttgtatggacaatgtgtgtgctgtttataaaatgtttagttatgtttggctgatgagtataaactcttttctctgcatgtttaccatgaatgatgaaacacacatcagttggctcacttgagttcctgtgctaactgataatccatgcagtctcttattctgtatgctatac

SEQ ID NO: 31722 - DNA, 1279 bp, Triticum aestivum
  Clone ID: PAT_TA_31722
gccgcctccaattccctcactccaccgccgctccttctcggcccttcccggcctcctcgcattgcagggagcctccccctccaattccctccctccaccgccgctccttctcggcccttccccgccccctcgcattgcagggaggagaggactcaatcaagatgccgaccatcatcatcaaggtggacctggattgcgcccgctgccaccgcaagatcgagagggtgctcgacaggatcagagagaagggcgagttcgtgatcgacgacatcgagtacgatgagaagaacaacaaggtgatcgtgaagggccccttcgacgcggacaagctctccgacaagctctgctgcaaggcctgcaagatcatcaaggagatcgagatcgtggagccgccgccgccgccgccgccggaggagcccaagaaggaggtgcccgcgcccccgccgccggagccggaggtcgtggtgccgccgccgccagcggtcgtcgaggagcccaagtgccccgagccggcaccggagccgcccaaggaggagccgccaaaggaggagccgccgaaggaggagccgcccaagaaggaggagcccgcgcccccaccgcccaagatcgtggaggtgccgtacccgtggccgtacccctacccgtacccggcgtggccgtcggactgctgctgctgccacggccacggcggctgctcctgcaaggaagagccggcgccggcccccgcgcccgcacccccgccgccccagttcaacatctacccgcagtacccgccgtacccgcagcagccggcgtacccgccgtgcggcggctacaagatcgtgtgcgaggaggacccctcctacgcctgcgccatcatgtgatcgatcgatcaatcagtacgtcgtacagtactccgttcccaccacctccgtcccgctgctacgctgccgccattaatccggccgtcccgtataagcaccgtacagatacgatgataaactcttcgcgtacatatacacgcgccacatatacacctactctctactccctcgctgtttatttcccctgtgattagtagaagccagaataaaatacatacccagatgcattcatgtggtacttcgtatactactactactagtagaaactaaggaggatccgagatcggtcatcggtgtgtctgtcgtctcattgtcagcgccccacttttatcaaattattagtatgtgctgctgtgacatcttctcactttaaaaaaaaaaaaaatgtatgttgcactctgaaaaaaaaggggggg

SEQ ID NO: 31723 - DNA, 846 bp, Triticum aestivum
  unsure (1)..(846): unsure at all n locations
  Clone ID: PAT_TA_31723
gtgttaaccccattgctggtggtgtcgatcgcaagaaccaactcgacgaggagaacctgagcggtatcggactggtaatgccttgaggtagatgctggggttgtacgtaggatgacatcggaagtcgatcctcaactgcgaatctgttgtgatcttctaatgacggagctgaccaaggagaaatgccggacggccgacaagctgcaggatagcatcggtgatggcaccgtcggagtgcctggcggcgcgacggcggcgtgctgggactgcagcatctgcctggagacggcgtcggagccggtggtgacgctgtgcggccacctctactgctggccctgcatcttccgctggctcaccacctcctccaggtccaagtcccgcgcctcgtcctcggcgcgctgccccgtctgcaaggccgccgtctccgaggaccacctcgtgccgctcttcggccgcgctcgtgccgccaccctaatcccggccggaggcagaggaggcagcgtctgccaggtaccgcgtcgttcgccggtgccggggccgaacgcggaggagcgccttcaggggccggacttgcacgacggcggcaacttctactactacgagaatattgggatcaatggcctggactgctccaacgaggagcgcttgctcggcggcatcgcgctggcggtgctactcccatgggcgacgaggggcggtgggactgggaggccgccaccgccgtcgttgtaccgcgacggcgagggctggaggatggcgcgccagcanaggcgggtggcgcgcangttgcggcagatgtgggtgttcctcgccatggtggcgttcctctgcttccttcttctttga

SEQ ID NO: 31724 - DNA, 831 bp, Triticum aestivum
  Clone ID: PAT_TA_31724
gccggccgggccgggattcacttattcagtggcgaagagcacttaagcggcaagccggccggaagagcaacatggagccggtcgtgaaggtgtacgagccggccatgtcttggaacatagccagggtccttgtgagcctggaagagtccggcgtcaagtacgagctcgtcgccgtcgacttcgccgcggccgagcacaagagcgccgcccacctcgccaggaacccgttcggtcaggtcccagttttggaggacggtgacttttgcctctgggagtcgcgcgcaatcacgaaatatatatgccgaaagtacaaacctgagctccttggggttggcaatctcaagggatcagcaatggtcgatgtgtggctggaggtgggggcccaccaatactggcctctcatagaggctattcttatggagatcaggatccggccgattttcgggcaaagggttgatgagagggccgtcgaggagaacattgacaagctgaagaaggtgttggatgtgtatgagtccagattgtctagctccaagtacctagcaggagacttcatcagcggatcagcctcgccgacctcaaccacgtctccaccatgctttgcctagggatcactatatacacatcggtgctcgacatgtacccgcatgtaagggcctggtgggatgacctgaagggcaggccagcggctaggaaggtgtcggatctaatgcacatgtctgtgaaggatgatctaaaatgattttgttggcaacacctagctctttcattaatgtgtttgtactttttcggtatttggtcaagctgtttgtgttgaactagtgtttgtgt

SEQ ID NO: 31725 - DNA, 1073 bp, Triticum aestivum
  Clone ID: PAT_TA_31725
gcccggtgcactgcgtcctcggggatgctgtggtgtcctctgcgcgccggcgcgggatgaggaggtggtgacgcgcgcgatctggatctgaggcgcgctatggctgctccgggtatgtgagctttctgcttggtggctggcggctggatgtggtgtggctcgcggctgcatccgcgcaatctggagttggtggctggcggctatgcgcggtgccggtgaccttgccgtgctgccatgaatggaggtccaaagctgtgactttttcttggccgaacggaagttggaagttgggctgcgtgcccttagccgtgtagggtggtgtactgcatcgttatggccacaatggctaggtgctgcggcggcggcggagtggcccttcatggacagtgtgcctcaatccgatgaggagtgttggagaggtgcgacgacacggatggaaatcttgcccggctttgatcggtgctggcggcgatggcgcctgcgggtgtcgctaccctccttggaggcgtcactaaggtgtgtcggcatctcccccttctagtttgggttgttgtctccgagcgaaagccttggttcgttcccggaccggcgatggcggcgtcttgacgtcgttcctccgttgagagcatcgcgtgtggagacttggcatggaggctctatgttgtggttcttcggtgctcgtcgctggtccaagtagatcttcttcggcgctatgcacgtcggcgccggtgagttcaagacgatggctatctcgggaccgactgagtcccgccacccactcaccatccccttttcggcattcaagggtggctggtgcgtcgacaaggggagtccggtggcagttgttcctttgaggtgacctgtgttggtcgagacgcggctttgttgttctatttagggcaagttcctttgccttgtgtttgtaatgtgtgtggtggcttttcttcggattagcttgggtgtggagttgtactacacatgttgttcgcagcaagtggtaatctcttgtaattatcttctgtcttctattaaaatatgatacgcctttgaaaaaaaaaaaaaaaaagccccta

SEQ ID NO: 31726 - DNA, 1179 bp, Triticum aestivum
  Clone ID: PAT_TA_31726
tcgaggccggccgcgtgggcggccgacgcgcaaccggcaggcgaggcgaaatcgcaacgcgcaacagctcacctaacaaccggtcgaggccatggcggcggcgcagaagccggcgaagcggctcggtggcatggcagaggcggtcgccatcgccggggacctcggcttcccggcccctcccgcgcaggaagatcagaacaccgacaaaagtgatgacctggtgagggtattacgggagctgacagtcgtgcagcggaacattgccaatttgcaagtcgagctacaaggcagaaaggatgataaaaacattgctcatttgactcatgttagtgaaatggaaaagaagtgtgaatctttggccagaattactgctattttgaaagatgttattcaaaacaaggaccgcattattgcccgtctgcagcaaccttactcgcttgattgcattcccgttgaagctgaataccagaaacaattctcggagctacttctgaaagcggcaagtgactatggggcattgacagcatcagttggagatttccagtggagtcaaaacttcagagagtcgcctgctgtatggggtgaaatgctacgaccgatacctgctgcgctcgcatcctgcacccggttcttcgaggccatgtctgcgatgagggaatccttttctactcttcaaacactacgcgttggtccttcttctctgtcaatgaccccaggtggctccagtgatgattcgaagttcttgacgccacctcagtggagagagggctcgacgctcaatagctggaagcaagtggatgacgtaaaccctgaaagtgatggactcgacagtgtaaaccagaggaggtgtcatggcatcctcctggacccgggacccggagggctctccgcacctagcggttgcctccaggctcgcaggcggccccattgagcactcccaggctttgccgccttccccgtggagtgtggcctccacgctcatggcctccacccaagtgcacgacgcaaaccctgaaagtgatgaactcgacaatatcaaccagaggaggctgtcatggccatcctccattaacagggacctgtagattacagctcaccaagctaatactcagctatttgcattttgtataaaagataggatcggcgaggcttgtcttccaaaaaaaaaaaaaaaaaaaa

SEQ ID NO: 31727 - DNA, 400 bp, Triticum aestivum
  Clone ID: PAT_TA_31727
cccacgcgtccggccccactccactggtaacatggagtcttctcatttgtaatggcatagatataggaacgagcaattcagctttgctataagaaagcgacggacaaaagagaacaggatattgttgttgagagctagctctggtcacatgatcatctatctatatagttttcaacaaaagagaactggattatttttactgagggctagctctggccgcatggtcatccatgtatatagttttcaacaataaacgtgtcatgattggtacatcataattagcaatcttagtttcttctgatctcataatttgaagatgaaccgaagaggggaatgtgtactatgtttcgaatctgtcacactaaatgtgtatttgtggtattgatgtacagttattaag

SEQ ID NO: 31728 - DNA, 760 bp, Triticum aestivum
  Clone ID: PAT_TA_31728
aggccgcatcatatagtaagactcactagggaagcctccgaataagttcaaaaggtttggaaaactgcaaagatttgttaaaaaggaaaaggcctcctgtttctcaaactgttcaactcgacaacttgaaaaacctaaacctacatggtgtatctctaacagaataccccttcaaaaaggttttaaacggtttccccttaaatggggaaaaccctcccacgcgtccgcccacgcgtccggatatgcacccatggatactctctgtacagagaacgctggaaaattacgtcgcatccgaggccacaacaaataagcttgccagagatgccttctgttcctggcttcgcgcttacaccgcccaccgcggtgagctgaagaagattttcatggtgaagaagctccacctgggacatgtcgcgagaagcttcgggttgaaggagcaaccctcgctggtcgggaggtcgcaccaggtgcaactcaagaagaggaagaaagaacagaaacgcgaaggacaaggaccgaccaaacggagaaaattccccaccaagaagtgaattcccatatggcaatagaagatcatcacacaggagacagcacctgatggatggtggatcatgaaactaacagcagcagcgattttttgcaagaaactcatgagagctagacaactaatttactgtgcaaccacaggattttgtcatgtgttccttggatgtaaaatgtttgattatctttgatcataactctcgtcttgtttgtc

SEQ ID NO: 31729 - DNA, 1030 bp, Triticum aestivum
  Clone ID: PAT_TA_31729
tttcaaaacctaaccttgatcttacactatattctgctctatgcgaagacggaggatattcactatgtcggatttttaagtaaacttctcgaaacaaaaatcatgcaagtactccgcttcaaatatggacaggtctactcagttaatgtaggtgtcttcttaggtggcaacaaaccttctagaagtggagatgttcgtggagacataagtgtgaatttctcatgcgatccagacatgtcatctaggcttgttgattttgttctggaagagatatcatatctacagacagaaggcccttctgaagaagatgtatggaccatcctagaaattgaacaaagagcacatgaaaacggattgcaggaaaattattactggttggatcgaattctgcggagctatcaatcaaggatttattcgggagatgttggatccaccttcatggttcaagatgagggacgtgtaaaagttagagaagctttaacaccacaggccatgcaaatggccttgcgaagggtgatatctttcccatgtaaaaaacagtacacggtagtaattcttatgcctaagtcatcttgttggaattcgttgatatcggtggttagttggagttctggtggatttagcagagatgcaaagatcttggctggcatggctggtgcactggtcgtagcagccagtttgtggagatactcacggggtgcatcgagatcgtagtgcacagcacatctaagttaagagccaaattggtagatgtttgttaccatctcaccatcagccagcaaatctggttgttggtgcggtgattcttcatcacggaagaaggtatacagaaatcgctagctaactgattcgttgctgcgtgtgtgtaagattgtaacaacattggtttactgccgcatgcgtgcgtgtaacagccgctgattactactggcacctcccagttgattcaaatggtagaacgcttatgccagattcagttttgtcgagatcgattgcacgtgctttgtgtacctcggccgcgaccacgcta

SEQ ID NO: 31730 - DNA, 1981 bp, Triticum aestivum
  Clone ID: PAT_TA_31730
gctattttctggagtgaggtgcacttcttagaatgcgtgactcaggatggtaacgatcacatccacacagcaaagttggttttgattgttgcaaccatagtatctgctattgctatccccaagttcttttttgtactgtgcaggttcttgttggcacccctggctgtatggatattcctagcctacaagtacatgaaaacaaggatcataattgatgcagttgagaagttcctcaggattcaacaaatgattggcccggcgaggtactcctacacagatatagttgcagtcacaagccatttcagagataaattgggccaagggggctatggtaccgtgtacaagggcgtgctactcccaggcgatgtccatgtcgccgtgaagatgctagagggcaactccaactgcaatggagaagatttcatcagcgaggtctccaccatcggcaggatccaccatgtcaacgtggtgcgtttggtggggttctgctcggaggaaatgcgaagggccttagtctacgagtacatgcccaatggctctctagacaagtacatcttctctgctgagaagagcttctcatgggacaagctcaacgagatcgcttggggtgatcgcggccgcggccttacatcaggggtgcgacatgcagattctgcactttgacatcaaaccgcccgatgtcctccgcgtcagcatgttgctcccggaggtcgccggtttcgggctcgccaagctgtaccccaggggggacactttcgtgccactcagcgccatgcggggaaccgtcggctacatagcccccgagatgatatcccggagcttcggcgtcatatccatgcaagtccgacgtgtacaggcttggggatgttgctgctggagatggccggcgggagaagcaacgctgatccaaacatggggtcctcaagccaggcgtactacccttcatgggtgtacgacccgctgactcgagaagaagctggcgagatatctcatgttgctgcccacatgcagcgagctggagaagaagctttgcattgtcggattgtggtgtattcagatgaggtctcgtgatcggccgacgatgagcgaggtcatcgagatcctggaggctggggttgacggcctacagatgccttccaggccgtttttctgcgacgaagggcacatccatgtggaggactcttaccagttcgcttccgagctgtcggcggtctcggaggaggaagtgagtgtggtgtcagaggaagacgacgtgcgaggtatatatacaatcggcgggtacttcgtcccgtacgtcgccatgttcggactcgccgaactgtatccggggggtgtcagggtcgtgccactacctgccctgcggggaaccttcggccacactgcccccgaggcggtaccccgcagcttcggcgtcatatccagcaagtccgacgtgtatagcttcgggatgctgctgctggagatggccggcgggagaaggaacgctgatccaaacatggggtcctcaagccaggcgtagcgtggccgcggccgaggtacgaccggctgacttgggaataagctggtgagatttctgatgttgctgccgacatgcacgagctcgagaagaaactatgcattgtcggattgtggtgcattcagatgaggtctcgtgatcggccaacgatgggtgaggtcatagagattctggaggccggggctgatggcctgcagatgccttcgaggccgtttttctgcgacgaagggcacatccatgtggaggactcttaccagttcacttctgagctgacggcggtctcagaggaagatttgaccacagtgtcagaggaagacaatatgtgaggtatatatacaatttgtggtattaatttattatgtgtgcacgtatatgtatgtatcatggagtgatgcacttatctgtaaaagttatggttgtaacagtaccaacccagtataaatgctttctgtcagagcaacttca

SEQ ID NO: 31731 - DNA, 227 bp, Triticum aestivum
  unsure (1)..(227): unsure at all n locations
  Clone ID: PAT_TA_31731
ccaagccatggagcatggcgatgctgccaccggcagcggcagccgcagcggtgcgggaacgagcatccaggtcacggctctggacggcatcgtgaacgtgaactctctcttcaccctcgccgcgttcctcggcttggcgtggcgcccctcctccgacgggccaggcctcgccgacggcgccgaccacctgngcgcctgcgccgcggnggaccgcatcgagtctgacc

SEQ ID NO: 31732 - DNA, 3114 bp, Triticum aestivum
  Clone ID: PAT_TA_31732
cgcgcgcgccccaggagagcaatcccacaaacactcgccgatcccaatcaatcttccaacccaaaatcttgtcagttcgatccattgtagagcgcgagcgcaagcagcagcagcggccatgaacccggacaacttcacgcacaagaccaacgaggcgctggtggcggcgcacgaggcggcgtcggaggccggccacgcgcagatcacgccgctgcacctggcggcggcgctggcggcggacaagtcgggcatactgcgccaggcggtcgcgggggcgtccggcgggaacgcgtccgcgggggactcgttcgagcgcgtgctctccggcgcgctcaagaagctgccgtcgcagtcccccccgccggactccgtgccggcctccacggcgctcatcaaggccatccggcgcgcgcagtccgcgcagaagaagcgcggggactcgcacctcgccgtcgaccagctgctcatgggcctcctcgaggacgcgcagatcgccgactgcctcaaggaggccggcgtgtccgcctcgcgggtgcgcgccgagctcgagaagctccgcggcggggacaactcgcgcaaggtcgagtccgcctccggcgacaccaacttccaggcgctcaagacgtacggccgcgacctcgtcgaggtggccggcaagctcgaccccgtcatcggccgcgacgaggagatccgccgcgtcgtgcgcatcctctcgcgccgcaccaagaacaaccccgtcctcatcggcgagcccggcgtgggcaagacggccgtcgtggagggcctcgcgcagcgcgtcgtgcgcggggacgtgcccagcaacctgctcgacgtccgcctcgtcgcgctcgacatgggcgcgctcgtcgccggcgccaagtaccgcggcgagttcgaggagcggctcaaggccgtgctcaaggaggtggaggaggccgagggcaaggtcatcctcttcatcgacgagatacacctcgtcctcggcgccgggaggacggaggggtccatggacgcggccaacctcttcaagcccatgctcgccaggggccagctccggtgcatcggcgccaccacgctggaggagtaccgcaagtacgtcgagaaggacgccgcgttcgagcggcggttccagcaggtgtacgtggccgagccgagcgtcgccgacaccatcagcatcctgcgagggctcaaggagaagtacgaggggcaccacggcgtgcgcatccaggaccgcgccatcgtcgtcgcggcgcagctctcggcgaggtacatcatgggccggcacctgccggacaaggccatcgacctggtggacgaggcgtgcgccaacgtgagggtgcagctggacagccagccggaggagatcgacaacctggagaggaagcggattcagctggaggtggagctgcacgcgctggagaaggagaaggacaaggccagcaaggcccggctggtggaggtgaggaaggagctggacgacctgagggacaagctgcagccgctgacgatgaagtacaggaaggagaaggagcggatcgacgagatccggaagctgaagcagcggcgcgaggagctgcagttcacgctgcaggaggccgagcggcgcatggacttggcccgcgtggccgatctcaagtacggtgctctgcaggaggtcgacgccgccattgctaagctggagggcgagaccggcgagaacctgatgctcaccgagaccgtcggccccgagcagatcgcggaggtggtgagccggtggaccggcatcccggtgacccggctcgggcagaacgacaaggagcggctggtcggcatggcggacaggctgcacacgagggtggtcgggcagacggaggccgtgaacgccgtcgccgaggcggtgctgaggtccagggcggggcttgggcggccgcagcagcccaccgggtcgttcctcttcctgggcccgaccggcgtgggcaagaccgagctcgccaaggccctcgccgagcagctgttcgacgacgagaacctgctcgtccgcatcgacatgtccgagtacatggagcagcactccgtcgcccgcctcatcggagcgccacctggctatgtcgggcacgaggagggcgggcagctgacggagcaggtgaggaggaggccgtacagcgtgatcctgttcgacgaggtggagaaggcgcacgtggcggtgttcaacacgctcctccaggtgctggacgacggccggctgaccgacgggcaaggcaggacggtggacttccggaacaccgtgatcatcatgacctccaacctcggcgccgagcacctcctcgccgggatggtgggcaagaactccatgaaggtcgcgcgcgacctcgtcatgcaggaggtgaggaggcacttcaggccggagctgctgaaccggctggacgagatcgtcgtcttcgacccgctgtcccacgagcagctgaggaaggtcgctcgcctgcagatgaaggacgtggccgtccggctcgccgagcgcggcgtcgccctggccgtcaccgacgccgcgctggacgtcatcctgtcgctggcctacgatccggtgtatggcgctcggccgatcaggaggtggatcgagaagagggtggtgacgcagctgtccaagatgctgatccaggaggagatcgacgagaactgcacggtgtacatcgacgccgccaacaaggacgagctggcctaccgggtggaccgcagcggcgggctggtgaacgccgagacggggcagaggtccgacatcctcatccaggtgcccaacggcgccctcggcggcggcggcggcggcgaggcggccaaggccgtgaagaagatgcgggtcatggaggacggggacgaggacggcatggacgaagatgtttgaagtttgaactctgaagctgaagtgaagcttgctgaagtgccgcctgtcggataaagtttgtagatgagttgcggtgaggcaggcaggcgcttcgtggtgctctgggaagatgttgtcctgtgacgcgtgtgtcgtttgaccggaagctgttacggcttcgggaataatcttctgtgtttttgtgagtctgttgaattgaagagagaaaagagtgtcttgtgaaaaaaaaaaaaaaaaaa

SEQ ID NO: 31733 - DNA, 534 bp, Triticum aestivum
  Clone ID: PAT_TA_31733
gccgccgcgtgttcggaagcgagcgaaccccgctcccctcctcctcgccttggtaacccaccccgccccaccgccgccccgctcatacgcagatcgacgcagcgccaatgtcgacggggggagcttcgctggtgcgccgcgccctcgaggccgtgcgccggacgccgcgctggcagaagaggctcgtcgtcctcaccgcaggagctggcactttaagctatgcttgccaggataaccgtgttcttcaaatcagtgatggaacggggggcaagaaaaaagtggttatacttggaactggttgggcaggtgcaagtttcttgagaaatatcgacacttctttgtatgatgtccatgtggtatcacctcgcaactattttatgttcactcctctgttgccgagtgtgacatgtggcacggttgaagcacgcagtattgtggagccaattcgcaatattgtgagaaagagaggtggtgcattcagattctgggaagcagagtgctacatgattgatccaacaagcaagaaggttcatt

SEQ ID NO: 31734 - DNA, 569 bp, Triticum aestivum
  unsure (1)..(569): unsure at all n locations
  Clone ID: PAT_TA_31734
cgttggtgcaattnctcgcntttctccacttngngtgctcatagcacaagagcaatcgacagttggagtgattcgcggctcgacaaacggataatgtttgcaaaagcaaatgaaatactccctcagatttctgataactgaatcagtgntcaatgcctcctgcagagcgtcagctnagcggctgctgctgcatctctccgttcagtagcatacctttccgatcttcgaaagtttatctgaaactgcaaccagtggaatgctgccatcagtccatttagcatcatgaagtgtgatttttggagctgctgcttttgccttccctgcagtagactctgtcttctttcgtggttttggtttctcatcaacggaggagtcatcgttactggatagctctgttgtagcatcactaagtcgccgtgacattgcttcctgaagttacagaagaagatcagttgtcattgctcaggtacatgaatttcaattgcatgtaaacctaagcaattcagaataaagcagtgcatataataagatatgcccattgcacaatgctcctgattcacacatacact

SEQ ID NO: 31735 - DNA, 1213 bp, Triticum aestivum
  Clone ID: PAT_TA_31735
gaagttatgacacgactattatgatttggcatgcattccgaggaagatcaaatgacaaaagatcaaagaatgcaagtaatgacctatcaactaaggaccatgttatcatcgaaaacccttctcacatcttgtgtggtcatgatgatattatcacatgcttatttgttagtaaggaacttgatattgttatcagtggatcaaaggatggaacttgtatatttcatacgttgcgtgaggggacttatgttcgatccattcgacatccatcaggtgctggcctgtcaaagctggtggcatcacagcatggtaggatagtattttattctgacagtgatctctccttgcatatgtattccataaatggaaaacatatcgcttcatcagaatccaatggccgcctgaattgcatggaactaagttgttgtggagagtttatggtatgtgctggtgatcatggacaaattgttctgcggtctatggattctctcggagttgtttggaggtatgatggatctgggaagacaataacttctttagctgtgactcccgaggagtgctttttggctggaaccaaggatggcagcttgattgtattttcaatagaaaacccattacttcgcaaaggcggcatacaacgaaacaaagtaaaatcttctgtaggttagtggtgtgtgattaagcagcgctccttgctgcaagttctgaacaaagcttgcagaatgctcaaattgcgtagtcaatctgcctctcgggatcttcccaggggaggagattgttgtgatgctcgtcaatgggggtcaccggcagtaaatgtaaaagagcacagtttgttgctcttctgtacatacagctttagattgaggagttaggattctccaggatgcctgagctgatcaaggtccacaagcagataattcttctaactgcaaaatggatacgtggtaactaataccacagtagtttctccttttgattttcgagatgagctcggataccgtggtgctggactgctagttgcatagctagtgcatgcgagtgtaacataatctcgtccggtgttcttacaagttagggcgagcaacttcctctcccaatagaatttatctgtatgtattagatgccagtatccggtagttacgaaatcatacattgtacatgaagctcatcttctgagtgggaaagtaagcggcacgtggttgtgccattagtctct

SEQ ID NO: 31736 - DNA, 1235 bp, Triticum aestivum
  Clone ID: PAT_TA_31736
cagtagctctagggagtggatggagtccgatgtcggtgaagggttcccgctatgtggcttcgactcgctctatgaaaagtactctcagagaatggtggcgtttgataagacgattacacaggtctttaaggattcagggtcattcaacatctcaaaaaagtcgcctagatcagcatcaaaattggcatcaaccttgcgcagtctatcattcaaaaggagggatgagcttcaggaggactgtgagaatcttcagcagcagcagagcgaggatgacccttaccaaatactcgagactgcttatgttgcacaggtttctttaagctgggaggctattcattgtacttacatgcacctgagtctgatactggtggaagagcaagacctggccgaccacaatggctgtgcttgcagctgctgtttgccctgacggacatcaaagtggtgtcgagggtgctgagaatggccaagctgagcaaggagcagctgctgtggtgcgaggtgtagatgagcattctggaaatcgcctacaacaaccagctgcgggattgatgacctaacatcttctgctgctgacgcatttcctttggccttcataccctagttagtgaacgttcgtttggcccctatcttaagtattcgtgttttcctgaatgaaggacaggtatatgtacagtgtcctcatgggttgttcatgtaaagactaggaagttccattcagcaagtccagtcctctctggatacgaaggagatgaaggtgaatgctctgcattagaagaaaaatttttggaagagcaagaacagcctatggaaaatagaggaagtccagctgcagtttgatctggtagacatcaaagtggtgtcgagggtcctgagaatggcaaaactgagcaaggagcagctactgtggtgcgaggagaagatgagcaagctggacctctccgacaacaagctgcggcgggatggatgccctatcctcttcccctgctgacgcattctctttggcagtgttcgttcgtttggcccctctgcagagcaagcgagcatagctgcttcctgagctgatatatgtacatcttaggctggaatgtttatactaaagtcaagtgtagtaccctacctaaaaggagattggtgttccaatccagttctgttgctctgcattagtttggggtttttatgcagcatggcaacagcgtatggtaaccagctggtaaattcagaaataaacatctggt

SEQ ID NO: 31737 - DNA, 998 bp, Triticum aestivum
  Clone ID: PAT_TA_31737
gttccttttccttccggcgcctccaaaccctagcccgtcgagccagccggaagaagcggcgagacattatggggtgggccgcgcggttcctgactgcggtctcattcctcgccgcgggcgtcctcttcgcgccggacgcgctcttcggcggcgcccccggccgcccagcagcgggcgtcgcggcggcgaggctggcccatgtactctgcttcgccaccgcatggggagccgcgctctgggtcaccttcatcggcggcatcgtcatgttcaagcatttgccaaggcaccagttcgggagtctgcacgggaagatccgcccacgcgtctgcccatgcgtccgggtgtgttcagctatatcggttgcagcatttgcatacctcaacccatggaagacagcatcaactgttgagcgttaccagcttggtttccttcttgctgccctcggttttgacctgtccaaccttctggtcttcacccccatgactatcgagatgatgatgaagaggcacaagatcgagaaggatcttggcatcggtggtgaggtgggacggtcaaggaatgccgagttggcaaagacaaaccctgcactcgcagcgatgaacaagaagttcgggatgatccacgggctgtcgtccctggcaaacatcatggcattcggcagcctggccatgcactcgtggtacctagcgagcaagcttgagttgtgactgttgaaagttaagtgatgagtccatgtaatggcctttcttctcagctggtgacaggagcttatagtctaggctgtctacagctaaagaaagagtagtgtgaaaactttgcatctgatgttgtgacttgggataataatgtacagagtgcaaggagtgtctagctgtttaataatgtgcaggagcgcagaaactctgctagaatcagtttatcttttacagatgatgatctgcgtatgaaacgggtgtaaactggtattggccacgaatggttgaagatggtgctatagc

SEQ ID NO: 31738 - DNA, 1086 bp, Triticum aestivum
  Clone ID: PAT_TA_31738
gcacgaggcagataagttcttactcggaggacgatgatatgcttggaattgagccgctcgaactacatttttctttccagcttaacaaacagatgtcatgcaccattcagctaaccaatgagacaggctcttacattgccttcaacgtcgaacatatgaacccactgtcatactgtgcacagccgcagaaagacattataccaccacgatccaagtgtaatgtagaaataacaatgcaaccgcaggccaaggcaccgagagatcataccagcgaattcactgtttggagcaccaaagtgaatgatggccttgccattgaggatataacaaccaatatgttcactaatgaggcagtcaatgtggttgatgacgtgaatttggatgtggtttttgacgtcattgagccacaagaagcaagtgaggaaaccagtgtgacaatccaacctttaatacagattataggtattacagcagagatgatcgactgcatagatgcaaatcagacagagccattgattataacaggtcaccaacgtggtggtgttcagatttggaactctgacacgcagaaagtggtcgcttcgatcaaggtctcacaggaagcagtatccactgttaaatttattgcacgaaagcggtggcttgtggctatgtcaaaagattgtttcgtccatgtgtacaagtatgaaaaggaacttgaaaaggtcacgagtttcaaagctcacaattatcatgacagtgactggtgtccattagacgttcatcctacccagccctatgtgctgtcaggatcgattgaccaaataaagctttgggactgggaccagggctggaattgcatacagacatttggagaacagccctatgaacttaaggccctaaaatttaacccagaggacaccaacagttttgcaagtgcttcagggtattttacagtagaggtctggagtcttgattctcccaaatctaagtatactctgtctgggcattcgggtaaggtgtactgcgtggatttcttcaatcgtgatggtcagcagtatttgattagtggctctgatgacaagactgccaagatatggaacatgc

SEQ ID NO: 31739 - DNA, 541 bp, Triticum aestivum
  Clone ID: PAT_TA_31739
ggcagcgaggacgagaacgatgaagatatagactgggatgaccgcctgcatttcccggccggggagaaggagatcgacatctcgaagaaccttcgggacatcatccacctggagataacgctggacgccttctgcagcagcacctgcaagggcctgtgcctcgtctgcggcgcgaacctcaacacgagcagctgcagctgcagcacggaggagccgcaggccaaggacgccaggcgtccgggaaccctcaaagacctgctgaagcctatgcagagaagattatgatgaggcagacagtgcatatgtatgtaggtatcttgtaacctgtgtgatagtctttaggattgccatgggcaagatatgcagcccggtgaaaatgcaaatacttgatggtggcgatagaggggaactagacctgcgacatctgagtcgcgtctcatgattcggtgcaccgacagtgcaaatctctctggcagttcctcacaagttcatgattatcatctgtattgcctcatcttactgtctgaaagtagaagcctgc

SEQ ID NO: 31740 - DNA, 602 bp, Triticum aestivum
  unsure (1)..(602): unsure at all n locations
  Clone ID: PAT_TA_31740
gatggaaaacatggtgtccaatgaggaattcaatgtggccttggacacattgaaaacctccatgacgaccgcggttgaaaacatgtttactaaattcttagaaggacttaaactacctacctcgtcgttgaaagtgggtgatcccactaacaaggtgacagatgctaactctgacaagggggaagctaatagtgagaagggtccttctactagtggtagaatggcaccgacatctttgcccatgtggaacctccaacttatggaggaccgattccctctactcatttaaatcatgccggtcctcctaagattgtgaaaaatgagaattttgattcttgggtgtatcgcttcaagcgtcatttaaatcatgtgaatactaatctttggggaatcaatgaagaagnctctatccacatgaccgaagcaactcaccctagagaagcgtgggtaatcaatcaatgagaatctctctcatcatccaagatgctatctcccgaagtntcctcancttcgacctactaagtcaaagaccatggnatncgtccgtcncctatcgggaaaccaacatcaagtcaactataatggngaagataaccttgntt

SEQ ID NO: 31741 - DNA, 580 bp, Triticum aestivum
  Clone ID: PAT_TA_31741
ggtctcttcctcctacccgaaacagcattttggttcacgggttccccagtatgtccactggcgccatggatttgcttgagaggatgctcgtatttgatccgagcaagaggattactgttgatgaggctctatgccatccttatttagcatcccttcatgagataaatgatgaacctgtctgcccagcgcctttcagcttcgacttcgaacagccatcatttactgaggaagatatcaaagaactcatttggagggaggctctcaagttcaaccctgaaccaattcactgaaaagtttccaatgtagaaaaagaagcaatttcaaatggcaaatctatcagctccgtgggaaaatacatgagctgacagcacgatgtacagagtaatcagtgatcacgtctcagcatcttgtcatacggcttgttgatgacaccatgacgtcgaaaacctggaaatttaggaataatgaacgcttgatcaataatttgttagccaaaaaaagtggggcccttatctgtatcatgttaggttgtatctaccccctttttgttgtatgcttaacaagacctgagttatggact

SEQ ID NO: 31742 - DNA, 892 bp, Triticum aestivum
  Clone ID: PAT_TA_31742
gctcgctccccggcggcgcccggctccctcccattcgcccaccggccgccgcccctctccgctcccctcttcttgcagggtaatgcggggacatcggagtcctgcggcgacatagggcagcatggattctcccttcctgttacatcgattcgtgatagcatggtgatgatgctgtacaatgcagacaaggaattggtatccaagacagaggtgaagacaaagttgattgttgagttgggaaccatggatgctgtttttactcttgataggtggagggacaattattctccagttgcagttttttctcacgcgatgaagatcgcaagcgcatccaagagatgaggaactctgtgatgaaaagaaagcagcaagagctgcttgggaatggcgactgaactttatttccaaggagctctgtttcttacaaaaggagttcaaataatatatcaccatggcccccagccaaaagagcatgctgaagatatccccggcatcctcagcgaagatgatctgaaaaagagggtcgtcttctcggaaacaagtgtagattctgacatggggcttccaaggaccccaccgttgcaaattggtggtactacttcgatgctcaaagtccccatcgacgccgattccaagaaaggacaggtaaaacaaaggagtggatcaagcagcgcggtgaagacgatgataagtgccttcgaaagcagctccccacagggtcttctttcgatgccccgcatctggtcccagagctcgttgcagtagggtcgttggaagggatgctgtcggcttccaccaatcccttcacgcaagccttctactcctggtgcatcagtggacgctccaggccgcacccagacaggtcccaggtcagggaaagcagccatgatca

SEQ ID NO: 31743 - DNA, 870 bp, Triticum aestivum
  Clone ID: PAT_TA_31743
ctcaccactggtcactaagccaactgttcttggagaattttttgtgaggtgtggcttcaataagtttggacatcatgtccttcagtagctttggggctttgaacattgcatcctccaagaacttgttacctgtttcgtcctttatttttgctcctttggttaacctcatcttacaagttccgaatcccatgatgtagtctggtatttttgacttgtgtttcctctcaattggttctaaagtcgatcgttttctttttttttttttttatttctttgtattctcattacggcacttggaacttttctatgagcaaattagacgatggatgttgacgaaacgatctgtaaaggtaaaaagaggctatctgctactttgaatgcttccatcaaaaagaacgagagccaaaaagaagtgagcagagtatggcctggatggatgactaaagaagtcacattaccttatgaggaaagttcgggtggcccccctgaacagtcctttttttttttttaatagtgattggaatgtcaacaagaatcggacaacttcaacaactctcttgtaaagtgttttctaatgtctataatccaacctgtgctcgtacgggaaataaagtgcttcgacaacgtttattgggacctacgttaacagcttataatcctaaacagattgtgcattttagagatattcaagcattatatcctcaactgggtttagttgatttagaagaaaaagaacgtcttgatgagattgcaagaagaaagagaagaggaaagggagcaccaaagaaaggtcaaggaaagcgtgcagcaaacaagaagaaataaagaaggatgttacatttacacatataaaaagaataggtttccagt

SEQ ID NO: 31744 - DNA, 889 bp, Triticum aestivum
  Clone ID: PAT_TA_31744
tcctcgccgcctccaccaatgccacagctgttcctgctgttcctgtctttctccttggctgtcgaagcgctgcattcgtttatgcaggatgaatctgagcacaagcattacctcattgtttctgcagtcacaaaccttttggtcaatttacttggtgtctggttctttcggagctatgctcgtgtcaacatagtttccaggaaagcagaggatatgaaccatcactccatctgtttgcatgttctgctcttactctctcccagtgcaggcttgatactagcttcttggtttctttcattggggattgagaacgcagaggtgttgtgcctgggaatagtttcggtggcggtgttcatgcttgttatgcctctgttcaaagccacgggcaatgtgctgctgcagattgcgcctggcaacgtgccaccttcagccttcatcaagtgcggcagacagattactgcttgtgaggatgtctctgaggtatcccaggctcggttttgggagcttgtgcctggtcacgccgttggttgcctctccatccggctcaagaatagcagtgatgatgaatcggtgctcgaatacgtgcatggactgtacgaggatctagggatacatgacctgaccatccagaccgaaaaatcttagatacagatactttctcttgcctagtggatctagtctttttctttacgtggtagaaatagaccaagaaattctggaagctgtcttgtgtttgtttgtttatgctactagtctagtcactcggtgtggcatgcaaatttcaaatcttgctctgattacggatatcaccaacccaaccgtctttcgaagttggattgttgtgaaatcacaattttttttttattttattgaaaaaaaaaaaaaaaaa

SEQ ID NO: 31745 - DNA, 783 bp, Triticum aestivum
  unsure (1)..(783): unsure at all n locations
  Clone ID: PAT_TA_31745
atattttgccaggtttttggaatccnaattccatgagggaagtcacgatgagatctctctgctacgtgactttcctgctcatcttgtccatcagcaacgtgcaactctctgcatccgtacgcctcttggccgaaagtccacatggccagccaggtgcaccggcgccgctccctcccggcggcctgtcgggaaacatcccggctaatgtcccggcgagcatgtcagacaacattccggggaacctccctgctagcctgccagagaacatgccggtaaacctccctgccaacgtgccaccgggggtgcttgcgaacgtgccaccggggatgctagccagtgtaccaccggagatgctggccaacctctccaccaccatgacgccggcgatgctgtccaagatcccgccggaggcgctggccagcatcccgccagacaagctgccaccaaacgtgacgccagatatgttggtcaccctcgcggcgatgaagcagcaggagcagcagcagccagggcagcctgctgctggggcatccaagggcaacgcagcggcgggcttgccgcagatccccaagatgcccgacttatcggggctgacgaacctctcgttcccgccgatgcgttcggcgtccctgccgaagatgccgcanaacctctcgctcttcgggttcgacgtgaagatcccaaagttcatcaacaagatggtaaaggagaacacagattcctgaaggaaaagcagcttctttngtgatggtgcatgcacgagcacgacatggttttgatccc

SEQ ID NO: 31746 - DNA, 908 bp, Triticum aestivum
  Clone ID: PAT_TA_31746
cagaacgcgagaggcgaacagaagtagcccgagatctcctgtctttccgtcggcgacctcgccgctcctcctcgcctccgatggccggcttggcctcggcaggtggggggagcctcggggaagcacgggcctgtagataggttccaggaggcgtcgttgagacgccggcgacggcgccgcgtcggaataaaggtgccccggcttcgaccgcgtttcgttgggagtcctacttccggcgagaagcttgtgggtgtttggttcctcctgctccaaccctgctccggtgacgtgcttctgtgcggcgccgaggagcgtgtgaggactatgtgtgttttgctgcagggatcgaccggaggtacggctgggagcagtgctgacggtgccctgcttgggatggatggagtccacggctggcatcggatctggctcgcggtggaagggcctggctgtcttcagggaggcagagtggcgtcgtccccaggcctggaggtgaaggagcttggggagcacggccgacatggccgttgcctccggccgatggaaaaattaggatcgaatccagttctttgcatctggtgtctactgcggctcaccaacgccaatgtgcaaggggttccttcagctctatgtgagccgctccttcgtgttatttccggcctccagcggtggtggttggcttcgacgcgacggagcggcatcggcggagaagaccaaggatggggttgcaaattttctttgtttggggtcttctgcgatgtatggcggggccagctctacggcttgtatccttcctgtattttcgtatttgtacgtctggtatctacgtttgtatgtactgttttccgactcgtataaatacaagtaacgtatgcctgcaggtgtacggtttcaaaaaaaaaaaaaaaaaa

SEQ ID NO: 31747 - DNA, 767 bp, Triticum aestivum
  Clone ID: PAT_TA_31747
cccacgcgtccggctcattacttggctcacgtggctgctgtgagagagatgccatgcacagtactgctcctcttgttgcatctgaacggcgtgcgatcggttgatcccattcgctgcctgttctctctgggagttttgttccatccgtctgcaaatcgcagaactacgtagtcgtacccatgctggtggccttgtgcattaacttttttatgcaggttgaagcgcttctcgtgacagctaggagagtagatttgtcatcgaattgtttttaccattatattgtagtaagttttaattctagaatatatagttatgcaaaatatacgatcaacctaatggtacaaccggtaatgcattttgtagccagaccggaataatttaacttaaattatagtacatcaaatctttttttgtgaaacaagatagtacatccaatctaacattacagtgtaactagctcaacatatataccctcagtatatgaagtgagtcgaactgttctacaatttttagcatatatagattacttatcttgtttatattgtgtagcatcaatattacttggagtagttctatctttacaatagaacctttgcaatgtcttgaaggatgcttgcttccacttgcatagctagcgtccaatgttcatgtcaccgatcaaattaattgataaacatgtgatgtatacagtatattgcttgggacaagcgatgacagttcatgcatgacacagacgggcacatgcgttgacatttgatctgtgcatc

SEQ ID NO: 31748 - DNA, 536 bp, Triticum aestivum
  Clone ID: PAT_TA_31748
ttttttttttttttttttggtctcaaatttaactggattatcaaattcttgaatccaccgacaacagtgccacgatcactttcaaccgattttaattatacagggcattgcaactaaaaaagcacaccaaattaaggaaatgcagacttgcgccgcttttttctagtccaatacaatactcattccagccgactggtatgcaaagaagctgcgtctaaccgtcttcacatatccttgcaagataatcatcgcttatttcagcagccgacaggaaatggattatggcaggtgactcagtgccctctctgatttgcttctccactgaagacatctgctcatctgtcttcggaaacactatcggctttagaggctccacgccttcacagtagatacatgtgaccctgtcatacaggtacacatcccctagattcaccgctgctttcatgacacgcctgacatgactcaccatgtattcttcagactggaagcagaagaagctagcttggtgagacgatggtgcttgaaatttggtgtag

SEQ ID NO: 31749 - DNA, 1068 bp, Triticum aestivum
  unsure (1)..(1068): unsure at all n locations
  Clone ID: PAT_TA_31749
gttgtaagctattggatacaacagtgatgagtaaggggttttgatgcctacagtgcgattttactgtatacatggnttatccggngaccttgaacacaattctagtttatcccatcaaccttgtgtcacaagtgtaccatattnactgtaaatactactccctccattccttgatatttgtctttcttggatattttaaccaagtgatactnacggagcaaattaacaagtgactacatacgaagcaaaatgagtgatctaccacctaaaatatgtctatatacatctgtatgtggtgttcccattttgaaatctcttggaaaggccaaatatttagggaacggcggggggtacatgcccatttacttatggatctgttttctggcccctcctggtgatcgagcttcatccgctcgcattcccgcctcctttcggccggttgcaacccccattaacccttatacacttgatctgttcattctacttagctcttgagagaatgattctttcttttttggagtactgaaatcatcattgagaagcatgggtgaattaatctctgcaaacaaggtagcattgttgtaatcttgatttcgaacgatgttgatcgattccacagctgatagtgctggcgcacatgctgtggtcattgcaaccatgggcactcctaaaggcgatgtcacgcttccgccctccattactggatcccaggaaaatgaacaaccgtatcgaggatttgtaggttcgcaccacgtcgcatggggcggttgggaaggagccgaggagctcaccaccggcttgctgctgacgagggggaggaggacacgagctgatcctggtgcgtgagagagagagaggaggcgacgaaccgaccgctaccggagattcagatgagaggttgcgagcctgcgacgagcacactgcgagatgagcttagtagcagaggagatctgatttgatctgcctcaaacagcaccgccggcgacgtgatcgccaggagccatcatagattttctgaattcgcccagcttgaggatggatctgggccgccgccgccgacagcgttgg

SEQ ID NO: 31750 - DNA, 2187 bp, Triticum aestivum
  Clone ID: PAT_TA_31750
gaattcggcacgaggccgcgtcggcgaagccagggagagaaaccattactagcactaccaagagagaaaacaattttaaaagaatttcgagttcgcgacagcgagaagcagagccgggtcgcggggccgcgggcgggcgtgcgcgttagcatggagagcgagacggcggcgcgcggtggccggagccagccgctggcggaggaggcggtggggtccagccgcaccatggagcgcgtcgcggctgcgaagaagatcatcgagaacgactaccgcgagcgcatgaagaatctccgggagcgcaacgagagacgcttgattttggaacaacagctagcttcttctcaagttcctagggaggagcagataaaattgataaaggagttgcagaggaaggagactgaatacatgagacttaaaaggcatagaatttgtgtggatgactttgagctgctcaccatcattggaagaggtgcttatggggaggttcaactatgccgggataaatcctctggtaatatttatgcaatgaaaaaaactaaagaagtctgaaatggttgtcaagggtcaggtggagcatgttagatctgaaagaaacttgctggctgaagttggtagccactgcattgtgaagctatactattctttccaagatgctgagtatctctatcttatcatggagtaccttcctggaggtgatatgatgaccctcctcatgagagaggataccttaactgaaaatgtggctcgattctatattgctgagacagttcttgccattgagtctattcataaacataattacatccacagggatattaagcctgataatctccttctcgataagaatggacacatgaagttgtcagattttggcttatgcaagccaattgactgtaccaaattgtcaaccttgaatgaagatgaacctatgactgatgaaaaccttagggagtccatggatatcgattattctctccctgatacagcaaatggtagaaggtggagaagtccaaatgaacagcttcagcactggcagaagaacaggagaaaattggcattttctactgtcggtacgcctgattatattgctcctgaggttttactgaaaaagggatatggagttgagtgtgactggtggtccctgggtgcaatcatgtatgagatgcttgttgggtatccaccattctattctgatgatccaataaccacatgccgaaagattgtacattggagaagctatttaaaatttccagaaaatccaaggttgtctcctgaagctaaggatctcatttgtcggttcttatgtgatgttgaccacaggattggcagtggaggagcagatcaaataaaggctcatccttggtttcatggagttgaatgggataagctttatgaaatggaggcggcgtttaagcctcaagtaaatgatgaactggatacacagaattttcagaagtttgacgaggtaaatcccgctccagcaagaacaggttctgggtcctcaaggaagatgattcctaattctaaagaccttagctttgtgggctatacatacaagaacttcgaagctgtgaaaggtttgcgtcagtctgcaggtctgggaagaagctcctcgtttacaagccagcctagtgaatctgcatctgatacagccgacatggattcatcagcagaaccgaatggaagtgacacacacatgcgcactgtttcgtctgccgatcatatgatgcaataagcagccttgcttgactgaaatccccgtccccgcaccagcatgattcgccttcagtgatgtggcttcatccaaagcgatctgcttgattttagtcagtctcgcgctttacttatcgttggtgagcattttgttgtaggtgtacaaattagtcagtatgcaacagcgcatgtgctgggcttggtcagatatggtgctgagctgcttggttgcccaggttggcaggttattgccttccttgcggcagttcgtagcccgccaacgtaggttcatcatggggtaggagaagaattaaagagacagtatttgtggtaggctagccattgttgcttgctgctggttgttttttcttttcagttctaactgcctgatactttgatatgcatcggataattatctgttggaacttgcacacgaatgcttcatctgtggattaaactgagtttccatatttt

SEQ ID NO: 31751 - DNA, 1440 bp, Triticum aestivum
  Clone ID: PAT_TA_31751
cccacgcgtccggcgatacgaacggttacgaacgaacgcgccccctccctccctcttcaccctccaccgacgatggcccagtcggctgccaaggcggcgccggcgacgcctttctcgtcgcagccgcacggcggaggcgtcctcctccggcgaccttcgtcaccgccgccgcccgccgcggcgctgcgcctcggacccctcttctggccgtggcaaaaggtgaaagttgggcccctttcggtttcccccatgggttttggaacatgggcatggggcaaccagctgctctggggctaccaggaaagcatggatagtgaactgcaggagtgtttcaatttggctctgaagaatggcataaaccttttcgacaccgccgactcttatggaactgggaagttgaatggccaaagcgaaaggctgctcggaaaatttatccgcgagtgccaagggccaataaagtccccagacgatgtgattatcgcaactaagtttgccgcgtatccttggcgactaacgtcaggccagtttgtcaacgcctgcaagtcatcattagaaaggttacagatcgatcggctcggaatagggcagctgcattggtctactgctaactatgcacctctgcaggagcgcgctctctgggacggtctagttgaaatgtatgacaagggtcttgtccgggccgtgggtgtgagcaattatgggccgaagcagcttctgaagatccacagctacctagcatccagaggtgtccccttgagctcagctcaggtgcagttctcgctgctgagcatgggcgatgagcagatggagctgaaaaccgtgtgcgactctctcggcgttcgtctcatcgcttatagccctcttgggctgggcatgctcaccgggaaatatgacgcctctaaccttccaaatgggccaagatctgtgttgttccggcagattcttcctgggctggaatccctgctgtcttgcttgagtggtattgccgaccgaaagggcaaaaccatgtctcaggtggctataaactggtgcatttgcaaaggcgcaattccgattccgggcgtgaaaacagtcagacatgtggaggacaacttgggtgcgctcggctggaggctgagccctgatgagatctcagagctggaagccgcggcgatggagtgccccaagaagatggttcagaacatatttcagaccgcatgagcaaactggaaactgcagtaacgccaatattaaacacgacatcaacctaaaataaagagcagagagatacccttcgttttgtgcagaaaagagacatgttgctttctctcctctgcgttcagagttcagttcagaacttccgagttcagagacatgccattgtaagctctgactagataactaactgtagctgattgctgagacagagtattctggtgttggtatggacagcaacaagcc

SEQ ID NO: 31752 - DNA, 786 bp, Triticum aestivum
  Clone ID: PAT_TA_31752
cccacgcgtccgcccacgcgtccgcccacgcgtccgggatttttgcatgcacaggcttatttattgattggaatggatgcaccaccattttgacttcagcaagtttgattcgggatcctaacgatggaaacaagattgctgaaaacttgaagattgaagtcaatattccaaacgaaggatgcaaaaaagggatattacaacattgtaatttacattacaatgttgctcttgttgatgtcgagaagttccgtcctctttgttcatctaagattcttgaagaaaagtgggaccctagaattcttgaagatccgaatgtagtagctgttgggcgctgcttcaaatcaggcgtgttaatggctacacatggaaaacggactgactggtcaggcatgcttgattgcagagatcttcggtactccagttgtacaatcactaaggccgggattggagggcccctgtttgactttagggggagatttgttggcatgaacttctatgataagaaaatagggacccccttcgtgtttaaggatcatatttgtcgactgctggcacagtttgagggaaaaagcaccgttgatgaagttggcagtgttgataaaccaattaggtggcctgtgcccaagccgtgttggcgccacccggatgatgagctcgatgatttgcgccactgggcatggggaaaaatctgattgggacggatatgtcgtgggtgcgtttactcataatagactaccactcgtgaaccttaacacttcccgctcgttgggcctttagacgactttt

SEQ ID NO: 31753 - DNA, 1020 bp, Triticum aestivum
  Clone ID: PAT_TA_31753
ttcggcacgagggtgtatatgaatgctcgtgtatatactgtggtcacacttctcgaaacatccatccagcctcgtcgccggcgacctcacccgccgccgcagccgccgcggaagatgccggtgagggtggtcgacaccgccaccccttcctcgcaggcctcctcaggacaagacgcaagtcgtgggcggcggtctcctcctagctgctcactcttaactgctggaagatgttttgcaggaactcagaatgtttcaagtttacaaaaagatgaagcatggaaagtcaatgttcgtatccatggttgtgatattgaacagggttatttatgtggaacgatggaggcacttaatgttcccttagccgacacacctgtggtgacattctgggagggggagatagtagatgctaaaaattatactttttttactggcaagtgggaggcatcagcagaggatgatgtaagacactggtccaagttcccatcatttacccctcttctgagtcagattgaggcagatggtggcaagtctgtggaccttagcaactatccttatatatttatgagatggaaagagcagtactttgttaatgtgggagtggactgcgggttgaccatagctggtttctattacgtctgcttttcttgtagcgatggatccattagtggcttttattacgacccaaacagcagtccatttcagaagcttgaattgaagtgcaccaacgagaaacaatctgggttcaccttttcttcatatgagctgcagtgacatgcatgacgctatgaattgaagtggcagagattacactggcgaactttctgtgcttgccaatatgaacatatactgtgtgtgtattgaacccgtagttcctgatgttcctttgaaatagttgagatgttatgtatgtacggttgtgccagtgaatgttgcaagaccaaacaattatgtaacttatccttttgcaatctcagtattctgggaaaaaagtatcaatttgtttattttatcgaaaaaaaa

SEQ ID NO: 31754 - DNA, 1785 bp, Triticum aestivum
  Clone ID: PAT_TA_31754
gcctgccgagccaggaggtggacactttgcacccaaccgacgagcgagatgaacggtggcaaaggatggcgttaccggcaggcccaccaagcaagcggcccgccttcttgtttctctcgctcgctacgccccccccccccgtgttttctggcccgccgacggacgccaggcgcgccgtcacgcgctcaggcacgggcggtcgcgtccgtccggcgggccggaacaactccgccggccggacacggcatacgcgcgcgtccatgctggcgtgagaaaagaaattggtcgtggtggtcgtcgcaaataaaaagagctatctgtcgcgcgtgactctgtaaaaacaaatgcgcgacgtcctaggtcagcggggccaaggcagggcaccgatcaaccgataaacaccgggaaggtcagcaactttattaccgggcttgtggttggaatcctcttctgcgtcaatttggggctgggcgtgtctgtgctgttccggctggcgctcaactgcatccgcgggcggtaccggagcaagtccggcatggtgatcttcaccccgaagctgatcaagcgggcggaccacctggcgttcctggagaaggaggacatgctgtcctcgctggccgtgatcgggcgcggcgggtgcggcgaggtgttcaaggcgcagctccccgtggagagcgagggcgaggagcccaagttcatcgccatcaagaagatcaagaagcaggtgggcgacgggcacgggcacgggcagaacaacctgagcgacgaggagagccggcagctggacaagtggtcgcggcagatacagtcggagatccgcacggtggggcacatccggcaccgcaacctgctgccgctggcggcgcacgtgccgcggccggactgccactacctggtgtacgagtacatgaagaacggcagcctgcacaacgcgctcaagccgacgccgtcggaggaggacggcggcagcggcggcggggtgcggctggcgtggccggcgcgcctccgcgtggcggtgggcatcgcgtcggggctggagtacctgcacgtgctgcagcagccgcagatcatccaccgcgacctgaagccggccaacatcctgctggacgacgacatggaggcccgcatcgcggacttcgggctggccaaggcgatgccggacgcgcacacccacgtgtcgacgtcgcacgtagcaggcaccatgggttacatcgcgccggagtaccaccagtcgctcaagttcacggccaagtgcgacatctacagcttcggggtgatcctggcggtgctggcgacggggaaggagccgacggaccagttcttcgtgacggaggtggaggaggtcgggctggtcaagtggctgcgccgggtggtgcagaacagcgactacgcggaggccatcgaccccgccatcgccggcgccgggcacgaggagcagatcatgctggtgctgcgcatcgccgtgttctgcaccgccgacgaagccaaggagcggcccgaggccaaggacgtgcgctgcatgctcgcccagatcaagaactagtagtctagtcaccgtataggcgcgagccagagctccgtgtaagtattggtcgtcgtcgtcgtcgtggtcttcaattgggcatgtgtcatgcgtgactgtgtgtagaataatgcggcaagtgccgggtcagcgggtcaagtatggggccggtcgatcgataaagaccgggaaggggatccaactattttacacaaatgatatttagaaatgagtgggtatattttttcttgaaaaaaaaaaaa

SEQ ID NO: 31755 - DNA, 590 bp, Triticum aestivum
  Clone ID: PAT_TA_31755
gaggcacccgatcaccaatacgtggtgcaggtgcagcagattaacaattcagctcgtgcgtgcgtgcgtgctccatggtgagatcgcttccgtctgtttcaatggaggggaggaggctggaggaggaggagcagcgggaggtgctgctcatccacagccaggtgcggaggatcaagcgggaggacgaggagacccggaggcacctcctgaagctgcagctgctggagacgaggccggccgccgggcaagggcaggaggcctcgccgccggcctcccgctcgctgtcaccgctccggcgcgccgggagcgccataccggtcggcgactgggcctagtcacctcgcgtggccggccaggcagcgtagacatatagatataggagagcgagcgagctatatatgtgagagccatagtacgatcgatgcctgtccatgctctctgggtgcatggaaccagagcttagttgatcgatcgatctagctgctttactctgtttcagtcgacttttcttcttctgttgtaaatataccgaagttcacctcgtgcttctaaacacgtactgcatccaagttcttccatgctagttcctt

SEQ ID NO: 31756 - DNA, 1166 bp, Triticum aestivum
  Clone ID: PAT_TA_31756
cccaactctcctcgaccacttccgccggcgtgtgccttcctctccgccggcgcctgcacagcaagtccaagagaggcaaagaaaccatggctctagcatcgccggtggactatgctggcataatcacttcaagtcagaggcaactcagttctgtgatgccccggtgcaatggcttgcaatgtactattggatatggaaataaatcaagagctacaggtcacttggtcgtcagagccatgtccatggatcgcccgaaactggacttttcgaatccgaattggaagaatcaattccaagaggattttgataggcggttcagtttgccgcatttgacagacataattgatgtggagtcgaggccaacaacattttctctcaagagcaggacccctctggagaatgttgatggttctttggaagagtcatggaacggctatgttaatgacgacgacagagcacttttgaaggttatcaagtttgcctcgccaacgtctgctggagctgaatgcattgatcctgattgcagctgggttgaacaatgggtgcaccgggcaggcccacgtaaacaaatatattttgagcctcagtgcgtaaaggctggaattgtaacttgtggcggactttgccctggtctcaacgatgtcatccggcagattgtgcttacgcttgaaaaatacggagtgaaaaacattgttgggatacagcatggtttccgcggattttttgaagaccatttagcggaagtgccgcttaatagacatgtcgtccaaaatatcaatcttgctggtggcggggcaagtatttcagacattgtcgacagcatccaggccaggaggcttgacatgctctttgtactaggtggaaatggaactcatgctggagctgatgctatacatggcgagtgccggaagagaaaactaaaagtgtcgattattggtgtcccaaaaacaattgacaatgacatactactgatggacaagacatttggatttgatactgcagtggaggcagcacaaagagctatcaactccgcatatattgaggcacattccgcatttcatggcatcggattggtgaagctgatgggaagaagcagcggatttatcacaatgcatgcttccctgtcaagcgggcaagtcgacatttgcctgatacctgaggtacca

SEQ ID NO: 31757 - DNA, 1838 bp, Triticum aestivum
  unsure (1)..(1838): unsure at all n locations
  Clone ID: PAT_TA_31757
gcacgaggcaaccccagtcgcttccgtccttctcaaaccacccactccactttccctatgccagatctgatccccgcccttgtagttcggcgactactacccctcagtccatgaccacaccgctgcgtcgccgcaccccctgcggctgcgagcgtggtcgctcgccggctccggctctgccgaggtggtggcggccgtgggtgttctcggagggggccggcgggccgccactgccgcagacaccgccgaacggccggcggactggcccagatgccgggcgctccggcgggggggaccgtgatgagatctccgaaggcgtggaacacgatctcttgggcgacgcccttcaagtactacgaggacgccgctcgggatcgagactggtaatatgcaggaccggagaagacacccggcgaatggcttaggccgcagttgtgtgcgggaaaactcaagggatcttggtgtatgttgtcagtcccacagggggactgcaaagggcatggtcgacacaaataaaatcgcctatgcacatctccacaggacactgcaaatttgtcgttggccaccatggcgcgacgccatgctccggttctgagggccatgctcaatcttgtgtctgtcctcaaatcgggaaccggagggaatgaattggcaatgttgagggcgcggcggtactgcgggaatctcgggtgcgttgcattgagaaatggatcccactgtgggaacacaggacctataggtctcacgggtttggcagacgtggaagtacccgattcctcagggtgagattcatcatgtcatgaatccggatccttaccgtggagcttttgggtctgatgctgcagcttatgccagggaagtcgaagaacatataaattttggcagttcaggaagggttggaggttttatcgcagaaactttccaaggtgtaggaggtactgttgaactagctcctggatacctgaagtcggtatatgatactgtccggaaggcgggtggtgtctgtatagctgatgaagtccaaagtggttttggccgtactggaagtaactactggggattccagacgcaggatgtcatccctgacattgtaacgatggcaaagggaatcggcaacggtctaccactcggtgcagttgtaacaactcctgagattgcaagcgtgatggctcagaagatccagttcaacacattcggtgggaaccctgtctgttctgctggtggattggctgttcttaaggttctcgacaaggagaaacggcaggcgcattgcgcagatgtcggcgttcacttggtggaacgtctgaaatctcttcagcagaagcatgaaatcattggagatgtcagaggaagggggctgatgcttggggtggagctcgtcactgacaggacggagaagactccggccaaggctgagaccgctcttctgtttgagaaactcaaagatcttggcgttctagtcggcaaaggcggtctgcacagcaacgttttcaggattaaaccaccgatgtgcttctcaaaggacgatgcagatttcttggtggacgccatggactacgccatgtcagggttctgaggaccatgaacgttcttgtgcctgcccctgaaccgtcaccggggcggcggcgcggagtgcatggggatgccctggtgctggtagcatggtacgttcccatggctgggctgcgtcaccgcgtgtttgctcgcaacgcatgtatacgtgcccggtgtctatgttcgtgatgatgaaacacaacccttacccagggagaagggatgaataaatgaagggaggaaagcatcagaaaagcaaaatgtgcaaaaanaaaaaaaaaaaa

SEQ ID NO: 31758 - DNA, 787 bp, Triticum aestivum
  Clone ID: PAT_TA_31758
gtagcgtaggctgcggtcatagcagacaactgaagaaattatcctacatataaattcgggacgcacatcccaccgatcaaccctagtttgacccactcctcttatcctggcggcgggcggcaggcggctgacacttccctagcggcggtgcggctaacggcggaggccggacaaagaggcgaagccaggctcctggctcctgttggacgcccttccctggccgccgacgggccggtgcgggccgacacggcgagtcggcgcctcggcgggcagtacctcactaggacgttggtgctcaagctcaacgccctcatctcctccctggtcgctgctcaatgcccccatcgtcccatcccctactggcccacgtcccaatcagtcgctccactccctagctcgcaatcttcagtctggcagctcatcacctcaagtagtctactagcacaatgtcttcagcaggatcaggggcttcttctacaaccacagccggaagaacaagaaaatatcctgcctagtgatgttgaagaagaggaggaagaggtggagaatcaagaagttaaggaagatattgattaagaagaccaggaagttgaggatgatattgattacgaagaccaagaagtggacatggatttgacaggacaagtctatgtgttgtgtcctaccaatagtttttgtttgcatggttacatgggtgaatactgtccagatggatagttatagtctatatgcttatataaatgatgattgttcaattcaacaaaaaaaaaaaaaaaaaaggccccta

SEQ ID NO: 31759 - DNA, 685 bp, Triticum aestivum
  unsure (1)..(685): unsure at all n locations
  Clone ID: PAT_TA_31759
gtgcaactcccaccgagctgtggtgtcccccaaataacctagcggcggcggcggcggcggcggtgatggatgagctgggtggaggcggcgggaagaagggcaaggcatggccctggtggcttggagcgagtgcggcccagatcaccggcgcgctggtttggttccggcgaggcaagggcggcagcgacatgacgatgccgttcagggcgttcgccgtcgcctcgctcttcgtcggcgccggcgccacgaccgtcaccgccggagtgtccgcggcgggcgtcggatcggtggaggagatgaagggcttgggcgcgaggatccggaagtggagcagagttcctcctcgccgggtggagggaggcgagtagcagtactgccatggatttgatctactgctagagcggcaagagtttccatgtgaggatcaagattgcttcacatgatcacacatttgggagatgcaaatcaataatcacatctgtactgtactactactctgtaggagtaactttgtagcgaaagcttgtttactcgaattttgatcctgccttctggaatatagccattgtactcgtctcccagattgaaactgaaactgcttgcttaaacgatactagttctctctctctctctccttggtaatgttatttgacgaatgtcagccggaaggggttgacaagcnnna

SEQ ID NO: 31760 - DNA, 938 bp, Triticum aestivum
  unsure (1)..(938): unsure at all n locations
  Clone ID: PAT_TA_31760
gtcttttatatctgcttgtgtgtgctccggcgcatcccaccgccctctgcagctaggcctcccgaggtcccgccgaccagaccgcatcgcccatggcagctccgacggcgccgccgccgccgaagaccgtcctgcgggtggcggcgatctccggctcgctgcgcagggcgtcggccaacaccggcctcatccgcgccgccgcggagatctgcagggagtccatcccgggcctgcagatcgaccacgtcgacatctcggagctgccgctgctcaacaccgacctcgaggccggcggccggttcccgccggccgtcgaggcgttccgcgacaaggtccgcgcggctgactgcttcctcttcgcctcgcccgagtacaactactccatttcaggccctctgaagaacgcgctggactggggatcacggccgcccaactgctgggccgacagagccgcggcgatgctgagcgcgtcgggcagcaccggcggcagccggtcgcagtaccacatccggcaggtcggggtgtttcttgacatccacttcatcaacaagccggaggtcttcaccaaggcacacctgcccccgagaaagttcgacgcggacggcaacctgatcgactcagagaccaaggagcaggtcagaaacatgctcctgtcgctgcaagaattctccctcaggctccagggcaagtccgaacaggggaactgatgcctccatttgtttgttgagacgaaatggcagtgctctgctcattagatcgtctgagcagatcatcacaaactcccccttgatgctccatgacatctggaataattcttcatctgcgattgaccatttcggtggcacattaatgcaaatcttttttactttcgaggggggccgtaccattccccaanngntctataccnccccnngcctntttanacgnggggggaaccc

SEQ ID NO: 31761 - DNA, 573 bp, Triticum aestivum
  Clone ID: PAT_TA_31761
gcacaagggaataataataacaaacacaatagtcgcgtgcctcttctcatggccctcgtagtcgtcgacccgaacaacaagatgaggaccacggctattgctttcctggtccttgcaatggtgtctgcttgtaccttaccgtcctgccatgccgcgcataagtatgatcttgctgcatctcctccaggtggcacccgatattgctcctttttgataggtcaaacatgcagttattccgcttgcaacgacatgtgcagcaagctggcgcggggacagcagcatttcacgttttgcacccgccctggccagtgctgttgttggtttacatagtttaaccggacacaaccgttttggtttacttgtgcgatgtaatcctccggatgaataagcttcttgcatctagtgtgcggcggcgttgatttattcaggggatgttgtgctgtgcccccagcaagacctatttggatcctgttgcttttctttccttctttgttattgaactttgaacctgagacctctcttgtggatggatgttggtgcggttgctttataatataaagcggcgttgatctg

SEQ ID NO: 31762 - DNA, 1302 bp, Triticum aestivum
  Clone ID: PAT_TA_31762
gccggccgggtcgggatagtactccatatctacgtagactactgcagatcaccaactcatcggcgcgtccgaggaaggaagcaatggcggaggtgagcaacaagagggtgatcctgaagcgctacgtgacggggttcccctccgaggacgacatggagctcgtccccgcgacggcgcgcctggccgtgccgccggggtcggccgccgtggtggtcaagaacctctacctctcctgcgacccctacctgcgcagccggatgtccgggaacgacgagcccagccacgtgccggacttcgtccagggggaggttttaactactttaggcgtgagcaaggtggtggaatccgggcaccaggattacaagcccggtgatctggtgtggggaatgacaggatgtgaagagtacactttgatcacgaacctgcagtcacatttcaagatcaaccatcctgaattgccgctgtcatactacacaggagttcttggcatgcctggccttactgcctatgctggattttttgacgtggccaagccaaagaagggcgactatgtctttgtgtcggcagcgtcaggtgctgtcggacagcttgtcgggcagcttgccaaaatctctggctgctatgtggttggtagtgccggttctgatgagaaggtcaacctcctaaaaacaaagtttgggtttgacgatgccttcaactacaagaaggagcaggacctgaacgccacactgaagaggtgcttcccggagggcattgacatctacttcgagaacgtgggtggtgcaatgctggatgcggtgcttctcaacatgaggctgcacgggcgggtgtcggtgtgcgggatgatctcgcagtacaacctggagcagcgcgagggcgtgcacaacctcttctgcatcgtcgccaagcgcatccgcatggaggggttcatcgtgagggatcactacggcagctacagaaagttcgaagaggagatggccggctacctcaaggaagggaagatcacctacgtggaggacgtcgccgagggcatcgagagcttcccggcggcgctcatcgggctcttctacgggcgcaacatcggaaagcagctggtggccgtcgcacgagagtgacgtcgcatgccaggagccctcctggatcgagaagtactgctgcgcgttcagagaccagaattcagatacagtatatgtagagaagtacttggtccggctttgctggattcaggtgaaccaggaagctggaatgaactataatctttgctagctactactatattaaataaaaatagggattgatggt

SEQ ID NO: 31763 - DNA, 1552 bp, Triticum aestivum
  Clone ID: PAT_TA_31763
gcgcgcctcccggcgacgtaaccagctcatcggcgcgtccgagggaaggaagcaatggcggaggtgagcaacaagaggatgatcctgaagagatacgagagggggttccacgcagagggacgagctgagaacggccttccagcaccaggccatcccctcccccgcggtcctgctcgcgggacttgccgcgacgtcggccagcatcacgaaccaatccgtcccagccggcgacctgccagccgagtcccccaccgcctcgcgcagcttctcccgccggacgcgtccaacgtcgcgggctcacttacctgtcggggacccgaggcaagaagggagccggtgctggggacggggtgtgcaaggtcccgaagggtgaggctggtgcgaggtgctgggccatccacatgcatgtcaagggtgactcagggagggttgtgggtgaggggcactcctcctcccatcgtgggcacggtgtccatgactcaaaaagttgacggttggttaagttcatccgctcggtcaatcggtcagtgtcggggatgtgagtgcaagatgaaggcggactttgttagcatcctggaccactgaactgactccagattgaagtatccctgaaggggggttgtgtaacttgataaatacaatcatcgcgaaattaagcttggatgttcaatcaaatgcacgaacgcgaattagctggatctatgcgcaattgacgaaaaagtatatctatatgctatcctcatgtacgacgagaaattggaagacaggacactcgaagaggtgctttttttcatgaggttgcacgggcgggtgtcggtgtgcgggttgatctcgcagtacaacctggagcagagcgagggcgtgcgcaaccttttctgcatcatcaccaagcgcatccgcatggaggggttcatcgtgacggatcactacggcagctacagaaagttcgaagaggagatggccggctacctcaaggaagggaagatcacctacgtggaggatgtcgccgaggggatcgagagcttcccgacggccctcatcgggctcttctacgggcgcaacatcggaaagcagctggtggtcgtcgcacgggagtgacgtcgcataccaggagtcctcttggattgagaagcactgatgtgcgttcagagaccagaattcagataatatatatatagagagagagaggtacttagtccggtttgctggattcagcatgctttgagccagtgtttggagaaagcagaattctacttaggtgaaccaggaagctggaatgaattaataatctttactagtatatatatacaagaataaaagtggctagctagcttcgatttggtgcaattcaacagccagggcgaatgcactcttgggctccctttagcctatttataaagggacgctcaaattgctaattccacaaggacatctccggcagcaaatagctgacgagggagttcatcgcgggcatcgtcggccgggaggagtgcaacttggagaccgtcttcgggcggtaccattactgcccgtccgaatatcttggacctga

SEQ ID NO: 31764 - DNA, 976 bp, Triticum aestivum
  Clone ID: PAT_TA_31764
caccaattcaccatgaagaccttcctcatctttgctctcctcgccattgtggcgacaagtgccattgcacaaatggagaatagccacatccctggtttggagagaccatcgcagcaacaaccattaccaccacaacaaacattatcacaccgccaacaacaccccatccatttgaaaaggaggagttgagaatggcgttcaagcaccagctcatcctctccaccgccatcctgctcgccgtacttgccgcggcgtcggccagcttcagggaacaatgcgttccagggcgggagatcacatacgagtcgcttaacgcctgccgcgagtacgcggtcagacaaacatgcggctactacctctccgccgagaggcagaagaggcggtgctgcgacgagctgtccaaggtcccggagttgtgccggtgcgaggtgctgcacatcctcatggatgggagagtgactaaggagggtgtggttaagggcagcctcctccaggacatgtccggatgcaaaaagttgacgagggagttcatcgcgggcatcgtcgggcgggaggagtgcaacttagagactgtcttcgggcggtaccattactgcccgaccgaatatcctgaagtggtcgtgtaactttataaatagctcgagcgtgaataagcttgttgctcgatcgatggacgaatcgcatatgtgtatctatgcgcatgtgcgaaaaatatggcaacaaagagcatccgagaggatgatgttaatcttctgttaagatgtgtggaagttatactagtgcagaaaagcttatggtgtgtttgattgccgtgctattttttgtgtttccccagagtgtctcgattgagtgtgtatggggtaatataatacaacctctagtccatgttgtgcacgtcgtttggttgcccgcaaagtcacaagttacatgagagaagaaacgccagcactgcgtttggttacttgtttgtgctccc

SEQ ID NO: 31765 - DNA, 623 bp, Triticum aestivum
  Clone ID: PAT_TA_31765
gccggccgggtcgggaacccaaaccccagcgcctcaaacaaagccccgctgcgcgtgccccgatcgccgcgaggaaccagcgagagaccccggagccagaggaggaggaggaggagatgagctactacaaccagcagccacccgtcggcgccccgccgccgcaagggtacggggacaagggcggctacccgccgccggggtaccctccggccggctacccgcccccggcgcagggctacccgccagccggctacccccagcagggctacccgccgcagtacgcgcagcagccgccgccccaccagcagcagcagcagagcagcgggccttccttcatggagggatgcctggccgccctttgctgctgctgtctcctggacgcctgcttctgaggagggagggagggaggaagacgacgatcaacttcgtgcaactgggactgagctatccttctctgacggagaaatgctgctagtagcttaattattatttctcgtcgggcattatcgcctcctttgtttgatccatgtttatgaacctctctgcattgcaactattcgcttggttgtcgactgatgaaaaaaaaatacaaaaggccccaaaaaaaaaaaaaaaagccccta

SEQ ID NO: 31766 - DNA, 690 bp, Triticum aestivum
  Clone ID: PAT_TA_31766
gccggccgggtcgggaatcacccaaaccccagcgcctcaaacaaagccctgctgcacctgctccgatcgccgcgaggaaccagcgagagaccccggagccagaggaggaggaggagatgagctactacaaccagcagccacccgtcggcgccccgccgccgcaaggctacggggacaagggcggatacccaccgccggggtaccctccggccggctacccacccccggcgcagggctacccgccggccggctacccccagcagggctacccgccgcagtacgcgcagcagccgccgccccaccagcagcagcagcagagcagcgggccttccttcatggagggatgcctggccgccctttgctgctgctgtctcctggacgcctgcttctgaggagggaggaagaagacgacgatcaacttcgtggaactgggactgagctatcctctctgacggagaaatgctgctagtagcttaaatattatttctcgtcgggcattatcgcctactttgcttgatccatgtttatgaacctctctgcattgcaactattcgcttggttgtcgactgatgattatattatgcctggtgccttccgtgtgtgaaaaaaaaaaaaaaaaaaggcccctatattcttcccccccctgtataatttataagaaggggccgcccttctttatgggttccaggt

SEQ ID NO: 31767 - DNA, 816 bp, Triticum aestivum
  Clone ID: PAT_TA_31767
gcttcttgcaatgcagatcactcgttttctcgaatttcttgagcgcttcggcttgaacttcagattgtgtgccattgacggcatcggagagcttcttgcagggcagatcactaggttgctcgaatttcttgagctcttcagcctgaacttcagattgcatgctaccgacgacatcagagaccttcttgcagtgcagatcactcgcttgctcgaatttgttgagcacttcggcctgaacttcagattgtgtgccatcgacgacatcggagagcttcttgcagtgcagatcactagtttgctcgaatttcttgagctcttcggcgtgaacttcagattgcatgctgccgacgacttcagagagcttcttgcagtgcagatcactcgctggctcgaattccttgagctcttcggcctgaacttcaaattgcatgccactgatgacatcggagagcttcttgcagtgcaaaaaaaaaaaaaaaaaaaaaaagaccgtcttcgggcggtaccattactgcccgtccgaatatcttggacctgaagtggtcgtgtaactttataaatagctcgagcgtgaataagcctgttgctcgatccatggacgaatcgcatatgtgtatccatgcgcatgtgcaaaaaatatggcaacaaagagcatccgagaggatgatgttagtcttttgttaaggtgtggaggttatactagtgcagaaaagcttatggtgtgtttgattgccgtgctattttttgtgtttccccagagtgtctcgattgagtgtgtatggggtaatataatacaacctctagtccatgttgtgc

SEQ ID NO: 31768 - DNA, 902 bp, Triticum aestivum
  Clone ID: PAT_TA_31768
tggtttagcttacatcggatatgtaaatcgagcagtaaaatattagacacagttgaacttagactacctccatactcctatgattctgaggctgtttggatacgaattccacggtcagcaaaaatagctgtggaggaaaggaaactagagtttcgtggtggttcacatgctgcttcacacgcactcttgaatatattgcctctgcatatgatgtgtagtgcttctgacctgggaactgagtgcgtaaatcctcatgaaacccgtggtatgcctgaaagaattcttttatacgataaacacccaggtggtatcggcctggcaacgcaggttaaaaaactttttggggaacttctgcttgctgctttagagcttgtttcgacatgcagttgccctagtgcttctggctgtccgaattgtatccaatcattgacatgtagtgaatataatgaggttttggacaaggaggcggcgattttgatcctgaagggagtgattgaacacgagaggtcgtattttgaagtggaagaagcttctgatcgaagctgacgtgcgagcaaggtacaaaccgcgtgttggtgatgcattaactaacaatgtttctaggccttgtcctttttttttgcgggaaggtttaccaattcagaaattcattgcatgtgcacgttttattcacagaattgagatccgattatacatcctctctgattcacgcgtgcatgggatttcaaggcatttaggaaccaccagctccatgaactagtgtttgtaaaactcaagggcttctgttcgttaaagcctgcattttttcatttcatttttcggtggtggctgtaaactagtgtttgtataacttttttttcaaaacaggctttcaccccatataaagcaccaaccgaagcagt

SEQ ID NO: 31769 - DNA, 535 bp, Triticum aestivum
  Clone ID: PAT_TA_31769
tggaagcaaattagcaagtggagtggagtgccaggagctcccgcgccacacgtaccggaggagtggtagctactagctagcgtcggccgggggccggcttagtgtgtggagggaggcgcgcacgatgtcggcggcgtcgggcgccgcgtgccgcgtgtgtggcgggggcgctgaggactgctcctgcttgctgcagcgggggagaggtgctgcaggggtgcggtgcggggtggccgacctgaaccggggcttccccgggatgttcggccaggcggcggaggagccggccgtcgacgtcgttgccggaggcggcggcgctgcggcggtggggctgcaggatttccagttcttcgggcaggaggaccacgagagcgtggcctgtctgttcaacgaccacgcgcccctcggtggggaggaccgcctgcagcaccgcccggcgaccaccgagcaactgcagcgccgccaggcgttcgacgcgtacgccgagtaccagcccggacatggcctcacgttcgacgtgccggtgccactgagc

SEQ ID NO: 31770 - DNA, 766 bp, Triticum aestivum
  Clone ID: PAT_TA_31770
cccacgcgtccgaagctatcaacgagctcggagtctgaactcaggcaggcgaaattgacctctcgtcgcgccgccgccggcaactaggctctgacggcaccttctctctcagttctcctcctcatccgctctacaggactggcttggggtggaggtttgcccggccccgggctcgaattgatctggtgacggaccctacttcttttgttcgctggaagtgtgtgtgtggtacttttatggttggccaaatgcagatatcttggccatccacgattgtagagctcatcttgggcctgctatggcacctcgtccacctgttggtcagcctctttgatttgtggtcgcatctgagtgataatctagaatgctatcttatttcgtctgagctgctgcctaagtaccaagatcttcattttgagagacttaattacgtgggcgttgtagtagatagcagagaagcaaataatgttttgaagatcaagcaacttttatgaactgtatcgactattgtcgtcaagtatgtagttctctatgacattgaaatagtactgaaggaatggcttaaacctggtatcgtcaccccaagagatgagaactcaggatctaatttagatcttagtgcacatggggggatgactatagagtgtctttctggttctgatggcaaggaaggcattgctaaagcagcaaacttactgtgctcagacttctgcaatcgcaacactcatggggcataataaaggtgacaatgcatttacagaagctg

SEQ ID NO: 31771 - DNA, 640 bp, Triticum aestivum
  unsure (1)..(640): unsure at all n locations
  Clone ID: PAT_TA_31771
cgggccgggcccaactcttcccctaaacgcaaatctcccacctttgcgccgccaatccagtctctcgcctctcctcctagaaaccaccatggcacccaaggccgagaagaagcccaaggtggagaagcgcgtgcccgggaaggagggcgagactaggaagaagaaggccaagaagagcaacgagacgtacaagatctacatcttcaaggtgctcaagcagattgacccgaacatgggtatctcctccaaatcaatgtccatcatcaactccatcatcaacgacatcttcgagaagctcgccggagagtcggcaaagctcgcacgctacaacaagaagcccaccatcacctctcgggagatccagactgccgtgcgccttgtctttccaggcgagcttgccaagcacgccgtctccgagggaaccaaggccgttaccagattcaccgtgtattagatcgccaccaagactttcttagtctggtttggtttcttcatttgtcaacaaaaatatggagttatgtttccctatgcaaaaatgtagaatgagttggatttgctaatcaatgaattatccagtgtttgtttgaaaaaaaaagattatacnaacancatanctcttctatantttcacctaaaatcg

SEQ ID NO: 31772 - DNA, 684 bp, Triticum aestivum
  unsure (1)..(684): unsure at all n locations
  Clone ID: PAT_TA_31772
gcccaatcttgattcttgaccactcttgttcttgctcttctacaccccgctcctagatcgggatggggaaaccgagggcctccggtgatgtcgagagcagggcgcttgcttccggcagcggaggcgcgacggcgccgctcctccaccggaatgatcgcaaggaggatgccaagacccagggagggtcgctgtctatggtcctcttcagcaccgcggtcgccgtgtgcggctccttcgagttcggcacctgcgttggttattctgcacccactcagttgggaatagagcacgaacttggactatccatcgctgagttcgcaatttttgggtctgtgttgactatcggggcaatgattggtgctgttaccagcggacgcttagcggactctcttggacgtaaaatgaccatgcggatagcagctactatttgcatttttggttggctttctatacatttcgctaagggtgctactatgctctattttggaagaaccttgctgggcttttgtactggtgttctttcttatgtggtgcctgtgttcatagccgaaatagcgcctaaggatctcaggggtggccttgcaactntaaaccagttgttgatcgtttgtgggagttcgtctacttacataataggggcgctggttacatggcgcaatttggtattcgttggtatagtgccct

SEQ ID NO: 31773 - DNA, 633 bp, Triticum aestivum
  unsure (1)..(633): unsure at all n locations
  Clone ID: PAT_TA_31773
cccgcccctggctccctctccgccggtacgcctcgcccgttcgcgccgccccccgacatcgccgtccttgactccctctccgttggaagcgggatagttcttgggccaccggaagcgtcgcacgcatggcagatgaggaggtatctgacccaaaggcactcctagaggatcgtacgaaggctaagtgtgtctaccagtggtatgaatatcagaaatgcgttaagagaattgaaggtgacgagaccgggcagaagcactgtactggccagtacttcgattactggaaatgcattgacaagcatgttgctgagaagctctttgatagcttaaaatgacaaggaaattgttctctctagctacttttcactcaacagtggtaataaatagcatcacttgcacgccttattgacaattcaggtctttatcatcatatatgtaaaagaaggttttgcctgtcgggtaacacgacagtttttctgcggccactttacattttgtttgtcagaggcgttgctggctcacgatatttttttgttgtgaattgagatattcccaagactgactgaggactaaacgctgccattttttccaaaaaaaaaaaacacacaaaaaaaaaatctacggaaactggtn

SEQ ID NO: 31774 - DNA, 1068 bp, Triticum aestivum
  Clone ID: PAT_TA_31774
aggaaattctgcccaggcttctggttcatgggcttcgtgaactatgacagcgctgtgaagtgtctccaggatgctgctcgtggtggcgcctagacatcacttccccgtcgcatgcatcccttgtgatggcccatgttgatgtctatagaccattcttgtgtattgtggttcaaatttctggcttaaataagcagtgcgctcatgtatcagtattcagtagtctgggtactgttctggcacagcaccaaggagaatctgagggagatgttcggctcggtggggaagaggttcaggcgaggccgcgcgcaggaccgagggcatcgccggcgacgtctggcagcacttgaaaactgggcctagcattacggatgctgcaatggggaggatcgctcaggtatccaaggtcatatcggaagggggatacgacaagatattccagcagacgtttgagtgcttgcctgacgagaagctcaagaaggcgtacgcgtgctacctctcgacctctcatggtccgataatgggcgtcttatacgtctccaccgccaagcttgcattctgtagtgacagccccgtggcatatgtcactgaggataatcagaccgcgtcagccatttacaagatagttgtacctgtacctcacctgagatcagtcactcctaccgcaagtcaacagaaccctgcggagaggtacatccaggtcgtttctgtcgataaccatgacttctggttcatgggcttcgtgaactatgacagcgctgtgaagtgtctccaggatgctgctcgtggtggcgcctagacatcacttccccgtcgcatgtatccgttgtgatggcccatgttgatgtctatagaccattcttgtgtattttggttcaaatttctggcttaaataagcagtgcattcatgtatcagtattcagtagtgtggatacttttctggcccaagtgtgttgtaaatatcagaggaatcttaagctttgtttgctgccctcattcttgcactgcaaattatgtgtattatgagccaaagatgctcctgccagtgccttgatgattgaggttagtgca

SEQ ID NO: 31775 - DNA, 1017 bp, Triticum aestivum
  Clone ID: PAT_TA_31775
tcggaaccccgaacaaagccgctctttatttattccgctcctctcctgtggagcgtgccgcagctctgaacccggttccgtccactgtctgtcgcccatcccgcggcaccccacgcacgcgccacagccagccggcgtccgcgtccgcgtccacacgccccacgccggcgccgaggaaggatggagaaggccctcaccaagctcggcagcttcaccatcccccgcaaggccaagcaggagctctccgccatcggcggcgacatctcgcgcatctcaagcaccgtggaggagaaggcgaaatgggtcttcgagaagctcaaaggcaaaccaaacaagtccctctctgacctgctgcgcgagtacaacctccctccgggcctcttccctcggaacatcatctgctacgagtacgaccagacgagctcgaggctcgtggtgcacctggccaagccctgcgaggtgagcttcaaggactcctccatgatacggtacgccacccgcgtgaaggcgaccctgtcccggggcaagctctcggcgatcgagggcatgaagaccaaggtggtggtgtgggtgaaggtgaccaccgtgaacctggagagcttccggtccgacaaggtgtgcttcatcgccggcgtgaagaagctgaggcagaaagacgcctatgaggtgccccgcgaagctgcctccgtcgaggagttctgaaccttgatctgatggtccgtcttcttatccatagtgtccatgattcgtgccattcttttgtgtcccatgtggtgtgtgtctgagggcgtgctggtgattgaattggtgtgctgaggctaggcatgtctgtacattggatttggttcttcctgatgaaaggcccccatgcatgttctctcatcatttcgcatgggtggtgtcccagtagtgtgaacatttagcatgtgttctggctttgtggtgctcatctgtcggggacctgtgtttcagtgctttatggtgctgcgtgtgccggctgctggctgaggtgcattg

SEQ ID NO: 31776 - DNA, 398 bp, Triticum aestivum
  Clone ID: PAT_TA_31776
gggccgacgggctggcggagaagttcatcgcgaggttccacgcgaagttcttgctggagaagcaggagtcgtaccggaggtaccaggagatgatcgccaggagcatatgaaccacgagatccatgacgacccatcgagggttcatccattgcgccgggcggcttggtgtccggactctgagcatccggagtactacgtgagtacgaatttgatgttgagcagtgagtaattcatggtgcagctcttcgtggccgtgcctcgaaattggagtcgttttcgctgggggcgtgtcgtgtgtcgtgtgtcgtgtgtcgtgtgtgcgtgtgatgatttaatttggtggattcatgtaaggttgggttacggtcgaagcaaaattactccaacggaggacaaaa

SEQ ID NO: 31777 - DNA, 938 bp, Triticum aestivum
  unsure (1)..(938): unsure at all n locations
  Clone ID: PAT_TA_31777
cccacgcgtccggctccactgttccacgtggaggctctgctcccgagctcgatcggacccaagatcgactccatcctccactcccacatctacccgcaggtaggtcacgtcttccgcgccgtcgccaggttcagggccctgctcgtcgacgtgatactcagcaagaagaggacggccgccgcgagagctggcagcggcgggtacggccactacggtcgctcgacgacgaagtcggcgaagaggagcggcggcaagaagcagacgagcaagatcgtcggcttcgtgaagatgcacttcgtcggcacctccttcccgccagctcgagcgagggatcggttggacgccagccgcgcgccctgctattcgtcatacaacgactacgagtacgcggcggagtggaacgctgtggttccggcgacggcggcggccgtggaggaggaggtggtggaggtgtgcgacgacacggcggagtgcgggtacctgtgttggctggaggaggagaggtcgtcgggtggcgtgccggcgggcgaggacgacggcgccgaggctagtccggcggtgaacgagatcgacaggctggcggagaagttcatcgcgaggttccacgcgaagttcttgctggagacgggcggagaatatcagcaggagtcgtaccggaggtaccaggagatgatcgccaggagcatatgaaccacgagatccatggcgatccatcgagggttcatccattgcgccgggcggcttggtgtccggactctgagaatccggagtactacgtgagtacgaatttgatgttgaacagtgagtgattcatggtgcagctcttcgtggccgtgcctcgaaattggagtcatttaattttcgtgtgtgtgtgtgtgtggattcatgtaaggttggcgttacgnccgaagcgagcattattgntcgggaggtcaana

SEQ ID NO: 31778 - DNA, 204 bp, Triticum aestivum
  Clone ID: PAT_TA_31778
ataaaatctggagccagagtacatcatatgaacaaaaaaaagatttatatgttggatgttctgtagtttcttgggagcatgtgggtgctcgtgatttccaggtctgatccaaaagccaaaggccaagcatgtcatttagaatggtacttatgattgtcttgcacatcctatgaatattctgaactatgaagtatgtatgctatt

SEQ ID NO: 31779 - DNA, 985 bp, Triticum aestivum
  unsure (1)..(985): unsure at all n locations
  Clone ID: PAT_TA_31779
gagtgatgtaaaaaatgggatgtgtttttgctcctgatcttttaccttttttccagttattttttgggcctttctagtttgaactgctggtttctgataatacaagtcggagagaaaattctctttatggaaagagagtgttggtgcacaatgatgaacatatgagaagttgcaagatttggtaaaaaatgcgttgcgtatcttgtgaaaaaatcgttactctttgcatagtctagaaaagcctctggtgaaaataggcttctaggcaacttaaaataatccacaacatgcctatagaatgtatgtttcggaaattcctatgtgcgtgtatatgtcatgatgctcgaaagtttttgtatatgctccttaaatgcaacatcacagttcttcaaatgaactaggtgagaagtacaagtgtgcggaaaggttgggcatcaagattgttaatcaccggtggttggaggattggtatcacacaacagcttttgtttataatataagctcacatattaaatatcattatattgctgatttttcctttatttttattctacagcttaaagtcatggaaaatcctaccagaagatgattatagcgagagtggctgggaactagagatagtggaggcgcaagccaaggaacgcctcaacttcccgattcgggatcgccaagttcgcaaatgggaagtatgccgtgaataaagcaaagaaaagaagcagcaggtgctcgccgcagccctgggcactcctaaagcgcgcccatccggaggtgggcaccgactcttgggcgtgccatgatcttcctccccgacatccaaggaccaagaccgccaantacgccaaggtcgcaagagctttgttgcctcctgctttaacaantcngaagcagacgaacctggatgaacaacttttaaagatgncttgtttggtagatacaacctgaattcctggngttagaataaaggttatgaatcttcaagaaaaaa

SEQ ID NO: 31780 - DNA, 1243 bp, Triticum aestivum
  Clone ID: PAT_TA_31780
ccggccgacgttcgtcgccctccgcaggtcaagctcagcagctccagctccgcctccaaaccgaagccgccgccgccgccgccgccagcggaggaggaggaggaggaggagggagatggcgtcgggcctggtgacggaggacgtgacggtggggcggctggtccggatccggcgcacggtgatgcacatgctgcgcgaccggggctacctggtggtggagcacgagctgtccatgacccgccgcgacttccagcgcaagtacggcgagtccttccaccgcgaggacatgctcatcaacaagtgcaagaagaacgaccccaacgaccagatatacgtcttcttccctaacgacgagaaagtggggatgaagcacatcaagaagtatgttgaaatgatgaacgccgagaaagtctcaagggccatattggttgtgcaacagaacctcaccccatttgcaaaatcttttcttcaagaactggagccaaagatccacttggaggttttccaggatgccgaaatgcttataaatatcaaggaacatgttctcgttccggagcatcaagtgcttgctaacgaggaaaagaagacgttattggcgcggtacactttaaaggaaactcagctaccaagaatacaaattacggatcccattgcgaggtactacggcctcaaacgagggcaggtggtgaagatcatcaggcccagcgagacagccggcagatacgtcacatatcgctatgttgtatgacagtacacaaactgaaggaaccaagaacagggtgatttttgctgttacacacaggacacacatacccattcgcttgcttggagaaaactggtattgcttcaagaagccattcttaaggatcgcatgcctgttacgtaaaaggattcttaataagctgagtgtatggggcataagcaaaatcctcatgttgtaccattgtttcaagaactttatagaacatacagaacagaaactggtgtgcttagagcaatgaaaggctctgcagttctggctgctacatcatttgaacgaaccattcttgaaattccatgattctggtcctgacgttgtgtgtgtgtgtgtgtgtgtgtgtgtggtggtggtggcatgcgtgatgaacttctttacaatacatggtggatcctggagtagtattgtaagcatttactcaaggtaaaggaaaaattgctctgtttagtattaaaaaaaaaaaaaaaaaactcgagactagttctc

SEQ ID NO: 31781 - DNA, 396 bp, Triticum aestivum
  Clone ID: PAT_TA_31781
gctaaaccggagatggagtcgtatgtcattgttgcagaaacggcaaatgcgacaccttcatagaatgaaccagaggagccggaggcaaccgcaaaggcctttttggaggtcttggcctcgtcgaagaaacctctttatgcgggtgcgaaaatatctcagctggatgccatctcgcaactgattgcagtcaaggctgagtacggctgtatccagaaatgcttcgaagcattcctgggagtatgggctaacagcctccctgagggtcatgaactgccgaaaagcatgtacgatacaaagaacatcatgaaggcactctctatggattatgacaaaatagatgtttgcccgaagaattgccttttgtttatgcactagtatgcggatgacatgtactgt

SEQ ID NO: 31782 - DNA, 1225 bp, Triticum aestivum
  Clone ID: PAT_TA_31782
cccacgccgtccgcccacgcgtccgaaatccgtcacgactccacgagcactcgggcagggcaacacagattcgcgcagcccacctcgccgagcattccccatcagatcggatcgaatccggcggcggcggtgatggcggcggagaagccggccccggcgaaggtgctctactgcggcgtgtgcggcctccccgcggagtactgcgagttcggccccgacttcgagcgctgcaagccgtggctccgcgcccacgcgcccggcgtctaccccgacgagctcgtggcctcctcctccggcggcgacgataaggacgtgggcaaggtcggcgagcgcctccagggcgtcagcatctccaccgccgacggctccacaagcgcagggggtgcttcggcatcttctaagactgaagaggtgaaacgactgccgggcggtcaagctcaagaaaaaggacaagcaagaggttattattgagaagattgtccgcaacaagcgcaagtggtgttactgtggtgaaaggcctggatttgtttggtgtaaagctgagtgatgcttcaaagaagcttggaaagaagtttgctactggagcttcggttgtcaagggcccaactgagaaggagcaaattgatgtccaaggagacatatcatatgatgttgtggacttcattacagctacatggcctgatgttcctgaatccgccgtatatttcatagaagatggaaggaaggttgctgctgcttgattacatatggttttacaaggcatacaccagtggagttacaaatatgatagaaatataaggcaagagacggccgttaaggcatgcctgtcacatgggttctttatccttactcccaagacacaacccgctccattttgacttgtgggtcagttcacaagtggtgttttaactaccgctggcacgtcgccttcgtgtatcatcttttatttgatagtcgagttcctcctgcaaggcgagtatgacatccatatgtgatttatataatttaatgtgcttttgaatcctagtttcaaaacaattcagtaccaactatccgtggacctgcagagataagtgcagattagtagtgctccagtctcgtctgctttcataggaacagtctgtgttactttgtattgcatccagtaagttataacctacttttagtgagatacacaatcgtcggtgtgcatcaaaaggttgaacactgatagaacaactaattt

SEQ ID NO: 31783 - DNA, 1206 bp, Triticum aestivum
  Clone ID: PAT_TA_31783
gtttggattcgacataaacccacggagagggttagaagacggcgactcgtccccaacgcgctcgtggaaatggcgacgacggtggtgccgctcgccgcggccatggccgccgctccaaggtctctcctcctgggcgctccagaccccttcccgttcctcgggatccgcccgctcctctgccgctctccgcgcggcgtcgcctgcgcccttcgccgaccttccaagtacaagaataaaattaagaacgaggtggtggtagcagaggatgacattgatggcagtgacgaggatgacgacgacgacgagggtgggttggaagcgcttttcaagcagctggaagaagatctgaagaacgacgatttgtctgtcgaggatgatgatgatgatgatgaaatatcagaggaagatatggccaggtttgaacaggtattggcagaagccattggagatgtcgatgttgctgatgaatctgcagtagatttggtgtcaggctccgaagttgttggtaatgatgaggcagcagatccagtcgaacggccagagcttaaaagctggcagctccggagattggctcgtgcaatgcaaattggtcggcgtaaaactagtataaagaatcttgcaggggagcttggcctggataggggtttggtcattgaattgctccgcaatccgcctccagaacttctacttatgtctgattctttgcctgatgaagccccctctaaacctgaaactaaggaaatagagccctctccagtagctgatgaggttgtagttgatgagattgatgccactgaagccaatccacagatggaccttccggttcatgtcatgagcacagaatggtctgcgcagaaaaggctgaaaaaggcgcaactggaaacactggaaaaggtttacttcaaatccaaacgccccactaatactatgatcagtagcatagttcaagttacaagccttccacgaaagaccattattaagtggtttgaggatagaagggagcaagatggtgtaccagaccgtcgtgccgcatacatgagatccctatctgagacaatggctagttgataacttcagataagcttgtgttatagtgttctcttttaggtctgaactacgtaggaatttgtaaattcaaactgtgaaatgcaaccagtttcataaggccaacacgccgtatcttttaaaaaaaaaaaaaaaaaaaaa

SEQ ID NO: 31784 - DNA, 1014 bp, Triticum aestivum
  Clone ID: PAT_TA_31784
cactcgccggccggctcttcacactcactctcactcactcacacttcgccttctttccccatccccaggcggcggcggccccctcgttcccactctcactctcacagcatccgggctccagagcggggagacgctagagcgaacgggagatgggggagacgaggagctggagctctctgctggtgcacattctggtgatcgccctctgcctcaccggcttcggcttcgccatcgccgcagagcgccgccgcagcacgggttcgatagtcacagacatcaacaactccacatattgcacttatgactccgatatttctaccggctatggtgtcggcgccttcctgtttctcctctcgggccaatcactccttatgggagttacaaagtgcatgtgctttggccaaccgctcgcacctggtggaagcagagcctggtccattatctactttgtttcttcatggatcacattcataatcgccgagtcctgcctgatcgccggggcgacaaataacgcgtaccacaacaagtacatgcacatgatatacgcggggagctggacctgcgactcgctccggaaacgggtgttcatctggggggcggtctttgtggtggtcaccatgaccctgaacgtgtacttctacatgtactacacgaaatcgacgcgccaggccgccaaaaagaccaacaaggccaccgccaatgtcggcatggctggctacgcatgacgagggagaaggcactctggtttgatggaacttgcttgtgtgctggatttagttagatattctggagcagaacgtagtagtttctggaaaatgtagcgtgtggtatggctctctatgatcagatcagatgtgtttgttcaggcctagttctcgtcttgcctgatctacagaatatttgatgtctaagacagcggcattgtgatactcctagatccaagttgtgagcgtgagcatgatcatatgagaggggtgaaccggatggtccactgccaacgggctaagaattttt

SEQ ID NO: 31785 - DNA, 1372 bp, Triticum aestivum
  Clone ID: PAT_TA_31785
cattcgatggcccaatggggctgaggttcttttgcaggtgacctgggatgaaccggacctgctacagaatgtgaagagggtgagtccatggctggttgagctggtctcaaacatgccggccattcacctcgctccgttctcgccgcctcggaagaagctctgtgttccgttctaccccgacctcccggtcgacggccagtttccggccccgatgttccacggaaacccactcggacgcggcggcgtcggtccgatgtgctattttccggacggcactcctgcaggcatacagggagccaggcatgctcaaactggtctatctttatcagatctccaccttaacaaactgcagtcgagtctgtcaccgcacgggcttcaccaggtcgatcacggcgggcagccgaggatcgccgctgggctcatcattggtcacccggctgcgcgagacgacatctcgtgcatgctcaccattggcaatcaccagagcaacaacaagaagtcagatgtcaagaaggcttcgccccagctgatgctctttgggaaacccatactcactgagcagcagatcactttaggtaactctgggggtttctgtccatctgctgctaggaagagcccctctgatatgagcgccgagaagtcggcgaataactctgatcttccaagcccacaaagcaaccagaatggcactacgaagaacctgtcctgcggaggagttccattgtgccaggacaacaaggtactcgatctcgggctggatatcgggcactgcaagatattcatgcaatcagaggacgtcgggcgcacgcttgatctctctgctgttggctcgtacgaagagttatatcgccggctttccgacatgttcggtatggaaaaagcagagctgatgagccatgttttctaccgtgatgcagccggggcgctcaaacacactggagatgagcctttcagtgacttcacgaagacggcgcgtaggctgaccatactaacggacacgagcggcgacagcagcgtagtgagctaggaggaatgaggaaggaagctctttcgccacttgtacgtacagctgggttgacggcggcgcggcgcagcacggtggcgattctcagagagcatagatagcgtggctgcggaattttccgcagcctggatgcaagtcaagaagcaccaccggtgcaggcagcttcagtttttctccgattattagagagctcccagaatgggactggtgattgtttgtgtggtgatccatgaacagttttctgtttttttttttcgttgtgttgactaccacccattatgatgatgttagcagtaactctggctcagaatccgtgggggttccttgctgcaagtcctgggaggaatg

SEQ ID NO: 31786 - DNA, 1441 bp, Triticum aestivum
  unsure (1)..(1441): unsure at all n locations
  Clone ID: PAT_TA_31786
ctggggcgcacacgagacggagatcgtcgaggtggtcgccgaccaggtggctgtcgcgctctcgcacgcgtcgctgctcgaggagtcgcaggccatgcgtgaccgtctcgctgagcagaaccgcgagctgctgcaggcgcggcgggacacgctcatggcgaacgaggcccgggacgcattccagcgcgtcatgagccaggggatgcgccggccgatccactccatcctcggcctcgtgtccgtggtgcaggaggatgacctgacgcccgagcagaagctcgtcgttgacaccatgggccggacggccaccgtcgtctccacgctcatcaacgacgtcatggagatgtcggccaccaaccgggagcgcttcccgctggagacgcggccgttccagctgcactccatgatcagggacgccgcctgcgtctcgcggtgcctctgtgacttcagggggtttggcttcgccgtgcacgtcgagaacacgctgccgaaccttgtcatcggcgacgagaggaggatcttccatgtcatccttcacatggttggcaacctcatcagccggattgactcggggcacgtcacgttccgggtgcgtgccgacgacgaggtggcggaggacacccttggacagaggtgggatccatggaggccaagctactccagtgggtactcttcggtgaagtttgtcatcggggtgaagagccagcagagctccggctcgatgatcccgcccccggggcagttcaaacgaaagccgagcggcgagggcttcgatctcaggctgagtttcagcatgtgcaggaagcttgtgcagatgatgagaggcaacatatgggcggtgctcgacgggcaagggctaccagagagcatgaccctggtgctgaggttccagctgcagccaccggcgccactcatgtcgtccagcaccagcggaggatcgttcgagcggcaatacgcgtcgccgtcgtgccagctgaccggactgaagatcctgctcatcgacgacgatgacatcaacatggtggtcgctcggaagctcctggagaagctggggtgcgtggtctcctccctaccctcagggtcggggttcctgaactccgtcggcccctcgtcgggcgcgtaccaggtggtgttggtgaacctcgagatgacgcgggtgagcgccctggacgtcgcggcgagggtccagcagtaccggagcggccgctggccgttcgtgatggcatgaatcggagcaaaatcntgggaaaagtcgctcantcgggatnaacgcatcctcaggaaccggtggtcatctcaagcgaaggaggactaaccggatctaaaaccatattcatgtggtccagtattcccttctgcgagaatccaaatnacaggaatgcacatacgcgggcncaagggcattnctggaaccttcaaaggccgggggaaaancatggac

SEQ ID NO: 31787 - DNA, 742 bp, Triticum aestivum
  unsure (1)..(742): unsure at all n locations
  Clone ID: PAT_TA_31787
ggnagnaaaacggnaaacgatactcgcactggaggcgtgagagagaaagttgaagttgacaaggagctgcagtccatgcagcaactgtcagtgaagaaggatgctgaggaagtatttatcaagctgggctctgacaagggagaagaagaaagaaagcacagaaagagaggagcgtgccaagaagtccctcagcatcaatgagttcctgaagccggctgaaggcgagaggtacaatggcgggcggggccgcggccgtggcttcaggggacgcggcgaggcccgtggcgggtacaacggcggcggcggtggtggccggcgaccagctgctgctccggcgatcgaagaccagtcccagtttccgacgctaggtgggaagtgaaggggtccgtgtcccgtgccctgatccgactagcagcggctcctcggtggttcgctccagactgtgtccttgttgagttgtcagtactcagtagcgtgtcgtcgtttcgcctgtctgtctttttgcctgtctgtctttttatctgtcgccgtgtgtgtatcccgtgtacccctgaggtgcacccacccgtgtcgtgtcttgttttagccgcagcttattccgttcatttggataggacaatgtcatgtatgagatgttttccctggcgcccttgctgctccttatctgtgtggtgtccgcttggctcagtgattttgttcagctgaaaaaaaaaaaaaaaaaaacccccccccacccccccgc

SEQ ID NO: 31788 - DNA, 1261 bp, Triticum aestivum
  Clone ID: PAT_TA_31788
gtccgccccgcgccgggccgccccccgccccgacgccggcggcggcttccaggccgggtgcggccgcggcccccgccgcccctaccccgcgccgcgccgccgccgcggcggcggctcccacgcgcagagcgcccgcggcccccgccgcccccaccgcgccggcggccgccgccgcggcgccggccccggcggccggaacaagcgcgagggcgcgggccgcggcaactggggcgaccgccgccgaggcagcggccgcggcttcaggtgtggaggcgatgaacatggcggagacaactgcggtggcggaggaggcgaaggagccccaggaggagccgcagaccgaggctgagaaggtgaagccgcggctgggacagaaggtgagaagaaggccgacggtgcgccgcagcgagaggccgaggagggcaagtggggtgctgagagagaagaggcccagtgaggaagctgagctaaataaggagatgacattggatgagtatgacaaagtactggagtagaagccggcaatgtaattctcgcacgaagcgctgggaagagagaggatgcagggcgacaacgagctgcagtcgatacaaaacatagcaggagaggagcgtgctaagaaggccctcagcatcaacggattcctgaagccggctgagggcgagagctacaaatgacgggcggggccccggccgtgcctccgcggcacccaacgccggcaacggggtgaagcaaagacggccagcggtggccgggccgaccagcttgctgctccgggcgatcgcgaggcccgtggcgggtacaacgcacgcggcggcctggcaggcgtccagctgctgctccggcgatcgaagaccagtcccagtttccgacgctaggtgggaagtgaaggggtctgtgtcccgtgccctgatccgactagcagcggctcctcggtggttcgctccagactgtgtccttgttgaattgtcagtactcagtagcgtgtcgtcgtttcgcccgtccgtctttttatctgtcgccgtgtcttcgtcgccgtctgtgtatcccgtgtacaccggaggtgcacccgcccatcgccacccgcccgtgtcttgttttagccgcagcttattccgttcatttcgataggacaatgccatgtatgagatgttttcctggtgcacttgctgctgtcatgtgtctcctgtgtgcttggttctgtgattttgctcatctcagaattaagtcatcttctttctaaaaaaaaaaaaaaaaaaaa

SEQ ID NO: 31789 - DNA, 1361 bp, Triticum aestivum
  Clone ID: PAT_TA_31789
gtgatgcctacctaaaatatagactatgcatactattattctatctagtactaaagctaatagaagaagagagatgtttgtctgaaacaatttatatttactacacttttctgtcacgaatctgtgattcacttctatcatgtttttttgtttctcgctcctcgcctgttctccccctcctcgcacccaccgccccgagatctcccctttgcctccccctctccggcaatggcctcccccggaccagcccccgccggcgagctcctccgcatcgaccccatcgagctccgcttcccctttgagttgaagaagcagatctcctgctcgatgcagctgtcgaatctcagcgacgactacatcgccttcaaggtgaaaactacaagcccaaagaaatactctgtgcggcccaacacaggggttgtcttgccacgatctacatgcgatgttgttgtgacaatgcaagcacagcgagaagtaccatctgacatgcagtgcaaagataagttcctagtccagagcgttgtcgcaccctctggcataaatgtgaaggatgttacaggagagatgtttatgaaggaatctggaaataagattgaagagatgaaattacgtgtcacctatgttgcacctccacagccaccatctccagttcctgaagaatccgaggaaggctccccatctagggttgaatcagaaaatggagatggtcctgctgggggattcaccagggcactgcgagaacgcattgagccccaagaaaaatctttagaggctggagctttgatctccaagttgaccgaagaaaagaattctgcaattcaacagaaccataaaattagacaggaacttgatatgatgagacgggaagtcagcaagaggcgcggtggagggttttcctttgtaattgtcataattgtagctttgatcgggatcttcctgggctacatgatgaagtcataattcttttcatccgtatcacttgaccgtatcgaagggaactggacttgctagtcatgtttgggaacttgaaaagatcattcgagatcaaatgtcttcaagttctcctttatgttttgtcaatataggagtacatgtgtgagaaatattgagctagtttaagcttcttttgttgttaatttcattggtgagttgtgcgctatgatgacgctgtaacttggaaaatgcatcaattgcttttgttcacagttagacctgtactgtgaaattgtcagtccatagttgaatgtgtgtgccatttggaagggtaaaaaaaaaaaaaaaaaaaaaaaaaaaaaaaaaaaaaaaaaactcgagactagttctctacctcggccgcgaccacgctaatcactagtgaattc

SEQ ID NO: 31790 - DNA, 643 bp, Triticum aestivum
  unsure (1)..(643): unsure at all n locations
  Clone ID: PAT_TA_31790
aaaagagcatttcaattgaattttgtacggaaacctttgagaagacctagaggacagaaatacttctgagtgcagccgagctagtgagaacagagctcaaatcctccctatatcacgaagcacttccctgagagggacatgattgatatccgacacagggcaaaaaccaatggtcaactaattttttttcatttcaacctggcgaaaacaacgaatatggcatcttccccccttcttatatcgtgacgaggaaaaaggaaaaagggaggctgtgggcatgacgttgacccgcgaattgcgtgctatgatgagacgttgcaggcaaggggatttatgggcgcgctctggtgagagacgggcaggcgttgggcaatctagttgccgccgaggctggggaaagcagactggtcgttggtgttgatagcagcattgcccttagcagctccctgaggagcccccccgcgccccccgcggttaccttcacgggcacggtcaccaccacgctctccgcctcgcccaccacgcccggcacgccctccgcgggcaccccctcgggcgcgctcgggctcgacgaaacgggggtngaagtcaacggtctgcccgaaattgcgatatangctggcgntgggccttgccacaggag

SEQ ID NO: 31791 - DNA, 700 bp, Triticum aestivum
  unsure (1)..(700): unsure at all n locations
  Clone ID: PAT_TA_31791
gcgcaggggcgcgtacggcggcgccgccgccgctgccgccgtatccttctcgtcctcatccggcctccagagatccggagcccgcagatccggcaacctcgcgcctggatcttgcagctcgggccgtgctcctccctctcctccccggcacacggcgcctggtgctcgtcatccacgacgcaccggcctggtgctttccacgccgcacgcacttaaccccgtgtcaaagacggctgcccccaaatcccacaccatgccccgtgctcgaaggcctcgccgtgagtggtcacccggcgtcccgcccgcgcttcttgccgtcatcttcctcgacctggcctgcctcagctacttggcgtcatcttccgccgtctgccgcgcctcgccgactgtggcgggcttcgctggcaccccccgcgcgtggcgctctgtcgcatggctccttggagccccgcccgagccgcgctccttcttctggctcctcctcccggcccaacgcaagccatccctcttcaagctcctctcgggggccaaattgtgggctacccatgaccggagatgggacgcggtggcattttggcaggctcctatgaaggcggncgggaacctcttgccttcgagcagtggcggcgtctccccagacaggctcaggactgcgcaccccgctcccttccccaggcgaaccccggctgcgagcaccaca

SEQ ID NO: 31792 - DNA, 633 bp, Triticum aestivum
  Clone ID: PAT_TA_31792
atcgagcagaggcttgtgtcctctggatacaagccagacttatcagaggctcgtatggttgctggcatggaccataccaagggcgccgccctccgcttgcacagtgagcggctagccatatcgtttggtttgctcaaggcgacacccggtgcacctattcggatcctgaagaacctgagggtgtgcaaagactgccatactatcagcaagctcatatcagagctctatggtgttgagatcattgttagggaccggattcggtttcaccatttcaaggatggagcatgttcctgcaaagattactggtgatacttgagccaaagagactgcgctgcagacgttttgttgagagtgccctagcaaaacataaaatgcatctctgcaggcgttcaagacacgaaatgaaatagggggtataccgtagcatgtatcttcttcattgttttataggttgtccagatcgaaattagctggtttgtcagataaacaggatgttattagatacatgttctacttctcagtcttcactttcactcaaacactataaggtagatactgtaatgacagttacattgacctcacgagaaatacgaggccggccagtccgttgttctgcacggattgattttgagt

SEQ ID NO: 31793 - DNA, 881 bp, Triticum aestivum
  Clone ID: PAT_TA_31793
tcggcacgaggcttcggcgagtgcaccaacacggcgggaggacacctatgccggtgcccacgtggcgcccaaggcgacccgctcataagaaatggctgcatcaaatcttctctaggtttaagtgtcggcataggagttggcagtggagccagcccttctctcatggtacttggtgctattttgattacccgaaagatgaagcaacggagggcaaaaatgctcaagaagagattcttcaagcaaaatcgagggcatctgttgcagcaattggtgtctcagaaggcggacatcgccgagaggatgatcatccccttggtggagctacaaaaggccacaaacaatttcgacaaagctcgcgagatcggtggaggagggcatggcacggtatacaaagggatcatgtcagacctgcacgtcgtggcgatcaagaagtccaaggtcgcgatccagagggagatcgacgagttcataaatgaggtagccatcctctcgcagatcaaccatcgaaacgtggtgaagctctttgggtgttgccttgagacggaggtgccgttgctggtgtacgagttcatctccaatgggaccctttaccatcatcttcatgtccaagaacccgcgccatccctgacatgggaatatcgggtaaggatcgcaaccgaaactgcgagagctctcgcctaccttcactcggccgtgtcgttccctatagtccacagggatatcaagtcccaaaacattctgttagatggcactctcgtagcaaaggtgtcagattttggagcttcaaggtgcatcccgctagatcaaacaggggatgaaaccgccattcaagggacatttgggtatctagaccccatgtacctgcccgggcggccgctcga

SEQ ID NO: 31794 - DNA, 698 bp, Triticum aestivum
  unsure (1)..(698): unsure at all n locations
  Clone ID: PAT_TA_31794
ggcaaagcgacgccggcggcggcgacctagcccattctcaggccatctcgccgcctctctccgcctgcgtccctccacacaaaaaaagaaaaaagaaggggaaaaaactggatcacagacgcaggtcgccattctctgcgacgcaagcaccagaacaacaaggccgcctgtggctgagagtgccggagcgcacgtccgggagagggagcgacgaggagcggtcggcacagaccggagaggtactagggcggcttcttcttcagagatgtttctaggtctgctgaatccgcatgccccacatggaaaattgctagctgtggggcttgtggccgcttggacctccattgctgccgctgcttcgtcgctgagcgagcaggtatggtgcagccagaaatctttcaattgcatgccctgctctatgatatacatttctgatgcatatcccggcaccttcacgccaccgcttgctcaacataatggcttagctgacgtacctgattcttctgacttgtgcaaaggactcactaatgnaccttgatgtggcctgtgcttttggaatcgcaccggcaacttggttggtggaaggttcccaccgcccgtcttgtctaattccatgaaatttggtaacagcgaagatactttggtaaaaatccctgatgactatgatgcgaattcttgggataattgagagcctccct

SEQ ID NO: 31795 - DNA, 810 bp, Triticum aestivum
  unsure (1)..(810): unsure at all n locations
  Clone ID: PAT_TA_31795
ttcggcacgaggcgaanatggcagcctcggnagtggagcgggtggagacggcctcgtcggccagatacgacgccacggccaggtccatgcaggcactgacatccaaggtcacgaacctcaccgccacactccacaagaaggaaaccgatgccgccttggatctcacccggacttcagcaaaggtgtgcgcgttggtgtccctttcggccgcggcgcttgggggcttctcgtacatcgccatcatgccccccggctcagctccgcccgctgcaactgaggaagtcgacaagggcatggaggaggtcaagactcggctccaagggaagatcagtgagtggtacgaggacgaggaggccaagacccgcgccaaggccgtctccaactccaagcccggcaccgtttccaagctcaagtccgtctccatctccaagcccaagtccaagatcggctccgccaccagctccgcccccggctccggctccaactcgtgataggctgataggttttcatatttgatagctctttatatgtggttgaggagagactgcatattatgtttgattgcaagcttcgagtcactcattatgatagctctttagttatatgatcttcttggtattgtccactgtaatgtatggcgcgtaacatatttgacctgctatagcttaattttcatgccttgccatttcttctcagccaccatctagtcttctcgacaatctagatatgttgactaggctacacagttagagttataaagggtttcatgctggcctgtctatgttcatgctgtacactngtaagagcttt

SEQ ID NO: 31796 - DNA, 679 bp, Triticum aestivum
  Clone ID: PAT_TA_31796
gccttacatatcgacttaatctaattatatgtaggtatatcaatcacacacatcgagatacatatttatatagatggattgatcccatgatcggcaaggtagctcttttcatatacttctcttctcctaaaacggagcggtgtggcggtttcacttcttcttcttcttgtcctaaaacggagcggtttggcggttaatcagtctgggccatctggctcagcttcctgttgcagttgtgcacgcagacgtcggcgtcatcagctgcatctgcagaaacggtcggcgccgccgctgagaggccgcagatctgtatcttgcaggccatcctgcaggtggcggcggcagagccgacgccgacgccgacgccgtagccgggctggttggtgtcggggctgcacttgttggcgcagaacacatcgcaggcgtagcccggcacgttgccgctcacgcacccggggtagcagtcgtcgaagcacttgcagaactccgacttcacaggcgcggccttggcggccgcccccttaggagtattcgcctccatctcctcattcctcgcgcccgctacgggctatggctttttcttcctcgggtcgcgcaagctatgggctatggcttcttcttctttttcgggatcagggagtggagacaagtccgtggtgagtgtggtcccggcccggcc

SEQ ID NO: 31797 - DNA, 762 bp, Triticum aestivum
  Clone ID: PAT_TA_31797
gggtcgacgggaggtactaagaggcgcatccggtcatgctgcctccgcaggcgccggtgcagctcacgcgggccgcgcaccgggcgatcgagaccgtgcagcagctcataggagagccgctgagggaggatgggccagtgcttggcgatcactttgatccgcttcctcctggtgcattcggagcgcctatgcctgttgttccagagcagcggaagcagccttatcgatcacatgagaccagtgtattttctgcacacgatcccaagcccatgaaggcatcagcattcttgccaagcatagacccttctgtttcaagtacagttaccgggaagaggaagtacatgtctggaaattcttctcatcttccttcacgggcagtacatgagtaccagtttcttccagaacacactagcgatatatatgagagaacaagccagtcgtgcttttatgatgcttcagcggaagcttcaaattcgaggatatcttctctgtctacaggatcacgcttagtacatggtgctgagaaagcatctagctatgcatttgatggtcaagtatctggctctagccatttaaatcaacatggaaaaccattgatctccctgtcggggtccacagattatgagatggcttcgaatattgatgttagtcctgctccaattgaaggccagtttggcattcctcaggttgctggacttcaaaatccccttgcatccgctgaaggagtggattatcacgatgatgcatatcgactggatagaa

SEQ ID NO: 31798 - DNA, 538 bp, Triticum aestivum
  Clone ID: PAT_TA_31798
agtggcgccacacgctcgagtactgggaggcgagccgccggagccccgatcaggtgttgttcctcaggtacgaggacatgctgcttgacccttcgggtagcctgaggaagatggcggtgttcatgggatgccccttctcgccggaggaggaggctgacggggtggtgcgcgacatcgtggagctctgcagcttggggacgctcaaggggcttgaggtgaacaggagcgggagcacaatgctggggctcaagaatgaggacttcttcaggaacggcacggtgggggattggagcagctgcatgacgccggacatggcggcgcggctggacgggatcgtggccgaggtgctacagggctccatgctcacctttggtgctacctccaaggattaagcctagcttacttacccacatgcatggccacatcgttgattttatgtgtttttcatgtgattgctgccatgccagcgagttcaagccttatccttggccatcactttaatttcttcctcagcaacatcactttctttctaatcaag

SEQ ID NO: 31799 - DNA, 1000 bp, Triticum aestivum
  Clone ID: PAT_TA_31799
gccggccgggtcgggatccaagacagctcgaagttcacaagtcacaacaccggccgtgctcgtcccacactcccctcagatcacctccccgccccagtccccatggcgcccaatgcggccgttgcccgagtgcccctggcggtgaccgtcttcgtggcggtcgcgacgagcatgctgctggcgcccgcggaggctggcctgtacagcgaccgtgacgcgctcttggccctgcggggcggcctacaggaccccgacggcgcgctgcgttcctggatcctggaggtgaacccctgcgagtggacccaggtcacctgcgaccgcgtggccaaccgcgtcaccgagattacaatcggccatgcgaacctgtccggacctctgtcgccggagctgggcaagctggaccagctaaccaaactgtggatttcgtggaccaatatccaaggaacgatccctgaagagctgggtaacttggagaacctgaactccctgcacttgcacaacaacagcctctcggggcagatacccgcatcgctcgggaaactcaagtctctgaaacagctgcaccttcaacagaaccacttgaccggcccgatccccagcgagctggatgggctgtccgaccagacgagtgtgaacctctcaagcaacgatctgtgcggccagattccgacagatggtcccttcaagaacatcaattccagcctcgccgacaacccacggctgggtggcaactgctagaccgatgcaagatgcaccatgcacggcggcccgccggagtgaagaataaactagcagtactactactactagcgtgcagccagagaatcgggtggcgccggttcatgcatgcactacttaggtggattcgtgagggtggttaattagctgagcaggccaatttatggatgttgtgtacaaaccgagatcgatcgttgtgggcttgtttctggctgttgccatcaatgggatgaattacatatatactttcccgtacctaaaa

SEQ ID NO: 31800 - DNA, 1033 bp, Triticum aestivum
  Clone ID: PAT_TA_31800
ctgccgccgccgcgccgcccgggcccccttggcgcagctcgaaagttcacaagtcacaacaccggccgtgctcgtcccactccccgccccagtccccatggcgcccaaggcggccggagcccgagtgcccctggcggtgaccgtcttcatggcggtcgtgacgaccatgctgctgcagcccgcggcggctggcctgtacggcgaccgtgacgcgctcatggccctgcggagaggcctacaggaccctgacggtgcgctgtatacctggatcccggaggtgagcccctgcagcaactggtcccacgtcacctgcaacggccaggccaaccgcgtcaccgagatagtaatcggctttgtgaacctgaccggacctctgtcgccggagctgggcaagctggaccagctaaccaaactgtggatttcgtacaccaatatccaaggaacgatccctgaagagctgggcaacttggagaacctgaacaccatgcacctgcacaacaacagcctctcggggcagatacctgcatcgctcgcgaaactcaagtctctgaaacagctgcaccttcaacagaaccgcttgaccggcccgatccccagcgagctggatgggctgtccgaccagacgagcgttaatctgtcacacaacgatctgtgcggcccgattccgacggacggtcccatcaagaacatcaattccacgcctcgccgacaacccgcggctggtgcagcaactgctaggcccatccacggcgttggctgccggccggagtggcaaatatactgggtactcctactcctactactagcatgcagcgcaggttaacgggttggcgccgtttcatgcttccacgagttaggtggataggtgagcgaggcaatttttgcatgttgtgtacacaccggggccgaccggtgtgttcttgtatgtgttgtgtacaagccgagatcgatcgttgacatatataaaaaaaaaaaaaaaaacgatgggattagttacatatatgcttcccgtcccgctttgggtgcttgagtc

SEQ ID NO: 31801 - DNA, 791 bp, Triticum aestivum
  Clone ID: PAT_TA_31801
gcttactcatcgctccagatcaatcattggctggctccattaactagttacactacttgctgagggatggatgatgtgtggtgcagcctcgacatggccgccgacatcgccggcctccacagcgccctcgccgacccattctggcccgccgaccttgacctcatggtttcgacccacgaggtggagggtatagcggacatggacgcgagcggcttcttcgtaggaggaggggatgaccgcttcatgctgccgtcgtcgacgacgtcgtcactctcgtcgaagcgatcactctccctcgacagcggcggctcctcaggctcagggtctttctcgctcgacctcgcggacgccacgcggtaccaggcgccggcgctgcccgtgccgcacaaccccttggcgggcgccgtcgaccacgacgacgaggcgatcatgcgggctatgatggcggtcatgtcttcgtcctctgcctccccgtcctcctcggcatcgtcccatccgcagcccttctgccgggaccgggacagcaacatgcaacaacagtcagcagccatggcgcggcagctgcgtggaggacgaagtggccacgtgatggtgaagagcagcctctccatgtcgccggagagaagcagcagcggcggcccgggacagcagcaagaggatccgacgagggccgcgagcggccacaccggccagctctaccacatgatgtcagaaaagaagcgacgggagaaactcaacgacagcttccacacgctgaggtcgctcctttccccctgctcaagaaagacaag

SEQ ID NO: 31802 - DNA, 574 bp, Triticum aestivum
  Clone ID: PAT_TA_31802
cgtgccctacacctccctcccgatctccctgaacttgcgccgctgacagaagctttcgcggtgaatttcgtcgccatcgcggtggagcacccaatcgagcagacggacgttgacagaagcagttcgccgctggccacagagagacccctccttcgccgttagaactaccatcgtcacctccgttgatcgccgcgtctgcacgtcacctcgccttcgccggagaaccgccgggggaagcgccgtcgcccacgcccgagccgcgccgccgccgtctcgttcaagtccggcgaccacacagcctctgttttccgattgtccagagtgtgaagcggaccagaattaagcgttagagtacttcaacaccgttcaaggattttcagatgatcagtgagatacagtagggtcgcgagtcttcactcagcattttcgccagtgggcagtgatgggactcatcgtctattatgctacatttccactgttgttattgaatacagctagcgatgtgctattccatttgtaatactttatgaattctggatcatacgttatagtaaatgatgcacttgttattggg

SEQ ID NO: 31803 - DNA, 1189 bp, Triticum aestivum
  Clone ID: PAT_TA_31803
tgggcgccaagcgtggcccggcggcatggcgctgcgtgcgcgtccctcttcacgcaggcgcccgcggtgaacgtggcctacgcgcacgccggggcagggcggctggccgttccggttgttgctggcacggtgccgccggagctgcccggcctgccggctgtgctcggaccggacgacgtgccgtcgttcatggccaaaaccgacgagtgccctgcgtacctggacctgctggtgagacagttcgtggggctcgacgccgccgactacgtcctcgtcaactccttccacgagcaaatttggaaggaatcggagtacatggcgtcgatgtggggggccaagacggtaggcccgacggtgccttcggcgtacctcgacaaccgcctgccggacgacgcgtcctacggcttccacctgcacacgccgaccacggccgcgaccaaggcgtggctggacgcccggccggcgcgctccgtcgcgtacgtctccttcggcagcatcgccgcgctggggccggagcagatggcggaggtggcggaggggcttttcaacagcggcaagccattcctgtgggtggactgggccttggcgacgtccaagatccccgacggcttcaccgacaaggcggacgggaaggggctgatcgtgccgtggacggcgcaactggaggtgctggcgcacggcgccgtggggtgctatgtgacgcactgggggtggaactcgacgacggaggcgctgagcgccggggtgccgatggtggcggtgccgcactggtcggaccagccgacgaacgccaagtacatggaggacgtgtggcgcgtcggcgtgcgcgcgcggccggacccgggcggggtggttaggcgggaggaggtggaacggtgcgttagggaggttatggggaacgaggagtaccggacgagggcggcgtcgtggagtgaaaaaacgaaggcggccatgagcgaaggcgggagctcggacaggaacatcttggagtttttccgtggactcgggtcgaggaaatccgaacggtcgggagcggcggaagatctgtagtctcgggctgtttctcgtggaaaatctgctgtccgtcgttttgatgtctcgggccatttttctctgacaagtacgcgtcagtattagcgagagcttcctactgaatttctctgaataaaacccagtccccttgaatggt

SEQ ID NO: 31804 - DNA, 1132 bp, Triticum aestivum
  unsure (1)..(1132): unsure at all n locations
  Clone ID: PAT_TA_31804
ggtcgacccagggccgcaaggagtatgcagccgaggtacgcatcatcagccagctgcgccaccggcatttggtccggcttgtcgggtggtgccatgaacaccgtggtgacttcttgctcgtctatgagctcatgcccaatggcagcgtcgaccagcacctctacggcaagggcgtgcacctcacctggccgacacggtatgacattgcactgggcctcgcgtcggcattgctctacctccacgaggagtgccttcagtgcatcgtgcaccgcgacatcaagccgagcaatgtgatgctggatgccaccttcaagtgccaagctcggcgactttggccttgccaagctcgttgagcatggcagccagccctacaccaccgtcctggctggcacgctgggctacttggcgccagagtgcctgacgacaggcaagtcaagccgagagtcggacgtgtacagcttcggcgtcgtggcactggaaattgcttgtggacgacaagccatcggagcccacggcggagccgagcaaggcgaggctggtgccgtgggtctgggagctttatgggaagaaagcccttctcgaagcggcggactggaggttgaaggtggagttcgatgagaagcagatggagcatctgatggtggttggactatggtgcgctcatcctgactacacgcggacgcgtgggatcaggcaggccctgaatgccctgaaatttgaggcggcattgcctgtgctggcgccgaagatgccggtgccgacgttcttccctttgcctgacttggctgctctggtatcatcagttggaggtgcgtccgacacgcagaacccaggcggcgttactgagtgtgagtcatcaggggctaatgctggcaaaggatcttcggtgagggatagacttctggagccgtgaaagtggtgggttttgtgaagctgctttcacgatgattttgtttgtttcgtcttgtgctgcaacatggaggtgtgattgattgtacaattatatttgtatgagttgagtttggtttgtatagcagggaaatgtgttggattaaaaaaaaaaaaaaannnnnnnnnnnnnnnnnnnnnnnnnnnnnnnnnnnnnnnnnnnnnnnnnnnnnnnnnnnnnnnn

SEQ ID NO: 31805 - DNA, 939 bp, Triticum aestivum
  Clone ID: PAT_TA_31805
aattatagttagaaacaagcccgtcataaaggaggatctacagttagcaattttatttcaatagattgaagaaatgaatgaaaaacatggtttttgttatatatgtgagtatactattcgaatccttcttgctatttttatgaggcatcacttcacaatttttatttatggagcttccttcagtctgtagtctatagatgcaactttatttattggtccatacattttctatagatgacatctcaagcacttgctcaaataaattataatttatttatacaggctggtgctgatgtgaataaaattgactatatgggcattacttgatggcagcaatgaacagtgtcctacctggtatggcggctttccaacccaataaaccaacgatgaaggaggatggcgaagacgggatggtgggagaaggctgcgaagaagattagagaggaggatgcagccaagctaaagaagaagaaggaagaggagcttgagaaggagaggaaggcaaaacagagagcgtcaaatgcgatgcgcgctagggagcaagtgttgatgaggaaatgtgaggaggcacagaagaagcgtcaacaggattttgaagaaagaaccatgaagctttgggcaattgcagctgaaaaagaagagagggacaatcagatattcatggagagggtggttaaggaggctcacctcataaaaaaaaggaggaggaagaggaagaagagaggaagaagaagggaaaggggccttgctctacgcaatagagctatgtcgtcctcttcgatttggttgtgaactactatgtgccatgaactactatgtctcctcctcgatttggttgtgaactactatatgccgtgaactactatgtctcctcctcgatttggttgtaagaactactatgtgtcgttgattactatgtctcctcctcgatttggttgt

SEQ ID NO: 31806 - DNA, 597 bp, Triticum aestivum
  Clone ID: PAT_TA_31806
gcggcctccaacggttagcttcggcagggaggtcgatgaggaaccggtcggcgggcctcggccgaaagttgaggacgatcttgaaattggtaccgatcttctgaagatctctcagcggcgcaactacgaggacgtcgatgcagaaacgggaggccgtcgcagtcgcagcagcgaggtggaaggcacggccagtgccagacctgtggcgtgctcggagtcccagatccctgcggtcgggggtactgacgtgagggtgcggcactcgagctgggaccggcgaagcgggaactgggacatgtcgtcggctgtgcttacgaggagcgcgtcagatgtgattggacgtagcagcgtgttcgccgcggacgctgcacgtccatctctagaagagactcgctagcgaactgtgtctgtgcatccaggaaacatgtgcgagcggttcggatagcgaggccatttgactcgtggtggtggtgacacacacccaggtgttttggctttggctgccttgattgggttttgttaccgacccttgtcagttgtcatgtatggacagttatttttagtcaaagaatctgcccccattgttggcgccgacag

SEQ ID NO: 31807 - DNA, 2297 bp, Triticum aestivum
  Clone ID: PAT_TA_31807
tctgcttctacttccacttccgcggttcctatcaccgcctagctccaaaaggtcgtcattgagaggctgcgctaatgggttgcattcctacttattgttcttatcaaacaaacagtgttggttcactgaaactgtcacctcacatccaattacaacaatcttgtaacaatggagttatgttgctatccatgcgaaataagacacagttggccaaaagaagagccacaaattatggaactcatcataattctagtaggactcctgcacctatcgtatgttcaactggaatgcccataattttcgttgccactgaagtgcacccatggtgcaaaactggaggccttggtgatgtcgtaggaggattgcccccagctctggctgcaatggggcaccgggttatgacgatagctcctcgctatgatcagtacaaggatacatgggatacaaatgttcttgttgaggttattgttggtgacagaacagaaacagtgcgcttttttcactgctacaaaaggggtgttgaaacagaaacagtgcgcttttttcactgctatgagagggtatggggcaaaactggatcaaaattgtatgggcctactactggaacagacttccgaactggatcaaaattgtatgggcctaccactggaacagacttccgagataaccaattacggttctgccttttgtgccttgctgcattggaggctccgagggttcttaatctcaacaattctgaatacttctctggaccatatggagaaaatgttgtcttcgttgcaaatgactggcacactgcagttttgccatgctatttgaagagcatgtataagcaaaatggaatttatgagaatgccaaggttgctttctgcattcacaatatcgcctatcagggcagatttcccagagtggacttcgaacttcttaatttacctgaaagtttcatgccgtcatttgattttgttgatgggcatgttaagccagtagtagggagaaagattaactggatgaaggcagggatcactgagtgtgatgtggtccttacagttagtccacattatgtcaaagaactcacttctggcccagagaaaggtgttgagttggatggcgtccttcgtgcaaagcctcttgaaactggaattgtaaatggaatggatgttgttgattggaatccagcaacagataagtacatcagtgtcaaatacaatgcaacaacggtggcggaagcaagagctctcaataaagaaatactgcaggctgaagttggattgcctgtggactctagcatacctgttatagttttcattggacgtcttgaagaacagaaagggtcagacatactaattgcagccataccggagtttctcgaggagaatgttcagataattgttctcggcacagggaagaagaaaatggaggaggaactgatgctgctagaagcgaagtacccacagaatgccagaggcatagcaaaattcaatgtcccattggcgcacatgatgtttgccggggctaatttcataattgttccaagtaggttcgagccatgtggcctcatccaattgcaagggatgagatatggagtgattcccatctgttcatccaccggaggactcgttgacacggtgagcgagggtgtcaccggattccacatgggttcgttcaatgtcgagtttgaaaccgtcgatccagcagatgtcgcggcagttgcttcgaatgtcacacgagctctgaaacagtacaaaacaccgtcgttccacgcaatggttcagaattgcatggcgcaggacctatcttggaagggaccggcaaagaagtgggaggaggctcttcttggcctaggagtcgagggaagtcagccgggcatcgagggcgaggagatcgctccacttgcgaaacagaatgtggccactccctgaaatctccaaatattagggagagtgttctaagattcgacaaaataatgaggttgctaaagatgaagctgtattcatctaggctttgccatttctctactactccatgtgtaacatactacctgaatttcaacaagtatgcatccttatgtaggtaaaaaaaaataggttcgtcaagtagtggtccatctggctagcaggtaccgccagcttgtagtatctagaagaggggtgataggttcgtggctttgtgccatttgcctccgttgtgccaaatcaagaacagaagggccctagctgtgagtgtgggtaaagtatataggttaagtcgttatctggaagaatctactacgaaaagatgcacgcaaccggcaatacgtc

SEQ ID NO: 31808 - DNA, 1100 bp, Triticum aestivum
  Clone ID: PAT_TA_31808
gctttgatctcgaggctggagagcacgggaaatttgctgttgttttggtccatgggtttggagggggagtatttgcatggagacatgttagtaatttgcttgctcgacaagtgggttgcactgtgctggcctttgatcgccctggatgggggttaacatctcgacctcgcagaaaggactgggaagacaagaatttgccaaacccgtacgagcttgagtcacaggttgatcttctgatttcattttgctcagacatgggcttgggctcggtcattttagttggtcatgatgatggcggcttgctggcactgaggaccgcagaaaagttacgtgcttctggagattctaggaaggttgaagtgaagggagttgttcttataggcgtaagcttatcaagagaagtgattcctgcatttgctcgtatactcctgcatactcctctgaggaaaaagcacatggtgcgcccacttctacgtactgaaatcactcaggtgatcaatcgacgagcatggtttgatgctaccaagctgacaacagatgttcttaatctttacaaggctccactatatgtcgagggctgggacgaagcactccatgaagtaggccgtctttcattttccaccgtcctatcatcaaaaagagcaacggaactactaagatcggtggaagacctccctgttttggtggtagcaggctctgaggatgctcttgtttctctgaagtcagcacaaactatggcttcagaacttgtaaattctaggctagtaactatatcaggatgtggtcatctgccacacgaagaatgtgccaatgcattgctctcagctctttctccgttcatctcaaaattggtatcatcagatgattcattgcaaagattgtagcatacacctgtccatcttcccttttgaattttgctctcttctgtgccctctacattgagtagatgacctctagctgttgcgagttggtgtgagcccatgttagttgcaaagtagtggagcctgacccaaaatctcaagggtcctagagctcccctaatttattttttggtcatatgtatttctgttcctgatctgttcaattgagcaagttgaatc

SEQ ID NO: 31809 - DNA, 1183 bp, Triticum aestivum
  Clone ID: PAT_TA_31809
cccacgcgtccgcggacgcgtgggcggacgcgtgggctcggcgccggtgtctcctcccccccccaaaccccccaaaccggtgccgccggcccttcctcctccaaaggcaggcgaaaaattcgcgcgggcgatcggcgaagggatggcggcggcagagggggaggcgagccggctgttccgcgtccggcgcacggtgatgcagatgctgcgggaccgcgggtacctggtgctggacgccgacgtcgacctgaccatgggcgagttcgtcgggcgctacggcgaccccgtgcgccgcgaggacctcgtcatcaaccgcgccaagaaggacaaccccgacgaccagatctacgtcttcttcccgaacgagcccaagcccggcacgaaggtggtcaccagctacgccgagaagatggcgcaggagaacgtccccaatggcatactcgtcgtgcagcaggcgctgaccgcctttgcccgcaacaaactggtcgagacctctaaattccggctgcaggtcttccaggaaggggagcttcttataaacattaagaatcacgatctggttcccgagcacgtgctcctcacacaggagcagaagaagacgctgctggagaaatacaccgtgaaagaaactcagctgcctcgcattcaacactcggatccaatagcaagatactatggcatgaggcgtggacaagtcgtgaagatcaccaggcccagtgagactgctggaaaatatgtgacatatcgatatgttgtctgagctccactacattcttgagggccagagatgttctgccagcactgccagttaaaatgcttcctccaatgctagctcctcagtagtagacacttgttttctcgaggaacggaagtactttttgaaccgccttagtgctctgtctttacatctgcttgtcaatttgacatgacactgttagctagcatctagacgtagatttcagtagtttttccttttctttttcgacacagctaaatagctctttgctacccgaaatagtcggtctaatttgcggagttcaacttagtgcccctgtatttatctgaatggcatgagcatgccttctgggaccgttgtttatctcacgagcaaagaaaagctgcagcatcgggaacgtgggatatctggagtgccggtttatgcattaacataaaaaaaaaaaac

SEQ ID NO: 31810 - DNA, 889 bp, Triticum aestivum
  Clone ID: PAT_TA_31810
tggtatgctcctggtagtggtacatgccagcaattggaccctatggatcctgtggatgatgcccccctgccagttcccacagtggagaccaactttgagaaagaccaaactgccgcacttcacagagcttatggtggttttcgggttgttgctgcggagactggctcattatatgagcggattagacagggggattatctcactaatgatgagatcatggggaccttggacaagcttcagaaaattgctctacaccaaatgaaggatattgccagccatggcgtagtctactccgaggtcccgacacaaccaatgcacaacgcaagcacctccaccacccggccatctgatcaccagagtagcctctaagactccagcaccaaatgtgattgctacagcatcgtaatgaactatgctatcaagtgacctctcatcgatgcggcttgctccttggggtaatacttgaagcaacaaagctggtttttgtgatgatgcttgttaaggaacatttcttatactgacgctgcataacccatactagcagcccatgccaatataccccgttttgagtttctgtcaccgatgactaattatcttggaagttcctggctgtaccgtgttgctgctgcatgtggcgctgtcaccacttaccagcatttaaggagtatatctttttgtttcttgcaaaaaagttaaggagtttgtttttctttttgaaaaaatttaaggagtacatttttggcctttatgaccatgattgctgcaagctggcatgctgtgtggcccgtgcggcggcccggtacccgttccgccccgtcgtgcgtcgcatgtacgttgcgcattctggcaaaagttttttgctcgtggaaatacaccctcgtgccgaatc

SEQ ID NO: 31811 - DNA, 1389 bp, Triticum aestivum
  unsure (1)..(1389): unsure at all n locations
  Clone ID: PAT_TA_31811
cttatggagcgagatccaaaccttaaaacccaaccttgtcggtccattcgcagacgcacgcctggagagaaatcctgcggcgaagaacgctggcaaatttatgacactggctgagttccttgattttgcaaaagccagcaacatcactggtatactgattggcatagagcatgctacgtaccttatagccagaagccttgacgtggtggatgcggtctccaaagcgcttgtcaagtccgggtacgacaaggagacctgtaagcagcgcgtgctcatacagtcagaggacgccccggtgcttgcggcgttcaagacgttccccaagttccagcgggtgctgacgatcgagttcgacataagcgacgcctccaagccttcggtggatgagatattagagtttgcaaacgcggtgaagctcaggcgcagccccgccgcgcgggtctgcgcccgcgtcctgggcggctgcgcctgctccgtggtcctcaggctgcatgcccccaccccgctcgtggcgggcggcgccctcttcattgtgctcgtgcacctcgcgttcgactactgggccgaccccttggtggagatcgccacggacacgttgtcggtgggcgccgacgggatcgtgaccgagttccctgccactgcagctgcatacttcaggagcccatgcgccaactacgaaanaaaggaccttcccttcacgatcaaccccgccgaacccggcggcttgctccagctggctgacanaaactcggtccctccggcgccccctccggcgccggtgctcgagccccaggacatcctgcaacagcagctgccggtgtgccccaacgaccccatgttccggaccttccgctgccgcctggggcccaaggagacgccgacggggaaacctgagtacaacatcaatatggctagcctagacgactaggttccccatccaggttcaagtcctaaacttgacatgggtgctctcgtagaaggtgtgtgcgcgtgttgtgagcgtctgcgtctgcattgtgtttctaaagaaaaaaaaaatctggctgccgatcgacgggtgaagaaatgccaagacatcatcttgttgcaaataccccaccccactctctgcgagattcgctaagttcgttgtgcattacatactggaatgcgttagttacctagttacgatcgcactagaacaacatttgtgtactgagtattcggacaaagtttgtttttaaagtgggcaacttttttgttaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaataaaaaaaacaacaaaaaaaaaaaccaaaaaacaca

SEQ ID NO: 31812 - DNA, 747 bp, Triticum aestivum
  Clone ID: PAT_TA_31812
agcgtggtcgcggccgaggtatccatggcaccacacacgagcacttcatgagcttcttccagaaaatgctgaacttaagggacgtgcagctaagggaggactactatccagcaccggagaacgatatgatgatcacagagatgcgggctgagtcttgtctccggttcgagcagcagctgaacaaccggcaatttcggcaaattcctgattgatgctgaattggcaatttcggcaaattcctgattagtgctgaattgggtggaccattagacattttcggcggattcctacttcaacgctgaattgggtgctccgctacagtgattcgtcgttgaatacgtgctactcgatgtcacgtgttggtttgcattgcgactgatcggttatagaaatttggaattggcgcattccatttgcatggataaaactggaattggacaaccccctgaatgataagagtagaagacaacgcctgatcaagtgacagtggtatcgaatctttatttgcattccttttcttttttctggtgtaataagagagagactcagagttcacatatttgcaggaggcaagatgataagttagcatttgagggaattttgtcaagggaaaaagttttttatttattttcaagctgagctcagttgaactgcggcaagagaaattggcttttaaaaaaaaaaaaaaagaaaaaaaaaaaaaaaaaaaaaaaaaaaaaaaaaaactcgagacacctgcccgggcgg

SEQ ID NO: 31813 - DNA, 897 bp, Triticum aestivum
  Clone ID: PAT_TA_31813
cccccccgcaagcaaccccctcccgaccccgcccacacgggcaacagagccctcgtcctcccacctgctgggcgtcggcttcggcccaggcctctgccaaggccgggcgcacccgcgcccctgcagagttgcctccggcctcggtggaggcgaccggagggcgggcgaggaagggcgggccggtcgcgccgcaccgcgcgcgcagccgggaggacctgctctagggcgccacctagaagctgtagatctcccggcctgccctcgactccgtcgggacaccggtgtgcgtggaggagatcctcacacttggtatcaagcctggatggacgaagggcacaaagatcaccttccccgagaaaggcaacgagacacgtaacgtcataccatcagatctcgtgttcataatagaagaacgggctcacccgaaattcaagagagatgggaatgaccttgtttacacgcataagatttccctcgtggatgcattgactggttgtgcagtccagctgacaactctggatgggcgaagtttaaccgttcccgtgaagtctgtcatcagtcccacctacgaagaagttgtccagggggaagggatcccgatcacaagggagccgtctaagaaaggtaaggcccaagtttcagatcaagttccccccccgctctaagcgctgcagaaggcaggggtccacttctgtcttagctgttggtccaatgtgagtccaccttcttttccttttgtcgagcagttgggaatagacgggtgaaatggatgcagaatttgctgaatgtaagatcactatttcgtgctagtgtaaagcgcatgctttccgtactgattccagcttgactcttgattgctaaaatgctaactgctgacatgctagcagctgttcccct

SEQ ID NO: 31814 - DNA, 1558 bp, Triticum aestivum
  unsure (1)..(1558): unsure at all n locations
  Clone ID: PAT_TA_31814
cacccgtgtcgtgtgaaaagctgggcgcttgaggaaggcttatggggcaggaggagactgtaacattacgccaaccgaataaccaaagcagagggtggctcggtaaatccgaccgggattgaaaccgttagacttgccgagatgtaggcgcccgggtcgtcatcgcattcgaggccttcgttgccctgtgcacatctgtcactactcatcactttccttacttctctcgggtctactcctgtgtttccgccgcacatctgggcgctcgaggagggggaaatggcaggaggaggcgataactcgcagacgaatggaggatctcaggagccgcgcgccatggaggaagggaggaaggaggactatgaccagggctgcggcctcgccatctctctccccttcgtccagaagatcatcgccgagattttcgggacctacttcctgatcttcgcggggtgcggcgcggtgaccgtcaacaagagcaaggggcagatcacgttccccggcgtggccatcgtgtggggcctcaccgtgatggtgatggtgtactccgtcggccacatctccggcgctcacttcaacccggccgtcaccttcgcgttcgccaccgtgcgccgcttcccgtggaggcaggtgccggcgtacgtgctggcgcagatgctcggggccacgctggccagcggcacgctgaggctcatgttcggcgggcgccatgagcacttccccggcacgctccccaccgggtccgacgtccagtcgctcgtcctcgagttcatcatcaccttttacctcatgttcgtcatctccggcgtctccaccgacaacagagccatcggggagctggcagggctggccgtgggtgcaaccatcctgcttaatgtgctgatagctgggccggtgtcgggggcgtcgatgaacccggcgaggacggtggggccggcgctgatcgggagtgagtacaggtcgatctgggtgtacgtggtggggccggtggccggagccgtggccggggcgtgggcgtacaacctcatccgcttcaccaacaagcccctgcgcgagctcaccaagagcacctccttcctcaggagcatgagtaggatgaactccgtctccgtctgattttccttatcactagcaacgttgtattactactactccctccgttccagaatagatgactcaactttgtactaactttagtacaaacttgggtcatccattttggaacggagggagtacaaggctatgtaatcgtcgtcatcgtggccatgtatccgtggcgtatcgagtgggctactctactcctctagtggtcttggcctaactgaacctgcgagagtatgtatatgtggaaaaagttgtgttttggaaccatgtgatgtggtggaattcgcctgtggcgcgagtgtttgtcaagggggtgggtggcgagggagaaaaataaagttttgtgtgttgtaaaaaaaaaaaaaggggggggggtttttgggggtccaggtttttttacgggggtttggggcgtctttgtttttttttggggggccttanttttatttaatgg

SEQ ID NO: 31815 - DNA, 1111 bp, Triticum aestivum
  Clone ID: PAT_TA_31815
cccacgcgtccgggttggaaccgacatacattgctcatcggccgactattctcagtcgtagccttgaggggcggctcaggccacggtactatgttatgaggtttcttaaagaaaatggattgctcaagcgcaaccaaagctactgtacaattgttaaatggaccgagaaagagttcttggagaacttcgtatgccctcacaaggaagctgcaccatacctcgctgaagactatgcggctgcttgcaaaggtgaagtgccggctagattcagataatcagatttacatgaaccaagaagcaggaacgcgagtgtcgactgggaagattttcatggaaaggtttgtatgcccatacaagcaagctgcccctgccttgcgcaagactatgctgccacttgtaggggaagtgccttctaatttcagatttacatgaccaataacgggctatgggatttggtaactgcgtatgtctacgtgtagtgagctggtaatttttgtctcagtgttctttgcctaactagatgttggttatctgctattgtatatctggtacatgttaattcggtgtcgccaatcctagatgaaactgataatttgattttagagtacttgtacgtctattacatcatttagagagaagaaagaatcacattgtatgaacttgttcatcatcatctcatatcgatacgcattctgaactgccggcctacattgctcattgcccggctatgctcacctacagcctggagggccggctcaggccccgctactatgttgtcaaatttctcaaggaaaatggattgctagagcacgggcggggctactatacaacactggttaagactgagaaggttttcatggaaaagttcatctgcccacacaaggaagccgcaccacacctcgctgaagactacgcggctgcttgcaaaggggaagtgccggctagattcagatttacatgaaccaagaatgggctatgaaaattggtaaaccgtgtacggtgcaacatagttttcattgtgcaggaagctggtaattcctattttggtatactttgcctaactggatgttggttgtctgctctgttagatgcggtaggtcattgccaacga

SEQ ID NO: 31816 - DNA, 1717 bp, Triticum aestivum
  Clone ID: PAT_TA_31816
atctctccctgttccgcttcctcctccgccgtgtcgagcaaaccacggcgatggacgaaaccctcgccaccgtcctctcctacctcccgcctccctcggtctccaccaccgcatccccgtcctcctcgtccaccgcctccgatgacgatgaccgcatcaactgcctcccggacgtgctcctccgcaacatcatctctcgcctccccaccaaggacgcggcccgcaccaccatcctctcctcccgctggcgcagcctctgggcttccaccccactccggctcgacgacgctggactcgttcctaccgccgtcaccgccgcgctgaactcccacccgggctcggtcacttccgcccgcctctcctccgagcacctcgcttaccaggaacccgacgtcctcgactcctggttcgcctccctctcagccaagaacgtcgaggaactctccgtcgtcaacggatcctggcctgctgaatgtgagtggcgtcctccccccagcctccttggatgcgcgtccctccgccgcgtctggctcgggctctgccagttcccggacatttccggcctcgctccggccttccccagcctgcaagagctcgggattgtccattgctccatgcaggaccgcgagctccacgctgtgctcccgcgctgccccgagcttgagaggctcgctttcgtgctgacacaggactacccaaggtacatccacatctggtcagggagcctccagtccctggttgtgtggaggtccatggtcagagaggtgcaccttgacgatgcccccaacttggagcggttgctgttggagccgattggcggtgcctctactcacgtcaagattattaatgcaccgaggctgaaaattttcgggtactttgacgttggactgcatcagctcaagatcggccccactgtgatcaaggatgggatagggatgaaggtgaaaccgaatgcgatggttcggacccttaggacattggcattgaaggtgcagtttggagacgagaagcaagtcaagctggtgcccctcttgcttagatgcttcccatgcctagaaaccttgtatatcaagtcatctccttctgaatcaccaaccaatgttgatgtggatttctgggatcaagtaggccacactgaatgtgttacctcacatattaagaagtttgtgttcgaagctgcccgaggagaggataccgagctggcatttgtcaagtttgtcatggaaagagcccaaatattggaggagatgcgtgttttcgtggatgatggttgctctagagatgttgtgctaaggcgtttatcttcagaagaatgtgtgtctgcagatgctagcgtggtggtggagaggcaagacatgtcccatgcgtggagcttcgaaagagctagcaacatgtcacagtgtgacccctttggttgctaaagttggaggataacaaagaagtgacaagatcacgtctcttcaagccttacccagatggaatgaaaaaaagagatgggtcctgaaccgagtcaagccataggcccctgaagcaagttgtagtctttttgtcttctataccttggttcagtacaagcttcgaacctttggttttgcttgtgttagacgtgctttgtggacctgaacatcggctgttgtaattgaatatgattatgtggatttgtgctttatggagctgcaactggtttcaacttgttaaagatcgtgtgctgcaaaaa

SEQ ID NO: 31817 - DNA, 588 bp, Triticum aestivum
  unsure (1)..(588): unsure at all n locations
  Clone ID: PAT_TA_31817
gcactaggcattcctccacgaccacgaccacgaccagatggcgccaccgcgagcgcacctcctcctcttcctcctcctcgccgccgctggcgccgccgcggtgaccgcggacgaggtcgaccccggcgccgacctcccccgcctcgcgctcccagcacctcctccgccgccgccggtgcccgcgccgccgcccggcccgctccacacggtggccgtggcgctggcggccaccgtggcggttgcctgcttcgtcgccgtcatcgcctgcactctcgtgtgcatccgccgccgccgccgagcgcacggccagggccagcccgttcccgtcttccgctgcgacctcgagatggcgcgcgcgtgactccgtgatgagccaacgactgggtcagcagatacagcggaggaatgtcgacgtcgtgctagtggggtgggatagcggctggtcagtgagtgtgtgtgtgtgtgggctgcgttataagccctatatatcgtgtactctgatccactacgtactagtatcaaatcaaatggacaaaggacaccttgttctctgaaaaaaaaaaaaacnnnnanaaannannnnnnnng

SEQ ID NO: 31818 - DNA, 1825 bp, Triticum aestivum
  Clone ID: PAT_TA_31818
gcctcctcactccagcttggcctcgcgcggcacctaaaaaaggcggcagcttctggagagctgcgggcccgttgagggccgccgttccccccccctcaccccacccaccccgccgcggcccgcgccccccgtcccctcttccaggcctttcccctcctcttcctcctcctcctccccggggcccgaccggccggcggggccaagaattctctgccccgccctgctctgaccctggcccgatgctcgccccgcccgagtcacggcgtactggccccgccggcggttgatgatgtcatgtggcccctctgcttcatctcggacaggctgttcaaggtgccgggcgacgacggcggcgacggcgacggcccgggcgcgccgctgccccccgacgcccgaatcccgctagcacgccgatcctacttcatcgatgtccctcacgtgcagcaggccttcacctgggactgcggcctcgcttgcgtgctcatggtgctgaggaccctggggctggattgctgccgcggcattcccgaactcgagaagcgccgccgcaccacaagcggccggacagtcgacttagcatatccgttacacgagttttcagttaatttttcgttctttactgtgactattggagcgaatccgcagtattctgcagaaaccttttatagggagcaattgcaagaagacattgttcgagtggatgagctcttcggcacagcactctttgctggattcacaacattgctgcactcgagacgctctgccgcacctcaagcgtctggactgtcgacctagcatatctgttacataagctttcagttagttttctcttttcaaatccatcagtgcgtatgatattgcttttctgtgttcatccgggtagtgcattgcaattgcactagtggataaatcaaagttaaattcctcttggatgaatgatgtacatgatatgcaacagtttgatgaggattcagattacatggggcattatgttgtaatatgtggctatgatgctgatgcttgcgagtttgagataagggatccagccagttctagaaagcgtgaaatggtgcccatgaaaagcttagatgaggcccgcaaatcgttcggaactgatgaggacattcttctggtgtccttaactggaaaaaatgggatgaagctgtcgcgtaaactcccggtcggctctccgtagactgctcaccagcctccagtctctccttgtgtatactctgtacatgcccctgtagttatgcttaccacctgtccaagttcggtatgtagtttgagaaggttcttccagccgataggaacagtgtctagtgaagatagaagaacatgcttatgagttcaggtatcacctcactgaagcttatgcaaccggcgcggcggcagcagcgttgctgctcggcatgaactgcttctgtaaacaggaaccgccgccgcctccgcttcgacctcgagcacaagattcgcaccatcatagccgggcagagatgtagcatatgtacagatatatccacgaataaaatggtggcctcggtgtgccatatattcgtatcccatttcaatcatttctggtacctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcggtttaaaaaaaaaaaatttaaagagcgggggggggaaaaataaaattttttttttggggacac

SEQ ID NO: 31819 - DNA, 1082 bp, Triticum aestivum
  Clone ID: PAT_TA_31819
atttcccaccactattcatcgggttgattgataatcatgagggcccagcttgctctatcccttctgctcttcctcgttgttgcctccaccagccccctagcatcggcccatggcgatcttgactatggcggtggagtgaagaaatctgaagctactggcggatacaccgctggtattgagaagaaacccgaagctgtctcggccagtgctgagaagaaacccgatgccatctccgctgatgagaagaaaccagatgttgtctccggatccaacgtctcctccagcacgaagacaaaacctgacgtcgcccccaagaatgttgatgcggagaagaaaccggtaagtgcctctggctatgcaggcaaaaagaagaaacccgaaggcggcagcaaggctgctgaggagaagaaagctgaagtggcctccgagaagaaatccaaaagaaagagtgagccctcccagccttccaccatcgagaagaaacccaaaagtaaaaatgagaagaagtccaaaggaaagaatgacgcctctggatacactggtgcggagaagaaaccaaaagaaaaagtagatacacccaagaaggagaagccaaaggaggaggtcatggctatgaaacctaataaatacaccaagccaaaggaggaggcgaagaaggaggtgaccgcggcgaccgtcacatccgatagttacactgcaccgaagaatgctcagccggagacgccggcagctagcacaactgacacttatgctgcaccaaagactgctcagccggagatggcggcggctagcacaaccggtggttacccctaaccgaagaatgactaaccggacacaccagaagacaggccatttcccctaccacatatgtatgtcgagagcctcacctagcttccgagtgaccaaccaaaataacttcccctctcagctcacttgaggagggactatgactagacccggtccacggttattttttataccccaattttcattgtgtgagtgcttacccttaatgtactgcttatataactccatatgtagtattattctacttctgtaaagaaaacatgtacccatgaggt

SEQ ID NO: 31820 - DNA, 1274 bp, Triticum aestivum
  Clone ID: PAT_TA_31820
cctccacgaggcttcgtcgggttgtttcatcacaccgacactgttcgtcgggttgattgatttgcatgagggcccagctcgctctagcccttctcctcttcctcgtttttggctccaccagccccctaccattggcccatggcgatcttgactatggcggtggagtgaagaaatctgaagctaccggcggatacaccgccggtattgagaagaaacccgaagctgtctcggccagtgttgagaagaaacccgaagcaatctccagtgatgtggagaacaaaccagatgccgtctccggaacagacgtctcctctggcgcaaagacgaaacccgagctaggcggtggctatgacagtgctaaaaagaaacctagatggcaaccccaacagtattgatgcagagaagaaaccggtaagagcctcaagccaaaggggaagcagaagaaactcgaaagatggcaccaaaagctgccaaggagaaaaaaatcaaaagatagatcgaggcagccctcccatccaaaaagtaaaccctaccaaacattcaccatcaggagaaaaccgaagaaaagaaatacgacgctgtacaaacgaaagagggacgccaactggatacactggctgcgcagaagaaaccaaaatgaaaaaagtggatacacccaaaaagggagacgccaaaggaggaggtcatgcctataaaacctaaaaaatacaagaagcccacggagcaggcgaagaacgaggcgacgtagatggccgacccggagaacgtggggagggaggctgacgtcacaccggtcaacggtactgcaccgtacactgatcttccggggacgactgctgatcccacaactgccactgttcccccgacagaccctcatccgtagcagaaggctgcctctccaaacacccccggtgacccgcaactgaccaaaccacagccgtatcccccggtactctcgcagtttccccgaccccatctgtaattcgagaccctctcagcgcattcgtggggccaccctgactagctccccccctctgccctcttgtggaccccatttttcttggtccgggccccggtcctttttgttcccccgttcctctttggctgcgccctctccagtaatgtaccgccttctgtactccatacgtggtcccatgcggcttctgtacgggtgtcttgtccccttgtggtctcgaatcgggtctcttgtcccgtccttgtctcgctcgattgctcatgtcccctgcatgtaacactcaattggtaaattaagc

SEQ ID NO: 31821 - DNA, 836 bp, Triticum aestivum
  Clone ID: PAT_TA_31821
cccacgcgtccgcggacgcgtggggtcaaaatccccgtgttgctcatctatgatgacatcaagagcacatatggtgacataaagcccgggagcatcatcccttacttggtcaaagttattctccatgttgatgtcccagtcattggcaggatctccttacctctcgagaaagccggtgagatccctgtgccttacaagccagacgttgatattagcaagatcaagtttgagaagttttctttcgaggaggcgaccgcgactctacatctgaatctcgacaacaagaatgactttgacctgggacttaatgccctggattatgagatctggctctccaatgtgagcattgcttctgctgagacgaaagaatctacaaacattaaaaagcaggaagtaacgaccatgaccttgccgatcagcttcaggcctaaggattttgggtctgctatgtgggatatgataaggggaaagggcactggttacaccataaaggggcatattgacgtgaacactccctttggacacatgaagatacctattagcagagaaggtggaacaactcgactaaaaaaggaagacgatgacgacgataacgatgaggactaaaaattgaagaaatgcactttcatggaaccgagttaatgctttgaagtttaacaagtggccccctatgactcgagagcactttgtatgctaatcatgtacttacatttgaatcgctgctaactgtgagaattttgagatattaaagattgtgtaacacttttctcgtcttgacgctttttgtatttgtgattccaattcggggtccagaagtaattaagatgttcaatggc

SEQ ID NO: 31822 - DNA, 1490 bp, Triticum aestivum
  Clone ID: PAT_TA_31822
gatgtcccctcgagtcctgccctgtggcccccggtcttttattgccgcctggctggctccttctcgcgacaggcctgcgttccctgccgggatggggctgctcgtcctcgctggcggtcaccgccctccttcccgcctcctggagaggggcggggcgcctttcgatcgacgcgccttggcgctcaccccgacttggcctccgggagggggcattggtggcgaacttgtttttccgtgccctctccgagccccgtttccccgtaccctagctttccggggtaccggtcatcgccagctgtgtgatctctcaagctagtcacccgatgagaccctatgcacagttttctcgtctcttctcctacaagtagtgagattgtcacaacagatgcatatgttgcagcttgtgttgtcccagtgatcaaaagactattaccatcggaatggagggaatgggatatgtttgacaatatatacaagttagatggtgttcctgtagtcactgttcagcttcgctacaatggatgggttactgaagtccaagacttggagaaatcaagacaactccaaaaagcagttggcttggataatctactctatactccagatgcagacttctcctgtttttcagaccttgcactgtcatctcctgctgactactacattgaaggacaaggttccctgatccaagctgtgctaactccaggtgatccgtacatgccattgccaaatgaggagattattagcaaggttgaaaaacaggtcttagatttgtttccatcagcccgaggcttggaagttacatggtccagtgtggtaaagatcggacaatccttgtaccgtgaggctcctggaaatgatccatttagacctgaccagaagacaccagttaaaaatttcttcttgtctggctcttacacgaaacaggactacattgacagcatggaaggagcaactctttctggcaggcgaacagcagcctacatctgtggtgctggagaggagttattagccattcgaaagaagctcattgtcgatcacagcgagaaggcctccgggatggttcaaatgttgcaaacaagttaaaccttgcaatcaccaaagccagaatgccaaactataggtttcagggttataggcgattgtcaacagtgatttctataaatcttgtttgcgcattagatttggtgctgccttttttttagccgtgacacatttgcacatcgcatgttcctatcttacaattggcaaccaggtgtctaagtggcatataggaatatatcaggcagcgtgtatgttcagttaaaccttagcccgtcattcgaatgattgatgtcatattgcacattttccacaattatcctgagaaatgcatgagtttttgtctgggaagatacccacaccattccaaatgatcttatactttctctgcccttgttcgcctgccgttttatagaataaaaggcaaataaaaaatagcggccgctctaaag

SEQ ID NO: 31823 - DNA, 570 bp, Triticum aestivum
  Clone ID: PAT_TA_31823
gccggcccgtcggtgtccgcagaaagaaggcaaggccgccgagggcggtgagggtggcgaggacgaggaggacgaggagtaaatgcaaccaaaaatgcaaaagcggctctccctgtctagggcacttggtgatgggataccactcatgggaaggggattctcttcatagcttgcggcgttggccagaggataaaaatggaatgatttcaccggataacgataaaaaaaaaaaaaaaaaaggcccctaaaaaaaaaaaaaaaaaaaaaaaaaaaacaaaaaaaaaaaaaaaaaaaaaaaaggtttccccccgccaaaccgacaaaatgggccgtcttcacaccaagggaaaggttttttttgcccccccccccccctactctcgattttcccctggggggttgaaaaccccccccgagaaggttgacgagaatatctccaagttcgcccgaaagggtgccaccccttctcaaatcggcgtctttccccgggactctcacggaattgtccagggcaagcacgtccccggtaaccgaattctccaaattctcagcccaagggcctcgcccccc

SEQ ID NO: 31824 - DNA, 877 bp, Triticum aestivum
  Clone ID: PAT_TA_31824
cccacgcgtccgcctcaccgcgcccactcgaagacctccctccccgcgcccactccaagacctctcgtgtcccccgcctccgattcgagtctgcccgacgagtatggcatgctaagctcgtcggagagtatgcgaggcgcaataagcgtgaggtatgtcgagtcggtctgactctgtccaagatccctcgtcgagcccgtcagctccttacccttgacgagaaggaccccaattcgaccttcggtccgaatgccttcattcgacgactcgtccgtgtcggtgttctcgacgagtcccgcatgaagctggattacgtcctggagctcaagatcgagaatttccttgagcgtcgtctccagacctgtgtctggaagctcggtctcgccaagtctatccaccacgcccgtgtcctcatccgccagcgtcacatccgagtcggaaagcagatcgtcaacgttccttctttcatcatcggtctcgactcccagaagcacatcgacttcgctcgtccctcgcccttcggtggtggccggcccggccgtgtccgcagaaagaaggccaaggccgccgagggcggtgagggtggcgaggacgaggaggacgaggagtaaatgcaaccaaaaatgcaaaagcggctctccctgtctagggcacttggtgatgggataccactcatgggaaggggattctcttcatagcttgcggcgttggccagaggataaaaatggaatgatttcaccggataacgacaaacaaaactttcccggtgtctctcctaactgtgtatatgaatcccatgaaacctgaatccaattacgacatctaaaaaaaaaaaaaaaaaaaaaaaaaaaaaaaaaaaaaaaaaaaaaggccccta

SEQ ID NO: 31825 - DNA, 1540 bp, Triticum aestivum
  Clone ID: PAT_TA_31825
ccacgcgtccggataaagatatcgaagataagcaagatgagtcagacttctcatctgactgtgatgatttctgtgttgagattgctaaatcttgttgtggccaggagggagttccatcacgagctaaagttggtggagaccgtaccgatgacttggaaggaacgactatttgcgcaaatgcggccatttccaatctcccttccaaggatcctgaaatggaccaatatgttgttttaccagtttcagcgagacagaaggttcagtctccggacagcaaaaaactcgctgcttatgggaaagcaccatctgattcgagttacagtgaagagttgtcgaagaaaggcacacctgaaaaggacaatggaaaagaaagtgaagcaggttctttcgtgcgtcagagcaatgaattcactccgcaaaggtctcaacaaagctttcatggttcggtgaatgggcaaaatgcagaagagctgcttacccctaacggaagcagtactacaggtcagaagagacaatatgggccaataattaatcagaggctacatgagcaatttaaaacagatcaatatcctagccgtgctgttaaagaaagcttggcacaagaactaggtctgacattccgtcaggttgagaaatggtttgaaagtaggcggcgtcacataagagtagcatccaacaaaggcagcactcacgtggaaaaccatagcaccaaggagaatcctaatgaatgcaaaagtgatgctctgaatgaggatacgccatcgggaattctgaatgaaggtatcacacaagatggtccactgaaacaagacattggtggtgggctgagaacaaatgccagccctccaaatagcagtcaaagatatactacccccttggtaaggcgcccaaaaggtgagtccagagagaatcatatgaagaatacctcctcaagcagttctggcaggccagaaggtagcgatgcagggtatgcagttctggctcttgaagctttggacgagaaaacaagaagcaaaatgctgcaggagctaaagaagaggaagattggctgatgacgtttctagctaatgactctttgaacttgcaagtcgggccatgattttggctgatgcaagtcaactaattctttctctgaaattagttacccacatggtgggtgtcttactccagcgggaggcgtcgttcgatatatgggactcccgctaagaatccttatactcctccagatcgcaagtgataaactgaacaatcttggaagtgccgtcgccacagcgcacttctatggcagagaatggaagacacttaacattttcgccttgggcgctgctgtctccttaaattatgctgtgaaattatgctcatgtgctgtcattggttgtgtacattgttgataagtgaccaggttcagcttatcgttcatatgaattttaaacagtgtcagtggatctcgttggtacatgttgtaatcttccccttttgggggaaatatatgttgtactgttggtgaggagtatattctggttaagacttatttttcatg

SEQ ID NO: 31826 - DNA, 1099 bp, Triticum aestivum
  unsure (1)..(1099): unsure at all n locations
  Clone ID: PAT_TA_31826
ccacgcgtccgcccacgcgtccgcccacgcgtccgcatagagttgtctcctctgtgtgtattctactatctaaggatgagctggttgtcttgctacactcttgcacattagcggcatgtgataaagtgaagcaatcagcagatggttccattcaagctattatagtatttattatcagaagaggcaaggatctacgtgaagctgatgtactgaggacaacacaatctctgctctcatcagctattgctcttaccgacaagcattcacgccaagaagttctcaatgcaatatcatgcttagcagaaaataccaaccacattgtggtctttgatgaagttctatttgtggctgggcgagatatttgtacgaaggacataacaagaattcgtggcggttgggctatacaagatgttttttatgttttctcccagcataaggtgctggctactctttttttggagtacattttatctatacttcacaaagaacctgttgcaacaaatgattcagaaaaaggggaaattaactcagagtcatcagctgatgactgtattctacaagcaactatgttcgctctcaatgcgttcctgagaggtggtgggaaggtcgggaaacaagcagttgagcaaagctacccttctgtcctttctgcacttatactgaagctgggaggtcttcacggtcttgctgaattaggccgcaatgagcttctacgatcgttgttaattgcattccagtcattctgtgattgtgttggcgatgtcgagatgggaaagatattagctcgagatggcgaacgaactgagaaggagaagtggattgatcttgtgcaagaggttgcatgcagttcctcagtaaagaggcccaatgaggaatcagagggctgctgcggtggcccctgctgctgcaccctctgggtctatgcgccccagtcgggctgaacctgcgttgcctgggctagtgcctgcccatttgcgtcaacttgtttcccccgactcgccgactgtcaggcctccctgcgcgcgagcacttggtctgaggcccgggggccacatactttatcccggccggcccgccctccatgtactgctatctncct

SEQ ID NO: 31827 - DNA, 718 bp, Triticum aestivum
  Clone ID: PAT_TA_31827
gagatgaagcaatttcctgttgatgttcgcttacgcattccagtagttgacaagacttcaaagacatagtgctatcagcttatattacagtattttttttccttctgcaacgataacacagagttgttttcttttacataaattcagaagctgatgaatctgatagcaaatgtactgcgtttcattcctcctggctttccttttttgcacagctatggctctgaaagctccccaattggagatctctcagaagtgtgccgcacagtgcctacatacacatatgtggatggagattgcaccgttcctgtcgaatcagccacggctgatgggttcccagcgaaagaaagggtaggcgtcagggccgaccacgcgagggctcctgtgttgatgagaatgtgttcaagccttctcaagaaatggctcggcgtaagtgagaacgcacggggtagggtgtcgaaatcgcaaatcatggacatgcccccagaaaggatccctgatcaggccagtctttgatagatatggcatcgatttctttgagggaacggttattttggtcctttcccttaaagagacgggcacgcgatgtaccggtaattgtgcacaaaatttatctgccatgtggaacattgtgaaaaacttcatgggcatatagtacgttgtagtatatcaatatatcatatgtgcctggaaacttctgcaaaatagtgttgcccgcctc

SEQ ID NO: 31828 - DNA, 901 bp, Triticum aestivum
  Clone ID: PAT_TA_31828
ttgattttgttgaacgagaggacgagttcgacataaatgcatatgcagaaagggttgaagaactgatgatagatcaagatgcagagattgatgttgaaacatgtgagaagaactcatcattcagtgattttgaggactcagcagacgagatcatctacttgcctgctattccttccccggatgctcctgatgagcagccagacaagtgcctagtaagctcatcaaaattggaggacagcaatcattctggttcccccccatcctcaatggatgctgtgcagaatggtctagccattcctcccgcatctagtccattggaagttgttgacaattccatggccgaagagccatcagcggaagcggcaaacgcaaagcggaagaggaggctatcagccaaggggctggagatgcagcaggctgaaaaggtgaagaaaccacccataaagatgtcgtccaacggcaagccgtcgaagcccaagagcaagccggtggtggaacctgtcaacggcaacagctcggccaagatcaagcagcaggtggtggaacctgtcaacgggaacagctcggctgccgacattgacgacgaagcgaccgaggaggacgagatgtaagcaagcagctcgtacgtttgacgctgatggctcgtgttctaatttcatgctgcccagaccgaaaacaacggtgagggcgtagagatagggctatcacctatgttaattagtgttcccgtagaaagaaagtatgtgtcgtggttatgctgagacatgataaacatcgtttgcatatgtgttgtgtgtagtctgaagtctgctgttttctcattgatcttgaggtgaagaaacctgatcagtatggaccatggttaagcttaattcctttatgctaaaaaaaaacggcacga

SEQ ID NO: 31829 - DNA, 1520 bp, Triticum aestivum
  Clone ID: PAT_TA_31829
cagcggaggcaaattgagacgagacgaaaccctcctccccttccctccccactccaatctccatggctcaagacgaggtcccggagtcctcttccccctcttcggcggcggctggccgcctgaacgccgccgcgccggagttcaccccccgatccgccgccccgcaccaagcccatccccatcgccgcgggccccaccatcaccaccaccaccaccaccagccgcatcaccagcaccagcaccagtaccgccaccagcaccaccaccagggagaggatgagggggatgccgcggcggtggtggataacgctcagctcgtcctgcccgaggagctcgctcgccgggtcgtcaagcaggtggaattttacttcagtgatgtcaatctagctacaactgaccatctgatgaagtatattactaaagatccagatggatttgtgccgatgacagtggttgcatccttcaggaagattcgagagttaattgatagatccttgttgcctggtgcattacgtacatcaacagagctggtagtttcagatgacgggaagatggttaggcgacgagtgcccttctctgatgtggatgctgaagaagttcagtctcgaattattgttgctgaaaaattacctgaggatcatcgctatcagaatcttatgaggattttctcaactgttgggagtgtgaaatcaatacgtacttgctatccacaagggatcgatatttctgccggcaaatcatcaaggattgagatgctttttgctaataagctgcatgcttttgtggagtatggaactgttgaagatgctgaaaaggcggttgctgagtttagtggcggcagaaactggagggatgggcctagagttcgttcgctgcttggttgcctgaaacatgggattggtcaaggaagaaaaggtggagatgaggaggctgcggatgaagatgatcctgaagagtatgaagcagaagatgctgcccagggtgaggatggtttctatgacaaagctggaatgaggcaagggagaggccgaggacgtgggggaagaggccgtggccggggccagtaccatggccagagtcgggacggcgggcatccaatcggcactcctccatcaaatcacagtgctgagcatccggtggtgtccaagccgcctcctggtccgcgtatgccggacggcacaaaaggatttgccatggggcgagggaagccccaggtcagccccgcagtgctgtctgatgcttagtggtaccctgttgccctgttgtcgggaggggttggcagaacggcgcttatatgatgacccattttgatgtgatcccatgaagaggaaggatagtaataccctgatacatgcgtcagtatactgcattgctgctggtccatggacctgtcttttggtctctgaatttcctagttgaaagtacaaattcatacttgactcgacaaatcaacagaaagaagtcttcagtgggaggagcaaatttttctagttgttcgaatcgtcgcttttgcaaacata

SEQ ID NO: 31830 - DNA, 967 bp, Triticum aestivum
  Clone ID: PAT_TA_31830
cctgtgggcggctcgacgaggatattctctccttgccttgtcttggtacgccgctccaagtatatttagctgccgatcaccaacaagagacccaacaaaataaactatggcgctagcgaacgcacggcttggtgtcctcatcgtggcggcgatgttatccgccagcttcctaccgctggcgacggctagagggaggggcggccccatcaacccgctggttgccggcgtatgcgcgcatacaccgttccccgagctgtgcaagggcacggctgggaaacacgcggacaagtacccgaccatcgacaatctggcagtgcttaacatgcaggttgacgcgtttgccaagcgaacggcgcaggcccggaagttcgtctcaagcgcgtcccgcaaggggacaccggcgcagacccaggcgctgagcttctgcgacaccatgtacatgaacacccaggacaccatcggcgcggcgcagcgggccatcaccttcaaagacaagggcacggccaagatcatgctgcagctcgccgtgcaagacttccagtcgtgcgaccggccgttccagcagtccgggataccaaacccaatgctcaagtacgacgaagagctcagccagatggccaataattgcatgcaactggccaacatgatgtgagacgtacccttgcatgcaggcagtcatgcatgggatggccacggctggcagaagctaatgcaaggatatgcaaggacttgagtttgccattctgttataacagaagatcgtttcctatatacttacttgtttcttgacaatttctttttattattttttacccggcctgcctttgttgagtaggtctcgaaattaggaggagggcctttttcttttgttgttattccttgactggtctcacttcctttgatccattcttgttaatttgttgatggtggagtttattgttaacttttgttaaaaaaaaaaaaaaac

SEQ ID NO: 31831 - DNA, 408 bp, Triticum aestivum
  Clone ID: PAT_TA_31831
caagaccatactgataccatacaggaccaacttggtgcggctgcaaaccgggccgaattacgccgacgcattcgccgatttcatgaagaggatggcctcgtcttcgggcagggcgatgacgggcggcgagaagcaaagattttgaggggcaactgtgttgccgtcgatcgaagtgatccgaggtgattgatggtgttgaattgctcggtgattgaaatgtgcataaccaagttttcacaatgtagcaattgtagttaccgatggggaacttggtactcccaatgtgtatataggttagcatacgaccatatcaacaatgtaacttagcacggcaaggaattgccaaattgttacaacgctgattaaaccaggtttgatcctgcacaagccctattgggttcactgtcc

SEQ ID NO: 31832 - DNA, 1324 bp, Triticum aestivum
  Clone ID: PAT_TA_31832
cagcggctggccgccgccgcggcagacgagtcccatgggagacaacaagtctccgctgagcctgagcccgatgggcgggcgcgaccgggaccgggagctcctcatcccggtctccggcggcggctcggcgcccggcgtcgatgacgagggcgctgacagggcctcctccgcctccgcggcgctctcctcctccggccgcgaggctttccataaggtcgtccgcagttgggcttcaaagaagttcatgactggatgtgtaattctcttccccatagcaataacattctacttcacctggtggttcattcattttgttgatggattcttctctccaatatatgcacaactgggaatcaacatatttggtcttggcttcatcacttctgttactttcatattatcaggcattttaggagggtgtcatcatgcgacatccccgtattggggtaattgactggatcattaagcgcatgccccttgtccgtcatatctacaatgcatctaagcaaattagtgctgctatatcgccagatcaaaacaaacaggcattcggggatatcttcatggtgaactcgaaggatgtgataaggcctaatctttctgtgcgtgaaggcattgagatcgttcagtcctgtgctatgtcaatgccccagaatttgtcgaccgttggatccaaatccatatctgcatgcaatccactcataccgaggtggaaggagcagatactgaggcatctttctggcatacctgttcgtcgatatcaagtgtataactctcaacaaatgccccaggttttgtcgaccctggatccacatccacatctgcatgcaatccacacagaccgaggtggagcgagcagaagctgaggcaaactacctgcatacctgttcgtcgatatcaagtgaactctcaacacagatcacaccagtgcggcgaacaagatcctgagcgcgatgcactagcaatctgtcacgcccgaggatcaaaggatcttgtaattaagtagaagtaggtaactcacacgcgttgtcgatccgatggatttgtacaattggcttggactttgtctttgtaatgctgcccccagatgcttcctagccatacttatattttcttacggttcaattgttttcttccggctgtttcagagtccaaattagctttcggcatcaacaatgtctgactgaggtgccttgctgtaaaagaaaacaatgcctgcctgagttgtcttgccttgaattctggactaattaacctcctaggtcaggtgatagtagacactggaccaacaatggtggaactggaaccttgactttgaaaaaaa

SEQ ID NO: 31833 - DNA, 2141 bp, Triticum aestivum
  Clone ID: PAT_TA_31833
ggggcggcggcgggccccgcccgccggagtaccccgccgagcgggcgcggtggcgccacccccaccgccggggcggccgctccgccacgcgggcggcccccggcctccccgcgctccgcacgcggtggtttgtgagctctggggagtcgccgggaacgacgatggtggcggctctggtgcatctgctggtcgccttcagcgccgccgtgttggccgctgccggcggcgagcagccgctgtcgaagatcggcgtccaccgggccaccttggcgatccatccgggcgcctccgtcgacgtctcgccgctcctcctcggcctgcaggggcaggaccaagaatgggtgaccatcggatttaacaaccccaggccatccaaggatgactggattggggtcttttcccctgctaatttcagtgactccatttgcccgtcggagaaccaatgggtcgaggcccctcttttgtgcacggctcctattaagttccaatatgcaaactacacgacggccgactatgccaagaccggaaaggggtccttgaggcttcagataattaatcagaggagtgatatatcattcgcattgttttctggaggcctctcaaatccgaagcttatcacacgttcaaatagcataactttcgcaaacccgaaggctcctgtatacccacgcttggcacaaggaaagtcctgggatgaaatgacagtgacatggacaagtggatacagtaccaaggaggctacaccgtttgttgaatggggcatacagggtcaaatccaaatcctttctcctgcaggcacccttgacgttcagtcgcgacactatgtgtggcccacctgctaggacagttggatggcgcgatcctggtttcatacatacaagcttcctcaaggacctatggcctaatcttaagtacacgtacaggattggccatcggctattcaatggtcaaattgtttggggacgtcagaatagcttcaaagcacctccctatcctggggaggattctttgcaacgtgttgtcatatttggagatttgggcaaggccgagattgatggctcaaacgaatacaatgactttgagcgtggttcaatcaacacaacttaccagctagttaaggacttgaagaatatcgatatggtgatgcatatcggagacatctgctacgccagtggttatctgtcacagtgggatcagttcactgcacaggttgaacccattgcttctacagtaccttacatggtggcaagcggtaaccacgaaagagactggcctggatcaggatccttttatgggactctggactcgggcggtgaatgcggcgtgccagctcagaacatgttctatgtgccagcagagaaccgtgagcagttctggtactcgacggactacgggatgttccggttctgcgtagccaacacggagctggactggcggccaggcaccgagcagtacaagttcatcgagcactgcttgtcgtccgtggaccggcagaagcagccgtggctcatcttcctcgcccaccgcgtcctgggctactcgtcggccaccttctacggcgccgaagggacgacggaggagcccatggggagggagagcctccagctcctctggcagaagtacagggtcgacatcgccatgtacggccacgtccacggctacgagcgaacgtgcccagtctacgagaacgtgtgcgtggccaaggggtcggaccggtacagcggcgcgttcacggcgacgacgcacgtggtggtgggcggcggcggggcgagcctggcggagtacacggcggagcgggcgcggtggagccacgcgcaggacctggactacgggttcgccaagctgacggccttcaaccacacgacactgctcatggagtacaagcggagcagggacggcagcgtgcgcgacagcttcaccgtctcgcgcgactaccgcgacgtccttgcctgcggcgtcgacaactgcgccagcaccaccatggcgtcctagagcgccgctcctttcgctgcggctcggctctgttgttgttgttggatcgatggatgcaattttgttctcgtgatgatacttggatagatatgcagtgttcagttcatagatgactgagaaacccatgcagaggcgtttcgagtttcgat

SEQ ID NO: 31834 - DNA, 796 bp, Triticum aestivum
  unsure (1)..(796): unsure at all n locations
  Clone ID: PAT_TA_31834
ggcacgaggaggcgtcagcgccagccatggaggcgatccagaagatccctggggacccatgcggcgtggccgtggtcgagacgacaccggatggggtccgcaagatcatcggggacatctccgcctacaagctgtggaagtgcgactacgtggcggctgcgtgggcgctggcaaacctgtcagcggggcagtttgtcatcggcgccgacgagaacgggtcgacccccatctccgcctttccgctgccccacgcgtccgcgtcgctgtcggaggaggccgccgagcccgggcgctctcccaggctgcttaagaagttcagcagcaggaacatcgggttcctgaacagccaggcgaaccaggtgcggagcatgtaccggggccggagctcgccgctgatgtgccggagcacgagctcgctcgcggccgtcatggcgcagatgctgtcccaccgggcgactcacgtgtgggtgacagacgcggaggccgaggaggacgacgtcctcgtcggcgtggtggggtacacggacatcttcgcagccgttacccggagcagcgcctgaccgtcgacgacgtcctgatcgcggtggcgtgtgtttgggtggtgtactataatttggggttagtttggtggttgtccagagctgagaactttgttttgggtgtgtgggcgtgtgagactgaatgggttgtgtattgttggatgtgcaattcgttgttgatggtcctataataatgcagactcgggcctatttatgcctgggagttcattgatcgctcnnnnaaaaaaaaaanaaaa

SEQ ID NO: 31835 - DNA, 441 bp, Triticum aestivum
  unsure (1)..(441): unsure at all n locations
  Clone ID: PAT_TA_31835
cccacgcgtccgcccaggcgtccggggacgggtgggactttttaaaggcttgattgaccctttggctcttgttggagcgcgtaattcaagaatggatggaaggtctgccgccacttgttttttggtgatgcttgtgttgttcggaagcactacatttgcagagaaatgtttgacttgttcgttttatcggctggtgttttgtaccaagggtatttgcaagtctgtatgcgtgggttggttcggttaccctgggcagaagatcctcgaactttggtgcagtaattttttctttggcacgtgcacctgcaaggtttccgtggatggatagagcttaatggatatgctaagtgcacttcatgttatcaataaataatccatcaagnnnnnnnnnnnnnnnnnnnnnnnnnnnnnnnnnnnnnnnnnnnnnnnnnnnnnnnnnnn

SEQ ID NO: 31836 - DNA, 1303 bp, Triticum aestivum
  Clone ID: PAT_TA_31836
gaattcggcacgagttgacatgcggggaggggatgttgacgaccgccagcttcgagatgatcttatgacaatgcttatcgccggacatgaaacaactgcggctgttctgacatggtctatttttctactggcccagaatcccacgaagatgagaaaagcccaggcagagattgattctgtactgatcgatggggtaatcactgcagaaaagctcaagaaattggagtacataagattaatcattgctgaagctcttcgcttgtatcctcaacccccattgttaatcaggcgttctctccggcctgataaattgccaggtgggtacattggagcgaaagagggatacgaaataccagcaggaaccgatatatttctttcgatatacaatctccataggtccccgtacttttgggataggccaaatgagtttgaaccagagaggtttacagtcccaaagaaggatgagaacatagaagggtgggctgggtttgatcctgaccggagtcctggcgcgatgtatccgaacgagattatagcagactttgctttcctccccttcggcggaggaccacgcaaatgcgtgggagaccaattcgcgctcctggagtcaacagtggccttggccctgctattgcaaaagtttgacgtggagctgcgaggctcgcccgatgaagtagagatggtgacaggcgcgacgattcacacaaagaacgggttgtggtgcaggctgaggaaaaggagttgatcagcgggcataactttgcaccgaaaggctttgcttattgttgacttctcgcgtcgtctgcatgctttagctgggtaaagcaggttcatgtacatggttatatctcttgggagctttaggggcatcgattctgtgcacaaccatcatctgaaacatatggctgcaaatgctgggttctgtgtgcatgcatgcatctaaacagaatcacagtagcacactccatgccaaattgaccagattattgtgatggagatgcctcacccaggtgtccggtttcttgtgaacccagatcacctgatctgtgccatggcgacatgcgattggatgcctgttggcatggaagcagaggtaggtatcagtcatcgctgttgtgccgtgttgcggtgggatgcatactgtgcaggaaacaagaagcccacagaattaaattcaaaacaaaatcgatgcagatagcgattggggcaagtaagctactccctacttcttttcagccattgatgccttgtgttttgtactattccacattttttaatcattattatatatacgatattccat

SEQ ID NO: 31837 - DNA, 657 bp, Triticum aestivum
  Clone ID: PAT_TA_31837
ggcgccgccgacgcgcgttccctgccgcctactcgcgttcccttccagcttaactgcctccatacccctcgccaccgctccgtggttgccttcttccccacgccattgccgtcgcccccccaccatcgccgggggacctactcggacgtggatcgtccgaccgctcagtccatccctggcaccgacggcctgtgcgccaagagcctcgacgcatcctcttgtggctgctcggactgctgcctcagcattctggacgtcctgtgctcatcttgatgttgctgttcttcctcttgtcgttcccacggcttacggcggaatcgcgtggagatgcctgacttatttcggagcactaatatagtcattggatgatatattttatatagcctgtatgtaataaggagatttatggatcaagtgctgtaatgtgttgacttatcttccgctaaagtagtcgtgcaatttggtctgggaaatttacccaaatcctgtttagcgtatgccggattgcttatctaaaagctagctactccggagcacaagttatcattaatcagcgagacgaactcaccaggcaccagcaccagggacgacaacgaacggcgcatcatggttcatggcaccgacaagacacccaaacatccgtgtgttgctgggctg

SEQ ID NO: 31838 - DNA, 372 bp, Triticum aestivum
  Clone ID: PAT_TA_31838
gccacagggagaggagaaattaagggcaagtgacaagacaagactggggatgaggcgagaccatggatggcaagtcgatctgggtttgttgagaccgatcagtttaaattcctgccggagtgtataatttcagattgccttatggagcagtcgcaacaaacaatttagccgtctaaatgtatatacacaagcgtgccacatacagtacaatagtaaccagttctagatgtgggtttctatactactataagatctgttggctgtttaagttggaatcaagtgtacctctgctaatgacatttctgtcagatgatttattccgatactgcggacttgcagtgtattttacatatttttgaaaccgattatcat

SEQ ID NO: 31839 - DNA, 1107 bp, Triticum aestivum
  Clone ID: PAT_TA_31839
gcctatcatcttatgtggggcattctattatagtgattggaatggaagtaagcgcggccaagtttacaaatttcttcgttcacaaggatttgtttcatcatatgacactgctcatcagtacagtgacagcgaagaagatgcacacaagtgggtgagtcatcggaatcatagaggaaacatctgtggagttgattttatatggcttctgaatccagacaagtgcaggaagcccctgaaaactagctggaatgaagctgtctttggtattatcaagttctcttttcagtatcttcttctccaagttgcatcccttccggagaatgcatttgcacttctcaaagctgacagttcagatgatcgtatcacatattcaagcttctgccaggcactttgtcagttaggaatggtccaccctgatcgtgtaaattctgaagaaatggaagatctatggagtgaagttgaccacgatgggaatggtgctgttgactacaaagaatttcagcggtgtatctggagcccaaaatgctacaaccaagaagaggaggatgatactgaaatcgacgccgctgaaggaagcatcatcacatttgagccgaacgacgaaacctttggcttcaccgtgaaggaagctgttctgttccccccagaagttgagaagggcatgtggcctgagaactacagcctctcagatcacgcgccccttactgtggtgttctcccctgtaagaatgccttgctctccacgcactcctcagcacccctagctatcaaacgccagtacagatgcaagctttgtacagttttaggtatacggtgagatatacaccagagaagttttattttaggtaccgaaagtggtaagaagaggcaacagacatgagttgctgttggcctaccttttggggcatgctgatgatgtctctgcaaacagtttgtatccaaagctgtctccacatgttcataaatgtaaatttttctgtctattcttggtgtaagataaactgaattgtgagggcttcacacggaaatttagggataattgctgattaagaccgaattaacttgttgtgttgttttcttgagtcaaatcatagcatgagttctctcc

SEQ ID NO: 31840 - DNA, 1257 bp, Triticum aestivum
  unsure (1)..(1257): unsure at all n locations
  Clone ID: PAT_TA_31840
ccggctccgccgnggcggctcgcgcggcaagctgggcgctgtgcgcggcgccctcgcgcctgcggcgtccggccccgtcccgccccctcccgccgcggcgctgctctcgccacgacggagcttgttcttgtgcccgccgtagttgtggaagcattgctgtcgtcgacgcggtcgtcgcggcgcttggtgcccggcgccttctcctccacgtcgtccaggtcgtagtcgtcgtcgtcctcctcctcctcttcaacctctttgctactgaggacgtcgtcctcgctgtcgtcctccgagcgcgtggaggaattcaccacctggcggccggcgggcgccgttgccggccgcgggttgtggaagcaggccgcgccgtcgtcggtgccgtgcgaggctgctgcggcggcgccgggggggttgtggtaggtgcacatctcgcggaagaagaggtgcttggagctgagcagcttgcgcgcctcctccttggccttggcggtgagctcgcccatggcgtcgagcagcgcggggttctcgaccaccttgcacgccgtgccgcggccgagcaggtcgacgactcgcttgtagcgcttgttgaggtcgttgaacttgtcctcgcattgctgcggcgacaccttgaagcctctctccaccatcgcccgggacacgggacctccacttacccttcttctgctgcgccgccgcagatgccaccgccttcccgtgcgaatccgccgccgccgccttggctcctgcagacacgccctccccgtcttccccggcgttgtacaccaccgcgatgagcagacgcaccatcgcatccgtccacttcatccgggaccacgagcaccccgccgtccccgcccccggctgctgcacggcgccgacgccgttgcccatctcctcctcttcatgcgcgttgaccgccctcgatggcggcgccacgtaagccgcgtacgacggtggcgggtgctgctgcctcatcggcatggcctggtggtgctggacctggaagccgccgttggcgtggcggaggtgctccggcggctgctggaacgaggaggccgcgtggatctgcggctgcggctggtggacgagatgcatctccatgcccagcatcgcccccgcagacccacgcgcacccaaccccgctcctccgtcaaccctctccatcggcaaagcctgaccacggtctctagttgtcaactcttttttttctctgggaggctcttgtggtcaactctacgttttgcgctggctgcc

SEQ ID NO: 31841 - DNA, 1817 bp, Triticum aestivum
  Clone ID: PAT_TA_31841
ttttttttttttttttttttttttttttttttttttttttttttttttttttttttttttttttttggaagcatcatggccaggcacagttcaatccaccaacaggggcttcactgctatacaatttgtagcagaatctcttttcaacttccctatggagaaaggaaattatcacgacagtgacacagaacaggggcttccagacaaccagaaacttctatggcacaagttcacttttccccactctcttcccccaaaaccacaacaaaacttaatgcctgcaaatgaacccaatcgcccacacgcccacattcaagaccttccaagtgttgctagggcactcttgatttcccatatctccaactggtatgataatccatcttgatctcttttcagggatgtctagaaaatatgatgttttagaagagcgcattcctagatgtatcagttaactggcatagaaccttcggcatcagaaaggcaacagttatccccattaccatatttattactgctttctggcggcggcggccccttcacatgcacgtaggcagcttcggtcatctgagccaggtcctatgataattaacacctagaggtgattctttctccccggaatgtagcagctgggatcttagcggtactggaaacggttcttctcaaatgtgccccacgaagattcaggagggtgcgaaggacctttctcagaaactcccgcatgtatattgtatttatctccatattgagtagggaaggtcgcttcaggactgcccagcttcatcccatgtgctccacctgtgccccatggtctgccatcaaaattagctaattcggcccgcatttgttgaatttcttgtgccatcgaaatcatactcttctccattgctttcctttgttccaccaactcgaaattccccttctgctccaattcacatgcattccttgcatgagtaagttccagttgaaggccctcaatctctgctttcagcataggtaactgttgtttatcagatctctccctactcagctcctgcatgagtgatgcagcctttgcagagagttctttcctaacagcaaggagcttctcgatttcaccacgaagatgcacaacctcatctctcaaaggctcatttgatctaagttcagcttcaagcttccttctcttgtcaacgagctcgctgatataagcttccttcttggcattaatctctgcgatgatcatgttaaggtgacggacctcctcctttccggcttgcaactccctgtgcaactccatccgttcctcagctagagcatgacgatcagccataagcctgcggaaatcaacctcgtgcaactgaatttcttcctctaggacatccgggtgagagcgaggagccaccctcatgagcggcctttcgtgaatctcagggtaggctctacgatcctcaatcacacgaactgcaggataggttctgcgatcttcgactacacggatctcatgatggcccctacgatcatcaaccactcggatgccaggatgatgacccctgcgatcctcagccacacgggcgtcaacatagccccttccatcttcgacaaaacggcgcggcaggcgatctcttcctgacatgatgattctaggtaacctggtggccttcagaaaccaatgtccaaggtttcggacggggtgaatacggcagggacgtgacgaggtggaatgggaacggcgatggtggcggcgacgcgcgtgagaggtgggttagggtttgggccgtgaggcgtcggcggcgacgcgcggcagcggcgggcgtggcgcggggccgtgaggcgtcggc

SEQ ID NO: 31842 - DNA, 430 bp, Triticum aestivum
  Clone ID: PAT_TA_31842
cccgggtcgaccccgactacacagtgctggcattcgcggccatgatgaggaagaaggtcacgatgcccgcccacttgatgtacgacgggcaggacgacaacctgtttgagcacttcagcgcggtggctcaacggctgggcgtctacaccgccatagactacgcggacatcctcgactttctggtgcagaggtggaacgtcgccaacctcactgggctgtctggggaagggaggcgggctcaggatttcctctgctcactgggaccaaggttcaggaagctggaggagcgagctcagggcagggcgaagcagttaccggttgttcctttcagctggatccatggtcggcaagtgcaactttgagtgacattgcaaaacaattataagacgatttgttcttcttattttcaaaatatgaagcaactgttgac

SEQ ID NO: 31843 - DNA, 1937 bp, Triticum aestivum
  Clone ID: PAT_TA_31843
ctcgccccgacgtcggccactgctcccttcccggccatttctcggccctctgctagtactcctcctgctatatatatcacccaaaccaaaccaaaccaaaccaaacccatcgatcgatcgcctgccgtccttccagcatatacatcgatagacggtcgaacaagttggccacgccgccggcgccgaaggcgatcgcggtggccgcctacccctcctagaatgcgcccggggacacgcttgatggcctgcctgtcgcccatgaaacctcgcaccagtctggcgttcatccgtggtacccggtggcattcgtgctgaccaccggggtgaacaggcgcctacgtgctgggctactcgggctcgctgatggtcccgctgggctgggtgggcggcaccgtgggcctcctcctggcgggccgccgtgtccaatgtacgccaacgccctgctcggccgcctcaacctgctcggcgccaagcgtcacaacaggtaccaggacctcgccgaccacatgtgcgggccaaagctgcaccatcttcacggggagccgaggctaaatcacaattgcagggccagcactcaaggcaccatattagctggtcagtcccgcaagggctatgaatctcccctactgcatcgcggtgtccgggttcgtgtgcgcgctcttcgcgttcgggatcccgtacctgtcggccctgtggatctggctgggcttctccaccatcttcagcctcacctacatctttgcagcctgcgtgctgtcgctcaaggacggcttccgcacgccgcctcgggactacagcatccaaggagacccgtccagcagggtgttcaccaccatcggcgcggcggcgagcctggtgttcgcctacaacaccggcatgctgccggagatccaggccaccgtccaggcgcccgtggtgaagaacatggagaaggcgctgtggttccagttcaccgccggctccctgcccctttacgccatcatagtcatcggctactgggcctacggcaaccagaccaccacctacctgctcaacaacgtcactgggcccctgtggatcaaggcagttgccaacctcgctgccttcctccagacagtcatagcactacacatctttgcgtcgcccatgtacgagtacctggacacccggttcgggagcaaggtgggaggcccgttcgcgatgcacaacgtgatattcagggtcggggtgaggggaggctacctggccgtcaacacgctcatggcggcggcgctgcccttcctgggggacttcatgagcctcacgggggcgctcagcacattcccgctcaccttcgtgctcgccaaccacatgtacctcgtcgccaacaggcagcgactctcctcgctgcagaagtcatggcactggctcaacatcgtcttcttcaccgttctctccatcaccgccgccatcgccgcgctcaggctcatcgcccgcgactccaaaacataccatatcttcgccgatgtctgactctctttctcactcaccaagctgcttctctgaggagtgaggatagtttcccttcatcgacgcaactagccgcatgatgtagcatgccttaccttcatttagcgcttccattaactattgcgcgtgtgtgtgtgtgttcgcgacaacaatagctagccaactactactagtacacaactgtgttgtcgcatagtactgagctgttactgaaaatggcctagcgtagttttggcttgacgtacgcctttgaacaaccaaagtcgtgagcaaaaacaaattaggaatttggaataagttctgtgtgcgtgcttgagaaatcacaatggaaaccaaatattcggtgacgccagccacacatttaaggtccacatttgctttacagaaagcaggggagggcctgtggtctcatcatgttattattgtctacaagaatgggcttttgcact

SEQ ID NO: 31844 - DNA, 1035 bp, Triticum aestivum
  Clone ID: PAT_TA_31844
aaaaagggcaaccctttttttttaatgataagtatagaagggcaacttggtttttcactaaaggggaccactaagcgccggggcgccggccgaaaccttttgggcgggcggcccctaaccgcccgatacatgcatccacaggccggtcgattggatccgcaatgtttttttccttcgccaaaggaaacaaaaaaaagccgtccgctcgcattgagcaagggcgcgcccctcccactgggagatcgaagttcccctccgggttgcctcgccgccgtcgggcagcacgcgccccacgcccctggtgtcaacagtagcctcccgcgcgccccttggcggggctgcccacccttctgtcgaaacaaatatgtccagtgttgtaggcctttgcagctcagcgagtgtccccacccccactggttgtagcaccgccgggtgggcgtttccagcatcgccaccagccatcgtcaatcccgtcaactggtcatcgttgtcgctggtgcagcaccaccgcctcgcttgtggttccagtggtcatcccgctctgaaaagaagttgttccaacaaaacaaatcgctggtttcaacagaataaatagctggttcaatcccttcaagcaatattatagatccagcaaaaataaaaaagacggatggtagcacaaatcaaagacagtggaagcaaaaaacaaaacgatggtagcaaaatttgggagtgattccagcaagaagatggatccggcaaaacaaatcaaaaataaggttgtagcaaaaaatgaagacggtggtagcaaaattcaaagaccgtgtggcaaaaaatagagtggttccagcaaaaggatggatccagcaaaaaaatcaaaaacagggatgatagcaaaaactaagacggcagtagcaaaaataaaaaaccgtggtagcaaaacttggaatcgttccagcatatagatggatctagcaaaaaaatcaaaagacaagggatgcaacggttgtagcaaaaaaaccatggtagcaaaatttgggagcgcggacgcgtggg

SEQ ID NO: 31845 - DNA, 118 bp, Triticum aestivum
  Clone ID: PAT_TA_31845
cagcctaaggaatatgcaggttaatcatagagctaaaaagctgggaaattcaaaaccaagcatgttaattcacatcaacacatttcgatcagcgtccagaacagaaaatctgttaatt

SEQ ID NO: 31846 - DNA, 871 bp, Triticum aestivum
  Clone ID: PAT_TA_31846
atattttctgcgagtttgcttgtattcgtatgaacattgttcatcaacaaataaggctgctagtgatcctcagaagaaaaaggaacgataacacaggtgatcacattttttcccttctgagcggcacaagcgaggagtcattggtgagatgtgagagagcaagatggcgaattatacgggtctacatgttgtctacgtagtaggtacatccgagtagccgtatcttctcccctgttcacttccacttgcgcccgtacatcttcttgtgcttgccaaacttgccgtgcttgaacttgccatgcttgaacttgccgtggtggtgaccgtggccgtacatcccgtgggcgccgccgtgcgacaccttgtgagctccatatactgcgcctgccgccaccgcgccgccggcaaccatgccgcctgctacgccatggccgcctcccccgtacataggagcgtgaccataaggaggaacctgcattggtggcccttgagcgggataaccagctggagggtgggccgtaggatattgtggatacccagcggtggcggggtacccattcgggggatacgcaacgttcggcggttgataacccccgggctgagggtacgcgccgggaggtggcgcatactgcccaggtggagcagcatatccgggcgccggcggatacgagcttaccggaacagggtaaccgggatatcccgccggagcagggtagccaccagggtacccgctgtacccacccgcacctttgtcctttccaccgtccatgcctctccctctagcttgttcacctactggtaaaaggaggaatgggagtacaacaaacagggaggaggctgattgcagcccacgcgtccgcccacgcgtccg

SEQ ID NO: 31847 - DNA, 782 bp, Triticum aestivum
  Clone ID: PAT_TA_31847
ctagttgaaaatatggttaacacactgagaaactgaaaaaatattttgattaaatagtcggatccaagctttggtacaaaacttaaaaacaactacatgcctaatatgaacattcaatagactaagaatatagaaggaaagacaccaaagcacacatgcaaagagggaaactgcatacattcagattatcaaagtgagcaactaagattgcttatgaccaccagaagttctctaagtggccgaaaagccctatggaagtggcatatgggcacgtcagcagatccgagcagccttcctcactggccggttggtgctactactgatttcgtcctccttgcctcggccgtggacaagaacaaccaaaacatggggcagcggagcaatgaagaaaccatccatccatgtatccatggtgacacttgaaaattgaaacggctttgataaacagagtgtccttttggcaagttcgtgcactattgcatcagctttgaggtccaacaatcaaaaaaaatcccaagcacatgaattgagcgaacgcctgacagaacaaaggaatagtgagtgttatctatacaaaaactaagacaatgaagtaggatggataattatttacaacagaagaaagggtggagtatgatatctctactcgactctgaattagcaaaataagaagacatggaaaggcacttgaaaaacatcatagcgaagttcttgggccacatgaaaaaacattccgatgaaaaaaatagagtcctcaaagtgagaattaatctatccaatct

SEQ ID NO: 31848 - DNA, 612 bp, Triticum aestivum
  Clone ID: PAT_TA_31848
tttttttttgctgaacttctctttttcctcatcatattattcgtagactcacatcagatacatgcatacatacaccacccacccgtcgtgccgctggagagctgaaccgaacggcaggacgggctggctattctttctgcagttctactttggtctaggcctctaggagcatatgtatagctatagctgaaagcaacagctcaagggaagcacacatacacacgacacgcatatataaatcgcacatgtactactaccagtacgttaggtacgtagctcggctcggatggttcgtcggtcggtcggtcggtcggccgtcgtctggatagcgtacgtgtttcgatcagctcacgaatatgatggacgggtcgcagcagcactcgtcgacgaggcagcagcagcacagagcagccaggcatccttcgaggaagcccgtctgccgtctcggcggcggggcgtactgcggcggcgccatcaccggtggtccgttgtaatacccttggttgtgtgggtacgagtacccgtaccttcgatcactcatgttggtcactggctatatatgaagttatgaaccctagttgcagatggctgctgccgtacgaggcctcgtgc

SEQ ID NO: 31849 - DNA, 1974 bp, Triticum aestivum
  unsure (1)..(1974): unsure at all n locations
  Clone ID: PAT_TA_31849
cctttaaaacggccgccccccaattttttattataaaaaaatattgcaaatgttagataatttctcctttttatattctttaaatttattctttttatattaattttatatttttttttttttncaaccaaaaacaagtattttcatcagagtattcgacggattatatatggtcttttgtgcacaaacaaaacaaaacaaataaacaaaacacattgtgtggtctgtgctgtcgaacaagagtccaacaaaatggttgcgatcgatccagcgccctgtcacgtacgaacgtgcgccggccgcggccgccggacctaccctcgattagcatgcagcagctcgtcggcgactgatcggcgacgcacatatctaaccagccagcagccagctacggcccggccgccggcagccgcagggcgcgggagtgcagcctcctgagggtgtcgccgaaccttcccaggtcgaggctcacgttctgcccgccgaggtacacgcgcgcggtgaggtcccacccgcgctcgcgcgtcgccgcctccgggtcgcgcagcaccacgtcgtccgccgggtacttccggaccagcgagctctcgttcgccgccgcgtcgtactgctcgtactgcatctccatcatggccgtcgccttctcgtagcagccgcgcgccacgtgtggcacgcccagcggcgcaatctgcaggagcgcggcgcggcgcggccggaggaagagcagcttggtcaggtcggcgccgtgcacgcccaccagcacgtcgcacgcgctcaccgcggcgtactccgacgacagcggcgccccgttcgccgtctccaggatggacacgtcgaaccccaccgactccgccagccgcgccaccgccgcctcgttctcgatcatccgcgtgcccttgcgcgagtacagccccagcctcggccgccgcctcggttgctgctgctgctgctgctgctgcttggcctccggcggcgtgctgtcgtccttgtacgcgccggccaggaagtcgtggaagtcgacgagggtgcggttgtccttggtccgagccggctcgacggcgaggatgccgtggaagcgcgtcccgacgatcgcgccagggaagcagtgcgtgcgcttgtcgtgtaggaggtcgatcacgtggtggtccgagagccccgacacgagctcccggaacgtgccggcccaccacgggttgtacgcgagcacggccaggaccacgcggcggcggaggtgctgcaccgtgagccacgccggcaggaacccgtcgttgaacgcgtggaacaggttccccgtgtacccgcccgccgtcatcaccagcgccggcgcgtcgtgccgcacgtcgcaccggtgcccgtcctgggcctcgtccggccgggccgcgcggagccgcacctcctggatgttggccatcaggtgcttttcccacttgcgcgtgtagggctgcacccgctcctccttctccgccacggtcgcgttggcgctggcggtgccgttgggcgcttgcggcgcgaagagcaggaacgagagcgacgcggcgtccgtgcgcacgtcgccggccatgaagcacacgtcggtgttgaagtcggagcggtcgcagcagatgccatggccgcccatggacgcgcacggggagttcacctggttgtcgaggaccagcgcgtccaggctccgtccttgtactgccgccgctcgaccggacgacggctgccgcggccccaagaagtcgacgggcacggtgggcgagaggaaccttggggcgtagacgagcgcgcaggtgacgacggtgagcacgaagaagaaatgaacaaacccgggccacctgccggtcaccttcttcccaccagcgccggcgccgctcccgtcctcgacgtctatggcgccggcgccgaggcccttggtggcgtcggggagcttcgaggccatgccgacgttcggttggagaaatggaaacgggatgggtgcagcttcgcgcc

SEQ ID NO: 31850 - DNA, 612 bp, Triticum aestivum
  Clone ID: PAT_TA_31850
gcacactaattattgtttatttattattaaaccacgatggggttattgagaaccgaagaggatgcatgcatgcgagagcgaaggtaacgactaccgagaggtgcagtcgaagagatagcacgcagcagccagcttgctgatgaagctcacactccgcagaggacggcgacgaagccgacaacgagcagcacggccttgggtcacgaggaagatggcgtggtagaggacgagtatgacgcggtcggcgttgcccatgcagaggcccaaggtgacggcggccaccccgcggacgacgtagtagagggcgtaggcgttgaagccaccgagagcgtgcgcgaagatagcgaggagccgggccatcccgcggccgaacgccgtcgcgatcacccaggccgccccggccgtggccgcctgcgccgccgcggtgaggagcacgaccagcccctcgaagcgcgtgcccagctcctgctgcggcgtggcgccgcagttcgcggacctcagcgcggtatcagtctgcggcagggaatctgccgggttgagggcgacggcgtagagcgcgaaggcggccgtggccaggccgaggacgacgtccgccgccgcccacgcgtccgg

SEQ ID NO: 31851 - DNA, 843 bp, Triticum aestivum
  Clone ID: PAT_TA_31851
cagcaaaattgtttactcataggatgtcaggaaagcgctttgccccgttgaatatttacacgagcaattgaacatttcaatcatttatacactccactattaatcagcgcctgaaaattccgcaggagcttgcgcatgcagggctgtgccgtgccggcagcaatggcatgcctcgttgcgtgatgaactcacgcgatggccacggtgatcaccgtgtccgtctcactcttcgcgggcgcgccctcgagcaccggccgccggcacgtgggacaggagccgtgggacaccagccaggcgtcgacgcagcggacgtggaagccgtgcccgcagagcggcagcacgcgcaccttctcgccgtccacgaactcgctcaggcatatcgcgcacacgtcgtcgatgtcctccccgcagccgtacacctccacggggaggcccctgaggacgcgcctcttgatgccgctgccgctgcaggccacccgcgccgacgccctgccctcgccggcagcaacagcggcggcagccccacgccccacgtaccggagcgcgcaccgtgccagcgagtggagcccgatggcgaagagcagcgtgaagaagaccgcggccaggatgatcaccacgttggtttcgaaagccgagtctgcccccgccggcgccggcgcttctcccccgcctccgagggcggcagccagccccgcggcgatgctcgacgtcggcgcctcggaatcgggacgacccatggttgatgaagttatgtaattccagaaatgtccacccagctcgatcaactcacagttcacccggcacgccgatcggtcgatgctttggtggctgcggacgcgtggg

SEQ ID NO: 31852 - DNA, 1230 bp, Triticum aestivum
  Clone ID: PAT_TA_31852
cgctcgccccgcggcccctcctcctgtcgtccccacccaccccccctcgaccactcccgtggactccctcgcgccctccctcctcctgccgtgtcctcccacacccccgcgcggtggtcgccggaagcagcgccccacagtcggacaatcgtcagatccgccgccgccgacgccacgatgaacgacaccgatgtctccaagcagatccagcagatggtgcggttcatccgccaggaggccgaggagaaggctggcgagatctccgtctccgctgaggaggaattcaacattgagaagctgcaacttgttgaagctgagaaaaagaagatcaggcaagaatatgagcggaaagagaagcaggttgatgttcggaagaaaattgagtactctatgcagctgaatgcttctcgcatcaaagtgcttcaggcccaggatgacctggttaataaaatgaaagaggatgcaatgaaggaactcctgaatatcagcagcaaccaccatgaatacaagaatctgttaaaagaactcgttgttcagggcctgcttcggttgaaagagccagctgtactgctccgctgccgcaaagaagatcaccataatgtggaatctgtactgcattcagcaaagaatgagtatgcatcaaaagcagatgtccatgagcccgagatactagttgaccacagtgtctacctgccaccttctccgagccatggcgatgagcacggccagatttgccatggaggtgttgtgctggcttctcgagatggaaagattgtgtttgagaatacagttgatgcaaggcttgaagttgttttccgcaagaaattgccagagatccggaagcttcttgttgcggcataatgcgcacttgtattttggtgatggtacagctgtttctatgtaaaatggctgctggtttgacccccagcaggtgcaacgaactccgcccggttttgcgaacattgattgtttaaagtattccatcctcttatgtaaacactacctatttgttcattatcgtcgccgagcacaaactatttgcacgaactttgctctgaggaataataaataaagcaccgtcggattgtgtttatgaaaaaaaaaaaaaaaaaaaaaaaacctaaaaaaagataaaaaaaaaaaactaaaaaaagaacaacaaaaagaaaaaaaaaataagccaaggggggggcccttttaaagaacccaaatttccctcccggggcttgc

SEQ ID NO: 31853 - DNA, 762 bp, Triticum aestivum
  Clone ID: PAT_TA_31853
ggtgttcttcggcatcgtcgccaactggtctttaaaaaaaaatataattcgagctatatttatggacccaagaaagtaacaaacataaccgagtatttaacattttcttaataacgaatcctatatatacagtgcctttatgccagacaagtgcacctgagcaactgacgccacgagttggcgacccctgactcgatcgactagtacatatagtactctagtagtgcttctggccgttggtcatggactcggcgatgcccttggagaggcagtaggcgacggactgaatggtgatcattgggttgacgccgaccgcggtggggaggaggctgccgtcgcagacgtacaggccctcggcctcccagctctcgccgctgccgtcgacggcgctgtccttggggctggagcccatgcggcagctgcccatctgatgggccgaggagaaggccgcccatttgtccgccgtcgagtgcatgggccccttctcgatggtcacctcgtccaggaacgcctccaggtcctcgtcgcgcaccacgggccaccgcacgatggtcccgtcgctgcggtgcgtgcccacctccgccgcaccggcgccctccaggatgcgcagcacgtggcgcatgccgttgcggagctcgcgggcgtcgtcgcggctgggggtgaagcgaaggcggccctcgcagtctacgaacccctcgcccgtgtcgtcgcggagggcgaacgcgtgcaggcggccctcgcagtccacgaaccccgagccgc

SEQ ID NO: 31854 - DNA, 929 bp, Triticum aestivum
  Clone ID: PAT_TA_31854
cagggaaaacgatgcgacatttcatcatctcaacggtagcacaacgtgctctggcaggcatgccagttcacataaccgatgattacactgctcaaggcaacatacatcaggtatttttccaccgagaagggtgaaaacgctgcgatcccccctcttcctcccctcttccagtgtcagttttgaccgcaatgccgatgcccagcgaagaagacaccatccgccgcttcgatgagagccacgcctactacaccctttcgtcgtttgaagcttcggggatcggctcttggaaaaactcgatgatgctcttgcacacctctgcaggcttctcgagattgactgcgtgcccagcgttgtgtatgactgccaaccgagagttcccatccagatgcctcttcaatctgtgagccaattccatcgggaacaccttatcttgctccccccaaattatcagcgtcttctgacgtagttttggaagagtcgaaatttgcctcccactaatcaaagcgtgtagtagctcagtcttctcctggatatggtctgagcccatcaccttaatgtagtcccaaaggaagcacgacggcatgatgatcggcggtcgcacgaatgtgagcctgaccaggcgccgcacctcctccggccgccgtggcaccagcagcgctgccgcctcatcgaccgcggccaccgggaacagaccctccgcgaggtccttctcctccaggcaaacgccggcgcacaccagagtcaccctccggacgcgtggggggtacatcgctgccatcctgtaccccacgaaccctccatagctcaccccaaccagcccaaacttggtcaccccgatggcttccagcgccgttttgatcgaccgcgcctggaatgtgtcggagcgatcggggaggcgggtggtggagttgccgaagaagacgagtcgg

SEQ ID NO: 31855 - DNA, 451 bp, Triticum aestivum
  Clone ID: PAT_TA_31855
ggcaaaacgaaaaataatcatttttttaaaaaagggatgaccccaaggctctgcatcagggagaatcaactaccttttcctaaacacttgtgcaacatttgcattgtacggctctttgtcaaacagtaaatgttgaatgcaactaattaacgaacggtgaaggtgcggtacgtggacaaataattgcatgtcctctgcaaaatacgcttacatgattcacttaattgggagttcagtaattcgaacaccagaacgcgcggtctgtggaacagacacatcgtacaagaacaccaggaattcacttgagagttgttggcacgccggcgcgacgtctcggcgccctctgagccaccgctctgtgctgcaggtgctcgcgcatgcggagccagtcgtggacgaagtccggcaggacggtggcgaggcaccacaggagctggtggccgaggttggg

SEQ ID NO: 31856 - DNA, 1018 bp, Triticum aestivum
  Clone ID: PAT_TA_31856
gaaggataaaacatttgtttcgaaggaagatatataataaaatatagtactcacatgttccccaacatgtgtccatggtagcaaaataacaaggacagataggcataaacagagtaacctactactccatccgttccaaaatacttgttgtggtgttacttcaaatttgaactaaaatcacgacaagtattttgttacgggaggtagtactacatcctaacagcacaaaagggactacacaccacctcaagataaatcagacaatggcattttgatcaactgaagtccttcgcgcggatgatatgaactttcatggcgcacaatttccgatgcttcagcagctcgaagaggcagatatcacccacctccacctcattggctttcacaaactttgtccatccgcctacaatccttttatcctgaggcttgcgtccaaaccacacttgacacctctcgccaagtcgctcaagacagatgctctgcacctcatctcccaaatacttgttgatatatttcttagagatgcttagagtgtatcttccagtaacattggtttgttgcatcatggcaacaaagatgggagtttcagaatcaataaattgaaccttctctttcactgccttcttctgatctgtagtaaggcgcgtaaaacgtgcaaggatgcaatcagacaaagcaccttcttcatgatcaatatcttccgatgacaaggaatctctcttgctgccctgactagacttgtccctttgaagttgtatccgtctttccaacgaaggtagttgtatttgcacaggctcgggatgaacgatagtatcttccactgtttcattatgcagttgcatttccttaagctgggggagagaatgagaatgttccataattttaacaacctctctgtgcctttgctgacaaattttggaaggcgtatcaatatcctttgtatggatgatatggacttccatcgtgcacatcttacatttcttcaacaattcaaaaatgcagatatcggacgcgtggg

SEQ ID NO: 31857 - DNA, 1668 bp, Triticum aestivum
  Clone ID: PAT_TA_31857
ttggctgtttcactagctcacggaacgtcggacgggcacggaggatggtcctttctctttcggaatcgcacacaaggatcggaaacgcagcagggagctaatgatatcaccaagaagcttaagagtgtttgaggagcgcttacaccagtcactcggtcccgtcgaggcctggaccggcatcttccagcaatctcagtcttcattattcttcttcttcgctattctctctacttccattgcaagcaagcaaaacagggcacctgaagtaagcttcatctgcttcaagcgaaggaagcccggcgctgcaggtgcctcaagctctgctccatgctgaccttcaccatctcggcgagcatcttcttggccttcccgccacggtcctccccgtcgatctgagaagcgatgttgctgacgatgttctccagcgtgttgggctgcagcttcgacctcgagtagggcgagttgcgcagcaggtcgaggagagcgtgagccttcactctggacttgggagtgccatgagcggtgagctccagaagaccggggatcgcgccttcgttcagaatgaggtctctgtatttactgcggtcactctcgcacatcgtgaggagcgctccaacagcatgctctcggccttggagggagccttcctcgagcacctccacgatggtgagcaccccgccttcctcggaagtcagggccacccggccttgatcaaaggcgagcagcgattccagaagggcgcagcacttgtctgctgtcttggaggacctcttgccagctctcagcaactctaacaaaggggggatgggctggacagagaggatggtttggaggttatctgcaatggtggagaggttgtagagggccatgacagcatcattcttggcctgcggattcccttcttccagaacctttacaaggagagggattgccccggatacgcttatgatgggcttgtttgtggatgaggctgagagagtgagtatagcagcagctgcatactcctgtaagttgagatcgctcgactgcaggtaaccaagcagaggctccagggcaccagcatccagtatcttgatcttattcctgcacagatgaaacaagaccagtttagggacaatgtgcatgcatcataacaaaactaccgctctgcaagctaaagatttctgggaaattttactaagccaacaccgcatttcagatcgtaatcatgaaaacagagaacatctgggtaaaacaatatacatgttgtactacacattctcgaggatgattacattgctggcatggtacatgtattaaagaagaagtttcatctataggaaagctatgtcagagacgacttagagcagtgatccagtactcagttaggccagctattgcagagatctaaatttaaggctctgctgctactaggacggtgtccaggacgaccggacgcgtgggcggacgcgtgggcaccaacatgggaaccatgatgaaatagcaatactattgtatacctttgaatgttgcagtttaaatctaactagcccaattaatccactgattaggggttacaagggtagcagcaaggaggataggggaatcgagagtcaggggatacgcccaacaacggacggccagtcagtctacagttatttgatgcgcccacacaggtttaaatgtgtg

SEQ ID NO: 31858 - DNA, 2021 bp, Triticum aestivum
  Clone ID: PAT_TA_31858
attcggcgcgcgccacgccccccgcgatggcaggctgaggatgcagggggacatttctcttacagatgcgacgttgtcactttaagaaatacaggaggtgattcttgtgggcggttccacaagaattccagctgttcaggatcttgtgaagaaaatgacgggaaaggatcccaatgtgacagtcaatcccgatgaggttgttgctcttggagcagcggtgcaggcaggagtctggtcgggggatgtgagcgatattgtgcttcttgatgttacgccactgtctcttggtttggagacactgggtggggtgatgaccaagattatcccaaggaatacaaccctccctacctccaagtcagaggtcttttcaacggctgctgatggacagactagtgtggagattaatgttctccaaggagaaagagagtttgttagggacaataaatcccttggtagcttcaggcttgatggaattcctcctgctccgcgtggtgttccccaaattgaagtcaagtttgatattgatgccaaaggcattctgtctgttgctgcggtggataagggcactgggaagaagcaggacattacgatcactggagccagcacactgccaaaggatgaggtagagaagatggtggaagaagctgaaaaatttgcggcggaggacaaggagaagagggacgcaattgacaccaagaaccaggcagagtctgtggaataccagactgagaaacaactgaaggagttcggagacaaggtctcaggcggtgtcaaagagaaggtggtggggaagctcaaggaactccagtatgccgttggtggtggatcgacacagacgataaaggatgcactagctgcgttgaaccaagaagtgatgcagcttggtcagtccctctaccagcagcaggggtcgggccctacccctggagctgacggcgctgctgactctacaggcccaggcccatctgagaagacaggcgatggtggtgacgtcatagacgctgattttaccgacagcaattgaatagaacagtaggttaggacatggtgcaacaagtgagtatgaatttagttccacatggattgcctagcaatatacgtgtgaaccattttcttttggatttagatgttggtttcatgctacgggtggttggcgtagagaagagaggttaagaagctgaaaaattcgcggcggaggacaaggagaagagggacgcaattgacaccaagaaccaggcagaatctgtgatctaccagactgagaaacaactgaaggagctcggggacaaggtcccaggcgatgtcaaggagaaggtggaggggaagctcaaggaactccaggtcgccgttgctggtggatcgacacagacgataaaggatgcactagctgcgttgaaccaagaagtgatgcagcttggtcagtccctctaccagcagcaggggtcaggccctacccctggagctgacggcgctgctgactctacaggcccaggcccaggcccatctgagaagacaggcgatggtggtgacgtcatagacgctgattttaccgacagcaattgaatagaacagtaggttaggacatgatgaacaagtgagtatgaatttgttccacatgattgcctagtagtatacggggtgaccgctttctttggattgagaccttgtttcctgtcagggtgttggccgagtttttgatgttggaggtttggagagttcagttatcagtttggatggatagattggcttttgcttgttggttactcgaccccttggctttgtacggttatgtattggatttactaactctctagagaactgggtcatttcctgtttggagcatgtgccaaattcggcacgggtcggcgcgggccgctcgactcccttcgtttataaatatatagcccatttagagatttcaaaataaaaaaaaaaaaaaaaaattcgaaattttaatttatatcatcaactcatatctaattaaatcataaatattattctttttgcgggccccccttttt

SEQ ID NO: 31859 - DNA, 581 bp, Triticum aestivum
  unsure (1)..(581): unsure at all n locations
  Clone ID: PAT_TA_31859
gtacgtgagccagtgcgccgtaaagattataaatcaggccatgattaaaaaatctatatacaaacagtatcatttttgccggtcatatacaggattacaccaatttcttctttttcctctcctataccaagactgcatatgtgtatggctggattctccagaccacgcacgaaaagaaaccaaacatttcgcgtcaatggcgcgccggcgatggatgatctctccgggatcagtctctcccgccggctgtatactctctcccaaactatcacctgcaaatagcaaagagcacagcaaaaagaatttgatctccctctcacggcccgacgatcttcactcgcaccttcttggccggcatctcggcgaactcggtctccgatacctccgagttggacgacgacgtgaggtgccgcaccgagtggcggtcgtcgccggcgtggcgcgaccctccgacgccgccgnacgccgncgaggcgagcacgagcagtgccatggccatcgacagggcggcgagcgcggnccacgtcgcccgcgcgccgcggcgcatcggcgcgcactggttgcccacgatgtccgcgaag

SEQ ID NO: 31860 - DNA, 716 bp, Triticum aestivum
  Clone ID: PAT_TA_31860
tttccgatgcacaaacatcaaaatggggcaaaaatgtaacatcagcgtataagcgtgcctaacaagagatgaatatgttaccaacaagagttgaatacggataaaagaagattggctctcaaagttgagcataacattgttgtcaacgacgacctcataaaatggctttgctacatattaatggcctctgcaatgtgttgtccatggcctagctaatgttccacttacatcctcccgagatgcccgatcacgcatcagtacaacaaatcaacaacgtacgtcatcctaccctgttggtctgacacaaaagaaaaggggacgctgatcctgcggagtaaaaggaggatgaggtgctcgtcacgatcggctctgtcgaatctccttcgccgtcagtcccgttaccacagccaccagctgcaagcgcatggaggcggacgcaagaggaacacaatcggcgatggaagccagcagcgcgtgcggctgccgcagtcgccaaggcagaacgctgcaggagacgacattaaaaaataaagtaaagaagagacccaccatgggggcctgcagaagaagagtagatgggtatcagagggcgcggaagctcgccgccgggattgaggacggtggcggcgcagcctcgaccaacagaggagctcagggatagggatagggccggcgctcggggatagacgaagagacctggacgacctgcaagttca

SEQ ID NO: 31861 - DNA, 597 bp, Triticum aestivum
  Clone ID: PAT_TA_31861
accgtcgaacacacgggcaaattactagtttaaactgaaaagagagtttcacgctctctcaagagaagtttcagaaacaaggatatgcacattattagatcagacagttgcaaatcaatccacatctcacaaccttagtatctactcgtagcacacaatcctccctacgatggatcagaacatatggatacctgaggcatgtttggttcattaccgcactttgcccagtttggtcgccacaaaagatgcgaattcacacaacccaggtgtggcgaagcatggtaaccaaccaaacacgcccctgatgttttgacggaaaaataggcatggtaacaaagaacctgcatagtttacattaggatgcaaggtattcgcatcgtcatccacatttgagatttgacctctggaacctagagattctgaggttttctttgtgtaggtgaccatccatccattgattgcagcctttgcttcagatggaacacttcaacctggagctggaatgccctcgcgcgctctcctgctagaactccgcgggtcgagtgcaactccttctgagtttcatccgtgactgccttcaagaacgccctcgtgccg

SEQ ID NO: 31862 - DNA, 1175 bp, Triticum aestivum
  Clone ID: PAT_TA_31862
agttcttggttgttttactcatttccttgggaaaataataattcgctacaaccgacgcagtacaatcaggcagagacaaattgtcagtggttaagactccggactattcacattaatgagtaaccatcacaggtctcgccgcgttagttcaagagtcgctcgtgcgttttcaaagtaaaaggacaggaacggagaaagacctcttttatgcaaaatcctggagaaccgagtccttgttcacggtagcgagcaatctctatctacatcatttcatatgctgtgctctccagtcaacagcaaaatctgtgccttcgtcttcgtcgtcgctcgatgagtcgctggcgctggaatctgtgtccatgccgatgggtttgctgttcgctttagcagtccgtgcggctttggactcggtgagctgtttcttcagcatatctactcgctgcctgtactcctcttgctccaaggtcaagtactcttccctctcggcagcagcatcaatctcctcttcttcgaggcggtcatcaacttcctggaggtcttcctgaatttccttttcaaattctttgtatgcgtcgttgatgtcaacttttggaggttgaataccacgtgcacggagatccgcatctttgttatcgaagaatccttcaggcagagcttttacttgagcagtttccagattattcgccgcttgagacgatgcactggtttcgctgggctgtgtgttactgctatcgaagaagccatctgggacacctttcacctgcacggtattggggttggtggtatttcctgaagtcctagtgggctcctttggagctggagcaggagttggaacttcatcttcatcttcttctgtataatcaaaaaaattccctggaagaattcctttcacgtccgtactgcctttactccctttatttggcgcttggtccatcctgacagatggtttatttgcacttgcttctttggttgctggctgagcactggccacttgatgacgtacagaccttccctcagaaccagtaccatcactttgccttttcattccctgattgtcaaaaaaattggcaggcatcggagaggattttgctttctgagtctcagctggtcgttcatgactgacattattgccacgaggagctgcagctggtgtaactttagcagctgcggcagct

SEQ ID NO: 31863 - DNA, 681 bp, Triticum aestivum
  unsure (1)..(681): unsure at all n locations
  Clone ID: PAT_TA_31863
aactccagaacacaaagacacgttctctttccaaagtaacattgcaggatcaatccacacaatcaagaacacacatacagagcaattacctcagaagacagacgccaagctaaaaacaatgcttaactcggtcagacaacagtaagcatttcaaattgatgtttaataaccaaaaggaagcctgcagtttctgatatatccccaaaaacccagccgtttagccccctggattttgcaccacagagtcaatcatcgctttcagtgtcatcgtagtcgtaatcgccaccactgctcgagttctcgtcgtaatcaggctcccatggctcccggaacgactcgagagcgcagcatctctcctcaatgtcgccgtcaagcctgacattcaagctgccaagtatatccagtgtacgcagcagagggcatttggtgaggatggcatcaaggccaacatcactgaacagaccatatgcaagctcaagttgcttgagcatcggcatggtattcgcaaccgccagggcctcgtcttcgaccactttaggtgctgcatcgttgccttggggggactccggaggcatgttcctcttcagctgagcaagcgacttgcattgtcggcnctattgcttncccggacgggcgtggggtcgaccnncgggaattnnccggnaccggggtancctgcag

SEQ ID NO: 31864 - DNA, 1231 bp, Triticum aestivum
  unsure (1)..(1231): unsure at all n locations
  Clone ID: PAT_TA_31864
tttttntttttttttttttttgcacaacccagcaagcttatatacagtttcatactatttcttgagatgtacaatctcataatatacataaatagtggtaccgtcaatctcgtaaatccagaaaagagaagaactgtacatatgtattacacacaccagcgtgcaggacatgtcctagtagctactgtgcaatgatccatttgccctaaggcggaggaacctcatcaagtcgacataaacatcatctttggccttcacgctcatgacgaaatcaatgtggccatagccactaatgtatagcagctctggcgtagatctcagctctttgacggtacgcgcgacatcagtgacatcagccaatgcatcaagacctccgtaccccatccacatccccagtgattccggtatgctgctcaggtccaacggagggggcgacagcttaccgtagcgccttaggtttccccacaatccgtagtcgtaccttgcgaaagtgcctttcctgatcatctgaaaaagatgatgcaagtttttagttgaagatggatgaggttcgtactccaagtaatggtcaatccgtgatccattgaagcaacaattttcccctgttattgaagacagcaaatcgttgcagtccacatgtccatcatcgcatatagaatctactatttgaactcccatatcgctccggaagttcagctgatggaagcccatggtaagaagcatctggtcaagatgcatgccaactgctctgagaacaaaactagcactaacatgatcaaggtaagaaattggacaaagaagtgcagcagcgctaatcatctttgtgatttcaggcaatgtaaaagcagccaaacccataatagttccctgtgaatgccccacatacaaaattttggactgcctaactgtatacacgtagcttaacattgccagaagatcatattcagcaagctcttgccagctccaatcccagaaaagcttatcatgcacagtgaaagttgcggacgcgtgggtccaacgtgttccacgaacatttccaatccaaacatcgaacccattatcagcaaggatatatccaagcgactgttcagcagaatttatgaaccatgtatctcctccctgaaaaagaccatgttgaagaaaaactggaggtccagtattatctggaactccatttttgccatgtggaatatgctgaagagacaaaagaaagccatctctgtttcaacgg

SEQ ID NO: 31865 - DNA, 646 bp, Triticum aestivum
  Clone ID: PAT_TA_31865
gaatgaatgtaaagatcttttgcattattattaacaccccaaagagtagaattattcatggcttgctgaatcagggcatctacatccaaaaaagatgagtatacagaattatctgtggctattctacattttcaacgccttcgcgaattctccataacattattcctatcatgttccaattggaaccagataaatcatgggcacacttccgaggaacttctcttctacagtgttaagctctcagggtcctcgacaatctttgcaaatgtttgcagaaatgctgccaaatcagcgccatatataatcctgtgatcagcagtaacattgaccagcatttcgttcttgatactgaagaaaccatccttgtcagctataacagtaggtctcgatgctccaacagccatgatagccccctgaccaggtggaaggattgcatcaaatctgtctaccccaaacataccaaggttggacagcgaaaacgtccctgagttgtattcatttggttggagctgcttcatgcgtgtctttttgagcagggctctccatttttgtgcaagcagatatatatccaacttatcaacatcctctaacacgggcgtaagaaggccaccctcaatggcaccgccaccgcgacgttgatactact

SEQ ID NO: 31866 - DNA, 882 bp, Triticum aestivum
  Clone ID: PAT_TA_31866
ttttttttttttccccacatgcaaagatttcatcccatttcataaaaagtgaatcaattccgttacagaaggaacacactcaaggttacaatggtacaatgactattttctgtaaaattagctgtcaaaatttccaatcataggtccttcttgctacctacaggtctagggtggaagtccaacatccattgcttataatttgtgtacagggtcaaaataataaactgtgagaagcagatgaacattatcagtgcatcaaagaggaagggatacctctttggaggctctatttgcagatacatggtgtgaagtaagatcgagcataacaatggcaggctcagaactgccattgttccagacgaaattttcatcccctttccatagtttccaccaggtgagtagtaaataagaacgaataatccaagaacagctatatattgtagaagaagctgatcacggcagataagtgggtacatcgaaaaaagtgcatagtacgtgaaccatccatgcaggtgaggttcgtgtaatgctaaaaggcttgcgggtaaaagaggaagcaaaattgatttctcatgcacttggtacgagaataggtagaaagagaacgaactgttcaacagagaatagaggaagccaagattacttggtgacttgacttgctgaataaatgaaggcaagaaagccaggatggtagcagaaagactcataagtttcagcgattttattgcgtacaatcgcttccacttgataagaactgaggtggtacaccagaaatttgcaacataatcctcatatatacctctctcaaacggagccaatcgagagatcacctgcatggcagcctcataagaatgcaaataaggccaccaaacaagagcaaaa

SEQ ID NO: 31867 - DNA, 1492 bp, Triticum aestivum
  Clone ID: PAT_TA_31867
gccgtagctactgtcaagagggtaacggcgggaagaagcaagtgccgccccccggcggcagtgccgccaccgccctggcagtggcgctggcgcggctccggagcacggcgtgggccgccgtggcgccgcccccgccgagcccggccgcccgccggccgccctcggtgccggcgggccgggtgcccagcgtgagggtgggggggcaacgacgacggcaggaaggacgccgcgcaggcggtggtgaaggcggggaggaacgcgtgcggggcggcggggacgcagaagatcgtgatcccgccgggcaacttcctggtgggcgcgctggagctgtcgggcccctgcacctcctccatcatcatccggctggacggcaacctcctcggcaccggcgacctcaccgcctacaagaagaactggatcgaggtgatgcgcgtggacaacttcgccatcaacggccacggcatcatcgacggccagggccccctcgtgtgggagaagaaccagtgcagcaagcactacgactgcaagatcctccccaacagcctggtgctggactacgtgaacaacgcgacgatccgtggcatcacgctcaagaacgcaaagttcttccacctcaacctcttcaactgcaagacggtgctggtggagaacgtggagatcacggcgccggggaacagccccaacacggacggcatccacatgggcgactcggaggacgtgaccatcaaggcgaccaacatcggcgtcggcgacgactgcatctccatcgggcccggcaccaaggaagtcaagatcccacggctcccggtgcggccccggccacggcatcagcgtgggcagcctgggcggtacaaggacgagaaggacgtggaggacatccaggtgaccaactgcaccatcaagggcgccaccaacgggctccggaataagttcgtacgaggactccaggtcggcgctcagggccacccgcttcgtgtacgacgacgtgaaaatggacaacgtctcctaccccatcgtcatcgaccagaagtactgccccaacaacatctgcgccaaggcccccggcgcctccaaggtggtcgtcgccgacatcgtcttcaagaacatcgtcgggacctccgccacgcccgaggccgtcacgctcaactgcgtcaacaacgtgccctgccagggcctgcagctcgtcaacgtcaacctcaagtacaccggcacgaacaacaagaccatggccgtctgcaagaacgccgtcggcacgtccgtcaacgtcgtcaaggagctcgcatgcctctgactcgaaccacgcaccccgcccacccggatccggattcattctttcttttgttaatttgatttgattaatttgttttttttttctctttttgcttcctatcatacgtttgttttcagtttttttacttaaatcaactggtgtaagcagctgacggttaactcgtcaatgatagcaagtgtctgattttggttaaaaaaaaaa

SEQ ID NO: 31868 - DNA, 795 bp, Triticum aestivum
  Clone ID: PAT_TA_31868
agctccagaaagaaagggaaagggccgaaaagaagaaagagaaaaggaatgacaagaaagcttgccatcagggtggtggtgagacaaaacattcaaaacgtagccataagaagagaaagcatgaagataccagcatagccggcctggagtccaaaactgcacccaaagaactatttgatcagttggagaagagtggactctcagaagagtatggggccccttctttcattcagacagtacatggatcaccagagagctctcaggacagcagtaagcgaagaaaggtggtgctcccaggccctagtcaaaataagaatgggacggtacttcgcattaagataaaaagagatcaggattcaccgtcagcgtccgggaggaatgacaagaaagcttcccatccgggtggtggtgagacaaaacattcaaaacgcagccataagaagagaaagcatgaagataccaacatagctggtccggagtccaaaactgcctccaaagaacagtttgagcagttggagaagagtggactctcagaagagtatggggctccttctttcattcagacaattcatggatcaccagagagctctcaggacagcagtaagcgaagaaaggtggtactcccaggccctagtcaaagtaagaatgggacagtacttcgcattaagataaaaagagatcaggaatctccgtcagccatgtcggatggttctagggttcttcagcaaccacctgtccaacaaatggctacacctttatccttgttgagtaagcagaatgccagtcaaccttgca

SEQ ID NO: 31869 - DNA, 487 bp, Triticum aestivum
  unsure (1)..(487): unsure at all n locations
  Clone ID: PAT_TA_31869
acccacgcgtccgcgttcccatctcgcgtagccgccgctaaaatttcccctctcctccccgtgaaaccctagccgccacacaagagccaaatccctcccgccgagagcccccaatccgttccgtcggatttcttcccgcgaatcgaagtctccttcggttcgcggtcgattagggcgggcctcgccgtcgctctcttgattccgagggttcgcgcatcgcgcagcgggattcacaccggccgccatgtcgaggtgcttcccctacccgccgccgggctacgtgcgaaacccagtggccgtgccccccgttcccgtggtggagacgaccgctaaggtttgttgaaccatcggatttacaacacgcacgtcctcggatcatgtgttcttgcctgttggttctgatcagatctgttgggtgtgcgcgtgcgatttgggaatcgcatgcgaggggaggctaaccttgccaccgatgcgtcngttagatcga

SEQ ID NO: 31870 - DNA, 2018 bp, Triticum aestivum
  Clone ID: PAT_TA_31870
cggcacgaggcctccctcgccttgccgccgcgaaaatgtcccctctcctccccgtctccccctagccgccacgcaggagccaaatccctcccgcccagagcccccagtcccccccgtcggatccctctcccgcctacccgcgtctccaagcggtcctcggtccacggtggatggccgcgccgccgcgccctcgctcccgagagtccgcgcgtccccccgtcgggcacccgcatgcacaccggtcgccgtgccgcgcctcttcccccacccgctaccggcgaaagcgcgtggcccagtgcccctgccccgcgttggcggcgaccgcacggcccctgaaggtaagggaaagggccgatacacagaaagcgaattcgaggaatcacagggattgtccccacccccgtggcggtgatgcagaacgttcaccacccagttcgaacaagcgtaatccggaagaatcccccagcgctggtttggtcggttaagctgccggcaaccatcaaagtcgctagttgcatccacccagactgccagcagcagcccgtcctgcaccacccaaagggacctgtcggcaatcccctcgtacaacagcagcagtcaagcacctccttggcgaaagacgagcccttgttcctctggcaggaacaccgaaaaaggcccagtaccagaggctaagcggtccaagtccgctcgcaagaagatcccccaggctgagaaggaagagaagaaagagaggaagttccgtggcctatttgttacccgggatccgccttcccttggagagttaagagacccgggaatctcgtcgtgcaatcagctgctggtctccagggtgccatcagaaaccgtactcactatgtgccaacacgctgcgaggcaaagccaccttctgccgtcctgcggagctggccttttcatgcgcaaatagctgctactcatcagccccaccctcatatgtagcagttgccaaatatagttcccccttcctcagcaaaaggcaggcagaggttagatgaccgggtgcatgttaatgctacactagcatctcccaaggtgaaagaaagtgctgctcctttgcctacgcagctgacacgatgagttgttcctccacctactaagacggcacagagagttgacattcctcctgccaaggttattgacattcctcatgcaaaggcgttgcaaaaggttgatcctctggtgccatccaaggtgctccgaagagatgctcctccacagagtttgccggtgttgcagaaggaaacaataaaagttgcttcttcccaccagccagacaggcagccgcagcccgttctgcacaaaccaaaggtgcctgtagtctctcccctcatcaaacagcagcagtcaagcaccttggcgaaagaagagccttgttcctctggcaggaacactgaaaaacagtaccagaggttaagcagtcaaagtctgatcgtaagaagagccgcaaggctgagaaggaagagaagaaagagaggaagttccgagatctatttgttacctggaatccaccttccttggagattgaggagacctggaatctcggcgaccaggattggttgcttggcggtgcaaagaaacctgatgcttacaacagcagctgcaaggcaagtgattgtttggcgcccatggagctggagttttcatggcaaccaagggctattcatttgcctgaccttgatgtctatcagttgccatatgttgttcccttttaggtttgtgtaggaagactgaggttagatgagaagtagaagagatgttgggagatagctgtgccggtgtgggagatagtgttcccccacggcagttttccagctttgtttcctagttttcttttccaggacgatggatttggcaaccttctgtagtgttgttaatctatttgacttacttttggtttccaagcaattgatttacggacaaccttggaccttgagttttaaggttattgttacccctgaaatgaatacatcattcagatagcacaacaagtaaataaa

SEQ ID NO: 31871 - DNA, 760 bp, Triticum aestivum
  Clone ID: PAT_TA_31871
gcaacgagggtttggctgttcaactcgttgcattccgtgacgaaagtctgcgagtaaatcgaccatggcggtcgcgacgcctcgcagctccctcatcatcttcttcgtcctcctcgtctcggccgcttccttggtggtcgatggtggcagcatcgtcaaggaggcctgcgccaagacgccgcagccgagcgactgcgaggagctcctcaagtccagcaccgcgacggacgcgaaaacgctggcccaggccgccgtcgccgccgccgcgaagacggccaccgaggctgctaccgccgccaaagcggagcgggacaagctccccaacggcaagacgcagtggcggtgcatggacagctgcgcggcggggttcgatgaggcggcgacaaagtttaagccagcagctggcgggaacgccgcgggagccgacgcccagctcacggaggtgctggacttcgttgtggtggatgaggatgtggagaagtccagggactgggagtggaagtggagctgcaacgagtgcaaggcggaccccaccgcgccggcaggactcgtcgccaagaacaaggagttcgacaagatcatggatatcatacctgccatcatcaagcaagcagtcgccggcgcggacaattccaccaaatcggacaccaaatccaaatccaaatcctagggagccaactcttcgttatgtctactttcaaccttcgccgttgatgcatttctattgcgccatcccgtctgacccacaccagcagggtgt

SEQ ID NO: 31872 - DNA, 1446 bp, Triticum aestivum
  Clone ID: PAT_TA_31872
cccacgcgtccgcggacgcgtgggcaaagcaatcaaccagatataatagattaaaaaataaaaatccacaaccctagcctgcctgccatgacgcgggacggcgtgccaccgtcggcgcctgccggcggcggtgcgggggacgggccgaggcggtgctcgcagtgcgggcaccacgggcacaactcccgcacgtgcacggcgcgccccgtgaagctcttcggcgtgcgcatcggcgacaagccaatcaggaagagcgtcagcatgggcaacctcgcgcagctcgcggagggtagcggcggtgccagggccgaggggtacggctccgagggcgacgacgacaaaccacacaggaagcgaggtgagtcatggtcagaagaggagcacaaaaattttctacttggattgaacaaattaggaaaaggtgattggcgtggcatatcccgtaattatgttgtctcgaggacacctactcaagttgctagccatgctcagaagtatttcattcgccaaacaaatgttaataggagaaagagaagatcaagcctcttcgatatggttattgaggatcctggtgaccagccactctcccgttcatcgtcacaagagatgccgctctcccgttcatcttcacaagatgtagaagagttcgtagatgatctacggcctgttactgctcctgtgacaccacccgctcctatgcccgtgataacatctgtttctgtcccaccaccagtgccagtaatggcaccacctgctcctgtgcctatgctaacatatgcatcagccccatcgccagttctagcaatggcacatcaacctcagggcaatgaatcggctggttcaagttcaattgctggagaagcagggatggtgatgccacaagtgatgcccccatatggttatcctcctccaatgatgattcctgcacctcactatgtccaagcagtttttccgtatccatactatggctatgctccaatgttctatgggccaccagtctctatgcaagcatcatcaccagttacagtacaagcatcacatgagcctgtcaggcctgttgctgtccactcagctcccccggtaaatgttgaagacctgtacaacatgtccaaactcaacctgaagggtgactcaagtaccaacggtgttgcgcctaacttggcgttgcctccaaatccaaacgggagaccagagaggcaatctgctttccatggaaaaggggctgagaatggctcatcgaacggactaatcccgacaaaatgattctgtggctagacctttaatgtgtatgtaacccttagctatttattatagtataaaatcatgatatagctttcttggtcatgttccgtgagtaaatttactgttagtctgtcatcaaggttgcatttgtgttttgccctattgattttccaaattcacatcgattctcataaaaaaaaaaaa

SEQ ID NO: 31873 - DNA, 883 bp, Triticum aestivum
  unsure (1)..(883): unsure at all n locations
  Clone ID: PAT_TA_31873
gcgagcaagnagnactgacatctacagctttggtgtcgttctgctagnagctgacaaccggcgtggttgccaagggcattggaggtggagaaagcttgggtgaatgggcatggaaggtgttacaggatgctatttaaccaaagacaaaattggcaagcatatccgcgactcggctcacttggaggatatctttgtggtgctaaaactcagtgtatcctacacgagtcctcaggcgggggagcagcttttgtcatccttatttgcatagctctcctcactatactgtattaaaaatatataatgtaacttcttcaatgccaagaaaaaattgtaacactggtgggcaagtaagaagacaggcataggaatgtcataaaacgcaaagtatagtgcagatcataggtaggtatatataacgtggtttccaggaatcataaaacattgtggtcggctattctgcctaattaagctcgaaaactccaagaggaagttcaggtttttccaatgttatgtgttcaggcgtataccaagcaggaggctggagagcatactcaaaagggcagaaaaaaacgctgctcatatgtaaacgagcatggatttggatatgcgaggtttccaccaataagtagtagttgtccacgaggaagtataagcctgaaatcatcagattttacgactaaagaaggttgagcaatgaagtcaccatcaccgacatcagcaatgaagtcaaacagaagttcgtcttttccatctagatgatcgtataaaaggtcgctgctcttagattcatctggacctttgttaatagcagcctgcaacatacgcatgtcaaatcgaccaacaaaaagtgtgactgataacatganggttgaaaacagtttta

SEQ ID NO: 31874 - DNA, 1375 bp, Triticum aestivum
  unsure (1)..(1375): unsure at all n locations
  Clone ID: PAT_TA_31874
ctcgagttttttttttttagcgataaacaaaaattctcattcatatccatcgacgatggcgatttaaaacaacagttacgggtcatacacgtcaacagcggaaaccaagactaaaactgaaagacaaagaaatctgccttcaacatcgttctcaagtcggccaaaaagaaacgcccctctgtgtagggtggtaagcaagccagtaagccatggcatatatgtatagtgtgtgtgtgtgtgcctggtatccttcaccatcaacctgccaaccggatctggtctcatcgccatgaactgcctgcccaaacaaaaagaaaacaactccatcgtcatcatcaccaccaacatcatctccatatatgccatgtcccttgcagtaaacagacaacactagctacagcctccacctggttgtcaatcccaccaccgattccatgtatctacgtcacttccagtaagcacaacactaaactacagcttccacctggataattccacagcttcagatcaaaggggcaaaactagggtggcattacattcagctcgatgcctcgttgcctagcggcttctgtgatgctatccgtgttgcttccactggccttgcaggcagtcaagtaagcatgccacagcttgaatgagaaggggtacactgatgttgcctgctggtgaaaccgcttcaccgtctcagcagcctgcagttcctccaggagattggcaccttctatccatactgattctggtgcgacgggtacagcacggaaaatggcattgatcagaacagaacttgcccagaacctggtgcccatcgaggtagggtcagcacccttgtaatgtttaaccacaaatgcgccaactgccagagctaggcggtagtttgcaggaagaacctccataactgattcaacaaaatccacaaggtattttactccgcctattttttctggaaggagggactggccatagcacacctcaagggttgagtttatcactgaagaatctgcagaagctggacctatagtgtcatctatcaactgcctaagcttatgcttcttaacattttggataaaccttcgagacagcagttccttcacaggtaagttccgaaggtctgcaagataacccctcatcagatttaaggtagctcgagcttgagtgtctgtacaagatggtctctctagcatgttaattgcagcatgctcccttaaacagtgctcatagctctcccctcgggccaacttcaatgctttgttcacagcaacttgtgcttcctgtaggttgttctctagcatcctgtacagtgagaggtttaacaaccagtagacctgatcttcagatgcagatggaccagaacaaacttncttgtggttgttcggac

SEQ ID NO: 31875 - DNA, 1522 bp, Triticum aestivum
  unsure (1)..(1522): unsure at all n locations
  Clone ID: PAT_TA_31875
gcccttaaatagaacncatagagccaaagggaccccagaacacatagagcaaagggaacaaacattacatgagaaattctaacgaaattcggacttacttggtggcaggactagctagcagatgggacagagcgcacaaactgtcaaaggtacatggagaaattaagggaaatacagtactacgtttcaagtgttgctccaaatttcttagccctcgccccacgttccgctgcttagaatatgccggagagcatggtcgccgcgctcgacagtgcggctccggtgatggcgaaatgaacgacgtggtcggagtgcccgttgtccccggtcagggcgactgccgctccggcgatcgcccctgctatcgcgctgttcttccagtcatggtgtcctctggcctctctcaggccgtacgttatcccagagtagactccggctgccaatccccactggatggcctccttgcttgccgatttaaccactgaatcgagcgacttctggccgtcatcccctctggcgctcgagaaatggctcctcttggcggtgctgtccagccccgtcgagtctcctcccatcccttcgacggngacgaagtatgcctcccgcgacacagccctcgccgctccgactccggcggcgcggatgaagctgtcggcgacgcggttgagcagcgggtggccgaggtcgaggagcgggcgccggtccatgctcgccacctcgtccttgagcgtgcgcgcgtcaagcctgctgcccatctctccctcacagccggtcttctctcttctcttgcttgctatggactgcgggaatcggtacatggagaaattaagggaaatacagtacgacatttcaagagttgctccaaatttcttagccctagccccacaccccgtggcttagaatatgcctgagagcatggtcgccgcgctcgacagtgcggctccggtgatggcgaaatggacgacgtggtcggagtgcccgttgtccccggtcagcgcgactgccgctccggcgatcgcccctgctatcgcactgttcttccagtcatggtgtcctctggcctctctcagaccgtacgttatcccagagtacactccggctgccaatccccactgaatggcctccttgcttgccgatttaaccactgcgtcgagcgacttctggccgtcatcccctgtggagagtcgatttcatcagctcaggctcaacgtaaacagagaaaagagctactgtccagaaaagaggtatcacctctggcgctggagaaatggctcctcttggcggtgctgtccagccccgtcgagtctcctcccatcccttcgacggcgacgaagtaggcctcccgcgacaccgccctcgccgctccgactccggcggcgcggatgaagctgtcggcgacgcggttgaggagcgggtggccgaggtcgaggagcgggcgccggtccatgctcgccacctcgtccttgagcgtgcgcgcgtcaagcctgctgcccatctctcccacgtagaaggtctgctccga

SEQ ID NO: 31876 - DNA, 1596 bp, Triticum aestivum
  Clone ID: PAT_TA_31876
ctccgacctcgcacacccgcgcccctcaggacataactccgccacctacggcacagggaacaaacattacagccgaatttcttttttaatttctcaaactcgtgagcatagtgccgcgaatagaacatatagaacaaaaggagcaaacattacagcagaaattctaacgaaattcggacttgcttggttccagggctagctagcagatgggacagagtgcacaaactgtcaaaggtacatggagaaattaagggaaatacagtaccacatttcaagagttgctccaaatttcatagccctagccccacgttccgccgcttcgcatatgccggagagcatggtcgccgcgcgcgacagtgctcgcccggttctgccgagatggacggcgtggtcggagtgcccgttggtccccggtgtgcgcgactgccgctcccgcaatggcccctgctcccgcgctgttctcccagttagcgtgtccttttgactcttgcagaccgcacgttatccccgagtagacccctgccgccgatcacaactcgactgcctcctggcctgtcgatttcccccctgcgtccagcgatcccttccacggcgacccactagggctcgcgagacaccgcccccgccgcgccgtgtccggccgcgccgatgctagccatcgccgtcgcggttcagcagagggtggccgcggcgaagaagcgggccgcccggtccacgcccgccgccctcgtgattgagcgtgcgccggtcaagcctgccggctagccgaggtagaggagcgggcggcggtccatgctcgccacctcggccttgagcgtgggcgcgtcatgcttgctcctgcgcgcgtcaagcctgctgcccttctctccctcacagccggtcttctctcttctcttgcttgctatggactgcgtgctgcaggtacatggagaaattaagggaaatacagtacgacatttcaagagttgctccaaatttcttagccctagccccacaccccgtggcttagaatatgcctgagagcatggtcgccgcgctcgacagtgcggctccggtgatggcgaaatggacgacgtggtcggagtgcccgttgtccccggtcagcgcgactgccgctccggcgatcgcccctgctatcgcactgttcttccagtcatggtgtcctctggcctctctcagaccgtacgttatcccagagtacactccggctgccaatccccactgaatggcctccttgcttgccgatttaaccactgcgtcgagcgacttctggccgtcatcccctctggcgctggagaaatggctcctcttggcggtgctgtccagccccgtcgagtctcctcccatcccttcgacggcgacgaagtaggcctcccgcgacaccgccctcgccgctccgactccggcggcgcggatgaagctgtcggcgacgcggttgaggagcgggtggccgaggtcgaggagcgggcgccggtccatgctcgccacctcgtccttgagcgtgcgcgcgtcaagcctgctgcccatctctcccacgtagctggtctgctctcttctcttgcttgctatgtactgcgtgctggactgcgagtctgc

SEQ ID NO: 31877 - DNA, 848 bp, Triticum aestivum
  Clone ID: PAT_TA_31877
aacaggaatcaatatacatttgatttgagactgccgaagcacacttatcacgggctcttttgctagcactagcagaccctaaagtgatagtgagggaagaatggacagaaaagctgtggcaaattaagcagcaatcctgtgcttatacaaccattcttttgtttttcatttccaccttccttttgatcagtacaagcttctcactctgtttttcgccttattccaaagaaatcatcgatcaaaataaaaataaaaaacatgaggaagcacaagcataccatataattaaatcactcctccacacatagattaactttattgtataagcatttgatcatgctgcaggtgacgcgaatcactaaaggaagcaagtggcgaccttggcgtagaaacagaaagcgaatgtaggagcagtgtataccatgaagctgtcgtagcagttccacgcaacttctccaaagcatggcaccaggtcgtcgctgatctctaggccgacgcagtggtacttgttgtcgtccttagccttggccaagcagttggccgtcatgatgccggcgacgaagcatgcctggaagctggcctccccggtgaccgagttgctggcgaagcacaccactgcggtgttcacgacgcaggccagccggtgattcttcaggcttatgccgacacagagcttatcctctgtcagcagtgccgtcggcgccggcgccggcgccagcgtcggtgtggcggagacgccgactccgcatatcagcgctaggaccacgaggggctggatcatggccatcgagcttgcttggtttcttcctcttcttcttttttgtttgtttcggacgcgtggagtcgac

SEQ ID NO: 31878 - DNA, 803 bp, Triticum aestivum
  unsure (1)..(803): unsure at all n locations
  Clone ID: PAT_TA_31878
ccgaggttttttttttttntgcagaatgtgcatagtattcttttaaaaccttcttttttttgcacaatggagtgggcacacccatgtgcaaaaggtcactacatccccatgttcccagcacatataagcatgtgcacctttgttctcttcttccaagtaaccagcagcacagcacagcatcatctctatgtcttccgactctgatgaatatcatcttttgtattgggaactttacagaagcaataccctcaagtctcaaccctgaactacaacaccacccgaccgagaggagcgtcaaacgcactgtatcaactccagcacacaaagctccacccccacacccaagaacacgcacccacgaccgatctgagactggtaaaaccagcagaaaacccccacccccgctactacatctactaagcagcagctatggcggcatgcaccgatgaaactggtacacgcaacgaatgctgggcgccccttaattttcacagaaatgtacatgagccttccttcttgggttcattggatgacgcacacgcacgtggagatgccttcgtcggccatcgagtctccggattcgcttggctcgaactccttgacctcggtgagatccttccccagcaaatcgagccacttcacattgcccttgggggcgcagacgccgtcctcgccgtaaatggccttcttgaggttgctcttgggtagtggcggtggtaccatcttgtcgccgagctcgtgctccttgaagaattcatgcttggggggcggcgcccgcgcgacaacctgaatcttgtggacct

SEQ ID NO: 31879 - DNA, 694 bp, Triticum aestivum
  Clone ID: PAT_TA_31879
tttttttcttttttttgcagccctgccgccgtcgacgacacgcccgccagacacgcccgttacatctcaagcacgtactagtatcccaagcaaaaccgatatatctcaagcacgtagtaattgatctctagctagaaagtacttttatgcacactgatagtaccacatacggagattttgcaaaaaaagaaaagaaaaagaagaggtactacacacggagagcatccgatgagctaggagctagctgtagtctgaactccagagcggcctgaaccacatggagtggacggcgggctggaaagtcaccatgaccagcagcaccgccaccatcgccgccacgccccacggtgaggcccccgatgactgcgacgaggccaaggcaggctgggcgttcacggcgtggcggcggagcgcccagcgggtgcggcgacgccagtacccgagcgcggcgaagaggaggaaggcggccatggcggcgagcggcgcggcgaagacccgcgcgccgatctcggcccggcgctcgacagcccggtagtcgacgtaggaggaggttgccaggaaggagaccacgatggcgaagaaggccagcaggcgccacggcggcagcgtcgccgacgacagcgcccgcgccgcccagccgtgcctccagccccgccgcgagtgctgcgcccacgacgacatcgcgctagcttag

SEQ ID NO: 31880 - DNA, 1028 bp, Triticum aestivum
  Clone ID: PAT_TA_31880
tgatcatatgtacaacatttacagagtagtttctggcacaggatagatgacctgtttgacgtaccaacgaatggcagactatacagttgcttgactgacacccaggaattagcaaacaagcagattacctagagacactgaagctccaagggtcacgaccaacagggagggacacaatgtgtgtcaccacataaaaagaccaagactattttccgatcctatcaaacagtgtggatagagctttatagagagtggcggcggcaggtggcttgggcagtgaaccaagaaggatttctgatgccttgactggaccgccatagaatcgggcattttcgttgtttcgggttgatactacacttccattgagtgcgcatcccacaaaggcgcctttgctacaactgtatgtgtaacaggcagcataaccaccatcaccggcacggaaatcagcctctgccacccgtccaagatgaccagcagcagcaccgaaaccagccccaagtgacagatgtgcatttccactgaatgttttaattgcatcagtgttcctcagaacaatgatgaagtcagctaactcagcgccagcctgagctccatatccaacaccacaagtagatatggccgaaggaggagaccaagaaccatcagctctgcgagcaataaccagcccagtaccaattttgtacgtgaccatcattccaacctttaccacagtaattatagcaagtccctttgcttgtctaagaattgaatcaggaatggacttctctggattcagctttccaaccttacaatacccatgtatggaatttgcagccttgtatatctcatactccatcgttggtgcccatgggaggtttaaccatgacctcaaggtgctcaggtctgtcaaatctttagtcggaagttgacaagcacgacttatctggttcatcaagtaaggctgaatacactcaagacgtactccacaaacatcacagatcctcaaagggtctcggacgcgtgggtcgacccggaaattccggaccggt

SEQ ID NO: 31881 - DNA, 767 bp, Triticum aestivum
  Clone ID: PAT_TA_31881
ttttctaggcgtggggaacaacaccaaccagccagccaccaagctgcctttcataccaaccgagcttacaactttagtacaaacgaggttgcacagccctgtacacgtatgttacaccaacacgaggaaaccctatcattttgatcttcacatcaaaacgcactagctgttccttggggaaaaaagggggtaagccgatcatacacacacacaaacaaattacaaacacccacccactaacacaggcgcacggtcaacaagctcaggtcaggcagcagcgatgtcactggcactggcagcatggccctggttctcaccggctgcctcgtccacggccatgttgtccacgggctctcgctcctgctccaccgccacggcacgcccctcgtcggagggccgctcttcgctctccatcggagcgggctgagacgggactgtggccgtgccggagctgctcccctgctccgccgccaggctcacgaggccgttctgcttcatgtagctctccagggggcggttcgcgacctcgaggaggctgaccatgctcacccggggctggccgccgtgctgctgctcctcctcgcggctggcggggtggaagttgaggtctatgtggcccttgttcgcgtcggccttgtcgaacatgatcacgtcgcagtcccgcgcggtgtccaccgtcccctcggttgcttccttcgggctcgtccctgcccacccaagcgatcctcttgctcgcctcggcctcctctcgctccgactgacattga

SEQ ID NO: 31882 - DNA, 406 bp, Triticum aestivum
  Clone ID: PAT_TA_31882
gtgcctccgttgctcaaccgcatttgcaggtaccagagacgcaccgcgtccacgagatggccgtgccggtgtggttcttctcgctggcctcgcttggcgctctccatgtcgttgccatcagcttccgcctcatcgcctacttctcggtcttcctccgcaggcccattgacctgcgccgccggtacggcgcctgggccgtcgtcaccggcccaacgtccggcatcgggcgctccatggccctggagctcgcggagaggggcctcaacctcgtcctcgtcggccgcgacccgcccaagctcggggacatctccgagacgatctccagggctcacgccgccgtgcagaccaagaccgtgctgttcgatttctccctcgtctccaccgcgcaaggcgacgaggcgatgcg

SEQ ID NO: 31883 - DNA, 1297 bp, Triticum aestivum
  Clone ID: PAT_TA_31883
atgagcacacttccggttgtgccttcgttgcacaggcgcatttgcaggtaccagagacgcaccgcgtccgcgagatggccgtgccggtgtggttcttctcgttggccttgcttggcgctctccatgtcgttgccatcagcttccgcctcatcgcctacttctcggtctccctccgcaggcaggtgccaccccgccaccggtacggcgcctgggctatcgtcatcggggcaacgtccggcgccaggcgctccatggcggcggggagccctccccgtcggccacctccatcctatacaggcagccgcaccacgctcgcacgtactcacgtacgtcggcaccaagcagccagcaacaaataataagtaaataaaccagccatggggcgatcaacccacgcgctgctcctcctagtcgtcgccgtcgcagcggcgacctgctcctcggctgcggcacaggcgccacccgaggtggccgcagtctgcaagagcaccccgtttgcggatctgtgcagcgccacggccgggaagcaggcggggcactacaccaccgtggacgcggttgcggtgctgaacatgcaggtcgacgccttcgcgaagcgcacgtcggcggcgaaggagcacgtgacccagatgtccgccgaggcgagccccgcggccaagaaggcgctggagttgtgcgatagcctctactcggacgtggaggacaacctcggtgcggcacgccgcgccttaggcttcaaggacgcctcaacggtccgagccatgatgagcatggcggcccaggacatgcagaactgcgacgaggagtttaggaaagccggcgagaagaaccccatggaccgcttcgaccagtcgctcctaaagatatctgagaactgccgcgccctctcaaacatgatctgatctcatagagctcacatctcgtctcatcggatcggacacgcgcgtagacggatcgatcggtcgacctgacctggattgccgctgccgttaacgctgcacacattgttgattttccacatgtttttctactattttctttctattcgtctcatctttttgtttaccggtgagatgtgtatattacccggtcttgggaaggggaggtgaattgaaatctgtttctgaattctgataccgctgttatatatgtacatatgtggatctttttcttcttctttttttggataaaagttcacaaatagccccatttctttgatgaaaatgttagtcatgtgtttaagccatgttcaacgtgtttaacccatgtttcctacttagggaaaattttaagtggg

SEQ ID NO: 31884 - DNA, 654 bp, Triticum aestivum
  Clone ID: PAT_TA_31884
gaaagaacatgacatgccaagacatcgaacacaaaatgcatggagcgacaagtgtccatgttatcagtggtttctaataactttttatgccttttcatgactttagtagttgaatgccatgacttttggttcagtacacgtgtatttgcatccaaaaaattgaccttaaatattcgccccggctagcttcaattcctgggtccgccactgtctgttaaggtgggttacagcttatattccaaaaagcaccaagaatatgacacttatgaggtagtgtatgagaggcttccacattactgcttcccatgtgtcttgctgggacactcttctatggaatgcccaacaccaggtgagagggatgctgggtaagctccctgtgtgtaaatgatgataagaagaagagcttttcaggttccagatcaacgcaaagttcacaatcaagtggcagatgttcacactgtgatgacgaaaaagggggatcccacccctctgctaaagccaatattgtcgaaccaaaagctgatgaattgcaagagagaaacgtagtcacgtctcccatgaagctgaagatgcagaatcaaaaaataaataataaggtggaacagggcacggcgagtaaggaaccttttacttcagtgtctacagatatacgtg

SEQ ID NO: 31885 - DNA, 1333 bp, Triticum aestivum
  unsure (1)..(1333): unsure at all n locations
  Clone ID: PAT_TA_31885
gtagtagaagttacctaagtgcagtaaaagataaaaggtaaggtctgccagggcaacaacacaacatgtcaaaaagaaaagaaaaaaaaagtcaaatatgaccactaaaaggtgagtagtcaactgctagcaggtgaagcaaactaccggaaaacatcctaaagaccatccagcatactggcagccggtccatgtcgtcttgctgtaaaaaaatgctactccctctgtcccataatataataaataaataaacaatgggtaattcttagcaaagcgaaagcacaggttacaaaaccaaatgccggtacatcgacatcttcgtgacatttgcacattgtgagaagagacctagataatgtaaatgcacgctacaaaccaaaatttggctgcatcaccctgtataaaccatttgtgttatattagatcagacctgttttaacttagacaattgcttcacaagtaaaagtggctcatcgtgggcagaaggaagatccgttgactcaaacatatcttccttttagcgcaaagtttacgcctacttgtcataacctgcatggggtttcccgtgattggtcagatactaccaggcatagttctcttaagaacttgctttcccaggtatatatccaagtaaccctgaacgagttgttctacactctgagattcctctgcaaaaaacctaaagatggctgcttctgtacgaggcacctttgggcccaatgtcaaggccactttatccacggctttcctcgctataattttgtggacctcacgagataagaggccttcttcccacagaggccttaagatattttttatgaattcgccgagggcacatttgaatgctgtgatactttcttcatcagtacttagttttggtgggccactatgtgaatcacagatccgcgaaccatttgcaatctcactttcgtaaattcctccactaaattcattcttttcagattgtttaaactgttttccctgcacagcagtcccactaaaggctgaaaagcactgacttgtatcctccccagttgcctgattaatcgcttcctttgcactatgtgaatcagagatccgtgacccatttgcaaccgttcttgtgcaacttcctccgacaaattcattcttctctggttgcttaaactgtttttcctgcacagcagtcccactaaaggctgaaaagctctgactagtatcctgcccagttgcctgattaaccgctccctctgcactatgtgaatcagagatccgtgaaccatttgcaaccgttcttgcacaaattcctccgacaaattcattcttctnnnggttgcttaaaccggacgcgtgg

SEQ ID NO: 31886 - DNA, 1563 bp, Triticum aestivum
  Clone ID: PAT_TA_31886
gttttttttttgttcacaaattaagggctattattgaaaatggaatgaacaatctcgttatgtacaagttcttgtaagatagaaaccccaacttcacatcactagggctcccatacacgcagggacataattcgacctccctttcatcctttccttggtaaacttatcatgaatgcttataaatagtggagtactacagaagagaggccaagaactccagatggagaaatgaaagaattaacagttacacacacacgggaaagacttcagcgattcaaggagctcctcctccaggaccatcaccagtgatcatcttagatatcatcactgacataagtccgggagtagctcgctatcttcacaatcgtctttgctatttacaactccgagctgggcctccgtgttcaggctctcagtgttatttacaagctcggcttggtggttaacgttcaagttcttatttacagcagcagcagcagcactatcttctactaaatattggccaacagtgttatcatcagaactatttgggacttcaggacatgcaatccaaagaactgcaactgcttctggaagagagtctaccatctgctgaaaatccagacttatgtcgctgcagcaacccacttctgttactatcaggtgtgttcacccttgtctgttgaaacctagatgtgtgaagtgagtcaaagaccggtatgagattctttgaccttgattccacattataactctggactttttcaatttcgatttcccctgaaatgttatcagtggcatatgcttctaaggtgtcgctccctattacttgaaagtgcaccccggatcttgaccagactggaatttgcacaacatgtgtctgcagttcactctcagaaatataataattatgattttcatcagcgctaagcttcagcctttcagtagcagcaccattggacggatagatactagttcctttcctgaccactttctggaaaattttattattttcaccactgtcaaaatcattatataaattactctcagcagtatctcttctatttctcttttgacaaacatcccacttctgaagaggttcaataacaaatcttgtgtcagtttctctttgagatccataagaagtggcatctgaaggataatcaattccagaatctggttcagctgagtgatggagaacatactgtatgatactcccagacggagaaaaaactagtaaataatacttcatacaaagcaaactgtcatctgaattaacaccacccttgcagttgtgaaatgttgaagcaatagcaccagaaattggactggaaacacctgttgcaaatgctgcagcaccatggacagcacccttcaacaagttactcccatttcttattctactaacaacagatagtgcgacaggggggccagatagagaaagcatcttctgactaaggctcaaagaggggcttgcgttttgagaccaatgagtggcatgcttaactgatgaatccacaacataattattttctgcaaggttgttatcactatagcgaaagcttgtggatccactcctcgtgc

SEQ ID NO: 31887 - DNA, 302 bp, Triticum aestivum
  Clone ID: PAT_TA_31887
aaataaataatgacagtgtctttatttccgaattgcgcatcagccggcgcattagcgggatcacttggagctggcccaaaggtgatcaaagtgtatatgggaagacaaaggaggatgggccggcgtgccaacgtggctgaagaagaatatgtattttatttgcacgcttccatgcataagtccattgaagtatagcagatgttgcttagtaaacaacagtcgcaatggaatgcagtgcggcaattccagcccctatgcgcgcataatccatgtggcaaatgaatcttcttgctgactttgtc

SEQ ID NO: 31888 - DNA, 527 bp, Triticum aestivum
  unsure (1)..(527): unsure at all n locations
  Clone ID: PAT_TA_31888
tttttttntnttttttttcttcttgggggcaggcttgggttccgccgtttgcttggagtcgagcgtaggcttgatgacttcaagggccttgctcacctcggaccacgacgccggcgcgagctcgtagccgtcgagcttgtcgaggatagggagcgccacgccggcggtgggcttcttggcgtcctgctcttcctcctcctcttcctcttcatcgtcgtcttcgtattcgtcatcactctggtctgcctcgacgtcgccgttggcggcggcggcgttctgcttggcgatgagccacggctcctcgacggcgctgatgtcgaacagggagacgctggtggccggagggcggtaggcgacctcggccaccgccacttccttggagcccgagcaacccatggtgcgcctggtgccttggagctaggcgaggtgagagacttggctggcgagctccaggaacggcttttgtggctgtggagggaaggcgcggacgcgtgggcggacgcgtgggaagctgtggagggagtggg

SEQ ID NO: 31889 - DNA, 920 bp, Triticum aestivum
  unsure (1)..(920): unsure at all n locations
  Clone ID: PAT_TA_31889
nnttttacttttgctgtcancccggagtacagctttgccgtcagcctagtaaatcacagacggcaaagaaaggggtaaattaaaaaaagaacagcagcgctgctcccgagcgatgtggtcaacgcatacgaatgccctatctaatctttcttcttcgttttaacagggaaaggcccagccgggccaagggcctttcattcaacattagtgcagtacatcccaccaaaaacgaacattagtggagtacaaaatgcaaacaggaccccgagagaactaaagttacaaaatagagctagcaattaacacaaaggaccctaaaacataaaactaaaaagcaatccggcccttcttctccactgtagtaccctgctctccccgccatccagcccaacccccgccgcggcgccgcccggcctgctcgtcgcgccgccgccaggccctgcttagccgcgctgccgtccggcccagccgccctcgggagctgattcgcttcggcgccacggggaggcacacgagcgagttcggggatgagcggtgcgtgaccggcggagctcgcgaggcggagcgcccagctggcgggtgaggaggagctcgcgttgtcgacgggctcgggtgcgcggccggaggagctggggtgtgctcggccggagggtgaggacgaactcgcgaggtggcggagcttcacgctgtgacgacgatggagatgcgctggacgcggaggacggacgggcacgcaggcgctggccgcggcggacggacgggcacgcaggcgctggccgcggcgtgccgctgctcggcgacgggcgggtgctgggatcagcgtgcggctgcttgggagcaccggacgggcaggctggtgttggccggcgagatgcgactgctctgaggaggagagaggagggagctggccagcggcttgc

SEQ ID NO: 31890 - DNA, 628 bp, Triticum aestivum
  unsure (1)..(628): unsure at all n locations
  Clone ID: PAT_TA_31890
ttcgacgtgaacacgcgacgacgacgacatatataaccaggcacagaacacaccgccattgatacaggttcgtagttcgtgtatgatattgtccatccagttctttccaagactcccttcctagctagaggccagcgttcggcgcgagccagccaaggcgcggcggggcgcagccgcagagccatgttaaaaggggcgccggcgacgcgccgccgtgcaggaccagagccggcgggtggtcttacggcgcagaacccaggaggctctcgtggctgccctggcctccccaggccctctccttccacagcagatcgacctcctcgaagctcaggcccttggtctccggcacgtacagggccacgaagatgaaggccatcacggcgatcccggcgatgatcaggaacgtggcgacgaagatcaaggccatcacggctatcccggcgatgattatgaatgttgggccggtgccgacccaccccacgatcgagaggaacgtctgcgccacgatcaggttggagatccagttgacggtggccgacatgccgccgcacatgccgcggtaggcctcggggtagatctccgctcgacggaacaaccanacgcntggnaggacggtnaaaggtcccna

SEQ ID NO: 31891 - DNA, 380 bp, Triticum aestivum
  Clone ID: PAT_TA_31891
gcacctgcccgctctgccgcgccccgctcatgcccggcgacgcgctctcggccgacctcccggacgcctccgactacgacatgtcctacccgtccccgctgccgctggcggccacccccaccctgctgcgcccgcacgagctgctgctcaacggcctgggcggcttccagtgaggaggctggtgagctctgaagccagcgcgctgacctgtacataggcgccacggagaaacggagaagaccgccggagatcaatcattctaaacaaagagtagagtactcctaggagctatgtaggccgattccatcttccaagcctgtggagctgtggatctttttttgcagattgaaagcaaacttgtcgagctaaaaaaaaaaaaa

SEQ ID NO: 31892 - DNA, 869 bp, Triticum aestivum
  Clone ID: PAT_TA_31892
cgctcgtctctcacccgcctctccctctctctcagccaccccttgctctctcactgctgggctagggtaccggagcatcggcccctctcacctctgttaggcggcggcgggcgcggcatcggcttgcaggcaaccgtgtcggcggcggtttggcagaaggcgacagcaagcggcagggagagagacctgcagcaagcatcgaccctccttctgatctttaaaccaggcagcagccatgtccttttgtggcgacccaacggagagcgactgccaggtgcagcagaagctgcagatctcctccgccatgacaatccagaagtgcttcagaagttggaaggcaaagcgtttggaagcccacgaacaattttattctggttttggtgaaattctcaagaatgctgattggaagcgctttggtattgaatctgaaccgtttggccagttcttatccatctttgacccaaagaaagagagcgatgttgatatcctcgtcaaaatctttgattggtatgccaaatgtgaggacaggagcacacaactatggatttgaacttgataccggaagaggaggatgaagctcaacaagaggaacaagctcagcaaggtgaagcttttgatttgaacttgatcccggaagaggaagatgaagctcaagaagaagaacaagctcagccaggtgaagctattgatttgaacttgatcccagaagaggaggatgaagacattgagtcatgtgtcatgtgtatgccttgtgtatatgtgtatgtcatgtgtatgtcttgttggatttatttgaaaagaaaggaaaaggaaaagttggaattatttgaattaagttggatttagttgaattaagttggaattatttg

SEQ ID NO: 31893 - DNA, 990 bp, Triticum aestivum
  Clone ID: PAT_TA_31893
cccacgcgtccgttttttttttttttttgtccaatcacgagttttaactagtggagaatgagcattgtttggagtacagtagctggcagcacgttagccagatcagtatttctggaacatatgaagctctggcagagagagttttacttgacaaatcaatgctagtaagctacgtactagaaagaagtacaggaagatagtatgtcacaaaggagaagcacgtgcatacagagagatgtgcatccactcaattgcgagttccacaagcaaatgccagcagcctgtaccactaacaaactacgagagctgatgcactgcagaaaagtcaggaaagagagatcatgaacgccagctcactagcaactgctgcattagagcagccaaaacggcgccggccgagatattgaccacgttgacaacatcattgttcagccattcaaaaccttccttatcctgcagtgttgcgccaatcaaactctcgccaaaatttgcaatctgggatgcaagaacacatagcacactctgtggtagatttacctgccccagaatataaccaatccctgccagaaacatcgatgctaaaattccagcaagagtgccctcaacactgactgcaccttctgtacctcttggaacaaccttaaatgttgtcactaggtacgttgttcttccatatgccttccctatttcactggaaactgtatcactgagtttagtacagaaacttgcaacaaagccaagtgtccagagttccgcgaatgctcccccgcccacattatatactgataggagagcacagacacaaccagcagcactagaaccaataacactaccaggacctctccttcctccttttttctcagccactcccaaagcttctttttgttttatctttaacttggtcactgctgtgcccaccacgaagtaggcggcgacgaggaggtaagcccgggccccaaatgcgcgccaggtgagggtgccgaggacgta

SEQ ID NO: 31894 - DNA, 843 bp, Triticum aestivum
  Clone ID: PAT_TA_31894
cccacgcgtccgcgtttctgctccggtgctccccctgggctgaacgcggggtggaaaaacacatcgacggccaggatgaaccaaaaacggttcataacgaggggcacgatcgtctttgttgcccccgcgtatagccgtcgaggagccctaggaggcccgtacgggcccgcttagatcgtatgcctggccgtatacgtatgcccgtccgtatacatatttgtttgtattacggcggcctttcgtgcacgcgtgaagccgcccgcacgtggggcagcacgtgtcacgggtagttgccaaaactgtcgcatcatataaatgtggacggcaaccacctccggccgcatcacccaccatttccccccgccgcatcgtctccctctctccactctccactccccactccctctcctctccaacctcctcgtctccctcaccgcatcctctccatcgccatggcagacgcaggaggcaagcgccccgattggggcacagatctggtggagcaggcacggcaggtcgatgcgggcacctttgtgagggggcgtgccagcgtccagcgtggtgctccctccgctggagatatggagaaggcgggggcgggccgcagcggcgcggtctagctagatgcgcccgctctggcgaactccggcgaggcacagaaggtggaggcgggctctggcgaggcgcagaaggtgggggcgggctctggcgaggcgcacaaggtggagaaggtggaggccggctccggcgaggaggaagcggagcagaaggtatctgcggctaacttttagttggtagtttttagattgtgtggtttgtggccagaactttgttggttagatt

SEQ ID NO: 31895 - DNA, 795 bp, Triticum aestivum
  unsure (1)..(795): unsure at all n locations
  Clone ID: PAT_TA_31895
cgtccgcccacgcgtccgagccaacccccagcgcagacccacccaacccaacaacgcaccccaaacgaatcgcccctcgattgttcgctcccgagcaccgacccaaccctagatctcgcagcagcagcgcaaagccgacgccatggccaagccctggggcggcgtcggcgcctgggcgctcgacgctgagcgcgaggacgaggagcgcgagcacgccgcggccttccccgcgccggagccgcccgccgccgcgggcggcgccgccagcttccccagcctcaaggaggccgtcgtcgccggcggcggcaagcagaagaagaagaagggcaccaccctctcgctctccgagttcaccacctacggcgcggccggcgcgcctcgccgcgtcgcccccgccgagcccaagggcctcaccccgcaggagatgatgatgctccccaccggcccgagggagcgctcggaggacgagctggaccgatcccgcgggttccgctcctatggcggcgacagggagccgcgcggtggcggattcgacgacgaacgccgctccagcagggattcggatttcgatatgccctcgcgtgccgacgagtcggacaactggggcaagaataagagtttctcgccggctcctaccgactctggccggcgtgataggctcagtggcccgtctccgctcggccgctctgacgacatcgacaactggtcgcgcgacaagaagccactcccgtcgcgctaccctagccttggaaccggtggcggnttccgtgaatcatctggcggtggtttccgtga

SEQ ID NO: 31896 - DNA, 2182 bp, Triticum aestivum
  Clone ID: PAT_TA_31896
ttgggatccctttgctctttctttgccctactttagggtccaagcgcccgcccacccctgcgaaggcgagcgctcgatcaatcgtggcgcccccgggcaccgacccaaccctagatctcgcagcagcaagcgcgaagccgacgccatcaccaagacctggggccgcgtgttcgctccggagcaccgacccgaccctagatctcgcagcagcgagccaaaggcgacgctatcccccagcgctcgggccgccgcggcggcggggggctcgacgctgagccggagcaagaggagcgcaggcgcggcgcgcacttccccgcagaagaagcccccgccgccgcgggcggtctcccagagcaccccctaccgcgcggcggccgcgcctcgcggcgtcggcacgcccaagcccaagggggtcaccccgcagtcgatgctcatgcttcaccccggcacgggggagcgcgcgcgcgactcgctcgacggaccccccggctgccggatcctctgagggcgatcagccgcgcagcggtgatgaagatgatgcccaccgcgcgtgaagcaagggctcggaacgccgcaggtggtaccgctgccgccgggtcggatcattgggccacgaccaagagccgctcggtggcggattccaactcgaacgccgctgctgcagggatttggatttcgatatgccctcgcgtgccgacgagtcggacaatggtgcgcgcgacaagaagccactgcccgtcgcgctaccccagccttggaaccggcggcggtttccgtgaatcatctggcggtggtttccgtgaatcatctggtggtggtttccgcgaatcatctggtggtggtttccgtgactcaccggggccatctgactctgatcgctgggtccgtggtgctgtccctgcccctatgaccaacaatggtgataggccgcgcctcaacctcaatccaccaaagcgtgatccctcagccactcctgtgccagctgctgaggtcgcacgcagcagaccaagccccttcggggctgctaagccccgtgaggaggtgctggctgagaagggccttgattggaggaagatggagggggagaccaccaaagcgtgatccctcagccacacctgtgccagctgctgaggtcgcacgcagcataccaagccccttcggggctgctaagccccgtgaggaggtgctggctgagaagggccttgattggaggaagatggagggggagattgagaagaaaaccagtcggcctactagctcgcactccagtaggccgaacagcgcacattcctcccgccctggaagccctggatcgcaggtcatcgccgggaggcgtgagggagcaccaagagcacggccaaaggtaaatccattcggtgatgccaaaccacgggaagtggtgctgcaggagaaaggaaaagactggaggaaaattgaccttgagctggagcatcgggcagttaataggccggagtcagaagaagagaagaatttgaaagaagaaatcaaccttctcaaggtggacttgaaggaaattgaggccattgcaggtgatggttctgagcaagcaaaagaagtgtctgagaagatatctcagatggaaaagcagcttgatctgcttacagttgagttggatgacaaaattcgatttgggcaaagacctagttctggagctggaagggctgcagcatttccacccgctagtgaggaaccacatgttgcagtggcccacatggacagaccgcgttcccgtggtggtgtggaaacatatccgaaaccagttgaagaaaggtggggatttcatggtagcagggaaagaggctcttttggtggaggcggaagttcagacaggtcatcaacaaggcagggatggtgaagaggagtttgaagaatcaactgtcaaggaaacttctgatcgctgtcgtttttggggttttgaaagtgggaaagaataagtcatttaatttttgtcgtgcttgactctcattttgttcgaggtagaagattggagttaatctttgtcaacaaaggtttactccgcgtgaagctattggttaccacctttgctgtaggtttctttttgcttctttcttttgccatttcgtgtcaaaacaaaacttgtcaaaaaattatgctaactgactattgctcttgagtcatggattcttgtgttcagctgttt

SEQ ID NO: 31897 - DNA, 784 bp, Triticum aestivum
  Clone ID: PAT_TA_31897
gcccgtctccactctccaagaccccaacccaatccgtagacggcgaacatgggccgccgccgccgccagccctcctcgccgtcgccggcggcagagcatccgctggaagacgacgacctactgcgcgagatcctcctccgcctacccccacagccgccctacctcctgcgcgcctccctcgtcgccaagcgctggcgacacatcgccatcgaccccaagttcctccaccgcttccgcaccgaccacgggaagcctcccctccttggggacttctccctacaaatcaacggaaaactctcgttcagatccaccctggacctgccctaccgcatccctcccgaccacttctccctacaagtcaacggccgcgagccatggaggttggtcgactgccgccaccgacgcgtgctcctcatcaacagcggagatgcgtcaggtcattgtgtgggaccccttgactggcgaccgctccctcctgtccgctccgccggcgtttgacgacatgcacactgcggcggtgctctgcgctgccggcgagcagggccacgctcatggtgcctgccactcgagcccatttaaagtggtcgtggtagacagctgcgagcacggcgatgaaaccgtcgtcttcgtgagtgtttactcatcagagactggcgtatggagtgatctcctctcaacacgcttgcatctatgggcattgctggtggtaatcgcagcacacttgttggtaacacccttcgctggttgcttctgatgagtaacaacatacttgagtttgatatgg

SEQ ID NO: 31898 - DNA, 488 bp, Triticum aestivum
  Clone ID: PAT_TA_31898
gcagtttgcccagatgacagggttcctgggtcagtaggaatctgccaaactagtgggcgacggcgcatagatgaaattagcacaaagttgctgagcttcaaaatttcgagtgcagtcaaaggaagttacattgccatggactctgctgatgagccgaagcaaggcgacaacctgagtccggctgctttgccagggaactgggagaatgtttctgcagccaaagcagataatcctgcaaagcaaaacagtgactgctcggttgtgaaggactcctcaagctgagggaccaccgatggattgtagattgttaggttagtgttttggttctttcttcaacctttggttgaaggaagtgattatgtctgcgaggaagcaaaatcaatatatataggagtacttgtgagattggctccgtgcttgtcttaaaactatttgctgtttagtttagtgtgttcatgataatagaagagattgatgcaattgtccat

SEQ ID NO: 31899 - DNA, 852 bp, Triticum aestivum
  Clone ID: PAT_TA_31899
gccggccgggtcgggggttcagttcaggcccagcccaagtagggttccgtcttccacgatccacccatccctccctccgccgcgaagcttccagtaccccccacgcgacgcgactccgccgacgccggtctcctctccggcgatctctgtagccctagcgccgtccacgtacgcacctacgtgtagccactcaccggccgcctcttctgtgccctcccgcctgcaacaactcgccggagttaccggtcgtggagatggccacaccgctcatagctggacttgctgtggcagccactgctcttgcgggtagatatggcatccaggcttggcaagcttacaaggcaaggcccatagttccaaggatgcgtaaattctatgaaggtggctttcaagctacaatgaccaaacgggaagctggtctaatcttgggtatcagggaaaatgtccgtcctgataaggtgaaagaggcacacaagagggtcatggttgccaatcacccagatgcaggaggaagccattaccttgcgtcgaagatcaacgaggcaaaagatgttttgctggggaaaactaaaggaggtggttcagccttttgatcatatatcatgcaaaatgtgctcacccaatgaagatactattatttttgcacctccagtctctgcacctagaactagaaggcagacaaaagccttggtgtatcactgaaatttctggagaaagaacattagatgtcttagacgtagcaggttctttgactgtttgacacttccaagaccaaagttgtgctggttaaggaataaatgatgtactacatgaggttggcctgtgttgagttttgcataacatttgttcatc

SEQ ID NO: 31900 - DNA, 706 bp, Triticum aestivum
  Clone ID: PAT_TA_31900
gctcccgacccggcggcaggttgcgtgccagctgacggggccgatggagttcaacgcatcctacttccacgcgttcggcaaccccgacttcgcggcggtcttctccgacggcagcgcgcaggccctccggccgaacccctccgccggcgacggcgaaggagccagcgtgaaggcggagaagggagccgcggtggctaggcccaccgccaccccctcgtccgtcacctttgtcgtccccgacgaggagctgggggaggcgcaccacttcctgaacgagtgctcccgctgccacaaaggcctcaccggcgacatcttcatgtacagaggggacacgccattctgcagcgaggagtgtaggaggaagcaaatcgagacggagaaggcgagacaccggaggaagaagcagaactcccccaaggccgcagccacaatagagctccaccatcaatcaggcctttgccgttgcacggtttcagcatgcatgcgtgcctgtagaagagcgtgagctcctacgtacgtacggacagaggaagagcatatatcctagttacacgtcgggaatggtactgccgcgtactatacacatttttgaatcacgggcccatattcccacttgtttgtaatttctagggaaaattgctcctctttttgtttgcttcctgattcagatcacggccacttgaagaacctatgagccattttcttc

SEQ ID NO: 31901 - DNA, 371 bp, Triticum aestivum
  Clone ID: PAT_TA_31901
cgtcctttttaccccgtttcatccgttcgttaccggtctcatgtagtttttgctttgtttggtatgttcgttgtcggtccctcaaaaaaaaacaatagtgagtgtacatggatttgaaccatggttgcgaggactcatgaaccaactcatccaaccaaagattctgcagaaagagagggagcttaaaccgtctcgccatataggtggcattcatttacgttttggaaacatccatcatgtacgattcgttttttcaaacctcctccctatatgtatgttgtggaccacagttgcgggcgtgttgcgccaagggttggagctccagcggaaagagcgggagatggggctactagaggccgttatccgggaaa

SEQ ID NO: 31902 - DNA, 1185 bp, Triticum aestivum
  unsure (1)..(1185): unsure at all n locations
  Clone ID: PAT_TA_31902
cgcgtccgtcgcctgcgcgcaacctgccagcctcgtactatacataccgcggcccgctgctcccatcaagccattcagcgtccctccacccctccccgcgccgccctcgcctcctgtcagtccaagctcaggacgatggggacgaagaagagcacggtggcgctggctctcctcgtcctcgcgctgtcgtcgctgccccgggcgtgcctcgccgtgacgtcgccgtacgtgcgcccgaggcccagggcgacgctctcattgcgccgggacgccgacgccggcggccagacgccgcagcaggtgcatgtgtcggctgtgggccctgacaagatgagggtgacatggatcaccgacgacgacgcgccggcgatggtggactacggcacggcttcaggccagtaccccttctccgccaccggaaccaccgccgattactcctacctcatgtatcactctgggaacatccacgacgccgtcgtcggcccactgaaacccagcaccacctactactaccggtgcagctccgacccgtcgcgggagttctccttccgaacgcccccgtcaggcctccccttcaccttcgtcatcgccggcgacctgggccagacggagtggaccaactccacgctgcagcacatcgccgccgccgactacgacatgctgctcctccccggcgacctgtcgtacgccgacctggaccagccgcgctgggactcgtacggccgcctggtggagcccctggcgagcgcgcggccctggatggtgaccgagggcaaccacgatgtggagaagatccccctcctcgagcgcgcccccttcaaggcctacaacgcgcggtggcgcatgccgtacgacggcggcgcctcgccgtcggggtccaacctctactactccttcgacgcggccggcggcgcggtgcacgtcatcatgctgggctcgtacaccgactacgacgccggcacggcgcagcacacgtggctgcagggcgacctcgcaggggtcgaccgcgggaagacgccgttcgtggtggcgctggtgcacgcgccgtggtacaacagcaacaaggcgcaccanggggagggcgacggcatgcgcgacgccatggaagcgctgctctacggcgcccgcgtggacgccgtgttcgccgggcacgtgcacgcctacgagaggttcgcgcgcgtgtac

SEQ ID NO: 31903 - DNA, 765 bp, Triticum aestivum
  Clone ID: PAT_TA_31903
gtcggatttggataacgatggtgttgggcatggcatgcatgtttgtgggtctcgagacatatgccccacctttaatagtgcagagacctgtttggcaacgatgatgatggcaagtgaagacgcggtttataatcgacactatgaagttggagctaccatgttgatgaccagccgtgttttcattcaagttgagaggtgcatataatatgatggcaaagctctcccgagagcagttgaacaacggcgttatctgctcctctgctggaaaccatgctcaaggagttgctctttctgcccggaaactgggttgtgatgctgttattgtaatgcctgtgaccacaccagaaatcaagtggcgatcagtggagagattgggtgcgacagtagttctgaagggggactcatatgacgaagctcagtcatatgcaaaattacggtgtgagcaggaaggccgcacattcatacctccttttgaccatcccgacattatcgctggacaaggaactgttggcatggaaattgttcgccaattgcaaggtccattacatgcaatatttgtacctgtgggaggtggtggattaattgctggcattgctgcctatgtgaaacgagtccgccctgaggtcaaaataattggagtagagccctcagatgcaaatgccatggcattgtccttgtgtcatggccagagggtcgtcttaaaacatgttggagggtttgctgatggtgtagctgtcaaagttgtacgggaggagacatttccat

SEQ ID NO: 31904 - DNA, 917 bp, Triticum aestivum
  Clone ID: PAT_TA_31904
attcggcacgaggcctcccgggggtccggcggcgcccccctgccgccgccgccggcgccgccgcgccgggccgtcctggcgcacccggccgtgggggggttcgtgacgcacgccgggtggaactcggtgctggagagcctgtggcacggcctgccaatggcgccgtggcctctctacgcggagcagcacctgaacgccttcgagctcgtcgccgacatgggggtcgccgtgccgctcaaggtggaccggaagcgggacaacttcgtggaggcggcgaacctgggtcggccgggcaagagccggatgcgcgagggcgcgcggcaggcctgggcgtcggcctcccgcaggaggtggaccggaagcgggacaacttcgtggaggcggcggagctggagcgggcggtgaggtgcctgatgggcgaggaggggcggaaggccagggagaaggccgccgagatgagagacgtctgccgcaaggccgtggagaatggcggctcctccgacgctgcgctgcaggggctctcggaggcgctccacgatggcgcggtgcccccgaccatatgaatcgatccttataatggagtatatatttctctcctacagaaaatgataaaataaaatcgaagtgtgtgtggtagaaacaccagagcagaacatctttgatgcagttcaaggctggcgttttgatgtgctccagatagagtgaagatctggaaagtcagtctatgcgcgccgagaaccagtgatggagaagctccttttggtcatttgctattttgtctgcttttgctcataagtttgtattggctagcttgtggttgtgtatcttgctttcacccatttttgtggtttggtagttcgttcctatgttaatataagcagcgtctttttttttctttagaaggagatcgaaaaaaa

SEQ ID NO: 31905 - DNA, 683 bp, Triticum aestivum
  unsure (1)..(683): unsure at all n locations
  Clone ID: PAT_TA_31905
ggcggcggcggcggcaagggaggagaagcgatggcgaggagggatagctgcttggcgcgcatggcggcggcaagggaggagaagcgatggcgaggcgggatagctgcttggcgcgcatcggcgccggagtcgccatcggcggcggcggtcggcggacccgtcggtgctgtgtatgggacttatgccgctatcagattgagggtccctgggctgctgaagatcagacacatcggacaagccaccgttggcagcgctgcggtattcgggcttttcttgggagctgggagtttgatacactgcgggaaaaattactagttctcgtcaagttacctctggttttactaggttttaaaggattgtcttatcttaggtaaaacatttgtttggtcttgaaggaacagtggagttctgctactatttactcggtcctggtttttgatatgtttgccctactgttgatgtggaaataaaatctttcatcatctgtatgagaattaagtggtgaaagcaggattcatgagaaaaaaacgtattgttgtattaaagtcactttgtcgttcatgataaaagattttctcctgcaaaactgcgtaccaatatccttcnnaaccccttccactggtatacaaagcccacntnccttcaaattccaccnangaatgaccccttcggataaccggggt

SEQ ID NO: 31906 - DNA, 673 bp, Triticum aestivum
  unsure (1)..(673): unsure at all n locations
  Clone ID: PAT_TA_31906
catacatccttcttcgaactagctaagctagctaggagacgatccatcgagatcgatcatgcactactacgccgagatggcgttgcttttcctgctgctggccgtgcccaccagtcccggtgcaggcttcgacgttgacccgttgaagcccgggcaggcttggcagcacccgaaagaccacaaggtggtcaacgtcagagaggccaactccatctcaagctacaaggccatgatttcggaggtgcacagcttcggcgtccggaccagcaagtacaaagagaagggcttgccgatcctcgccaggcaaaccagcacgccgaagcctgaccggtggctgatgctggagctccgcggagacggccaggacgagatcatgctcgccatacgaaatgacaacctctacatcgaggccttcgccaacagctccgggaagtggcacaccttcgccaacatcggcaacctcatcccaggggccaccatcctccccttcgacgacagctacagggggctggtgaacgggcacgccaacctcaggacgctggtgcttggcaaggagaccacgctccgggcgctcacgagttggccgtgtacaagcagtcggttggcgccgacaccggctgcgtctnccgcgccctggccataatggctgtcaccttctgtgaagcaacgcgcc

SEQ ID NO: 31907 - DNA, 885 bp, Triticum aestivum
  unsure (1)..(885): unsure at all n locations
  Clone ID: PAT_TA_31907
cgcttcttttttttacccacctcctgcacccaccagagaacaagaattcgatcccattccacccactcgcgccgcgaatttcaccgccgatccggccggcagcaatggcctcctccgccgacgagtccctgccttccctgccgccgatcaagacggcgccttcgccgccctccgacgccgcctcggcctctccgtcgccggcgtcgtccacgcaggagtcggcggcagcggagggcaagacgacggaggccgcagcggcggcggaggagaaggacccgtcgacgccgacgtccaaggagtgccggatcctgctgcccgaggagtgcccagcggcgccgcgcaagccgccggtgccccggctcccggcgctgaagcggaagtcgcggccgacgctgacggcggcgacgacggcgcgggtgtgcctcgccgtcccgcgggacctctccaccgtgttccggtcgatgcccatgcccgtgcccgccgagaagcggatccgggcgtcgtgaggtgctgcgattttgtcggcgtccatgcccgccccggttcggtcgattcatctcccggagaattctcccagtcgcttgcttctttctcctctcctctcctctcttggggtcgtgtccatggtaaattatgagtcgtctcctcatcgtatacataaataaggtgttgttcttagtagtggtatgtgtgcttcctttcgccatcgccatggctccgtgaaattctcatgcaagctgtacaataaggtaggctgttaattactgggcggaagtggttaagggcggaagaaggctgtaagaaaattcagagagatcccggtaattaatcaatcaattaattatgatagccactactaccagaattgtgcaattatccccaana

SEQ ID NO: 31908 - DNA, 728 bp, Triticum aestivum
  unsure (1)..(728): unsure at all n locations
  Clone ID: PAT_TA_31908
cggacgcgtgggggagaggcgcatcggttcaggagatcattgctaaaggggaaaaacctggaagttgtggttattgcaggccgagggaactcacagctggttggctcggaggcgtgcaacgacaggctcttacaacatgatgcggtggcaggttgagaggagcttcgaggaatagcagattgtttgaatggcaaggtgctgctattttactgaccgggagaggaacggaggtggtggtctatgagctgctcatggggctcaactaccgctgccgctacgagcagcactcgactgttccagcagccttggcgaccatggcgattgtgttacaaccgttctcatctgtgtttatcaaagcgaaagaagcctgctgctggcattgctggtgggatactggagatggtggctaaggtgggaaattggttcacgccacttttagttggttgtcaagctgatccagcaagtgcctggttgtcttagctcgttttgtgttcaacacaagtgttggctactcctctgcaggagaggtgcatcggtttaggagatcattgctaaagggggggaaactggaagtcgtggttgttgtaggccagggaacttgcacctggtggcttcggaggcgtgcaatgacaggcccgtacaaaatgatgcngtggcaggctgagaggagcttcgagcagcagcagattgtttgaacggcatgtgctgntgctgcagatgctctactt

SEQ ID NO: 31909 - DNA, 1091 bp, Triticum aestivum
  unsure (1)..(1091): unsure at all n locations
  Clone ID: PAT_TA_31909
gacgcatacggcaccacgcgctgctgcaggcaagggtgctccggccccgggccccacattgtcgcgcacgacatcagcctcgctcacgccgcggtttcggacatctgcagggagaagtccaaggcagggcagaagggtgaggtggcgatgtctttggatgccatgtggtacgtccccgtctcaaactcctcagctgatgtggaggccgccacgagagcacaggagttccggctcgcatggtttgccgatcccttctccttcggggatgacccggccacgatgagatcaagggtcggacaaacgctgccgaggttcatgacgaaggaggccgacctggtgaaggggtcgctggactgcgtggggatcaatcactacaccacattctacacaaaagaagaccattccgctgtcatcaaatacttgctgaatgataccttggcagacagtggatccgtcagcctccccttcagaaatgggaagccaattggagataaggccaattcgatatggttgtacattgtgcctggcagcatgaggaggctcatgaactatgtcaaagatagatacgacaccccaactgtctacatcactgaaaatggaatggatgacagcaacagccccttcatctccctcaagaaggccctcaaagacacaaaaaggatcaactaccacaatgactacctcacaaatctagctgattccataagggaggatggctgcgatgttcgcgggtattttgtgtggtcccttctcgacaactgggagtggaccgctggatacacctcgagatttggcttgtacttcgtagactacaaggacaacctcaagagataccccaagaattcagtccagtggttcaagaatttcttggcaccttcctgatcaaaatttgatagctaatgtagaggtcatgatcacatacgcacttcaatatttttctatgacttctagacagggttcaatagcaatttgtgacttctcatgtatacatcgattgtatataggaaaattgactttttagacataccatattccctaaattaaatggcctctctgggcccttatagataattattgagccggacaagana

SEQ ID NO: 31910 - DNA, 907 bp, Triticum aestivum
  Clone ID: PAT_TA_31910
atggcgggggagttggagctggctggatcttgtgaatctaccatgcatcggtgcttgaagaataataaagatgagcgcgggtatcaagctcaaggtttcaaatgcatgataaagtccatattttcagggaaagcaacttctgtatttgagaatgccatgaagctttatagttcgagcactggttctaggaagtccaaagctctcacatcatctttacaaccagaaagtgaagagatgattaaggaggcttctgcggacatggtggagggaaaaaatgttcctgtcagccaggatcaggcattgctttgtactgatatgtgtgacgaagtgcacaataacggcgggcctcatcatgcagcggttgatagcatgcctggtaaagctgggctggcaaaagattgcagcaacacaggagaagacaaggttggctcagatgttgaggacaaaagcctcagcatcaaccatgctgaggggcatgcttgtgatactgaggagctgcaatttccgagcaacggtgagggagagctcctccctcccaaagctttgcaaccttgttgcagctcggtaagcagtgctcctgacgtttcgaaagagcagttttctggtgtcatttctgatgctacatttgcctctggttctcagtcgtgcgaggatgtcatgccaggttgtagggttaattttaaccggataccttgctctcctgggagtacttaaaacaatttattccatttattgctccaattagtatcccatctccttcggctggtacctcccatgcgtttctttttccccaccatattttgtttctcttggagaattggcagcattctccagtgtgttccttgttctgccgcagtgtgtgtggcagcgatcaataataaaagttgtcttctccatccaaaaaaaa

SEQ ID NO: 31911 - DNA, 889 bp, Triticum aestivum
  Clone ID: PAT_TA_31911
ggccccggagcccggcgagctccggcggtccggccgcgtcgcgggcctcccggagcagcccaactacctcgacggcgcagagcagcgcggctaccgtggagtctacgaggcatacgctgttcggaaagggccgaccgacgaggagagggccggcgccgtcgccaaggcggaggagctccagcgccggatccaccgcacccgctgccccgccttcgtcaagcccatgtcccacagcctcgccatgaatgcagtccagatgctaatccccaaggacttcttcaagtatctcccggagcatgatgaggcggtcgtggtggtggatgaggcggatgacgagttccacatgatgtacaatgcccacagaaagggcaaacactgtcactactacctcgacaaggggtggaaagggtttgccgtcgaccatgaccttgccgatggcgattgcttggttttccacatgacagagagggcaaagttcaaggtctacatttttagagcaaacccagactatgaaagcgaccaaacttctgatgactctgaggatgaagagtaatgaagatgtctgcttccaatacaatgttcgatgggagcaggagctttgtaggagaaggatgtcacgctcttggctgatgttggagttggctaccgcgattttgtgttggttgcgtgtcgcatactcggaccctaccagtgtggcagacctgcattataacataggttagatgggattagtaggtagtgcagaccttgtgttggttgaactaaatggttgtactcggacgagggcccccagtgcattctttccgggctgtcccatttgttttaaaaaaaaagggggggccccggtacccaattcccccctaaaaggagtccttattacgcccgctca

SEQ ID NO: 31912 - DNA, 1086 bp, Triticum aestivum
  Clone ID: PAT_TA_31912
gttctgctccagccaccatggcccgcctcgccaccctcgccatgctcctcctgtccctcctgtccgtcgcaagctgccgcgaccttgaggccatctccgacgaccagggcccacccgtccccgtcctcctcactcgagctgatcaagcggatgctgctgctgaggcgacgacccttccgagcttcccggccccggtcgtcgcatgggacgaggacgagctcccatcccaccgcggtcacctctggttggcgcgcccgcgccatcacggcttcttccaccgccgcggcgcgttctccggcctgggcgaggcccgcgtccaacctgcggccttcttccccacggaggtgctgggagaagagcaagcacactgggaggcggtgctggaggtggtcgcggagcctgaacccgacacccacggcgaggagggtgaggggaacgaggcagtgaaggcgtggaaagtggagatgatggcgagcatgttcgtccacggcgtcggcctccaccaccgtcaccaccacgaccaggacgaggaggacgacgaccacaggcagggcaaggatgaagaaatgaacacgaagctgctcggacgcctccacctccacgcccacgacggcgaccacgaggctgacgaactgggagaactggctaggaggctgggcccggcgaccacgagcacgaggagcttcaaccacggcgaccaccaccttggggcggaggaagcaggcggggtgaaaaagtggttcaagggcctcatgaaccgattctagacatgcatgcataccgcccaggacggctggtttaattactatgaatactgtttgctctgcacctccgcgtttacgtggcgcgtcgatcgggtgttctaccatttcgtttaccttccgattattccacattaccgcttcggttcatgtactggtgtgctactggtgactttgtgagggttgtgaaattgttacgagtagcaatgttacgtgtttcttataactacgtaattactttgtcttcttatgtactcgctctgtttcataatttttattgtgcttgtagttcaaatttaatctaaaaccccggcaagaattatgg

SEQ ID NO: 31913 - DNA, 1159 bp, Triticum aestivum
  unsure (1)..(1159): unsure at all n locations
  Clone ID: PAT_TA_31913
ccggcagaggagacgttctgctccagccaccatcgcccgcctcgcccccctccccctccctctcctttctctcccttccgtccctagctgccgcgagcttccaggacatctccgccgaccacgaggccccgcgcccccccgtccccctctcgcgctgttcaagcggatacgcggttgctgggggacggcccttcccagcttcccggcccccggcctcggatggggcgagggacaactcccatccccccgcggtcacctctggttggcgcgccccccccatcacggcttcttccaccgccgcgccgcgttctccggcctggagtgaggcccgcgtccaacctgcggcctccttccccacgcagccagatcgcggagaagagcaagcacactgggaggcggcgctggaggtggtcgcggagcctgaaccccacacccacacccacggcgagcagaagccgttccatgccgaggagggtgaggggaacgaggcagtgaaggcgtggaaagtggagatgatggcgagcatgttcgtccacggcgtcggcctccaccaccgccaccaccacgaccaggaggagggaggacgacgacgaccataggcaggacaaggatgaagaaatgaacacgaagctgctcggacgcctccacctccacgcctacgacggtgaccacgaggctgacgaactgggagaactggctaggaggctgggcccggcgaccacgagcacgaggagcttcaaccacggcgaccgccaccttgggacggaggaagcaggcggggtgaagaagtggttcaagggcctcatgaatcgattctagacatgcatacataccgcccagggcggatggtttaattactctggttgatgtgtgctctgcacctccgcattaccatttcggtttggctttgggtgttctaccttcgtattattcctcagtacctgttcggtttatgtatgctcatacaatatatatgtggatggtgtgctactggtgacttttacgggttgtgaaattgtacgagtagcaacgttatgtgtttttcataactacataattactttgtctccttatgaccccccccccagtgcgtcgttttgctgtccctggccgcctttttcgaacggcggccgcggcaaaccngggttaccaattaacc

SEQ ID NO: 31914 - DNA, 657 bp, Triticum aestivum
  Clone ID: PAT_TA_31914
agagattggctttggctgtgaaaaacccgtgcctctcacatggctgcttgcctgatcaaacaaaagagatttgacgaagctatcgcacagtgtagcattgtgctgtcagaggacgaaaccaacgtgaaagcactgttcagacgtggaaaagctagagccgagctcggccagacagaatcagcgagggaggactttctgaaagccaagaaacactccccggaagacaaggagatcatgcgggagcttcggtcgctggcggaacaagataaagcgatgtaccagaagcagagggagctatacaaaggtctgtttgggccgaggcctcagcccaaacccaaggccaaaaatttcgccgtcctcttctggcagtggctggtgtcactgctccgttatcttgccaggatgttcacgcgcaagaatgactaggatggctctgatgcaagtgctgctggcggcataccgacacgacaagggaaaacctgatgatacatctatagcttgtggtcaagagacaaccttcctctatatatacttgagtacaattgttttggtatggagttttgccgcgcactttggactggaggggatggtctctttgtgtttatgaagattggaactgcagtttcagtttcagaatgtccttccttccacttggat

SEQ ID NO: 31915 - DNA, 561 bp, Triticum aestivum
  Clone ID: PAT_TA_31915
cagcgagtgatggcagtaactagtaggaattaagaacaaacctattctatgcaataaaaaattacgacatagtaactaagaataaacctacactatacaataaaggatttaaggtatattgcatccactgggcatcgaagtcgccacttgtgatcataaagcgcaacgaagaagcacattacaaaaactgggcaccgttgcagcgtaacaaaataatactgaaccgagaccacttccaagctagttcaagaaaggttagccttgcgcgggaactgctgcgcaagctgctgagcaaggctgtgagaccggcctagcatgtcggtcatagcttccaggtgtagctgtttagcgttgaggttctcattggtgttctccgcaatctttcttagagataggacttcaagtcaaagttgagttgcagaatgcctttctgctagaacttgggactgaagaagtcgaactgattcagacaacaaattctgtgagcttgtctgactgctagtctcaagtaacttgaacactgcaacaggacaagactttggggttgtctcgctatcttca

SEQ ID NO: 31916 - DNA, 1524 bp, Triticum aestivum
  Clone ID: PAT_TA_31916
gattccgctcaaggcaaggcaggcaggagctagctcggggacagcgtcgccgggagagctcgatcgctgcaccactacatcactagagatagcccatggaggagatcggccaccacttcgggctgggagccaccgcccacggccagcaccacagccagctcccatggggctcttcgccgctcagcgccgtcatcgcgccgcccccacagcaacagcagcagcagcagtccgccggctatctggcgcacagccctctctccctgaacacggcgccgcccagtggaagccacggcggcggcaccgggtgtagcaacccggtgctgcagctggccaacggcagcctcctggaggcgtgcgccaaggcggccaaggagccgtcgtcgtcgtcctacgccgccgacgtcgaggccatcaaggccaagatcatctcccacccccactactcctccctcctcgccgcctacctcgactgccagaaggtgggggcgccgccggaggtgttggcgaggctgacggcggtggcgcaggacctggagctgagacagcgcacggcgctcggcagcctcggcaccgcgacggagccggagttggaccagttcatggaggcgtaccatgagatgctggtgaagtaccgggaggagctgacgaggccgctgcaggaggccatggagttcctgaggagggtggagacgcaactcaactccctctccatctccggcagatcgctgcgcaatatcctttcctccggctcttccgaggaagatcaagaaggcagcggaggggagacagagcttcctgagattgatgcccacggcgtggaccaggagctgaagcaccatctcctgaagaagtacagtgggtacctgagctccctgaagcaagagctgtcaaagaagaagaagaaaggaaagctcccgaaggatgctcgccagcagctcctcagctggtgggagatgcactacaagtggccttatccctcggagagccagaaggtggcgctggcagagtcgacgggcctggacctgaagcagatcaacaactggttcatcaaccagaggaagcgccactggaagccgtcggacgagatgcagttcgtgatgatggacgcgtaccacccacctaacgccgccttctacatggacggccacttcgtcaacgacagcgggctctacaggttcggctagctcggccaggcctcgtctcttaccggtgaccttggtcggcgccaatggcggcgaccgagtgccttatgctgaagcactaggttaccgacgaccgaagctagttaagttagcgtttgtgtgccgcatgcgagctggaaggaggccgcatgcttattttgtttatcatcactacttatacctacctacctatcatttatgcatggactcgatcgcttttgtgtggttttgtagcgattgacgcgaccatatggacaaccgcctgtttgctgcgacatgccttgctacgtgcatgcttgaataatttgccttctctctaaaaaaaaaaaaaaaaaaaaaaaaa

SEQ ID NO: 31917 - DNA, 578 bp, Triticum aestivum
  Clone ID: PAT_TA_31917
gcgagcaagagcaagagcaagagcaagagcagcctttctccgtgaggtccattgcaatccagaaaccttcaagtatgggcagatctgcaatttctcaggccctcccggtgcaccaggaggacgaagacctgttcgagacctcgtcatccttctcctgcgactccgacgacgaggcccagttctcggacggcgaggaccagtttgtgccggcttccccgccggtgcggagactcaactctgacagcgtctacgatctgtcgtccatcaaggctgagctctccgccaagaaaggagggttgtccaagtactacgacgggaagtcccagtcgttcgcgtgcatgtccgaggtgaggtgcctggaggatctacccaagaagagcccctacaagaagatcaagtcatgcaggagcaacatcaatctagacggaaaccagagagattgccccgtaactggttctaacaacagcaaaggaatctgatgatggcgcggaccagcagcgccaacatgctctacaggcctccggcgatccctgttaacaagagcgcgtgccaccagtagggctcgcagctgcctggaa

SEQ ID NO: 31918 - DNA, 632 bp, Triticum aestivum
  unsure (1)..(632): unsure at all n locations
  Clone ID: PAT_TA_31918
gngcaacagcaagnaacagcgcaggaatatatccatccatatacagcagcgagcataccttccttgcctttctccgtgaggtccattgcaatccagaaaccttcaagtatgggcagatctgcaatttctcaggcccttccggtgcaccaggaagacgaggacctgttcgagacctcctcctccttctcctgcgactccgacgacgaggcccagttctccgacggcgaggaccagtttgtgccggcttccccgccggtgcggagactgaattctgacagcgtctacgatctgtcgtccatgaaagcagagctctctgtcaagaaaggagggttgtccaagtactacgacggaaagtcccagtcgttcgcgtgcatgtccgaggtgaggtgcctggaggacctgcccaagaagagcccctacaagaagatcaagtcgtgcaggagcaacatcgatctggacgggaaccagaaagcctgccccgtacctggttctcacaacagcaaaggaatggccaagccctctggaagctcttgcgcgaatctgatggcccggaataacagcgcaaacatgctctacaggcctcccgcgatccctgtcaacaagagtgcgtgccatcagtagggctcgcggct

SEQ ID NO: 31919 - DNA, 861 bp, Triticum aestivum
  Clone ID: PAT_TA_31919
gccggccgggcttcgagagcaagcaagagcaaagtccaagagtaagaatatatccatccatacagcagcccagcaagaatatatcctttcctttctcctagaggtccttccgttgcgttccagaaaccagaaaccagaaacttgcaagcatgggcagatctgctggagctcctcgggtcctcccggcgcaccaggaagacgaggacctgttcgagacctcctcctccttctcctgcgactccgacgacgaggcccagttttcagacggcgaggaccagtttgtgccggcggcgcagccggtgcggaggttgaattccgacggcgtctacgatctgtcgtccatgaaggctgagctctctgccaagaaagggttgtcaaagtactacgacggaaagtcccagtcgttcgcgtgcatgtccgaggtgaggtgcctggaggatctgcccaagaagagcccctacaagaagatcaagtcgtgcaggagcaacatcgatctggacgggaaccagacagcttgccccgtacctgctcccaacaccagcagcaagggaatcgccaagcagagctcctgcgcgaatctgatgatggcgcggaccagcagcgccaacatgctttacaggcctcccgcgatccctgtcaacaagagcgcgtgccatcagtagggctcgcagctgaaaaaaatgtctgtccagggctggcctcgcgcctcttctttgttccttgatgaggattttttttggcgggcgtattagcctgtcaaatgtactaagaggcttttgcttctctcctgtttgggaagacattgattgattcggtgtgtaaataaagagaccggttgtataccaaacttttttttactgc

SEQ ID NO: 31920 - DNA, 905 bp, Triticum aestivum
  Clone ID: PAT_TA_31920
ccagcaggccgcacacgagcgcaggaatatacccacccctagaaacaagagcaggaatatttccatccatatacagcagcaagcataccttcctcgcctttctccttgtaggttcatcgcagaaacaagaaactcgcagccatggacagatctgctgtttctcaggcccttccggtgcaccacggaagacgaggacctgttcgagacctcctcctccttctcctgccgactccgacgacgaggcccagttctcacgacggcgaaggaccagtttgtgccggcttccccgccggttgcggagactcaactctgacagcgtctacgatctgtcgtccatgaaagccgaactctgcggccaagaaagggttgtctgaaatactacgacggaaagtcccagtcgttcggcgtgcatgtccgaaggtgaagatgcctggaaaggacctgcccaagaaggagcccctacaagaagatcaactcgtagcagcgagcaacatcgatatgggatgcggaaccaaaaagcctaccccttacctcctcctaacaaccctcagcaaaggtatcgccaagcagcaacctgggagctcctgcgcgaatctgatgatggcgccgactaacagcgccaacattcctctacaaggcctcccgcgatccctgtccgctacaggtgcgtgctagcagctgaggtctgtcccgctgcaaggattgtctgtccatcggctgttcgctcgccccttcattgttccttttgatggatttttcttggggggcgtttttgactgtctaatttcaaaagggttttgtgtctctctaataaaaaagaaaaatttgcgggtgcggctcggtcagttatgagaccgttccttcccgccccctgtctcgtgggctggaacctgggttccacttta

SEQ ID NO: 31921 - DNA, 1211 bp, Triticum aestivum
  Clone ID: PAT_TA_31921
cttccatgacgatgcctgcgatcccctgctccaagactcgtcctgctcctctgcagcttcgtcttccgcttcctctgacgaagagctgtcgccgaggcttccgccctacaagggcgtgctgccgtcgccgtccgacatggtcgcacttctcactggcagtttgaccttacgctcagcggctttgtcacctgcatttacatgctcgcggcgcaatgtcgagttaccgagaaagtgagccttgtgcagcatgagtttggcatgagccaagccgagtttgctattctaatgctgattgccggtgctgcgggaatgatctcacagttaacagtaatgccaatatttgctccaatcgttggtgaggagatgctacttattgttgggctgttaggagggtgcactcatgttttcctgtatggcatcgcatggtcgtactgggtgccatattttgctgcatcgtttataattttgagtgcttttgttcacccatctataaggaccaatgtatcaaaaagcgttggatcaaatgagcagggaattgctcaaggttgtatatctggaattagttcttttgccagcatattagctccacttgtctttactccgttgacagcatggttcctttcagaaacaacgccgttcaacttcaaaggccttcagcattatggttgctggtttttgtacgctcattgcctttgtcatcagcattaggatgcgcgcggcgagatgtggagttagcgagaaagtgagccttgtgcagcatgagcaagcatgacatacagaacaccctggttaagagtggcttgctccatgcttccaggagaatgaatggccctcggcatgcaaaagcacctttctctattacatgaacgctgcagatgtcgaattgggcagtaaacctcctactgtcctaccagtacatagctgaccggaatagttaactgtatgtagcttgcttcagaaagggggtcagtgggtaagcacttagcattcagagttggcgcagttctgtttctgaatgcagaatgtatggtggatgaattacaaagtactagtacatccgttcctaaatataagatgttttggcagttaatttaaactgccaaaacgttcatatttaggaacagaggtggcaatatgtaaatacaacgacttctggtgataaattcgactcgtcagagtaaaaaaaaaaaaaaaaaaaaaaaaaaaaaaaa

SEQ ID NO: 31922 - DNA, 1289 bp, Triticum aestivum
  Clone ID: PAT_TA_31922
aaggagcttgaggagcagcaggcccggagccgcatctgggatgaaacctggctatcaggattcttctacaaaccttgcaactacgaactgtttgtgaagcaatcactcaacatggagatggctattgtaatggccagggaatctggcatggattggataatgcatctagacaccgatgagttgctgtatcccggtggagcttccgagtattccatcagacgcctgttagctgacgtccccgaggatgttgacatggttatcttccctaactatgaaagcagtgtcgagcgtgatgacataaaagacccattcagcgaggtgtctatgttcaagaagaattatgatcatctccccaaagatacttactttggcatgtataaggaagcaacaagaggcaatcctaactatttcattacttatgggaatggaaaatctgctgcgcgaattcaagatcatctccggccaaatggtgcacacagatggcataactacgcaaagagcccaaatgagatcaagctggaagaggctgcagttctgcactatacatacaccaaattttcagacttaacatccagacgtgatcgctgtggatgcaagcccacgaaggaagatgttaaaagatgtttcatgttggattttgacagagcagcttttataattgcatcaacagctagtgaagaggatatgcttcgctggtacaacgagcgcgtcgtgtggaacgataagcagctcaacctaaagcttctgagaaaaggagtattaacccgcatctatgccccaatggcgatcgtgcaaggcctgcgggagtctggcgtcttcacctccgtcatcagagcggccgtcgacaatgctaaagttcgactgaaggaaagcgttgaccgaaacagcactgatcctgaccatgaagatgaacctagggcattcgtcgcagctaacgctaggaagatcctgaacgtcgtcgagcctgccccagcctacagggacggcggcgcgtctgccgctgttccccctatgtcgcccccgggtttggatgaggcgcgaggggaggggctggctggctgctgacttggatcatcaggatgaaagaattctttttgcccatgtaggttggtcaggtagtgacaagaagaagatgatcgtggatggatgggcaatctagctagtgacatgattttggtgatgatacgctggacatatgttatatccagaatatatatatatagagagagagtgattttgggcaggacatatatgcacccatctatttttgttagtaaatgctagtgaag

SEQ ID NO: 31923 - DNA, 793 bp, Triticum aestivum
  unsure (1)..(793): unsure at all n locations
  Clone ID: PAT_TA_31923
nctatccaactaggccacactttatcacggtattcttgaatattcttatccttcaaaatgagttccgcccatttttcttctggagctttgatcattttgtcatcgtcatcccaaccaaatcctgtgtgttttagaagtctgtccatggtagcataacaactcctgtagtacttatgacgattttttatttgttgcaactcaagtttgtctacctttgactcattgaactgttctaggatttcacgccatgctttttttgtgtatcctgttccttccttccctccatttatagtttgatcttttagtatgttcagcaatattttgtcctctgaagatttccatgtgtggcgctttgtgacctgcttatcggtcttttccttcttaatacttttgatttggtcatccatatttcctaaagggaaataaagctgcaaaatgattactacttaaataaactagttcacgcgaatactgcaatctttgttacctttggcactaattatgatctcggtaatcccagattagcgccattgcatctacaatcattgatcacactgggggtaaacggctagccatccaatttatatatgtgcgtgctctataggaataattggatattcataactcaagtaaacacacagatggtacagatttgcaatttcagtttcgtagttgcactcatgtacttaaagcatgaaccttctcgctacaaatttcagtatgttgatcagttcatgattatggaaagtacctgtangatgacgaatctgcanattgaatgctgctgatgaaa

SEQ ID NO: 31924 - DNA, 1406 bp, Triticum aestivum
  Clone ID: PAT_TA_31924
aggaattcggcacgagggaaggattgacagggcttgagggggagcttaaagggtggagggtaggggagacctttgaagggttcacagggacatcctcattgtcgacaacgaatgatgatgatgcatctagcacgaatacagagccggtccgcgtcttctcgcccgacccccgcgtccggcggaacatcaagtcatggatgcgtggtgcacttctgggaagtggctcattcgggatggtgtatgaggggatcagtgatgaaggtgcgttctttgctgttaaggaagtatctttgcttgaccaaggaagcaatgcacagcaatctattctttcacttgaacaggaaatcgctctccttagtcagtttgaacatgaaaatatagtccagtattatggaactgacaaggaagaatcaaaactctacatttttattgagcttgttacacaaggttctctttcatccctctatcagaagtataaactgcgagactcacaagtctctgcgtacacaaggcagattctcaatggattggtttatctccatgagaggaatgtggtccacagagatatcaaatgcgccaatatattggttcatgcaaatggatcggtaaaacttgcagattttgggttggcaaaggagatgtctaaaattaatatgctgagatcatgcaaaggaagtgtttattggatggcacctgaggttgttaatcctagaaaaacatatgggcctgcagctgatatgtggagcttgggctgcactgtgttggaaatgctaacccgccaaataccatatcctaatgtcgagtggacaaatgctttctttatgattggcaaaggagaacaaccacccattcccagccacttgtcagcagaagctcaagatttcatacgccaatgtgtacgagtcgatccagacgagcgaccttccgcatcacaacttttggcgcacccatttgttaacaggccacttcgagcttcttttgattctttgtctcctccgatcaataggccgtagtagtgatagtgtggtttctctgtttgtgcaaccacggtccacggctcatctcctgatttgatcttcatgatctccaccgtgggggaccatactttaggaggacgtagttgagcatgtgcagtcaaataggatgggtgaggttgagcactgaccatgtttgttggattgtttgtggattttcttcataggcgaaggtttcaatagattttgttgtacaacttagtggaggagagttggaactgcagtgctgctagggtgacctgatctgctgctttgtaaatgtttgaccactggctattattctttaccccatggcttgctgctcctaaatcaactggagcattatatcgcatggtatagcagcattcttttttcttactcgagacaaaaaaa

SEQ ID NO: 31925 - DNA, 1218 bp, Triticum aestivum
  Clone ID: PAT_TA_31925
gcacaggcaattatacgctctgtggtagatttcaaaaaagacccatggcccagagtgtctgagcctgctaaagaccttgtcaggcggatgctggatccaaatccaatcgcacggcttactgcagcacaagtacttgaacatccatggttacacgattccaaaaagaatcctgacattcaacttggcgatactgtccgagcaagactgcagcaattttctgcaatgaacaaattaaagaagaaagccttaagggtgattgctgagcatttgtctttagaagaagtagctgacataaagaaaatgtttgatagcatggacgtaaacaataagggccaactaacctttgaggagttcaaggctggacttcgtaaactcggaaacaaaatgcatgattcagatcttcagatgttgatggatgctgctgatgttgataaaaacggcacccttgattatggagaattcgttgcggtgtctatccatgtgagaaaaataggcaatgatgaacatatccaaaaggctttctcatacttcgaccaagataagagtgggtacatagagattgaagagcttagagtggctttgactgatgaggtggatggagcttgcgatgaagacattatcaatggcatcattcatgatgtagatacagacaaggacgggaagataagctacgacgagtttgcggcgatgatgaaggcggggacggactggaggaaggcgtcccggcagtactcgaggcagaggttcagcaacctcagcctgaagctgcacaaggacgggtccatcagcgacgaccagaagtagaccgagcagaggtgtaagaaacagaaggggtgctctgtttctcacatcgagtgctctgtcgagcagaactactgatcgtgatcgccccgagcacgggcggggtatatattgaccatcgagtgtcatgttgtttcgctgtgctggggttttgttgtcggggttttgtcgtcagatttcaccagctcgtttctttctccggttctttgtttctttcacacggtaaatgcagctaccactcgattcttggcgtttgttgtttgtaaagaagatcgtagcttgtaagtaaaatcgtttgcagtgtaaaatgtacaaaggtagcatgggaaatgcttaacagaggggtcttggtcttgcactccggcgggcccacctgcgaaaaaaaaaaaaaaaaaaaaaaaaaaaaaaccgggcgct

SEQ ID NO: 31926 - DNA, 683 bp, Triticum aestivum
  unsure (1)..(683): unsure at all n locations
  Clone ID: PAT_TA_31926
gaacactcaaattctattgagctttctcatgatgatacaaaatgccttgagcctgaatcgttactttcctcaactataatgaacttctacattatgtacctgcaagggccaatgtcatcgattagcacacaaagaggcaagtatcaccagttttaatacatacttcttcaagaaacttgaagccctgaaatcaaaggtagacaagccttcttatttcttaaacctgagaagatggtggaaaggcatagatatatttcaaaagccatatatattatttcctgtgcatgcagatactcattggagcctggtgattatatgcatgccagcaaaggaagatcaatcaggccccattatacttcatttggattcactgaagttccataacagcagattgattttcagtgttgttgagagattcttaaaacaagaatggaattacctgaaggataatggttctttagcagaatgtcctatacgagaaaccgtgtggaagaaccttcctcgtaaaattgagaagaaaccaattgcggttccgcagcaggaaaatgaatttgattgtggcctctttgttctgtactatatgcnagcgttcatcgaggaagcacctgaaaggcttcacaagaaagacctttctatgtttggcaaaacatggtttcaacctgaagaggcttctgcattgcgaa

SEQ ID NO: 31927 - DNA, 1010 bp, Triticum aestivum
  Clone ID: PAT_TA_31927
aaaatggcaagtggaaacgaaaaagatagagatggtgcggtcatggaggaggagcaactggaagtggtagagtatgaactacagagaagtaggatcattgaggaaaatgataaagggttggcagcggcacgagcaacaagagcctctatgcagaaagatatggaagcaaaccaagcccaaaaaagaaaagaaagagattactcgtgagcttgatgctgaaggtagtcaaaagaaaggtggaaggaaaattacttaaaaggctaacatatatgcaaggctgcatcaacccaaaatccatattccacttaatgtgaatggccagcctgttgggccagatgcaaccgaatttaccaatttcattggtactttggtgaggaagcatgtaccacctccagagttagattggcgagatgttgatgtacaaaaaaagttgttagtgtgggagaccttgaaggcatttcatgagctggactcaaccgctttgagctttgttatcaatagttcacacacaaaatggaaggattggaagtaagatttaaagaggtacaagtttgatgttgtgctgactgatgcagaacttatgaaaagacatgacagcagaattagtgaagctgacttgaagacccttattatttattggagatcttcggtatttgaagttgctgtcaggttgtgtaggaaagacaaagaggaccaagaaggaaccatgatgctgtcagtttgcatgaactagatatcctccgtaatggagcaaaacaatgcatcttgtagctatcatattgtaaagcatatcttgtgtaacagagcatgcattgaatcggtggacacgcatctatgattttgtaaacctatctggtgtttcggccacttagacaaatgtttcctcttatttagttacctttattatcggaattactagtgttatttttgtttgcttccggtttaatattttcaaagtacacacatgtaacttgatagatattgatgagatatgtaacctgattgatgtt

SEQ ID NO: 31928 - DNA, 740 bp, Triticum aestivum
  Clone ID: PAT_TA_31928
cccacgcgtccggagagtcccaaagtaaagcagcttaactgcgcaatgcctgcaaacaagacttctctagcgaatcagaaggacggtcgtaacatctctgttgacatgtacccgttcatacgcaagtacaaggacggcagcatcgagcgtttcctacgcagtccattcgtggtggcgtcgccggatcagggcggcaaccgcggggtggccacgaaggacgtcgtcgtcgacaaggccaccggcgtgtctgttcggctgttcctcccgttgcgtgccgccgacaccgcaggcaggaaccggcttcccctcgtcatctacgtccatggcggctcgttctgcacggagagcgctttcggccggacgtaccaccgctacgcgacctccctcgccgccagcgccggagccctcgtcgtgtcggtggagtaccgtctagcgccggagttccccatacctgcggcttacgacgacgcgtgggccgcgctccagtgggcggcgtccttgtccgacccgtggctggccagctacgccgaccctgcgcgcacgttcctggccggcgacagcgccggcggcaacatcgtttaccacacggcagtccgcgccagccacgaaatcaaggacgacatgatggacattgcggggttgatcatggtgcacccttacttctggggagccaagcggctgccctcggagctcgcgtgggcggacgacagcgatggcgccgcggtggtgttcccaccgta

SEQ ID NO: 31929 - DNA, 629 bp, Triticum aestivum
  unsure (1)..(629): unsure at all n locations
  Clone ID: PAT_TA_31929
cccgggccgacgggaaagaaaatgtgtgaagttacttgtcgtggaaattgtgaggaaaccaataaaaggcagaaacaaagaaaagggcattctggcgaaacagctgcaggaccaagggaaagggaagtgaatgttacggatcagttcctaccagatcaaccaatgcagggacattatgtacttggccacaactttggtcttggtacctcacagaaccttcgtgatgatttgaaccattttggtcaggcttctgcagttccaaccctgcaacagcagccattccctgggaatggtcaactaaccgaaacccaagcctatactggtgacatgcacgcattgcaattcatggagacgaatccccagatcgaccatgagaatggagaggagggtcagtcgtcgataccggtgtgggattttctctgacgtacgacttcacatcacttgtaccaccacggctattactagtgattgcctgaccgcaacctgtcagccactaggtttgaagaacgtacgaccgcaacctgtcaaccatcactatgcagtagtgcaatcccaaagggatcttttgtatgtaactggctgccttacaacattggcnattgccggaagccaaagaaatgtcaaaaata

SEQ ID NO: 31930 - DNA, 713 bp, Triticum aestivum
  Clone ID: PAT_TA_31930
gtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtaaacaacatcgtctctgtctttctactcattttctacctcacggaagacaataacaatcatatgtgaactttcatatggtcaattacatacaatagtttcaaatcccgacgtcaatcagcacacaatttagccggcttctccatctgatatgtgcagaactagagttatagtctgttaatgtatacatgactgtcaatctgatttgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactaggatggtggacattggattggtgagaagctacagatgtacagtgggaatcagagctaccggtgatcaacgaggtggaggaggtcaagaaggagtaccctgacgcgtatgttcgcatcatcggattcgacaacatgcgt

SEQ ID NO: 31931 - DNA, 1097 bp, Triticum aestivum
  Clone ID: PAT_TA_31931
gggaggccgtcctactgcgccatggccctcgtcctcctcctcaccctgctctgcatcgccttccccgcctacctgcgcaacccggtcagcgtcgccagctgcttcacgggagccgacgtccgcgccgccgccgccgcccaaccagcggcgtcggcgtcggcggcgttggtggcggacgacgggggccgccgcccgggccagctccgcatcctcctcggcgtgcacacgatgcccaagaagcactcccggcggcacctgatccggatggcgtacgcgctgcagcagatggcggccctccgcggcgcggcgcgggtggacgtccggttcgcgctctgcgcgcggccgatgccgcccgagcacggcgcgttcgtggcgctggagcgccgcgcctacggcgacgtgctgctcttcaactgcaccgagaacgccgaggacggcaagacgtacacctacttctcggacctgccggccatgctcggcgcctccggcggcgagggccgcaggccgccgtacgactacgtgatgaaggtggacgacgacacgtacctccggctggacgcgctggtggagacgctgcggcgggcgccgcgggaggacatgtactacggcgtgggcctgccgttcatggaccgggtgtcgccgccgttcatgctcggcatggggtacgcgctctcctgggacctcgtccagtggatcaccgcctccgacatggtcaggaggaaggccaaaggtgtggaggacgtgaccatggggaactggctgaacgaggggggcaaggcaaagaacagggtgaacatcttccccaggatgtacgactacaagagcgccgaggccaaggatttcctggaggacaccatcggcgtgcaccagctcaaggcggacatcaggtgggcgcacacgctggcgcacttcaacgccacctccggcgatctccggccttccagagaggggagctcatagattcatatgtggaagacagacctgtaaatttgcagagtcaaactgcctcactgaagggcagcctgtctagaaacccagcagtttcacatgcatatcatacatttggcattaattaaacgctggattccagagtttcc

SEQ ID NO: 31932 - DNA, 1165 bp, Triticum aestivum
  unsure (1)..(1165): unsure at all n locations
  Clone ID: PAT_TA_31932
gcaccattggtcgatccctcggcatccaaagccgaggatgcttgcaaggtgaatgaagagcttatccccgtgatcagcgagctgccggtgccaatgactgaggaggctgaagaggataccgaggtcgttgtcgtcgtcgaggaggtcacagtggctgcagagaagcaaaactgactgccagttagctgagtgttttgtcggacaaactaacttgtattgtttacatttgatgtaaaagaccttgctgcgttaacatctgggaaatctggggatggccaaaatgcaactcacctggtttggcagtccatattgcattggtaacttcaatgtcatgattctcagaggaaacacaaagttggcagtaagatctgagtctggacaatccgcaatcagtttcatatatctgatggagatgatgaacaagtttgggatacacaaattaacaggtgatcaggatacatgttacagttggtacggttaattacacataaacagcgcaaacggcataatcaccacacgacacgaaggagaacgaacgacatggtgagcaacatggagaaggaacacggccaacagaaagtacacctggaactctaagtctccttttcctttggttcagggagagacttcctgaaccaggggatcagaacagaggtcctcttctggtacagcctgtaggcctctgcccggtgctcctgcttcagcatgcgccgctcgacgagcacggtgacgtagccgaggcacatgctgttgacaagcgccccgatgaacatccaccgctgccccaggttccaggcgaagaggtacacaccccaccaccagagctgctcgccgnaagtagttnggggtggcgcgagtacccccaacaggccgtcctcggagggtggggactgtcggttcgcctagctgcttccagtttctcgttccttggtgacggactggtgcagctgggtgtcagcaaagtaggcgatcacgactccggtaatgcagacaactgtcgccacgaaggtcccagatgcccaatggctggtcgctggagtgaatggcgtacatccgcaggcaatatgccaatcagaaacacctgctgcgagaggtagacggcgaagaatgacatccaccaccaggtcttgccgtactgcccgcgcatctcggagacctccagtcc

SEQ ID NO: 31933 - DNA, 1209 bp, Triticum aestivum
  unsure (1)..(1209): unsure at all n locations
  Clone ID: PAT_TA_31933
gcaccacctcgccgactcagaccccgcgctcgtaacgaagccgtcacaaccgcggcatcgccgacgcagcaccccgcatgccccgcccggtggccgatccgtgttccgtggtggagagagcgagggagagaacctccgggccgcgcctggtgctcttcggcgactcaatcaaccgctgcactcctttgcccccggcggctggggcgccggccctcgcggcagcacttgcgcgagggcagggcggatgtggtgctgcgcgggctcagcgggtacaacacgcgctgggcgctgaaggtgctggatagagccatggagggggcggccgacgggcggcgcggacccggcggcagtgacggtgttcttcggcgccaacgactccagcctgcccagacgatgccgcacgcgcaccacacacgtgcccgactcggggtagtacaatggaccaactgcgcgcgatctttccccaccttcataataattgcccctccgctgccctcatactcagcgcccctccaacgattcaagagccatcatggcccttcaagacatcctgagagaaccaaagaagttgctggcacttatacacaggcgtgcatagcggttgcaaaagaattggatgcacccgtaatagacatctgaaggcatgggacaatcaatttactgatttggcaaacctctacaatgaagtgacgtccttacatttcaccccgatctggataaaaatgtttgttcacatttgagccgaataccctggaaaagagtttggttcaaccaggtgcagaatacagttgcgatcgtcggcttcaccaagaaaattctccggtccgatctccgtcacctctatgaaattgaccacaaggaccccctcaaagtctttgacccaaaaggaaggtattaggcccatggtttggttcccagaaggaagtcactttgactcagcttcaggttcttaaaacaaactatgttggttgggccgactgacgagttctgtaacgtttggagactggttttgttttcgatgtaattagcatgtgttgaagggcaagtgaaaaatgagtgaagacataaatggaaaacatcggagtctcccttcgtaggcgaaganggaacaanatttacttctcanggnaaaaaaaaaaaaaagtggganctccccgggggggggnccggccccnaattcncccctaaaaaagnngncggcattncnng

SEQ ID NO: 31934 - DNA, 1046 bp, Triticum aestivum
  Clone ID: PAT_TA_31934
caaaaaacatcattttctgttcatgggattaggatctaggccactccgccatctccccggatcctattcagcgagcgacatgcgcggttggaaccagaggcacgagtcggagcgacgggtagggggtaggagcgggtacaggcggttgacacagtaggcgggaggcggcggaaaaattgagcttctcggagggcggctttcccggcatatttggcggcaaggtgagggtggctacaactagttgtagggaccaaatttaggtctttggccggtgaccaggagccaaaattcaatggtggcggcgaatagagttgaaactaaaggcttcaactcttttgttaggatcctatgtcgcttctaaggttatggataggaaatatttccctaaacgctgagatattgttcatcatatactattgatcgaaaactctgaggtaccctcaagttaagcagcttgaaattttcatcatgattacatcatgtggtagtgtgcttgttcaggtgtttatttaagacaatgacgaaaaatgtatgagggatagagaggaataagtgatcttcaacaagtctttgtagtgtatggtgggtacaagtaatgttagattcaaaatttagagcttttgccaataattagtagcaaaattcaggattgctgagaagagaggtgaacctaatggcttcagtactattgttaggatactatgttgcttctaggctatcgataagaatagttcagtcgctttagagattgttgaacatatgaaattgattgtaatctctgggcaccctcaagttaagctgcttgaagaccaagttcaaatatgtgtgagggcagtgcggttgggcatgcgagcctattgcacctgatataatcagaccattagatatgttttgacatagtgatctgcaaatgaattttttgtactcgtaggtatagttttcattgcgtgagacatttcctagaaccattagtagtcttgtacattgaatcaatttattagacgactttgttattcctatggacatgttgattatttttgcattac

SEQ ID NO: 31935 - DNA, 846 bp, Triticum aestivum
  unsure (1)..(846): unsure at all n locations
  Clone ID: PAT_TA_31935
gagcgccgggaccgggacacggacgagggggaggaagacgacgaggctgcctgctccaacgcgggcgctaacaccagtagcgcgaatgcgagcacgagctcgagcaccgctcctagcagcggcgggaggaggaccggcggtggtgcggcggcggcgggcgggtgggggagcagccccgtgtcgggggcgaccatcaacctcagccaggagtacacgcttcgccatccagaccagctcctacaacgagatctggggcaagatccacgtcatcgtggacggcgaacgggttgacggcggcgaccaagacgaggacgaggaggacaggggcaccctcgccggcgtgctccgtccggaggacgcggtggtggagcgcgcgctcggggacgcgccggacacggagctcacccgcctcgccgcggactacctccgcagcacgcacaacgcgtcgctgcactgcctcttcctccgccgggcgctgcgccgcgcgcgggcgctgtacgggcccatcacggacgtcctcgcgctgatcccgcacgccacgccgctcgccgtgccgcactgcgactgcgcgttcgacgccttcctcctgttcgacaaaatacccaacccgttcctgccccccgcagccagcttccagggcatgcatcggagctttgctggcctcaaaacccatctcgacctccgcctcctcaaggcccgacggaggcgccggctgttgcggtgcgcacgcgcgggtctggcatctgcctcatcggctgcgcgacgggggcggcgatcgctggcctcgtcatcgccacccacgncnncnnnntnnnnnnnnnnnnnnnnnnnntgcctgcgcanngn

SEQ ID NO: 31936 - DNA, 759 bp, Triticum aestivum
  Clone ID: PAT_TA_31936
tccaccgcagcagcgagcgcatccaccgcgtcttccgccaggagctcgagacgctcctccgcatccgccacccgcacatcgtccgcctcctcggcttctgcgagcagcaagatgagggtgtgctggtgctggagttcgcggcgaacgggaacctgtacgagaagctccacggcggcggcaaggccgcgggggcgatgccgtgggcgtggcgggtgtcggtggcgctgcaggtggcgcaggcgctcgagtacctgcacgagcggtgcgagccgcaggtggtgcacggcgacgtgaaggcgtcgaacgtgctcctggacgcctccatgtccgccaagctctgcgacttcgggtcggcgcggatggggttctccgcggccgtccgcccgcggtcgtcggcgcacaccatgctcggctccccgggctacgtcgacccgcactacatccgctccggcgtggtcaccaagaagacggacgtgtacagcttcggggtgctgctgctggagctcctaaccggcatcgaggccttctgccccgtggagggccggctgctgaccggcgtcctcgccccgcggctcaaggccgcctgcgacgcgcggatgctggtggacgagcggctcgggagcgcgtacgacgcgggcgaggcgtccgccgtggccgcgctggcgggcgtcgtgcgtggggcagaaccccagcctccgcccgtccatgggcgaacgtggtgcgcaccctggagcagagcgcgcagggcttcatcctggc

SEQ ID NO: 31937 - DNA, 954 bp, Triticum aestivum
  Clone ID: PAT_TA_31937
cctgtgcgccgctcgagccggccgggtccgaagatcgatccgtggcatggctcgccgactctgccgtctccctcgcctcctcctccccctcgccgccgcccccaagccccagccccgcctccccgccctaaacgccctaccccgccgcccacctccgtccctctccctcctccccgacgccgacgccctcgctccccgccctcccccgcctctcctcctcctcatccgcgtcgtcctccggcgattccagcatggtggtcgtcggctccgcggactccttcgaggacatccacgccaaggtgcaagcggagaagctccccgccgtcttctactacacggcggtctggtgcgggccgtgccgggcgatggcacctgtgattgagaagatgagcaggcagtaccccaagatacctgtctacaaggtcgacatcgacatggagggacttgtgaccaacacttagttacccgaaaacattctctatcccaactttccacttctaccacaaaggagagaagagcagcgaagtggttggtgctgacgtgaagaagcttgaagctgccatggaaagtcttcacaagcaacagtgaagttgagttggagtgggggacagttattatgcatgaagagtttaagacgctgtgatgcttggtattttcgtgtgtaacatgggaacttccgtcttgctttcttctttcggatatctggagacaccttgcccccaaaacttggatttcgggatttatgccactactgagcgcagctcttcggcaatttctgcacgtccatttaggagcatctgtgattgtgaatctgtctgtattgtggcgctgctctccatctctgatggtcgggcggccttttgcgcaaaacatgttgaactgtcatgttcttgtctccttggtcttcgttacaagtagtttatgctgctgctaaaaaaaaaaaaaaaaaaaaaa

SEQ ID NO: 31938 - DNA, 666 bp, Triticum aestivum
  Clone ID: PAT_TA_31938
cggctacacgtttgtaaggaatgcggtcgagggaaccgttgaggcgaggatcctcgaggggcctgttgatttccatgggagaatcatcgctcgcactagcagctttccatgtgacattatgctacatgatagcgaacttgctgggatgctaacagccggtgacggtggaatactgcaaacagcacgccgtgtggtcagcgtctctatcaatgagacgctcttgttgaccgttgccgctgctaccagtggtgtccacaccgttgagtttactccaaagcgtggcagctatgatgaagaggaaatcacttgcggcgactataagatgctggtgaaggtcacttggtccattgtgtgctggtgaaggttagctggtccattgtgcgtcgctgatttcgtatgttcctggttgaacatgctatatccaaaaggagatgtgtgtgctctgtatatgctgtcgtactagatatgtctatgcttttggtggaagcttagttatcactgtttgtttgttaccactctgttcgttacaactgagtgggataaaaattatatgtatatccggcttgtgctttgaagtaggaggaacagacaaagtgtgtgtgcatcactttgattttgtttcagcacttgagtcttgaaaatgtggttatatagtttcgttctttc

SEQ ID NO: 31939 - DNA, 823 bp, Triticum aestivum
  Clone ID: PAT_TA_31939
aaaacgctcctaatcgcccccatttccccccgttaagcccgcagccaggccggcgaggctgcgtgcatgcatgcggcgacgtcggccggcagcatggcctcgatcgagctcgggcgcgccggcgctggcgccggcagtggcagcgggaacggcatcggcatcggccgcggcgggcccgccgggacgacgtctaagaagcggctcgtgaatgatcatcgccgacccgggccgcgagtccacggcggcgatggactgggcactctcccacgccgtcgtcgagggtgacgacatcctgcttctccacgtcaacatgccgccgagcggcgcccccagcggcgcggcccctccgcgaaccggctccgtcggcagcagcagcagctcccagctggccgtgttcctcggtggcgggggctccgcggacggggagttcatggagacgatgcgcgccgcgtgcaaggcgcgatacccgcgcgctagggtccacgcggagcgcgtcgagccggcaaccgagggccgcgaggccaaggcccagaccatcctcgccgagtcccaacgccgcggcgtcgagctcctcgtcatcggtcaccaccgcttctccgccttcctcaggttgcggagcgcgagcgggacgagccggccgagacacgacagcacggcggagttcttgattgagcacagcaagtgccggtgcgtgagcgttcagaagaagggcaagaacgccggctacctgctcaacacaaagacccacaagaactactggctcctcgcatgaacatgtacatacacgtgcccatcgattagactgatcgaaattacatttttc

SEQ ID NO: 31940 - DNA, 1199 bp, Triticum aestivum
  Clone ID: PAT_TA_31940
tctgcgtgactatcctgagcaaccatgagcactcaattcttacctcgttgtttcaacttttattgctttaattctttcaaaggataagctcaaaaggagactgaaatcattggaagaggacatgagaaatggtaaattcaacacacctgccagtgaggccaataggaaaggcactccgaaaagatcaacatctcaaccaagacagccaagcacacccagaatgtcacagcaactggcttcattcgaaggcattgttgacaagagaagaccaacatcccaaccaagggcggctgtgggagggaaggtgctgaagcaacctaattcggacaccgagcctgcagagaagacgagaaacattaaacaacctgacagcccaagagtgagaactgctgctgctagaaaggagcgtcctgtgagaaatcacctgtgggcgacaagaagtaaagtgaccagcgatgctggcaaagagaacaaggagcagaatccaaattacaagccacattcaagcgctccacatgagcagggacatgatgccacaaagccacaagctgtagtatttgatgcgaatggagactgtggagttcagcgcagtgaacatcacaaagacatggatttggagaacttggatgacaaaaaggcggatgcttcgaatgcagagagtactcagggtggcaacaggggaaactaaggaatttcgtttgcaagaggaagccaaatacaagggtgaaaacagttatcatgtactggtaagtgatctcctttagtgtttgcagacacgcctgcctaagtatttgcttacatatcttgtacttttgaacaattctattaccatgtcttggaattttttacatttattttaccttttctgggaatttaagcaattcgtgcctataaaaaaatacaaatgttgtgtgttgttttgtgaagagtggctgttataaataggaaggtgggtgctgattgagagtgtctggaacaaaaacagaaaggatgtttgtttctctctattgttttatgtcaatctactttaaatatcatgtttgtttctctgctctatccctctatttatgtgaatgtttgatcaatcactctccctcatgacgctggatttgaatgtatattgtagatttgtagtcagagattcttgtggaatttctctgtttcatactacaccattttattcagaataaaaaaaaaaa

SEQ ID NO: 31941 - DNA, 701 bp, Triticum aestivum
  Clone ID: PAT_TA_31941
gaggaattcggcacgaggggagagggagacgagcttacttgggaggagggatacaagaaggaagtggaccgggaactggagaaccgtaaaaacgatcgccgatctgacaatgtttctgcaagggacaacaacgattcacgggcagctcctacatctggaaggtgggatgatggctccacccgaaattcagggaatgaaggtaggcgtgatggaaaatggtcattaagatggggacctgacgacaaggagaaggactcgaaaccagaaaagaagatggatgcagaaaaggatgaacctcatggtgagaaacatacacttcctgtaaggctgctacctgagtcagactcccgtgataaatggagacctcgtcaccggcaggagactcagaccagtggtacagcgacataccgtgctgctccaggatttggattggagaaaggacgtgtgaaggaatcgaatgttggttttgcccctggaagaggcagggcaaaccccaactcagttccatccttcagccgtccatcatctgctgggccaattggtgctccacctgtgtatgggaggcgtgcggcaactgctggtgcttttcgctacccaaggggtaaacttcttgacatatacaggcaacaaaaggttgtgcagtcatttgaagatggccgacggatgctggaatcatacttttcattaacttgttccccccc

SEQ ID NO: 31942 - DNA, 870 bp, Triticum aestivum
  Clone ID: PAT_TA_31942
gctggtcaagccaagctcctgcccatctagctcaagccagtagccagtagccagtagccacacccaatcccaatcccaatccaacgccgatgggcacgccgacgacgactctagcggccctggcggcgctgctgctgtgcctgtgcgtctccatgtcctccgccgctgagtacaaggtgggcgggctggacgcgtggggggtgccgccgtccaccaagccggacgtgtacgtgcgttgggccaagtccgtccccgtcaagctcggcgacgccctcttcttcctctacccgcccagccaggacagcgccgtccaggtcaccgccaaggccttcgccgcctgcgacgtctccgacccgctgctcaagctggacgacggcaactccgtcttcaacctcaccaagcccggccgggcctacttcaccagcgccgccccgggacgctgccgcaagggccagaagctgtcggtggacgtgcctggagccgatgggaagctgctcaagccgtccgcggacgacgaggccgcgctcaaggcgctctctgcgctgccgcctgccgctgccccgtccgaggcgctcccctcgctctcacccgacgacgccgacgacgactccgctgcctccatggccctgcaccgggccgccggatccgtaggtctcgctctgtctctcaccctcctgtggctgcgattcttcttcttcttcttcttcttcttcttcctcttcttcttcttcttcttcttcttcctcccatccattccaatttctttcttttttgtcagatcagaaacaaggggaggacgccattgtattgtattgtactgtactctactccggagtagtaatttatttgtttggattggattataagtat

SEQ ID NO: 31943 - DNA, 485 bp, Triticum aestivum
  Clone ID: PAT_TA_31943
gatacaaaaaccgtgtaccagtggaaccggatggacgacgggaagcacgtgcccacggacaacgtggtgttccacaaccagtactgggcgagcaacacgcggcgcaggcggctgaagaagaagcacctccggtacgagagcctcgagggcctcatgtccatgctctaggagctcgttgttaccagcaccactacagaacattggcagcggcacgggagtttcagaggccccggcgggaggcacgggagctttgcttctgcttctgctttgtggccgctggcagccctggtcggccggcggacctcgtgccgcggccgccgacacgggggcatatggtagaagcctgggcattcatccattccacacacttcttcagactgtgctggtactgctatataatgaacacggtccgtccgacgcatgtaaaattccggccagctagatggccaccaactgcactgttcaagtcgatagacactcagagt

SEQ ID NO: 31944 - DNA, 1938 bp, Triticum aestivum
  Clone ID: PAT_TA_31944
gcgcccgctcgccccgccacccgctcccggactacgccgccgccgccgcggcgagctacggccactcgaccctgcagttgataaaccggacgcacgccgtgtatcagtgcaaccggaacgacggcgcgccgcacgtccccacggtcagcgtgctgttccacgaccggtactgcgctggtcacacgcggcgcgggcgccgggcgaagaggcgcctccggtacgagagccgcgagtgcctcgcgacgaggcgtttcctctcgccgcatcgagctcctacgtcgcgctcgggagttccccgtccagccgttatgcctcctcgaccagcgaagtgcttttcgcgtcccccgcggggctacagcgcgccacagcaggttcatatcacgcaaggtgactgtgatggaaaggcggtcatagtatcctgggtcactccgtcggaacctgcgccgagtcaagtgttttacggtaaagaagagaaccgctatgatcacgaaagccgaagggacaatgacaaattatacattttacgactataaatctggatacatacaccattgccttgttgatggccttgagtacaacactaaatattattacaagataggtactggagattcagctcgagaattttggtttcaaacacctccagcaattgacacagatgcatcatacacgtttggcatcataggtgatctggggcaaacatttaattctctatcaactcttcaacattatttgaaaagcggaggagaaagtgttctatttgttggggatttatcatatgctgatagatatcaacataacgatggtattcgttgggattcttggggtcgatttgttgaacgtagcactgcatatcagccatggatatggaattctggaaatcatgaaatagaatacaggcctgatctgggagaaacttctacatttaagccatatctgcatagatattcaacaccatatttggcatcgaagagcagctccccaatgtggtatgcagtcaggcgtgcatctgctcatattatcgtgctctccagctattctccttttgtaaaatacactccccaatggatgtggctgaagggcgaactcaagcgcgtggacagggagaagacaccttggcttattgttctcatgcatgctcccatgtacaacagcaacgacgcccattttatggagggcgagagtatgagggctgctttcgagaagtggtttgtcaagtacaaggtggacttggtgtttgcaggccatgtccatgcctatgagagatcgtaccggatatctaatatcaactacaacgtaacatctgggaaccgatacccggtgccagacaaatccgctcccgtttacatcacggttggcgatggaggcaaccaggaaggactcgcctggaggttcaatgacccgcagccggactactcggcattcagggaggcgagcttcgggcactcgaccctgcagctggtgaaccggacgcacgccgtgtaccagtggaaccggaacgacgacgggaagcacgtgcccacggacaacgtggtgttccacaaccagtactgggcgggcaacacgcggcgcaggcggctgaagaagaagcacctccggtacgagagcctccagagcctcatgtccatgctctaggagctcgttgttgtgactagtaagacagagcatttgcagcagcacgaggctctctgttgctttgctctggtgccagccttggtcgaccggcggatcgtcggacctcatgccgccgacacggaggcatatagtagtagaaggctgggaattctttccactattgcagactgcgtgctagcactgtatgcacttttataatgatgaacacggtccgacacatgtaaaattccagtcagccagatggccagctgcaccgctcaggtcgacaggcattctaatcgaataaatcaatcaaaaaaaaaa

SEQ ID NO: 31945 - DNA, 944 bp, Triticum aestivum
  Clone ID: PAT_TA_31945
gttcttccacctaccggagtcggagcggctcaagtgctactccgacgaccccaagaaggcgatccggctgtccacgagcttcaacgtgcgcacggagaaggtgagcaactggcgcgacttcctccgcctgcattgctacccgctcgagagcttcgtcgaccagtggccctccaacccgccggccttcagggaagtagtcggcacctactcgacggaagcgagagcgctggcgctgagactgctggaggcgatatcggagagcctcgggctcgagagaggccacatggagaaggccatggggcggcacgcgcagcacatggcggtgaactactacccgccgtgcccgcagccggagctgacgtacggactgccggggcacaaggaccccaatgccgtgacgctgctcctccaggacggtgtgtccgggctgcaggtccagcgcgatggccgctgggtggccgtcagccccgtgcccggcgcgctggtcatcaacatcggtgatcaactgcaggctctgagcaacgatcgatacaagagcgtgctccaccgggtgattgtgaacagcgagagcgagaggatctcggtgccgacgttctactgcccgtccccggacgcggtggtcgcgccggcaaaggcgctggtggacggcggccaccctctggcctatcggcccttcacctaccaggagtactacgaggagttctggaacatgggcctcgagtcagccagctgcctcgaccgcttccgaccgatcgcatgatcgactgtccgtctgggcaacaaaatctcacgggccacaaatgttgcttgctactgatgatgtgtcgccataggggaggcctatcaaggcgcccagaaccgttagaaatagttttggatggctaagatcagggtgaacggtagaacttttttttttgagcatcagtatagacccaagcgctcat

SEQ ID NO: 31946 - DNA, 722 bp, Triticum aestivum
  unsure (1)..(722): unsure at all n locations
  Clone ID: PAT_TA_31946
gcacgaggtggcactgcacatagagcacatgcttcaacagagggagttaccaagtatttgaagcctgctgtcgctggatttcttatgcagaaagaacttgactatcttgttggagctgttgccaacccgacaaagccatttgctgcaattgttggtggatccaaagtgtcaactaagattggggtgatcgagtctcttttgtcgaaagttgacatcctcatccttggtggcggtatgatttacacattttacaaagcccaggggcatgctgtcggaaaatctcttgtggaggaagacaagcttgaactggcaaactcgcttattgagaaacccaagttgacgggggtctctcttttgcttcccactgatattgtggtggctgataattttgctgcagatgctgagagcaagattgttcctgcctctgctattcctgatggttggatgggtcttgacgtcggcccggattctatcaagaaattcagtgaaactttggacactaccaagactgtcatctggaatgggccgatgggagtttttgaatttgagaagttcgcagctggcactgatgcgatcgcgaagaagttggctgatatcacagcaaaaagcgtgacaaccatcatcggcggtggcgactctgttgctgccgtcgagaaggcanggttggtgagtaagatgagccacatttcaaccgggggtggcgcaagcctggagctgttgga

SEQ ID NO: 31947 - DNA, 1655 bp, Triticum aestivum
  Clone ID: PAT_TA_31947
attcggcacgagggaaagatttgcgatcctatattctcaaggttcaggtggtgaaggcaggacaagtatcaaggtcccaaaggtctactggacttatacacgtaaatctatactagcactggaatggattgacgggatcaaactaaccgatgctgagcgcatcagcaaagccaatctgaacaggaaaaagatgattgatgagggtctctattgctcgttgagacagcttcttgaagatgggtttttccatgctgatccccatccaggtaatctggtggcaactgaagacgggtctcttgcatattttgactttggtatgatgggtgatattccaagacactatcgagtgggactcatacagatgcttgtgcactatgttaatcgtgacccattgggcttggcgaatgacttccattcactcggatttgtccctgagggaacagacctacacgcagttgcaactgcattgagtgttgcctttggtgatggaaggaggcaatcaaatgattttcagggggtaatgaaccatctgtatgacgtcatgtatgattttaatttctctcttcctcctgattatgcactggtgataagagcacttggttctttagaagggactgcaaaagcactggatcctgatttcaaagttattgagagcgcttacccatttgtcatcgggaggctccttgcagaccccagccctgatatgaggaaaatattgagggagcttctgatacgtgatgatggatccatcagatggaatcgactggagcgtctgattgcagctatatctcaacagtcgtcagaagaatcttcaaagaaacctggagacgagaatactgccagcagttctgactggagatcattcgatatgcattcggttgtttcagctacagaagacctttttcatttcattttatcgaggaaaggctggagggttcgtgttttccttatccaggacattgtgaaggcttctgatgcattcttacaagaaacaacatttccaggtatatttgaggaagagggaaatacaggcgagctaaatccagagagaagtagaatgatcagaaggttgattaatggtgttcaatcattccgtcaagcaatcagtttggccccaaatgcctggaccgcaatgctaatccgtgtcgccctgaaacctgaatctcaaagattcattcttgacgtattcctagccttggtgaactattcccatgacaaggttccagaaacatgctggatttgtatgtcgaaatatctcaactacttggacaggcagtggaggtaggtaaaatgaagaatgaaaatgctcagtctgctagctgtgttcggaatcttgtgttcagtgctaatatctctcatgctccaaaagctctgctaatattatgtcatgctccaaaagctgcaatgagcgtttgttgtcctatttaccacatcctctgtttctaaatataagaagtcccgttggttcagtttaagctgccaaaacgtcttatatttaggaatggaggtagtatttagtattgcacaatcatcctcatgtttctagaacttgcattctttgtggtagttggatttagttacgctggcgttaagtgaaaatattttttgagttcttgtatgcaaattccagaaatgttacaagagagttcaacttc

SEQ ID NO: 31948 - DNA, 951 bp, Triticum aestivum
  Clone ID: PAT_TA_31948
gcagctggacctggacgtcgacagtagcagcagcgctggaggaagcaggcagcccatggtgctcgtgaacaccgtcgaagaattagagaccatggctttcgcgtccgttcctggactggacgtgttccccgtcgggccagccgtggtgtcgctcttcaccgagggcgagagcggcacgagtggcaccgccgccgcagtaggagatctctttgagcacgacgaaaatggttacatggagtggctggacacgaagccagcacggtcggtggtgtacgtgtcgttcgggagcatggcggcggtgagcaagcgacagaaggacgagctgaagcgaggcctcgccgctagcggccgaccgtacctgtgggtggtgcggaacaacaacagaggcgacggctttgacgacgccggcgacgagcggggtatggtggttgggtggtgcgaccaggtgcgggtgctgtcgcatccggccgtcgggtgcttcgtgacgcactgcggctggaactccacgctggagaccgtggcgctgcggcgcgccggtggtcgccgtgccacagtggtccgaccaggacacgaacgcgcgcctggtcgtccagtggggcatcggcgtgcgcgccgcgaccgacgttgacagggttctggacgcggaggagctcgcaaggtgcctggaactgatcatgggtgacagggaggagggtgccgccatacgggcgagctcggcgacgtggaaggcgaagttgcagcaagcgattgcggccggcggctcgtccggtcgtaatctcaggactttcctggaccaatttgcgaatgatgcttagaagcatttatgtactatacgagtcctcgtttttgttctactataaaagccttgtttccgtatgatattctcccactaaaatgagcaactcagctcctgtaaaaaccttccgtccatggaatagtatattttaggag

SEQ ID NO: 31949 - DNA, 713 bp, Triticum aestivum
  unsure (1)..(713): unsure at all n locations
  Clone ID: PAT_TA_31949
gagcgtggagcgcaccatggcgcccaagctggagtacctggccgggctgggcatgtcgcgggacgacgccgtggccatggcgctccgctgcccggccctcttcaccttcaacgtggagaggaactacaagcccaagttcgagtacctggtggaggagatgggcggcggcgtggaggacgtcaaggccttcccgcagtacttcaccttcagcctcgagaagcggatcgcgccgcggcaccgcgcagccgccgacgccggcgtcgacctgccgctgccggacatgctcaaggccaccgacgaggagttcagcgagatgctcgagaggaggaggaggagcggatgaagcgtgcggtatggccgccggccggccggctgagcgcgccgtgcgccatgctcatgcacgcaggcggccggcgggtgctttgtacacttaccaccgagctatggcgaccagggcttgcactgtacataatgatcaatggttgatgccacggctcctgagtcctgactcacagcgtgaagtgatgatacttctttcttctgtagaggatgtgtaagtaccaatgaagtagtcgggtgtgccacgtgtatagtgttcgtaacacatgttggggcaagtaaataaagtcatggaggaaagttcaatcggggatgaactctgttataatatcaaagaaatgttaagcanggggactgaaanaaaaggggggggc

SEQ ID NO: 31950 - DNA, 993 bp, Triticum aestivum
  unsure (1)..(993): unsure at all n locations
  Clone ID: PAT_TA_31950
ccacgcgtccgcgagtagaggatagtgaggatctggaaaagaagccaagcccccttcctatgatagtggaggtgcctttagttggagatacaaaaatatggcttgatgaggatctaaatctttttcacacaagaccatgcagtccatctctcaattgtgatacacagttagtagacagtatagtaagaaccagtgtggtgcctgaccaagcagctgtacaaaatgacagcccaaatgctggacagggtgaggagatcccatcttgtggtcaggatgctaatactggtgttttccagtctgctacatgcaccaaagcagaacctctactacaggaaccgattcatgaagtgaacaaaagctcatgtcaaccatctctgggcacaaaagttgacccggcagcattgccgctagaagcgacgagccatgattgtatcaacaatggaaagttgaacgttgttgctgaaaatatcgatagcacaaacctaaaggacagagagcagctacataagaaagtgggtaccatttttccgaagaaggagcaagacagaaagatggtgaagcaacgggagaagcgcaagaaaaatgatgccctgcccaaagaagataaggatcaacttgcagaaaatgctcaaaagggccatgcagagccaaaaccactgcctagcttcaagaattttgtcgtggaagaggaggaagggtcaggaggttatgggatcgtttatagggctcggagaagcgaagatggaaaagtatttgccataaaatgtcctcgtgagaaagctcattcacatcatgttgacaatgaacgaaagatgttggaacgatttggaggcaagagttttgtgattagatacgaaggctgttttaggagtggtgaactagactgctttattctagaacatgttaagcatgacagaccagagattctcannagagaaataatgtctttgagttgcagtggtatgggtattgtctgttcaaagctctttcaag

SEQ ID NO: 31951 - DNA, 451 bp, Triticum aestivum
  Clone ID: PAT_TA_31951
agcagagtgggctatatcaaggcagaagatctaaggtgcattattcacaacctggggaagttcttgtctaatagggacgtgaaggacttggtggagactgcgcttgctgagagcaattcggcgagggataaccgtgttatctatacaaagcttgtgaagatagtggacctctgatgcgtcccagtttgtagtttccaggaaatctgtttgatggaagaaatttaaagcgaagtcgcaacttattcatctaagattctcgttgaagccttgaagatgatgcatgaaaagttgacatgaggggttcatttttaatttcttccagcatgaattgtacctttcctttttctttttgaactgataacttttttttatggaatggcaaatattagtcccagagttatgcattctttttcccttgatataatataaaggcgtgaaaaagcaacccttt

SEQ ID NO: 31952 - DNA, 797 bp, Triticum aestivum
  Clone ID: PAT_TA_31952
gggaggatgaagatcctgactatgaagaagatcctgaggaggtagaaatatatgaagacgatgaggacatggatggtgatactgctgagcaacaggatggtaatttgaacagtagagaggtcaaattagaagaagtaacaaaagaagataaactgaaccagaaagcagggaaggagatcgaattagaaaatgttgcctgtatagatgaaaagcctgttactatagcagagaaaggaggtttggtagaagttggcgataaggcagctgtatcaccgaaaggagattcagcaaaacatgaagtagttgataaggacctgttgcaggcttttcgctactttgacaagagcagagtgggctatatcaaggcagaagatctaaggtgcattgttcacaacctggggaagttcttgtctaatagggacgtggaggacttggtggaggccgcgcttgatgagagcaattcggcaagggataatcgtgttatctatacaaagcttgtgaagatagtggatctctgatgcgtcccagtttgtagttgccaggaaactctgtttgatggtagaaatttaaagcaaagtcgcaacttattcatcaagattctcgttgaagccttgaagatgatcatggaaagttgacatgaggagttcatttttaatttcttccagcatgaatagcacctttcctttttctttttgaactgacaacttttttttatggaatggcaaatattagtcccgagttataaagcaaccgagtcccacccgtttgcttggaaaaaaaaaaaaaaaaaaaaaaaa

SEQ ID NO: 31953 - DNA, 876 bp, Triticum aestivum
  Clone ID: PAT_TA_31953
gcgcgagatggcatcggcggcggctgcgcgagatggcatcggcgccggctcagaatctgaccggagctgggcaccgggtaggagggcaggcggtgctggcgatggtgtggtaggagccgcatgatggtgcgcgcggtggtggccggcgtgtgcacggccgccgacggtagaagaggggcgggctgggagtaaattgctgacttgggtgaaacgacttggattgatcgaatcatggagaaggatgatgagtgttattctggaaggcgatcaactctggcgacaaggtggacaacatgctcatgaacatggaagtggtgatgaagcagcggcaccacaacgaggaggcaatataagccatcaggtcgttcaggcacctccactccaggcaggcccaggagtcactcgatgacctgctcatcgacctctacaagatagagatataaagatgatatgcctatgtgaggccttcaacagtaagagcaccaagacggatgatcccacgacaagaagttcttggtctcaatcgagcaggagaagtctcacattctggtatagatttctcttacatactcattgataagttggcatctcactgcaatattaatcagttgctgaaactatcatggtggtcggcatgggataaagcgatggtgttgttgcccgcgcggttgtggtgtgggagctgcatcgatagtcatgcgaatgttgctcacctttgtgtgatgtgtgctgatgctgctctattgcatgcaagtttagagccatttatcttgctgcgggttgatgctgctctgctatgtgtctatgctgtgtagcctctgttgtgtgttctgattgggcaattttgcacgggcaactcagaaactgagatttagt

SEQ ID NO: 31954 - DNA, 894 bp, Triticum aestivum
  unsure (1)..(894): unsure at all n locations
  Clone ID: PAT_TA_31954
agtacctctcccccgccgacctccgccgcctcccggccgccgggaagctggtcaccacgctgttccagaccaccggccgcgcctccgccgacctcggcgccgtcaacgtcacggccgccgggccgggcctcggcgtcgtccgctcgcccgcgcccttccccgggtccaacgccaccgtgctcggctccgtcacctccgtgccgtacaacctgagcgtgctggccgtggacggcctcatcgcgccctccggcgtggcggaggagttcgagggcgacgagcgcggcgccggcatcacggtgttcgtccccaccgacgacgccttcgccagcctccccgccggcgaccggctccagtccctccccgccgaccgcaaggccgtggtgctccgcttccacgtcctccattcctactacccgctggggtcgctggagtcgatcgtgaacccgctgcagccgaccctggccaccgagtacgccagccaggccggccgcttcaccctcaacatcacccgctccaacggctccgtagccatcgacaccggcgtcgtgcaggccaccatcacgcgcaccgtcttcgaccagaaccccgtcgccgtcttcgccgtctccaaggtgctgctcccaaaggagatgttcaccagggccgactcggccgccgtcgtcgccgcggccctggcgcccccgccaggcactttgactcgatgccgccgacccgcccagagcgccggctccgccgcgaagtttgcttccccccgcctgnccggttgaccagacaaaccttggtttcccgccgtctttntngggaaggcacaccaattggtggggggtttaattgggtattatcggtccctggataaaaaccgggggactattntcttgcggtcttgttaataat

SEQ ID NO: 31955 - DNA, 854 bp, Triticum aestivum
  Clone ID: PAT_TA_31955
ccacgcgtccgaagagatatcatcctccatggtttcacagtcatttggtgcgtcagacatggcgtttaattcaattgactctggaatcaacgatggtgccttcttgaacaaaagttcttggccacctgctcctccagtaaagaggatgaggacgtttacgaaggtctataaacgtggagctgtgggccggtctattgacattagtcagtacgctggatatgaggaactaaagcatgcactggctcgaatgtttagcatagaggggcaacttgaggaacgacagaggattggctggaaacttgtctacagagatcacgaggatgatatcctgcttcttggcgatgatccttgggaggagtttgtgaactgcgtgaagtgcatcaggatcctttcgcctcaggaagtgcagcagatgagcttggacggcgatctggggagcagtgttgttcccaaccaggcatgcagcagttcggagggtgggggcaatgcctggagggctcgctgtgaccagaactccggcaacccttccaccggttcatatgaccagtttgaatgacctaatttaccagtctatacacaccaacggtatcggtctaagtagacatcgaccgctggaatgaccggagaaggctgtgcggcgccaggatgttgtagattctgtcagcttacatccgggagcgcaagcggctcattggatcagtagtgttctgtttatatgtgtagttgttacaagaaaggaagtaggcatgagtaaatgaagcttacctagagttggagagggttagggggaatattttgtattattggaaaggcaagttctgtggtagtaacctgatgcttcctctgttgtgagg

SEQ ID NO: 31956 - DNA, 1056 bp, Triticum aestivum
  Clone ID: PAT_TA_31956
gatttttattataatattgctgttgtgaacaccaaggcttttccagaacttcgtgcagcatgctttcataatgaggtgggacactgctgtacaaaacttgcaaatttgattgccaacaactcatggcatctacttgtaagaccacaaaggctggaattgggggccccattattgctgctgatggaaaattcataggcatgagcttttattataaggatggagctcctttcttaccaatcactatcctccagaaatgcttaaagcacttcaatgaatttgggagagttctgctgccatggcatggtctgaggattggatcacttcaagctgaaaaactgcgtgtcctagaagaagtacatgacatcttaccccatgcacatggcatttacgtacagaaggttgtgagtggatccccatcagcagattctggaatcaaagctggtgatgtaattaccaagcttgatgactttgcgctatccaatgcacaagagttccatgagctgattttggacaaggcagagagtgcttttcgacatggtgaaagaatgcatcttacggtatctttcctaaggccaagcagtggctctgagttctgtgcaactatcagtgctgaagttatcgacatgagcgaacaaaacatgagcagtcaaaacaagagcaagcaaaacagtgatggccggtacccaagacgaagtggctatatccagatgacgaacgtgatgctgatatgatgccccttgttcgaaagtgtcgtcgacctggctatgtatatgaggcccccttgatgactgacgtatctagatacacaagggtctgatgaataatcaagttgagcaatctcgtagggttactaaagaggagcttgttagggagccagatgtgaacgtttcggttttctgatccatatttggcaactaaactgcatgttatctacccctatgctaagttggcccggagatattttgtttggtttgattgttttattaatgcgtgtatgaaaaatactaagacggggtcgtgggatgtaacgagaaagcgcttgttgtcagcatgttg

SEQ ID NO: 31957 - DNA, 546 bp, Triticum aestivum
  unsure (1)..(546): unsure at all n locations
  Clone ID: PAT_TA_31957
nnnnnnnnnnnnnnnnnnnnnnnnnnnnnnnnnnnnnnnnnnnnnnnnnnnnnnnnaacgcgtccgaacggagccgacccgatccggtcaaaatccagacgactcactgcttcctccgccctccctccctcccgccccgatcccccgccatggtgtgcgtggcgtgcctgatcccgctcttcctcatccccttcgtcaacgcgctcccctacctcttcgacctcctcctcagcaaggtttatcgcatgcttggatgggaatacaggaggcccgagagagtcccagctgcctgcccgttcaagcctgcagcaaacaagactgaaggtgtggcgggtgaatcaaaaccagtagcaaatcctcatgttgcaagtgcaaatcctctggtggaaccccagagtgctaccacagaaatgaagaaagatgattagaacatgtaacgctcgcccgatttgacttatgtgaacaactctcactatttgtatttgtgactgcgtcgtaaccgagaaataattaatgtaagattgtatatttgggcaagggattgct

SEQ ID NO: 31958 - DNA, 724 bp, Triticum aestivum
  Clone ID: PAT_TA_31958
ccatccccccaccttctccgtcttcttcttcctcagaccaaccgagccgaccccgatccggtcaaaatccagacggctgactgcttcctccgcgctcccgatccctccctccctccccgacgaagccatggtgtgcgtggcgtgcctgatcccgctcttcctcatccccttcgtcaacgcgctcccctacctcttcgacctcctcctcagcaaggtttatcgcatgcttggatgggaatacaggaggcccgagagagtcccagctgcctgcccgttcaagcctgcagcaaacaagactgaaggtgtaacaggtgaatcaacgcctctagttaacccacatgtcgcgggtgaatcgaaaactctgatggaaccccagagtgccacagcggacgggaagaaagatgattaacacatgcgttgtgtttataatcaaaccgcaactaaaataataattcatatactgaatgattattgaattgttacatcgcttgtgttacaatggtgtttctcacggttccttttccaacattatttgtgtgtgcatgtgtgttttgtaaaaaaaaaaaaaaaaaaaaaaaaaaaataaaaaaaaaaaaaaaaaaaacaaaaaaaaaaaaaaaaaaaaaaaaaccaaaaaaaaaacaaaaaaagaaaaaaaaaaacgggccccccaaaaggttccaatctaacttacccttgaatgcaatttaaaacccctccaaaa

SEQ ID NO: 31959 - DNA, 892 bp, Triticum aestivum
  unsure (1)..(892): unsure at all n locations
  Clone ID: PAT_TA_31959
ggaggcaggcagacggccaccccccgccagtcttcttcttcctcagaccaaccgagccgaccccgatccggtcaaaatccagacgactcactgcttcctccgtcctcctcctcccgccccaccgccccctccgccctccctccctcctgcgccgaaccccggcgaccgcgatcctggcgtgcctgcagccgccccaccgcttccccctccctcccgccccgccgaagccattgtgtccgtggcgtgcctggtctcgctgtacctcatcccgggtagtcaacgggctcccctacctctcagacctcctcctcagcaagctttatggcaagcagggataggaatacaggaggccagcgaaagtcccagctgcctgtccgttcaagcgtgcagacccaccgagactaaagctgtggggggtatgaatcaaaaccagaaagctaatcctcatgtttcaacgcgcaactcatctagtgtatgtgcaccactattgctaccacaagaaatgaagaaagagtgattagaacatgttaaggttcgcccgatttgacttatgtgaacaactcactatttgtatttgtgattgtgtcgtaaccgagaaataattaatgtaagattgtatatttgggcaagggattgctaaaatattccaagaagccccatccccatataagaaaccaggccccggcacggcntcttttaaactcctgacgggaaacctggnttaccaattancgcttgaacaancccttcgcanctgggtatacaaaagcccacgatgccttcaaaatnccacctaangcaatgaccccccntcggcataaccggggtttggtacccantgccgtantttaagccnanccgnctttctttcctctncntccgtttccnacna

SEQ ID NO: 31960 - DNA, 1917 bp, Triticum aestivum
  Clone ID: PAT_TA_31960
gctggccttcgtaaaatacttcgcgtgcggcgagttcttgttgaacgcctgcgctttctggactcccgcccgggtcatactcattaagttctggaagagggcgtacacggtgctgctgttgacgtcctatacttagattagtctcttccgggctttccggatgttactctgaaggaaggtgtagtgcgtaaagtggtcgccttctacgactgagtagatcacgtttcgctggtagtggctcccacaatattttctcctctagagcttgactttctcatttgtggtcgacgggaactttgggagccggagacactggccgaacatataaattttgatcatggttatacctctaagagtccagcaatagtcaatctactggagatgaagacagaatttgcacatggcaacccccatgagttctgccagtttgtgactggcgcccctcgtcttcctcctggggatttggcctgcctttaccccaggctgactatagttaggatgcactcttcggcggcgtggaatacggcaaaggcccctcgtgcgagtgagtctgcagctgatgatctgcctagtgtcgtgacttgtgccgactatcgtgaactgccgccatactcgacgaagctgataatgttcattcgcattctccagccgatcgacggaggctggtggtcgcttcactttgcttggtccctcgacctcggacacctagtactgcgtcttcattgagtagtagtttcttcatagtcgttgagtatatccgcttagagtggcttctcatgtcaaaagcatagcgagggggcacactgttagttctgcctatgtcatcttcattgtatgttcgtccactgccatgggaaatatagtcgtacggctgtctatcttgtgaaacggtgtgtgcccggatccttcgggacctgcaagttcttcttgctcgctcgcgttacctgggcacccgttgtagatattctccaattgatcgctgtagtggccttgcgggcatgctcctttttgaagacctatgcttagattttactcttccgggcctatccggattttgttctgaaggaaggtgaagaaaatacagtggtctgcatttacaacttagaagagtacatttcgctggtagtggatgctacacttaaggctggaataatgcgccaagtagaagcattcaaagctggatttaatcaggtatttgatatatcatcactccaaatattttctcctcaagagcttgactatctcatttgtggtcgacgggaactttgggagccggagacactggtcgaacatataaagtttgatcatggttatacctcgaagagtccagcaattgtcaatctacttgagatcatgacagaatttactccggagcaacaacatgcattctgccagtttgtgactggtgctcctcggcttccacctggtggcttagcctccctaaatcctaagctgactatcgttaggaagcactcctcgactgcggcgaatacttcaaatgcagctggagcagcagagtctgcagatgatgatctgcctagtgtcatgacttgtgccaactatcttaaacttccgccatactcgacaaaggaggttatgcacaagaagctgctttatgctatcaacgaaggccaggggtcgtttgatctttcatagtgggttcaaaactaacatacagatgttggtgcacatgtaaatgcgcaccagtttttattcaaagttagtttgttcattgccatgtataacataggctttaagtcgtttcttttgtgaaaggtttagagcccggatcttgtggtgcctgtgcttataacattctctctctttttacctgggcacccgttgtatatattctccaattgatctctatagtgactaagaagacatttctcttttaaaaaaaaaaaaaaaaaaaaa

SEQ ID NO: 31961 - DNA, 799 bp, Triticum aestivum
  Clone ID: PAT_TA_31961
gcctccccgagaagcgcgccgcccgcttcgtctacagaatcgacatcgacacggtgaggttaaagggaaccccctagcccaggtcgctgaagccctgcagcgtctgctccccatccaacgtcctcgccaaggcggacgcattcttcggcgtgccggcccacggcgccgccggcctcgagctgcacggcaagggccagctcctcgccgtggaggccatgttcctcatgtcgctcgcgctcgccgccgcgcacctcgccatggcctaccgggccagcagccgcgagaagcgccggctccacgtcgtctacaggatcgacatcgaagcagtaaggttaaagggaacccacacgcccaagtcgctcaagcaatgcattgtatgacacccaccccatcgtccagtcggatgggaatggggattctggagaggcgaccgcaggcgtctctgcttcctcctccggtctcaaatttttggctcgagcagtagtagtttgtgtacactccgattgatcgatcgatcgacacgacgcgccatgtgtatatgttagtacccgcaccaacgtctctctctcccaagtggacatagtgtggagctcagctgtaaatatggtgggacatttgtgcttcggcctcctgcaacataggatgagccgtccggcagatgcgattgctgttttttcatcatcttcttcttctctctgttttagtttcaatcactggacgtcaccatgtctgacactctgaccgaaactgtgaattgtcaaaagaacgaaatttggcggactggtaaaattaatctggg

SEQ ID NO: 31962 - DNA, 794 bp, Triticum aestivum
  Clone ID: PAT_TA_31962
tggcccggacctggttccagaaagactccttgccccctcaacgacaagcccctcgacacgaagcgaaacggcggtgttcctcggcaaggaagccgggggacatcacgacgacgaccaaccggagggcgccacccggaagaggaagagatccaaggtgaccgcgtcgtcgccaaccatcagcgtgaggccatcgagcatgaacgccttcgacatcatctcgcggtcgagcgtgctggacctggccaagatgttcgacgcggagcacaagacgtcggaggcccggttctccagcaaggagaccacgacggcgatcgtgtccaagctggggaagatcgcggaggcggggaggttcagctttaagctcaacaaggagaaggggagagtggagctggaggggagccaggacggccggaaaagggcgctggccctggaggcggagatcttcgaggtggcgccgtcggtgcacgtggtggagatgaggaagacgggcggcgactcgctggagttccaggacttctacaagcaggagctcaagccgtcgctgggcgatatcgtgtgggcgtggcagggaggtgactcgccgccaccaacgctcacgccggcggtgcctaggtcaaacacgaattcctgagttcattcaccaacgcgcttggcatttcaggcatgcctagccatgcgtgaccctcttgtgtaactgatctggcctctgccttgatcagacgatcgccacgcctctgtcgggcgtttcgaaaacgtgaatcagtacagaaccggagcgcgcttgctcttctgtc

SEQ ID NO: 31963 - DNA, 945 bp, Triticum aestivum
  Clone ID: PAT_TA_31963
ggtgattataactacatgaaactaataaagtactagtagtataaccatattagctgggcatgtatctagttaagacaggtgcatccacctgctgtcagtcagagcctacctcgcctcctctgacggagaaaacgacgatcaactaacaccacctcacttcacgctaatccgctcccgatgaacacaggcatcacacgacatctaaagctacatgatgtgcatgggaacactcccgctggccattcttgagtgcagtcaccccagcagagacagcaggctggtcctctgcgcagatatcatctgagctttttatgtggcttagcgccctcttggagtaaacagtaaaggcgaccgtgagaacaacggcaatgacgaacgagattatgttgtatgtcagctcaactggcgtcatcttatacttgccatacttcacatcggccaacgtgcgtattagccgtccgctatagatatagatgaatgcctcaggtgtcattccggcaactgaacccacatacataagggctgaatttgatttctgtcacggccacggcatagttaaaaatcgagtatggaaacggtgagactctgaatagcgcaaccactcgaaactggtggaaccaactcccttcgccagcaagctttattagagctatctgctgaggccatctctttaaccatgcatgtagtcgctcgcggaacaatgagccgatccaatatgctccaaccatgccaagagtagtcccaacaataataatcacgaaaccccagccataaccgaagatcattcctgctaaccacatagaaggtccagaggggactaaaatgagtgggaagatagccaaagacgcgacgaggacaagagccaatactggacgaccaaaggcacttgcttcccatttcatgattggaaagaagaacctgcatgagtaacaaacgcaagaaaat

SEQ ID NO: 31964 - DNA, 874 bp, Triticum aestivum
  unsure (1)..(874): unsure at all n locations
  Clone ID: PAT_TA_31964
tagggccttttttttttttttttgcttttgttctggacccatttctggacacggaggaggaaaggaagatcgctagctagcaagcaggggcctgcagtttgttttccccttcatttttcagctgtatacacagatgcagggagagactagactgaacccgactgaactgaactcaaggttacactacacagcagcagcggcggcggccaagggccggcccgtttagcttctagcgcggctggtggatggcgcggcgggcgccgccgccggccctggggccgacgtgctgcgccggcttctcggcgtgcctcatcggcgcccaggctggcgccgggccgccgcccctcggcgagttcacgctcagcgtcttcagcaccgcgtccatgtcgccgccgaaccctgctggtttgtagtggtagaagtcgggctggggctggggcgacggcggggagtagaagaggtcgtcggcgtcgagcaggtcgacggagtcgtcggggaggagggcggcgacgtcgtccacgtcgacgtcgtcggcgaggtcctcgtagagctggtgctggcggaaccagtggtcgcggaaccaggcggtggtcttgaccagctcccaccactcgggcgagtagtcctccaccttcttgaacgccgccgggatgaacatgggcgcgtccgggttcagcgccgacatcgccatggtgctcatgatcaccacttttctctgccgttcgtcggtcgtcggggcggacgaaatatctctcgtggttatctgggtagacgggtgggatttctggggtgttccgacgactcaataatccctactcgactgtatcctagcgttttttatcaacgtgctaaactgaaggacacttntgctcgc

SEQ ID NO: 31965 - DNA, 1082 bp, Triticum aestivum
  Clone ID: PAT_TA_31965
cgtccgcggacgcgtgggcggacgcgtgggcggacgcgtgggtcgcaccctgcattccaaaacctctcaaaaccctcgttctccccactccctgcctcctcctccgccgccgccggtgcctagcaagatgagtcggcaccctgaagtaaggtgggctcaaaggattgacaaggtgtatatcacagtacaattgcctgacgcaaaggatgccaaggtcaacctggaacctgatggtgtattctctttctttgccactgctggaactgatgggaactcctatgaatcgaaactggatttgaatgacaaagtgaatgtcgaggcaagcaaagtaagtgttggtgtcaggtccatattctgtattttggaaaaagccgacgccaaatggtggaataagcttgttcgagatgatcagaaggcaccacacttcgtgaaagttgattgggacaaatgggtcgatgaagatgatgatggtgctgatgttaatgttgatgggatggacttttcgaatatgggtggcatgggcggtatgcctggcatgggaaggtttgggcggcatgggcggcatgggtggtatgcccggcatggaaggtttgggtggcatgggtggtatgggtggtttggctggtatgatgggatggtatgggcggtatgggtggtatgggcatgccgcctggtatggaaggtttgggtggtatggggatggatgattttgaggatgagagtgacgacgaaggagaagtgtcgaaacctcaagacgcagggaagtctgatgctgcggaaatctctgaggtggaaggcaaagctggcacagcagctcagagcaactgaaggctttctactcaataatccctactcgattgtatcctaccgtttctttatcaacgtgctgaactgaaggacacgttctgctcgctggttgggaatggtgtctcatgtaagatgatgacttatacttgtgtcgaactaagcttcgtaccgtctgttggcatattacgagttctgagactgtttgcattgtatgctgattgttctgcactctgttctgcactctgtttgcattgtatgctgattgttctgcactc

SEQ ID NO: 31966 - DNA, 1263 bp, Triticum aestivum
  Clone ID: PAT_TA_31966
ctcctctgacggagaaaacgatgatcaactaacaccacctcacttcactctaatccgctcccgatgaatagacatcacacgacatctaaagctacatgatgtgcatgggaacacttcctggtggccattcttgagtgcagtcaccccaggttggtcctctgcgcaagtatcatctgagctttttatgtggcttagcgccttcttggcgtaaactgtaaaggcgatagtgaggataacggcaaccacgaacgagattatgttgtatgttagctccaccggcgtcatcttatacttgccatacttcacatcagccaacgtgcgtattagccgtccgctatagatatagatgaatgcctcaggtaccattccggcaactgaaccacataggtaaggattgaacttgatttctgtcacggttacggcatagttaaaaattgtatatggaaatggtgagattctgaatagtgcaacaactcgaaactgctggaaccagttcctttcgccagcaagctttattagagctatctgctgaggccatctcttttattggggacatcgttcatgatgccgcgtctcgtcggggcgacgtacctcgtgtctgggtggagacgggtgggatttctggggtgtttagccgtgcatgtagacgctcgcggaacaatgagccgatccaatatgatgcaaccatgccaagagtagtcccaaccataataatcaagaaaccccagccataaccgaagatcattcctgctaaccacatagaaggtccagaagggactaagatgagtgggaggagagccaaagatgcgacaaggacaagagccaatacaggacggccaaaggcgcttgcttcccattgcatgattggcaacagaaccttctgaaaggcaaaggggactccaaatttcacgaagatataagatgctaatgtaagaaggaagcagccaagcagaactttcatccaccaaatgaagtgtcttgactttggttgctcaggaatttctatgttgttgtcagctgttgcatgttgagctggtgtcaccagcctcgcatattcgtcgtccttcatgtttgatgccacagctgaagagcttggcatgcttgcgaccgtctcaccagctctgggtgcctccccgggctcaatgtcaagagggagcacgcgcgccatgccgagggcggagatcgatccagagctttgcttcttcctcctccccttctccgtcgcttctggaagctcgcggcggaggggaacaataaagcggc

SEQ ID NO: 31967 - DNA, 1624 bp, Triticum aestivum
  unsure (1)..(1624): unsure at all n locations
  Clone ID: PAT_TA_31967
ccttttttccttgtttctttagctgttgcgctgccgccatgccaaaacctctcaaaaccctccgtttcttctttttttgagaaaaggtcccagcgttggacctgattaccatctcatcatagtttacacatgatctttttttttggtgcttttgttcttgacccatttctgaacacgggagggaagctacaagggaagggagatcactagctagcaagcaggggcctgcagtttgttttccccttcatttttcagctgtatacacagatgcagggagagactagactgaacccgactgaactgaactcaaggttacactacacagcagcagcggcggcggccaagggcaggctcgtttagcttctagcgaggctggtggatggcgcggcgggcgccgccgccggccctggggctgacgtgctgcgccggcttctcggcgtgcctcatcggcgcccaggctggtgcggggccgccgcccctcggcgagttcaggctcagcgtcttgagcaccgcgtccatgtcgccgccgaaccctgctggtttgtagtggtagaagtcgggctggggctggggcgacggcggggagtagaagaggtcgtcggcgtcgagcaggtcgacggagtcgtcggggaggagggcggcgacgtcgtccacgtccacgtcgtcggcgaggtcctcgtagagctggtgctggcggaaccagtggtcgcggaaccaggcggtggtcttgacgagctcccaccactcgggcgagtagtcctccaccttcttgaacgccgccgggatgaacatgggcgcgtccgggttcagcgccgacatcgccatggtgctcatcatctccctcctacttttgcgctgttcgtcggtcggtcgtcggggcggacgcgtccgggacgaaatatctctcgcgattatctgggtggagacgggtgggatttctggggtgttccgctgttattttttgggtgcaactaagcttcgtaccgtcggctggcaaattacaaaaagagagaaggtgcgcatataacacggaagctgacgcgcagagctggcagccaccaattgaagtgacttgacttggggggctgagggaaaatttctgtgttgttgtcagctgttgcatgttgagctggcgtcatcagcatcgcgcattcctcgtcctttatgttttgctcagaatgctcgattccattgcatgatgccacagctgaagagcttggcatgctagcaaccgtctcaccagctctgggcgcctccccgggctcaatgtccagagggaggacgcgtgccatgtccgaggctttgcttcttcctgcccctctccgttggttctcccccctggcgcgctgagcgggtggcgcccgccacccagtggccccggccgtccggcgcggcgccacgcccgccggccgcggcaggtttgcgaccgtctcaccagctctgggtgcctccccgggctcaatgtcgagagggagcacgcgcgccatgccgagggcggagatcgatccagagctttgcttcctcctcctccccccccccgccgcggctggttgctcgcggcgcgccggtttttttttttttttttttttttttttttttttttttnnnnnnnnntnggtatttt

SEQ ID NO: 31968 - DNA, 792 bp, Triticum aestivum
  Clone ID: PAT_TA_31968
cttatccgagcgagccgtccggcggcgccgcggcggccggagtcgtctctcccatcggccgcgccgccaccgtggtccacgatgggcttgcgggaaggtggcgcgcgacgtttgggttgagagacgcggcatccgcggcagctgccggcggcgagcgatgacgactgcccgcggtcggagcgcgcgcgatgatggccgcgcgggctcacccaacaaacaaaacaatctcattactttcttgctttcttcgaagggttttcatcttttttttgatcgatttctttttgttcgttttttgcttgtgcttgctatttgtattcctgagcaaattgttctcttcagtatgtttttggttcagtaggatatttttcctgcggaagtgcatatcaagtatggtttttttttttttgcggattcgagttaaatctcttgtctaatactcctaaatcaccatccataatagtagaaagtaatctgttattatgggtgttgatttgctgaacttacacagaattcagattgttattctgcaggttgaatctttgattgctctcttggaagcgggaatttgctagttttcctgttcgagacgaatacatgacctggagactgttatagtgtagtttatctataataaggtgtctaatttcgttaggagctgcgcgctgtaatctttctcttattggttggcggctgccagcaggcagattcagcctgttagtggaggatcatgttgtaatattattaactgtatttgtatatgacaaagattcaaagaaatgccgttgtaat

SEQ ID NO: 31969 - DNA, 760 bp, Triticum aestivum
  Clone ID: PAT_TA_31969
ctccttcctcgcatgccccctgagttcctgcaccgagactgctagctagctataatctcctcggcttctttctccgtcccctcggccggcctgccacccgatcgttcctgatgtccggcaccgtgtgctccatgtgcggcgacgtcggcttccaggacaagctcttccgctgcgcccgttgccgctgccgcttccaacactcctattgcacgaactactacggcgacgcggccccggctgacgcgggcgccggcgtgtgcgactggtgcctcagcgacgaccccctcgtgaagaacaggcgcccttcggcgccgccggccatgcagcaccgcggtccgccgaccgggatgggctgcggcaaggtcaaggtgaccggcggcggcgagcaggagggcggccggagagtggccaaggcggccgtccgcaggtacaagctcctcaaagacgtcctgtgctagctagctggtgcatgcatggtcctgggtcaccgcactcctttccttagatcgggacctcgtcatcatgtgtactaaaaaacgatgctgtttaattaagtagtcgatagtcgttgtacctagctagctggcgaggttctgcttccatatcgatccttgtgtgcaaatgtcggcatgtcacaatgagatctacttctgtaaatatgcgctgctactctttatctctgtcatcaactgcgtgttgtcgtgtgtgttaaattccacaagtgtatgatcagtggcagtaagcaatacatgtgttcgtc

SEQ ID NO: 31970 - DNA, 702 bp, Triticum aestivum
  Clone ID: PAT_TA_31970
cccacgcgtccgggtggaggaggctcaccgccgcgagaggaagatccggtaccggtagatcggagaagaagggtttgttcgggagcgatggatgaggagtacgacgtgatcgtgctggggacggggctcaaggagtgcatcctcagtggcatcctctccgtcgatggcctcaaggttcttcacatggacaggaatgactactacggtggagaatctacatccctgaatctggccaagatctggaagagattcaaaggcagcgacaccactccagaacatctgggtatcagcaaggagtacaatgtcgacatggtgcccaagttcatgatggccaacggtgcattggtccgtgttttgatccgcaccagcgtgacaaagtatctgaacttcaaggccgtcgatggcagcttcgtgtacaacaacgggaagatccacaaagtccctgcgacagatgttgaagccttgaaatctaacctaatgggcctgtttgaaaagcgccgcgctaggaagttcttcatttatgttcaggactacgaagaggatgacgcgaaatcacacgaaggcctagatctgcacaaagtcacgacgagggaacttatctccaaatatggactggaggatgacacagttgactttattggtcatgcattggcacttcaccgggatgacaactatctcgatgagcctgcacttgacactgtc

SEQ ID NO: 31971 - DNA, 1948 bp, Triticum aestivum
  Clone ID: PAT_TA_31971
cggacgcgtgggcggacgcgtgggctcctatgagtgccatcgcatgcgcgtccgacttcttccggattcccgaacgccaaatcccacccccacccctaactgctgcccttttgtcaactccacttctccccaccgccgtcctccgtgctgacgcctctcgctccccggagccaccgcgacaagctcgccgagaggctcgccgccatggatgaggagtacgacgtcatcgtgctgggcacggggctcaaggagtgcatcctcagcggcctcctctccgtcgacggcctcaaggttttgcacatggatagaaatgactattatggtggagattccacttctctcaaccttaatcagctctggaagaaatttagaggggaagacaagcccccggcacatctaggctcaagcaaagattacaacgtagacatggttccaaagtttatgatggcaaatgggacattggttcgaaccctcattcacactaatgtaacgaagtatttgtcattcaaagctgttgatgggagctatgtcttcagcaaagggaagatccacaaggttcccgcgactgatatggaggctctgaagtctcctttgatgggcttttttgagaaacgcagagcaaggaacttcttcatttatgtccaagattacaatgaagctgatccaaaaacacatcagggattggaccttacaaggatgacaactaaagaattgatcgcaaaatacggattgagtgatgatactatagatttcattggccatgcgcttgctcttcacagggacgatcgctacctaagcgaaccagcaattgatactgttaaaagaatgaaagtatgccctgactaatttttttagttttttcttttcttaagaagatagaaggtttctggcttgttaacatcaatataatttctatgatttgctacccttgtttatttgttctttggcgatatttctgctatttaaatgtattttatcaatggagcataatgaaactttgctgcttgctgctagctctattctgagtctcttgcacgttttcaaggaggctcaccttatatttacccattgtatgggttgggtgagctgccacaggcttttgcacgtctaagtgctgtttatggtggcacttatatgttaaataagccagagtgcaaggttgaatttgatatggaggggaaagtgtgtggtgttacgtcagaaggtgaaactgctaagtgcaagaaggttgtctgtgatccttcttacttggccaacaaggtaaggaagattggaaaagttgcacgagcaattgctattatgagccacccaattccaaatgcaaatgattcccactcgattcagattattttaccacaaaagcaacttgggcgcaagtcagacatgtatgtcttctgttgctcgtacacccacaatgtcgcaccaaaagggaagttcattgcatttgtgtctgcagaagcggagactgataatatacagtccgaactaaagcctggcattgatctacttggtccagtagatgagctcttttttgatatgtatgacagatatgaaccagtgaacgaaccatctcttgataattgcttcatctcaacgagctatgatgctaccacacattttgagacaactgtgacagatgttcttaacatgtatacaatgatcaccggaaagactattgatctcagcgttgatttgagtgctgctagtgctgctgaagaagaatactagatttcataatcaaaatacggccgttctcttcaaacactgcaggacaaaccataacaaatgtcctgactatttcacccgcagatcaaaatctggtgttatggccattgtcttccgcatgcttgtcgcttgcagcaatatggaaaaaatgttggttccagacgattgaaccatggtggttttatttactactgtactagaaaagtaattagtgaatgatggt

SEQ ID NO: 31972 - DNA, 1840 bp, Triticum aestivum
  Clone ID: PAT_TA_31972
tgccttccccagcccgttctgctgccgctgctctgctctgctctgccggcccctccccgcgagcggctccgtcagcgagccctcgacgccccaccgcccgccgccgtgctggcccctctggctcagcgggggcaccccgacgggctccccgaccgccggggcccatcgatttggcccacggagtcatcttgcgggccacggggctgtactaggacctgcacatcgggcggccctcggaagaggcctccagggcaacgaaaatcctcagtgttgtctgttacaaggaaaatctcacgtctaggaatcgttaccaccgttgaaaatggaaaagggtggatgggtagtccttgttaaagacaggctaaagcaaaatttacatacttgacaagccttctaagatcatgttgtccaaaagaacaatagggcccaaaatcatgctgccacagatttcgatgctcttaaaattcatatgttcgggtctgatgaaaagtctgaagcaaaggactttttcagtaaggttcaggatcacaaaggggctgacccaaaaacacatggaggagtatatcgtacaatagaaatattaaggaaacgtatagctaaaaacggattgactgatgatattattgatttaaatgctgatgctctgacactacgacgcgatgaccgcaatcagagcgagaccaccattaatgctctccaaagaatgtaacttcattataagtattcaacaccgttccaagggagagttgattatatgtgctgccagtacgggtggaggagtactactccgtactgcgcacgtttctctgctgtatatggtggcacgtatagacgaaagaatccaaggggaaggtgaggagttccatgggacgggtaacctaagtggtgtatagggcaaggtggaaacgccaaacgtgcgaaaatgctgtgtggaacttcttatacgtgggacagtgcatggataatgcgttaagggtggcgcgtgctatatgcataatgaaggttccaattcctgacacctagcgcgtcttagtccgtgcatattatactcccacagaaacagctgagacgcaaatcagacctgtacgtgttctgctgatccaccactcgcaacgtagcaccgaaaggcaagttcatctcgtttgtgtcgccgcaatgtagagccccgacgaacctgagatcgagctgataccggcgaacgggctgtctcttgcatgtgtggaggacacattccttacgacatgtcacgatcgatacgagcctgttgatgttgctgaggaggacaactggatatggacaactagctccgacgcgaccacccaatttgagacaaaggtgaaggatgtgttcgccttgtacagctagatcactggaaaggaactagatctttctgtggatctgaatgctgccagtgccggtgaatatgtcgccgcttgaacatctggtgctagtagataacttcagttttctttctttctttgtccatcgtttcgatcatagatggatcggttccattcaatccatttggtgcatttaggcctcaagttgtgcttactccaccagagtataaaaccctggatttatatacgttgtatactctgtgcttgtcgtttgcagcaaaatggcaaaaaaatgctctgtcctgtcgattgtaccatggtggttttatttactaatgtacttgatgagcatttagtgaatgttgtgaacagtgagaagggttggctatgaactttggggttttatgtatgtatcataatataactgttaaaataactttacaagtctggctacgaacagggttgatgttccaaaaaaaaaagtcaatgaaaaacctcgg

SEQ ID NO: 31973 - DNA, 971 bp, Triticum aestivum
  unsure (1)..(971): unsure at all n locations
  Clone ID: PAT_TA_31973
gccaaagccaacaagaagaagagagaagccaccatcacctccagcctccaggagagagggaccgcggacggagctagcactagcaggcgggccgatcgatgatggcggcggcgaaggcgctctcctccgtgctcctcctcctcctgctcgtcgccgtcgcgactccggaggcggcggcggcgaccatcaccaagcgcgacttccccccgggcttcatcttcggcaccggctcctcggcctaccagatcgaaggtgcggtcgcagaggacggaagaaaacccagcatctgggacacgttcacacactcaggccattccgtcgatggatcgaatgctgatgtgactgcagatcaataccataagtacaaggaagatgtaaagcttttgagtgacatgggcgtcgacgcatacagattttccattgcttggcctcgccttattcccgatggccgtggagctgtcaatccaaagggactggagtactacaacaatcttatcgatgaactcttggctcatggaattcagcctcatgtcacgatatatcatttcgacttccctcaggctcttcaagacgaatacaacgggatgcttagtcgcaaattcatagatgactacacggcgtatgcagaagtgtgcttcaagaactttggcgaccgggtgaagtactggagcactgtcaatgagccaaacatagagccgattggcggatatgatcagggtatcctcccaccacggcgatgctcattcccattcggcgccctcagttgcgacaacggcaactctaccacagagccatacatagtagctcaccatcttctgcttgcacatgcctcagcagcgtccctgtataaggagaagtaccaggccaagcaaggaggcaaaattggactcacatgctcggtttggtggtacgagcctgcgacacannacacctgagatatagcagcagctgaaaggatgaatgacttccat

SEQ ID NO: 31974 - DNA, 1955 bp, Triticum aestivum
  Clone ID: PAT_TA_31974
gccagagagaccggagggaggaagcgaccatccaccacccggcggcagggggactgtgggcggagcgatcgatgatggcgctcgcgaacgcgctctccgccgcggcccccgtcgcgctgctcaccatcgcggctcacgacgcggcggcgagcatcaccacgggcgccttcccccccgggttcgacgttggcgccgcgttcgccgccgactgacgccaagtccgggtcgcggtcgccggcggacaaccccgaagctgcgcccgcatcccgcacgcgggcgcccattctgatgggtaacatcatgaagtcattgctgttcagattcaaatggacatggaagttgacaagtttttgagcgccatgggaggcgatatccacatatgtggagagggcggggctcgccatgtacccgatcgcgttggtgatctcaatccaacgggtctgcgatagtagaacggtctttccgatcaactcatggcatatcgagtccactctcacctctcgattcatctctactaccacgctaaggctattcatgacgaataagacgggatgcttagacgtaaattcagtgatgactataaagtttatgtggacggtgtgctttaaggacttctgcgacagggtgaacgactggagcaatttcaaacgagcctaacatcgcgccgattggcggggaacaccagggtatcgtcccaccgcgacggatgttcattccccttcggcttcctccagttgcgacaacggcaactctaccactgagccatacatagtagctcaccatcttctgcttgcacatgcctcagcagcttccctgtataaagagaagtatcaggccaagcaaggaggaaatattggactcacattgctcggttggtggtacgagcctgcgacacaaacacctgaggatatagcagcagctgaaaggatgaacgactttcacattggatggtatatgcatccgttggtgcacggagattaccccccagtgatgaggaaaaatgttgggtccaggctaccatcattcaccgacgaagaactgaagaggctgctcggatctttcgattttgtcggatttaaccactacattgcggtatatgtgaaggctgatcttagcaagctggatgatgagctgagagattacatgggcgatgcagctgtgaaatatgacatgccatttttgaagaagaaccagctcctgtttgggttgaaaatgcgatttcagaacatcgacaccgtgggctctgaagaaaatgctggagcatctccagctcaaatacaagaaccctatagtcatgatccatgagaacggagctgctagcattgctgatctctctgctgggaacgcccccaacgacgagttcaggtcgcagtacctgcaggattacatcgaggcgaccctcgaatccagcaggaacgggtccaacgtgcagggctacttcgtgtggtcgttcctggacgtgttcgagtatctgtttggctaccgcatgggcttcggcctctatggcgtcgacttcaactctggggagaggacgaggtaccagaggcactccgccaagtggttcaccggcttcctccgtggcggcgagctcaggccggtggctctgcccggccaggcctattcccagtgatcttggcacacttcttcatgcttctgtagcacacggagaggaggatgtacggcgaataagcctgggaagatggttggggtgttgtttttggatggaaaatgaattttgcttgggcaggagggtttatatataggtctctgacttctttgtgtgcgtttgttcctaagtttatatataatgttttgatgtttatgcggaaaatattaatatgtcgatatacaaggtgttggatacagataggcggaaaaaaacaaaatgaccacatacaagaggccgcaactagtcagcagttcgagatcgaaatcacgtacctgcatttaaaaaa

SEQ ID NO: 31975 - DNA, 1008 bp, Triticum aestivum
  unsure (1)..(1008): unsure at all n locations
  Clone ID: PAT_TA_31975
ggaatttccttggacgttacaggtgagaagagagaggatcagccagcggatgaaatttctccaggacctcgtcccaggatgcaacaaggtgattggcaaggcactgatgcttgatgagatcataaactacgtgcagtcgcttcaacggcaagtcgagttcctctccatgaagctcgcaaccgtgaacccgctcgacttcagcaacctgcccacgctcctgcacaaagatatgtacggcccatcggcgagctcggtgttctcgctcgagagctccagctcggccttcccgttcagcgaccaaggagacgtcttccagtccttcctgcccaacagcatggagagccagtgcaccctgaatcagctggacctggctctgtcccaggccaccaacgcagcgcagtacgccttccaggatgggacggccacggccagcacgaacctgcagcagcagaggaacttctgggaggacgatctccagagcgtttttcatgtggacaccaacaggcagagccaggataacggggtctcggcagagagcttccacggtgatctgcaggcaggccagatgaaaatggagttctagccggcgcccctgaaggataaaaatgattgacggtctgtacataggaagaatcaagaagacggaagcggtggcgagtgaagctatagctctcagctctgaagctaacagtctctgtaattaggctctactactaccaagggacgagtttcttgtgtcatattctgcctgtagggcggtgtgatgtggttcctctaatatcgctggcactgattagcatatctcgtcgatattttaagtgattattaatatagcggaacgatcagttacaaaaaaaaaaaaaaaaaactcgagggggggcccggtacccacttcgccctatagtggctcgctgctgctcctcaaagttttaatatccgtgggcgatnaaaaaccccgtcagtatacagattcccttgggagcttaacttctctccaaaaaaaaaaaa

SEQ ID NO: 31976 - DNA, 1359 bp, Triticum aestivum
  Clone ID: PAT_TA_31976
cccacgcgtccgcccacgcgtccgcggacgcgtgggtccggacgcgtgggttttttttttttttttttttttttttgctggaaaagatgccatcacatggccaacttatataaacatgtgattcagattcttcagagtgctagcagagtcagtagctgcacacatctggagatcatattcatacatccctaggggaaaaccttggacatgccacacagaattttaccgacagcgacgtcggacggcacaaaaaatagctatcgcacgatttgactcattgcattttttttctccagccaactcgcaatagattctccggtcgaaatggttgctctgcaactcaattgtagatttatgtgtttggtatcaccgatgacttccgatccaagacctgaacttcccctttcgacgcaattacggcatacggcgtagtgttgcaaattatcccatggtccacaacgccaacgattttctccaagccttctgctacctttccaagatcctggattggggttgtgaagataacatcaagtatgtgatggccctctttggttaccagtgggaagtcgcctcctgatggaccggcagttccaattgatggcctcctccaaacctctgcatcgcctaggaacaaatcatcaatctcttcagcggtgtcgatccagtttccacttttgaccaaaactggaatggatccctcgatgccattcacatatttgtcgttgtcaatgataaaagcaaccttgtcagccgattcaacaatacccttctcttgtatgaaagaaggctgcccgctttcagttttcccgcgcccgatgacagcagcgagtgtgccctcttcaattacatcagcatcagtgaaagcaaaatcaatttgggcgccttcctcgtggctgccgacctttatccctgctttctccgcctcacttgcacagatcacagacgagggtatgccgacaatgccggtcagcgagcctcgccggaggcgcgtgccgaggtactggacagcgagccccgacgcggcgccggagccgagcccgaccaccatgccgctcttcacaaactcgtccaccgtgagcttggcggcatcgaagaggcggacgacatcggcgtcggcggcggccgcgcaggccaccgaacgtcgtccccggagacaccgcgcggcgtggcgctgcggccgcggtcgccggcacagggggacccgcgcgtgcgagcttgccgcgatgcttgctctggcgactgcctccatggagacgagcggcgaacacgggggctgcctccctgctggagagtcagctttgccggtgtagcgtagcggtttcgagaccggccacacagttgggtaagcaccaccgttca

SEQ ID NO: 31977 - DNA, 861 bp, Triticum aestivum
  unsure (1)..(861): unsure at all n locations
  Clone ID: PAT_TA_31977
cgtccgctcgatctcatacaatgtcatgatcaagggatatgttgaggcgaataaggttgaggaggcagtggggttgttcacggatatgggggagaaggggctgaggttgagtgagaagacttttgctgcgttgatgccggggctttgcgatgatgaggggaaggctgcggaggcccgcaaggcagtggcggacatggcggagcgacgactcacgccaaaggacaaatcggtgtttctgaggctcgtgtcgacattgtgcaaggctggggatttggatggggcgttggaggtgcataagaagagtgggcagttcaagcatgtcctggtggatccgaggcagtacggtgtgttgatggagagcttgtgtgcaggtggtaagtgtgatggtgctgtgcaggtgctcgatgagcttctagagaagggcacactgcttagcccaaagagtccagtgatggaagcaccggcttataatccagtgattgagtatctgtgcaacaatgggaataccaacaaggctgagacgttcttcaggcagctgatgaagaaaggtgtggatgacaagtctgcattcaacagtcttatccgtgggcatgcaaaggaaggtgcgctggaggctgcaaaggagattcttgccattatgacacgccgtggcgtccctactgacccccactcgcacgcactgcttattgatagcttcctgaagaagaatgagtcagctgatgcaaagacagcattggacagcatgatggaacatggtcacttaccaaggccagctctgttccagtctgtcatggtggcacttttcaacgatgggccggttcaaaccgcaagcangtcatganganttgatnnaaaagggat

SEQ ID NO: 31978 - DNA, 676 bp, Triticum aestivum
  unsure (1)..(676): unsure at all n locations
  Clone ID: PAT_TA_31978
gacccacggcgtnccgcccacgcgtccggaaaatgaaaaacctttcatatacattttcaacttgatggcacattggaccatagaaaaggatacaagaccctacattcaaggaaaaattaagggtttgattacctctgtcaaacgatttcaatttaggaaccgcagagagtacgagcttcttgtgtgcatagatgatggaagtcaaatttcagaggcctttgttgacagtactattgtacgtaacataattggccactcatgtgaggaggtttcaactgccgtttctgatccaacctcagaatcgtacatcgctatgaaacaaattctgagtggatttcagcattatttggagaaatttgagggtacaatgcatattgagtacaacggacaatcttctcgacctatcgtgcgtgagatgaacgaaggttgttcgactgctgatgcatggctcctgcttcagaggctgaaaacatgtacggctcaacggcacatccgaaatttggactttatggataccaccccgtgtctatggtcagcctttttgctcggttaatgcaaaagccacatcgtcctgatcttgatatgctaggccacttgtgaagttttcagctctaggcttaagcagcactcagtttctcgttttacatctatgcttctgctataaaatgttttcact

SEQ ID NO: 31979 - DNA, 917 bp, Triticum aestivum
  Clone ID: PAT_TA_31979
gtccttcgcgcggagccccgagagaggacgggagggggaaggtcggccgtgcgcgtgctgctatcgcagcgccgtgaactgtcgaaggtgcaagagcaggatgaatcaggttagcgaggagcctagggatgatccgtccaagagagtgagcgggggcgcgccggcggcggcccgcgccggctgcttcgactgcaacatctgcctggacttcgcggtggagccggtggtcaccctctgcggccatctctactgctggccttgcatttacgagtggctgcgccgcgacgccggcggcggcaccatctcgacggcagggcgggccgtgccccgtgtgcaaggccgcgctcacgctggactcgctcgtgccgctctacggccgtggcggcagccggtccagcaagtcacggctccacccggcccttccgcgccggccgaccgtgcaccggggagccgtcgagcaacagagagcgcaaaccagcggtggcagtggccgccggcacgtgagcacggaacccgattcgccaactcgttcatcccgtcacgcgcatgtcggtgccgcgcagttcgacatcatgtaccctcctccggccctggggcgcggcatgaacgcgatgaactcgacggccggcggggtgctcggagggatggccctggcgttgctcccctgggtgttcggtggccaggcgccggcgccgagctaccccctgggcgagctgcaaaacctgagccctaggctgaggcggcagcacatggaggtggagaggtctttgcatcagttattgttcttcctctttgtgttcgtagtgctgtgcctgctcttgttctgatctcccggagcacattcgtgcaacttctgtacagatagcgtgtcgtgtacatagtacaactcttaaaagaggtcatgtgttagcactatt

SEQ ID NO: 31980 - DNA, 954 bp, Triticum aestivum
  Clone ID: PAT_TA_31980
actcacaatggcttcctcttcctcattgtttctccttgctgccctccttgcgctggcctcatggcaggtcactgcctatgatcctagccctcttcaagacttctgcatcgccgacatgaaggcgcctgtgcgagtaaatggatttgcttgcaaggacccaatggccgcaaccccggaagacttcttcaacgcagccatgctcgatcagcctagggatactaaggccagcaaggtcaggtctaacgtcaccaacatcaatgtcataaatttccccggcctcaacaccctcggcatctcgctggcacgcatcgactatggaccgttaggtgtgaacacgccacacatacaccctcgtgccactgagctcctcacagtgctcgaggggacactctaccttggatttgtcacatccaacccaaacaggctcttctccaagatagttaagaagggcgatgtattcgtattcccaaaagcaatgatccacttccaaatgaacctagcgcatgacaagccagcagccgcgttgtcctcgctcagcagccaaaaccctggagttatttctattgccaatgcagtgtttggatcaaagccaccgatttcggatgatgtcttagccacggcatttcaggtggagaaggatctcattcactggctccaatctcagttctgggggaacaccaactactaaatattctcttttatctgggcatatgagaagttaatatgtaatgatatatactcccatcatggagtagaataaatgacatgcaatatgatgcatgcatggttgcgagctgtgaattttcatttcctttctgaatcgtgacaagatatgttttttgtcggattcatgtcataatgtgctggtgatgttttcactgtttaatgaatggaatacagaggtgctcctttctctcaaaaaaaaaaaaaaaaaaaaaaaaacaccaggccccc

SEQ ID NO: 31981 - DNA, 998 bp, Triticum aestivum
  unsure (1)..(998): unsure at all n locations
  Clone ID: PAT_TA_31981
ccaactggcgtcctggcttcctcttcttcatcgtttctccttgctgccccccttgcgctggccgcctggcaggccactgcctatgatcctacccgtcttcaggacttctgcattgccgacatgaaggcgcctgtgcgagtaaatgggtttgcttgcaaggacccaatggccgccaccccggaagacttcttcaacgcagcaatgctcgtcgcacactagggatactaaggcgaggaagcacgggtctaactaaaccaaccaacattatcataaatatctcccgcctcaacaacctcggcggcctgtcgcttcgcaccgatcgactaagcactaggagtgaacacaccagacacacacccgcctgccactgacctcctcgcagttcacgatgatagactctcccctgtctttcatcacaacccaatccaaacacacctcatctcgatctttagttaaggatggtcgatgtatgcttattcataaaatgttaccgaatccacttcgaaatagaacctaacgcatgacaagccagcaagagccgagcagtcctcctgctccaagcctgccaaaaaccatggagttgttatttattgccaatgcagtatctgtgattaaagccacacgatttccggatgatgtattagcccctgcacttcaggatgagaaggatgtcattcaatgtgatccactctcagtactctggggaacaccaactaataaatattctatattatctgggcatatgggaagttaatatgtaaagatatatagaattaatgacatgcaatacgtatgcatgcaacttgttgctacattgtgaatttttattttctttttgaatcgtgacaagatatgttttttgtctgtattcatgtcatacatgtgctaggtgatgttttgcactgtttgatgaatgggaatacagaggtgaatatatctgcacacatctcgcccacaaccacgcataatcacttagtgaattcnccattccctaaagg

SEQ ID NO: 31982 - DNA, 1031 bp, Triticum aestivum
  Clone ID: PAT_TA_31982
ccttcgtcaacctcaacgccgtcgtgctcatgacgctctgctccgtgctcctcgccctccggtcgggcgacgccggcgagagcccggaccggaaggggtacatcatcggcttcgtcgtcacgctcggcgccgcagggctcttctctgcatacctgccggtgatggagctgctgtaccgggaggcggtctcaggcgggttcatcctggcggtggaggtgcaggcagtgatgcaggccatggcgtccgtcgtggcagcgatcgggctcgcagcgaccggcggcttcgccaacgacgtggcccactggaaggggtcccacgccgtttactgggtcgtggtggcaacgttggtcgtgacatggcaggcgtgcttcatgggcaccgccggcgtgatatacttgacgtcgtcgctccacagcggcgtgtgcatggcggcggtgctcacggccaacgtcatcggcggcgtcgtggtgttcggcgacccgttcggcgccgagaaggccgtcgctaccgcgctctgcgtctggggcctttcctcctacctctacggcgagtacatcaagatcaagaagaaagccgacgatgatcaggacgaggacaccaccctctccggcgcccgtgacgacggcgagagcgtgcacaagagcctcactgccgccgccgtcgacaccgtttgaagcaaacgaggcagcgccggccacagtgggtgcgcgtgagccatgtgatcgataagtgcattgcgacaatagcaatggaaactgaaattttcttggtgcgtagtaccaccagaaagcaaagtggcagggtagatgatgcattaggtgtagacgtggcatgttacatcgactaggccatgagttgtgtttacagcttacaaagagacaagaatggtgtggtgatgatgatggatgcttgtttggtgggctgctatgtatcttatgcatgttgcacttgcatgggtgtgtgaaaaacttgcacattaatgtagtaccatcaacagggagcatgccattcaatatatatatcttttcttg

SEQ ID NO: 31983 - DNA, 1147 bp, Triticum aestivum
  unsure (1)..(1147): unsure at all n locations
  Clone ID: PAT_TA_31983
ccacgcgtccgcggacgcgtgggcggacgcgtgggcgcagccaaggtctgcagagctccggctgtctgtcacgtacgtgcgtatatacatacacgcagcccgccagccatgtctgccgccgcatgcgtctccttctgcccctcccccgcgtcctctcgccacggcgggccgatcgtcgacttggccgggctgccgccggctacggaggcggaggagcgcggcgcccagagggacctcctggagttcggggtcaacggaacgatcggcgccaacagtgacagtgacgaagatgctgctgctgctgagatcgatgacgaggaggagcactcggtgaggaggccacgggcggtggttcagaagttcatgtgcgaacgcaaggctgtcggcgacggcttcgctctccggaggagcattggcaggcctgagttgcagagcttggatcctttcatctccttggatgagtttgaattttctcgtccagctggcttttctgatcatccacaccgaggattcgagaatgttacctacatgcttgagggaggcttgagttaccatgacttttcaggccacaagggcacgatcaacaccggagatgttcagtggatgacggccgggcgtggtgtggtgcacgcagagatgccgggtggtgagggggtgcagaggggcctcaacctctggctcaacctctcctcaaaagacaagatggtggcgccgaggtaccaggagctgaggagccgcgacgtccccacggcggagaaggacggcgtgtccatcaaggtcatcgccggcgaggccctgggcgcgcgctcgccgatccagacgcgcaccccggccatgtggctcgacgtgaccatgcggcccggcgcgcgcctgcgccagcccgtcccagccggctggagcgcgtgcgcctacgtcatcgacggcgaggccagcttcggccagccaggggacgaggcggccggcgcgcatcactgcgtcgtgtttggcggcgacggcgatggcgtggacgtgcggagcgaaggcgcggggacccggttcttgctgctggcggcgcggnccccccccggggcggggcccctgggcgggcccttcgtcccggacccccgcggnnnnnngcaacnnnnnnnnnnngactacctgaaccgcc

SEQ ID NO: 31984 - DNA, 2443 bp, Triticum aestivum
  Clone ID: PAT_TA_31984
ctctccctccgctccgcctccgcctccctctccagtctcccctccaacctccgcctcctcttctcccacctctccctactctcatctcacctctcggcgccgcgcgcccacctcgcgctctcctcctcctccctctccagcctcctcgccaccgccgacctcctcctccactcccaccgtctcgtccgcctctcctcacgcctcctcgcctcctcccctgcccccgacctcgcccgccaggctgagctccatcgcgagatccgcctcctatacgaggagaagaacctctccggcatcaatgccgttgatgaggaaatgcgcaaggttgatgctgccgcctccaagctccgatcggaggccagtgctgtgatcgaccgtggcatcaccgagtccaaccagaacgacatctggtgcggtctgcaggtgtactacaatcttggagaactgaagccggcggttgaggggctcgtggggaagtgcaaggcagcaggggcgaagagcgtgaccgtggcactggacatgaaggcgatatcgatggctggtggtggaggcggccctggaggcgtgcagagaagcggcacgccacagcttggtggcagtaagagggcagcggatgcactctgggaaaggatgaggcagtgcatggaggagctgcatcgggcagtcatcgctgcatggcagctgcagactgtgctcaccaagaagcgtgtgccgttcacacaaatgctgttccttgaggaggtttggcaggagggtgagcctctgttgacagagagagtatgggatgcaattgttaaggcctttgcacggcacctggaatccgtctttactgcgtcaagctttgtcaaggaaatatttactcttggatatcctagactgttctcaatgattgagaaccttcttgagaggatttcaagagatactgatgtaaagggtacccttccagcacttactcccgaaggaaaagatcacatggttgcagccattgagatattccagaccgcctttttggctcttagtcagagtcgtctttctgattacatcaatagcatatttcctatgtcaaaccgtggaagtataccatcaaaggatcaaatatcaaggctaatatctcgcatccaagaggaaattgaagttgtgcgaactcatgggcatttgctgcttcttgttctacgtgaaattggaaagatcttgcttcttttagcacaaagagctgaatatcagatctctactggccctgaagcccgtcaagttactggcacagtgactccagctcaattaaaaaactttgctctgtgtctacatctccacgaggttcacacacgtatttcaagcatcctgtcaacactcccaaatgttgcttctgaagtcctttccccatctcttggggtcatatatggggttgcttgtgattcggtgacctccctattccaagcaatgctcgatcgtctggaatcatgcattctgcaaatgcacgagcaggactttggagctgatggaatggatggagcgatggacaataatgcatcagcctacatggaggagcttcagaagtgtgccgtccacttccgcaacgagttcttgtcaaagcttctgccatcatcagcctcccgctcggagaccatatgtaccataatggttagaaggatggcctcaaggatccttatattcttcataagacacgcttctcttgtcaggccactctctgaagcagggaagttgagaatggctagggacatggccgagctggagctagctgtcggtcagaatctgtttccagtggagcagctgggctcgccataccgggcattgcgtgcgttccgccccgtcctattcctggagacatctcagcttgacaagtctccactccttcaggacttgccacccagcgtgatcctccaccacctatattcgcgagggccggatgagctacactcgcccttacagcggaacaagctgacaccgctgcagtactctctgtggcttgattcacaaggcgaggatcagatctggaagggcgtgaaggcaaccctggacgactatgagatgaaggtcaggtcccgtggagacaaggagttcagtccagtgtaccctctcatgtgtcagattggatctgcattgtcacaggccacaccttgacatgcgttcagttcagctgtgcagcgtacatttgtatcaccatcctgtaggcattgttcttgagagatcgcttgagccccggcatagattttatacccatgaaatagcacctatatttctctttgatcacaaaaatgttgaaagtacagagcttgtgtttctggtgggaattttcatgttctgaattctgatatgtttgatcattgtacatcgctggacgacaccgagaatctgtgtgaactgaacctgcaaacctcatgaaggatgcgttatgaactttaaagttctttcattaaaaaaaaaa

SEQ ID NO: 31985 - DNA, 508 bp, Triticum aestivum
  Clone ID: PAT_TA_31985
ccacgcgtccgcggacgcgtgggcaagaggagagcaagcgaggccgcacaggcacagcaaatgccggccgtcccgccggaggccgacgaggtctccgtggaattctgctgcaccggggacaccgacgacgacaatagacgcctgtacatgaaggcgtctgtcagctgcgacgatcggccggacctcgtcgccggtttcatccaggcgctccatggcctgaggttgaggacggtgagagcggaggtgacctccctaggtggaagggtgcggcatgtcttcacactctgcaaggaggaggaggaggaaggcagtgcagcagcaggtcgtgctggactgaattctctgaaggaggctgtgaggcatgctctgtccaaggttgcttcaccagagctggtgtgtggcggcagtccgttccagttccagagcaagaggcagaggattcttgagtcgcattactcaatcatgtccatatagatgagtacttctggagtaattatatttttgtgcc

SEQ ID NO: 31986 - DNA, 1251 bp, Triticum aestivum
  Clone ID: PAT_TA_31986
atgtgagagaacgatgcgtatgtagggcggtcatctctcgcacacaagctcatcatctgcctcctaccgtccagtatccatcctatatatgaagagaatgaggtgacaagacgccgccgcactaattattgtgagcctcctatccatctcactcccacttctccttccttctggttcatcaccagaaattcacattcgtccttgttcttgcactgtcctagagctggatggcagctccatgccaatccccgcaaggagggaacgagctgatggcatacgatgcatgttatcctacggtgagcagaggcccggctccgctgccccggcaggccagctcggcgccaccggccgggccgccggagctgtcgacgacgtcctcgtcgacgacggggtcgggaaggaccgcgacggaggcaagagccctgaaggtccacagcgaggccgagcgccggcgtcgggtgaggatcaacgctcatctcacggcgctcaggaggatgatccctgataccaagcagatggacaaggccgccttgctagccagggtggtggaccaagtgaagcacctgaagaggagagcagccgaggccgcacagcaaacgccggctgtcccaccggagaccgacgaggtctccattgaattctgcgccggagacaatgactccagactgtacatgaaagcctcggtcagctgcgacgaccgcccggacctcgtcgccgggctcatccaggcgctccatggcctcaggctgacggcggtctccccggaggtgtccgccctcgcggcgcgggtgcggcatgtctgcgcactgtcccagcgggtggccccgccgggcagcgcggcacccggcctcgccgcgcccgcgtcccccgtcggggctgcgcggctggccctggcctggggtgcttcgccagcgctcctccctcgcgctactcgtagcccgttccagtcccagaccagaggcacgaggatggccgcacagctaacgccggcagtcccaccggagaccgacgaggtctccatcgaatattgtaacatgaatttgtgtgtgtgtgtgtgtgtatagccagaccctggactgcccggccatggcctgaggcatggaactaaaacactcagtatactttagctactgtagcctactgtagctacaatatttacggttccaacgaagctggtctggggcgtagctatatcctggctacggcactatgtgtgtgtctccacttgcacatatgcccgcacattgcgac

SEQ ID NO: 31987 - DNA, 1045 bp, Triticum aestivum
  Clone ID: PAT_TA_31987
gcgggagggcagcccccacctccgccgtcgacgtcaggaatggctccacctagcaccgccacgtcggcatcccctcgctccccgagattgcacacgtcgtccgtggcgccaacctggccaaggccgtcaacccccccgccgtcttcctgggtgccctccacgccggtgtcgagaaggagcgtcggctccaccccccccccggcgcatgtcgcgcccggtcccaccacacagccccgccgccgcggctcgtccgcccacgcgaccccccccgggccgtccggctcccacgcgtccgcctacgcgtccgcacctagaaggggagggttgagcagagcgatgctgtcgaaataaagaatttctaccagcaatactacaagatgtacatccaggcgctccagaatgctgcagataaagctgaacgtgatcagctcacaaaggcttactagactacagctgtgttgtttgaggtcctcaaggcagttgatcagacgaagtgttggtttcacctccctgctggcgactgttgcacattttcaaaacacacaaccacgtcgatcctgatagttctatcatgagatgtcccaagatccatgccacttatcacacccttcgtgacaccaggggtctaccatggcctaaggaccatggaaagaaagaagatgcagatcttcttgattggcctcatgcaatgtttgggtttcagaaaaataatgtgtccaatcaaagagaacatctcatactcttgattggcagcatacatataaggcagatctccaaacatgaacaacacccaaagttagatgaccatgtgttggatacaacaatgaacaagctattcaagaactacaagagatggtgcaagcaccttggccgcaaaactagcttatggttgccggcaattcaacaagaagtacaacagcggaagcttctctatatgggcctttatctgctcatatggggcgaggcggctaacttgtggtttatgccggagtgtctttgctacctctatcatcatgtgatgatcgtgtttttttaatccgttcca

SEQ ID NO: 31988 - DNA, 896 bp, Triticum aestivum
  unsure (1)..(896): unsure at all n locations
  Clone ID: PAT_TA_31988
aatcgctccaataagcaagccgggctaccggtagtagctccacactgccactcactgcgcgacaccgctccttccatcgccggtagcagcagccaccaccaccacttcaagtgcaaggcctctcacaccctctctcagtcatcagctcctcatcactctgcttcttgcagtctcggcacctgcatcggcttcgccgctcattcccacatcccgatcaatccccaagcaaggaagatgaagattttcagctggatggcgaacaagatcagcgggaagcaggaagcgagccgcttcccggccagttcctcgggcccttctcgttctaacgtgccggattgtcgcaacgacgagttcagcgattggccccaatcattgcttgccattgggacatttggaaataagcagatagaggaggtagcacaagtgcaggacacttccgaggatgggcagtccatgcaagatgccatcaagtttacagaggaggaagtagacaggatacagaaagagtttgcaatgatactagcaagcaaagaccaagcagaagcccatgactcgcacgatgatgagcaggtaacttcacacaaagaagtcgatgagagcataaatgagaagcacagggaccagctgctgaacaagatggtcgtcataagtaaggcaaaagattcactggggaagaaagcaagtacacttaagccgaggtcggttgcttcgctcttcaaactactcatgcgcaaaggtggctttgcctctgctattccagatccaaggagtctttccctcaatcaagaatggaaaactgctcaaggcaatactcagaagaaaatacacccgcaaaatcttcgacctcgtacctangagactttggactggaaccggatgacaagagncaatgaatg

SEQ ID NO: 31989 - DNA, 439 bp, Triticum aestivum
  Clone ID: PAT_TA_31989
taggaggaggcccgggggccgcgtccatacgtgcagcagcacgcgggagccgtggggatcaaagcaggcgcgcaatcctgggagtctgcgggtcgacgcgcgtgcgttagaggaggagaaggcgcaggctggggagacggcgacaacaccggtgacggccagccattttcttgcgtgcgaagaacgggcgagcgctcgtacgtcgatttcttttccgtccatgcaggatgtcgcgctcgtactaaggatccgagcaagcattcttggtaatctacgtatgtgcgaataatttgtttggtggtgagcgatgatgagtactctacatgacattccttttccttgtgtatccatgatagtgttattacgacgcatgttttattttggacgccaatatatgtttccacttgtaccaaaaatatataaacagattatattacgt

SEQ ID NO: 31990 - DNA, 797 bp, Triticum aestivum
  unsure (1)..(797): unsure at all n locations
  Clone ID: PAT_TA_31990
gtccatgggtctcgctaaatttattcataggatgtagaacaccgctgaggagcttgtccgcaggacgagctgctcccgatgctgcatggcaacccagccggatctgcctcgacaggttcgagccctccgtcacgggccccgtgcacatctggcagggtgttgggaaggtgatcaatgtgaacaagatgatcagggccagatggagtgaagatcctaataccggaccagaggccgacttggcaagatcaggaagcagctggaccacaacaaggacgtcggcggcggcttctccgccatgtgggattattccttgacctttcacaattccttcaggcgtccataacatcaagcataattttggtgtttcttaaccttttgcattctactctaataagttaaattaggcctatgacttagaagtttttcttaatacttttagttgtgaaatttgttttgtggtcttcttcctgattcgatgtgattagcacaatactaaatttgccggctattgatacttctgtgtgaaccagattaatctaaagcaccaagatctgcttgttcattattttgattcaagctaatcgaatgttcattattttgtgtcaatacagtacaatggagagctatccatgacatgtgtgggagcaatggaaccggaggtgctagatgcaggcactaattgtatttagagttcggttgcaataatgaaatcttttaggatggtaccaccttggactaggggataccatgaacagatcttatagtcaaataatttatgagtgacttctactggtnnt

SEQ ID NO: 31991 - DNA, 703 bp, Triticum aestivum
  Clone ID: PAT_TA_31991
aattcggcacgaggcacaagggtgccaccagtcattatgttctagaccaaatagatcgtaatgcgatcgagttggagaggtggattcagacaacagattccttcacaaattcaaaggcagaactcaaaaaagaaagggcaaggaaatgaaggacgcaggactactagaggcaaagacagacagacgcggccggagcactatgacggctttgatgggcgtggaggagtgcacgaagacgctgcggagcactgctgaggagcttgtcagcaggagtagctgctcccgctgctgcatcacaaccgcatcctgatctgcttcgacaggttcaagccctccgtcaccggccgtgtgcacatctggaagggtgttggaaaggtgatcagtgtgaacaagatggtcagggccggatgcaaagtgaagatcctaatagtggactagaggcctgggctgaaggactccgcaagatcaaggagcggctggaccacgacaaggacgtcggcggtggcttctccgccatgtgggattattgtttgacctttcacagttacttcaggtgtccataacatcaagcataattttggtgcttcttaaccttttgcattctattctaatcctatgacagaagttttcttaatacttttagttatgaattttgttttgtgatcttcttcctattcgatgtattagcataatactaaatttg

SEQ ID NO: 31992 - DNA, 788 bp, Triticum aestivum
  Clone ID: PAT_TA_31992
aacaacaattcacgactccaacatcatgcagtacttttatattactataggatactggatacaaatggctttgtaaggggtttcatacacaatttttaatgtgtaagtaaacatgttcgaagaagcaggaatgctgatgcaaaattaaaccatggatataaccttatagcaccaacatgcctgtctatgttactcatcaagccagactatagaacttttctctgtcggcaacctgtccaaatagacactacctaattgcctcaagctagccccattccgccacaaatatgcacatgcggctttcctcttcggtcttctcatccgcctgaccatcgggagcattgcccactatgcatgctcacgtctacttgctccttgtcaagtacatccatgcgtccgactcccacctcaacaccatgctccatgtttgctgatgtctatgtcaagtccagcctcatgacacagatggggtgtattattttgtccaacacatgaatgaccgtcaccgcacccgccattctcgtttcttatgcccctattaaactcgccgccgcatgcgcctttatcctgtgtgggttgtggttggtaacatgtgctcattgctcaggtgtgttgagatcttgcctttaccaagatttccacatatgccaaacaaattctgtcactgaaacttttatccaagctagcgctgctctggttcttttcctccatacgtatcaccctgaactgcttcatcttgtcatgcccaaatctctttgccctagaatgtgtggaggcgcatctcccag

SEQ ID NO: 31993 - DNA, 376 bp, Triticum aestivum
  Clone ID: PAT_TA_31993
ggcgggtcggaacttacccgacgaaggcgtaacgatctgggcactgtctcggagagaggctcggtgaaatagacatgtctgtgaagatgcggactacctgcacctggacagaaagaccctatgaagctttactgttccctgggattggctttgggcctttcctgcgcagcttaggtggaaggcggaagaaggccccctttccgggggggccccggaccatcagtgagataccactctggaagagctcggattctaaccttgtgtcagacccgcgggccaagggacagtctcaggtagacagtttctatggggcgtaggcctcccaaaaggtaacggaggcgtgcaaaggtttccctcgtgccgaattcggcacgag

SEQ ID NO: 31994 - DNA, 716 bp, Triticum aestivum
  Clone ID: PAT_TA_31994
gaagatttggtgctttggacctgagacgactggccccaacatggttgtggacatgtgtaagggagtgcagtatctgaatgaaatcaaggactctgttgtggcagggttccagtgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgctaagccaaggctgctggagcctgtgtacctggttgagatccaggccccggagaatgcactcggtggtatctatggtgttctgaatcagaagagagggcatgtgtttgaggagatgcagaggcctggtaccccgctgtacaacatcaaggcttacctcccggtcatcgagtcgttcgggttctcaagtaccctcagggcggcgacatccggccaggctttcccccagtgtgtgttcgaccattgggacatcatgtcttctgatcctttggaggccggctcccagtctgccacacttgtcacggagaatcccaagcgcaagggcctgaaggaacagatgacccctctttctgtattcgaggaacagctctggacttttgctttttgtacatggcctagttttgttttgctgcttaaaagagtgccttttttttttgtttttgagtccgcct

SEQ ID NO: 31995 - DNA, 613 bp, Triticum aestivum
  unsure (1)..(613): unsure at all n locations
  Clone ID: PAT_TA_31995
atcttgccaagaagatttggtgcttcggacctgagaccaccggcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgccgatgctatccacaggggtggtggccaggtcattccaactgccaggagggtcatttatgcttctcagctcacagccaagcccgaggctgctgggaaccagtttacctggtgggagatcaggccccagaaaatgcacttggtggcatatacggggttctgaaccanaagagaggacatgttattccnaaggaaatgcaaaggcctggtacccgctctanaaatcaaggntttccccctgtcacnantccttgggntcncaancanctgagggtgcaactcggnnagggtcccccatgtgttttnacaccgggaatatggctccgtttttgggggtgcnccangtgccactgnggggtnnccaagagaggncgaaaaaaagcccncttcntttgagaanncnatttttttttg

SEQ ID NO: 31996 - DNA, 1077 bp, Triticum aestivum
  Clone ID: PAT_TA_31996
cgaggtccttctcctgcgccttcgctcggcgccgcggccgcgcctcttcatcctccagggctgtcctcatctcattcctcctgatagcgagggggatcctcaaggaatttatatttgtactgtgataatcaaaagcagtcaagatggtgaaattcacagtagaaggactccgcatcattatggacaagcaaaataatattcgcaacatgtctgttattgctcatgtggaccatggcaagtctacgcttactgattctctggtggcagctgctgggattattgcacaagaagttgcaggtgacgtccgcatgactgatactcgtgcagatgaagcagaacgtggtatcacaatcaaatccacgggtatatctcttttctatgagatgactgatgaatcactcagggcttataagggcgagagagatgggaatgaatacctgatcaaccttatagattcgcctgggcacgttgatttctcttcagaagtcacagctgctcttcgtattactgatggtgctttggtggtggttgactgtattgagggtgtctgtgtgcaaactgaaactgtgcttcgccaagcccttggtgagaggattaggcctgtccttactgtgaacaagatggacaggtgcttccttgagcttcaggttgatggtgaggaagcttaccagactttctcccgtgtcattgagaacgccaatgtcattatggcaacatatgaagatgcaaaacttggtgatgtccaagtctacccagagaagggaactgttgctttctctgctggtttacatggatgggcatttactctcaccaactttgctaagatgtatgcctccaagtttggagttgatgaaactaaaatgatggagaggctttggggtgagaacttctttgacacagccacgaaaaagtggaccaacaagaacacgggctctcctacttgcaagagaggttttgttcagttctgctatgatccaatcaagcaaataatcaacacctgcatgaatgaccagaaggataaattgtggcctatgttacagaagcttggtgtgaccatgaaggctgatgagaaagagc

SEQ ID NO: 31997 - DNA, 743 bp, Triticum aestivum
  Clone ID: PAT_TA_31997
ccacgcgtccgcccctcccattctctccgggagcgcgcgccggcttcctcatcccccagactctcgcctctcgactcgggaggcggaagcgaaaccccaaggaaccatatttccagcgtgacattcaaacacagtcaagatggtgaagttcacagcggaggagctccgtggaatcatggacaaaaagaacaatatccggaacatgtcggttattgctcatgtagaccacggcaagtctacgcttacggattcccttgtggcagctgctgggattattgcccaggaagttgctggtgatgttcgcatgaccgatacccgtgcagatgaggcagagcgtggtatcacaatcaaatccacgggtatctctcttttctatcagatgactcctgaatcactcgagatgtacaagggcgatcgcgatggggatgaatacctgatcaaccttattgattcacctggccacgttgacttttcttcggaagtcacagctgctcttcgtatcactgatggagctttggtggttgttgactgtattgagggtgtctgtgtgcagactgaaactgtgctgcgccaagctcttggtgagaggattaggccagtccttactgtgaacaagatggacagatgcttccttgagcttcaggtggaaggtgaggaagcatatcagactttctcccgtgtcatcgaaaatgccaatgtcatcatggcaacatatgaagatgtgctccttggtgatgtccaag

SEQ ID NO: 31998 - DNA, 683 bp, Triticum aestivum
  Clone ID: PAT_TA_31998
caccaacaacaaaaaaacacgcatcgacgatacgagcagcgcagccgtccctcgccggcgacgagtgctcggccatggattccgactacggcgtgccgcgcgagctctcggaggtgcagcagaagcggactctctaccagcccgagctgcccccctgcctccagggcactactgtgagggtggagtatggtgatgtggcgatcgctgctgatccagctggcgctcatgtaatcagccacgcgtatccccacacatacgggcagccactggctcatttcctcaggaaggctgctaatgttcctgatgctaaagtcatatcagagcaccctgccgtcagggttggtattgtattctgtggaaggcagtccccaggaggccacaatgtcatatggggactccatgaggccatcaaagctcacaacgtgaacagcaaacttattggtttcctcggaggaaccgatggtcttcttgcacaaaaaactttggagatcacaaatgaagttctttcttcctacaaaaaccaaggtggttatgatatgcttggtcggactaaggatcaaatcagaacaaccgagcaagtcaatggggcaatggctacttgccacgctttgaagttggatgctcttgtgataatcggaggtgtgacatcgaatacagatgctgctcaacttgctgagactttt

SEQ ID NO: 31999 - DNA, 1117 bp, Triticum aestivum
  unsure (1)..(1117): unsure at all n locations
  Clone ID: PAT_TA_31999
ttttttttttaacaggaacagtcacgaaaaatgcactcgagaccatcatcatcaggctagaagcatttggttcattgttcaacccatacaaggtctgcaccgcgatctgctacctactacacctatctaggttaaaaatcctgctacactgagaccgagagtgcggcgactctacacgcaaccagcacgaaactgcattagccgagtctccagcctcatcgaagaaattgcttctctaacaaactgccctccgatctaacattgtattggaagcacacatcttcacttctgttcatcctcagagtcatcggaagtttcgtcgctctcatagtctgggcttgctctaaaaatgtagaccttgaactttgcgctctctatcagctggaaaaccaagcaatcgccattttcaaggtcatagtcgacggcaaactctctccaccccttgctgaggtagcagtgcctgccctgtctgctggcattgtacatcatgtgggactcgtcatccgcctcatccaccacgacgactggctcatcgtgcgccgggaggtactcggtggattgcttcgggatagtcataaagtttgccctgctggcgcaggcgtgggtgatgggcttgacgaaggcggggcagcggatgcggtggatccggcgctggagctcctccgccttggcgatggcgccggctctctcctcctcggtcggtcctttcccaaacagcgtatgcctcgtacactccacggtagtcgcgctgccctgcgccctcgaggtagctgggctgctccgggaggccggcgacgcggccggaccgtcggagctcgccgggctccggggccttcggcttctgcgacacggaagcagcggaccagtcatgcatacgggagaaaaaggagatggaagaccggaggcaaggaagaagaagggagaggaactgacggaccggtttggggttgggcttgggcctggcggcggcctccggcggttctcctcaatctgcctccggcgctgctcctcgtacgagttcgattccgccatttccccttcctgattccgcttatctgcttcctccccttctttcttcttncttgggagttttcccctcgtgccgaattncctgcag

SEQ ID NO: 32000 - DNA, 997 bp, Triticum aestivum
  Clone ID: PAT_TA_32000
ggccattgatgagggccgcattggtccacgtgatgatcctaaggtgcgctcccagatcctctctcaggagtttggttgggacaaggaccttgccaagaagatttggtgttttggacctgagaccactggtccaaacatggttgttgatatgtgtaagggagttcagtatctcaatgaaatcaaggattctgttgtggctggtttccagtgggcatcaaaggagggtgcactggcagaggagaacatgcgtgggatttgctttgaggtctgtgatgtcgttcttcatgctgatgctatccacaggggtggtggccaggtcattcctactgctaggagggtcatctatgcttctcagctcacggccaagccaaggctgctggagccagtgtacctggtggagattcaggccccagaaaatgcacttggtggtatctatggtgttctgaatcagaagagagggcatgtcttcgaggagatgcagaggccgggtacccctctatacaacatcaaggctttcctccctgtcatcgagtcctttgggttctccagccaactgagggctgcaacctctggtcaggcgttcccccagtgtgtgtttgaccattgggacatgatgggctctgatcctttggaggctggctcccaggctgctcagctggtgctggatatccgcaagaggaagggtctcaaggaacagatgacccctctctctgagtttgaggacaagctctaaatttttggttgtttgttctactgttactattgctggtttaatcgtcaatttgtctattgtattgggaacgacttgaatattttctctcgttttagttaatgtacctgtctctgaactatattggtcatgtagtgtatgctgctgtgttgagagcctgagactccattttgatatctggtgtgatgtagcagatgaaacggagttggtatctgtgtggtttagttagtggttacatacttgtattccctgtgttgctcatttcta

SEQ ID NO: 32001 - DNA, 739 bp, Triticum aestivum
  Clone ID: PAT_TA_32001
cgtccgcccacgcgtccgcccacgcgtccgcttcctccgggagcgccgccgcttcctcatctcccacctctcggctcgggagccggaagcgaaaccccaaggtactgtagtcctggcgtgacattcaaaagcagtcaagatggtgaagttcacagcggaggagctccgtggaattatggataaaaagaataatattcgtaacatgtctgttattgctcatgttgaccacggcaagtctacgcttacggattcccttgtggcagctgctgggattatcgcccaggaagttgctggtgatgttcgcatgactgatacccgtgcagatgaggcagaacgtggtattacaatcaaatccacgggtatctctctgttctatcagatgactcctgaatcacttgagatgtacaagggcgacagggatggggatgaatacctgatcaaccttattgactcacctggtcacgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagattttctccttggtgatgtc

SEQ ID NO: 32002 - DNA, 698 bp, Triticum aestivum
  Clone ID: PAT_TA_32002
ggactgttgcattctctgctggtttgcatgggtgggctttcacccttacaaacttcgctaagatgtatgcctccaagtttggagttgatgaggcgaagatgatggagaggctttggggtgagaacttctttgacccagccacaaagaaatggacctccaagaacactgggacagctacctgcaagagaggttttgttcagttctgctacgagccaatcaagcaaatcatcgccacctgcatgaatgatcagaaggataagttgtggcctatgttgaagaagctgggtgtgaccatgaagaatgatgagaaggacttgatgggcaaggctctcatgaagcgtgtgatgcaaacttggctgcctgccagtcgtgctctgcttgagatgatgatatttcaccttccctctccctcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtaggttctttgcctttggacgtgtttttgccgggagggttgcaactggtatgaaagtccgtatcatgggtcccaactttggtccttgccaaaagaaagatctgtatgtgaagaatgtcccgcggtctgttatctggatgggaaagaac

SEQ ID NO: 32003 - DNA, 1133 bp, Triticum aestivum
  unsure (1)..(1133): unsure at all n locations
  Clone ID: PAT_TA_32003
aaccaagctggctatatagcgtagctggaaatcttgattgaactcaagcttcaaactttttcttcaggatttgaagacccggaaaagagctttctaagcttcaaatttggtttgagaacccggaaatgaaacaanacgttttgaaaggaaagggcacttnacaaaaggaaaagaagntcaatgcaatctgtcacttcttttgctaccaagctaggggtgcaatgccttcgaagttcgactgtgattatgcctatgcangttccagctcaccttactaattntgacttagcaaattgctntgctgtctatttatcttttgagcggntgatttcaggttctgggacatgtgtgttaccacatcttggcagctggtttgaacggttacatggccactgtgacaaatcttaagagccccctgaacaagtggcgatgtggtgctgctcctatttcgtccatgatgaccgtgaagggatggtcacgtggccctgcaaccacacaaatcgggaagccagctgtgcatatggctagtgttgacttgagaggaaaagcatatgagatgttgaggcagaattcatccaactgcttgttggaagacatctacagaaaccctgggccactccaattcgaagggccaggtgctgatgccaagcctatttcactgtgcgtcgaggatcaagactacatgggcaggatcaagaaattgcaggaatacttggagaaggtgaagagcatagtgaagcctgggtgctcgcaggatgttctcaaggcggcgctgagtgccatgtcttccgtgacggagacactggctatcatgacttcctcttccactggccagcccccactctgagggccaagcaccacttcagtgggttacgaatctactacgcgttttctgattctcttttgctccatctgactgttgggattcgagacagtgatcttgtcatcccatgggttattcttttcctagctttttggagagttttattatcatttttggctctgatagcgtatgcgggtgtgctgttggcgagattcagcttgaataattttgatcaaactgtcggctgtgatctattaataatctaaattttgagagggtccatctctagcgctctctttgattcatagga

SEQ ID NO: 32004 - DNA, 820 bp, Triticum aestivum
  Clone ID: PAT_TA_32004
gctaggggtgcaatgccttcgaagtttgactgtgattatgcctatgttctgggacatgtgtgctaccacatcttggcagctggtttgaacggttacatggctactgtgacaaatcttaagagtcccctgaacaagtggcgatgtggtgctgctcctatttcgtccatgatgaccgtgaagcgatggtcacgtggccctgcaaccacacaaatcgggaagccagctgtgcatatggctagcgttgacttgagaggaaaagcatacgagatgttgaggcagaattcatccagctgcttgctggaagacatctacagaaaccctgggccactccaattcgaagggccaggtgctgatgccaagcctatttcactgtgcgtcgaggatcaagactacatgggcaggatcaagaaattgcaggaatacttggagaaggtgaagagcatagtgaagcctgggtgctcgcaggatgttctcaaggcggcactgagtgccatgtcttcggtgacggagacactggctatcatgacttcctcttccactggccagcccccactctgaaggccaagcacttgagttggttacgaatctactacgcatttcctgattctcttttgctccatctgacggttgggtttcgagacagtgatcttgtcatcacatggtttattcttttcctagattttcgggaagttttatgatcatttttggctctgatagcgtatgcgggtgtactattggcgagattcagcttgaataattttgatcaaactgtcggctgtgatctattaataatctaaattttgagagggtccaaaaaaaa

SEQ ID NO: 32005 - DNA, 2330 bp, Triticum aestivum
  unsure (1)..(2330): unsure at all n locations
  Clone ID: PAT_TA_32005
taccggtccggaatttccgggtcgacccacgcgtccggagctgcgcaattttttaagctcgaataatccacatggtgctatatatatttatatatatgctcaaaagcaacacacgaacaggggctccgtaccgcgagagacagaggagaacaccgatcccgccggccggccggcgacgtgaaaccgcgactccggcgagaggagaggcccgaccgcaacgatgggcaacgagatgtcgcccctccagaagcaccgcgcggaataccgccccgagctcccgccctggctccagggcaccgcggtgaaggtggagtacggcgacgccgcgatcgcggctgacggcgctgacgcgcatgtgatccgccgcgcgttcccgcacacctatggccagcggctggcgcatttcctcccgaagacggccaatgcgccggacgctacggtcataacagagcaccctgccgtcagggttggtgtcgtcttcagtggtaggcagtcccctggtggtcacaatgttgtatggggactatataatgctataaattctcacaacccaagcagcgagcttatcggttttcttggcggaactgatggcttgtttgctcagaaaactttggaaatcactgaggaagttttttcttcctataaaaatcaaggtggttattatatgcttggtcgaaccagggaccaaatcaggacaactgaacaagtaaaggcagcaatgactacttgccaagctttgaagttggatgctcttgtaataattggaggtgtcacatccaacacggatgctgctcagcttgctgagacttttgctgagtcgaaatgttcaacaaaggtagttggtgttcctgtaactttgaatggtgaccttaagaaccagtttgtcgagacaactgttggttttgataccatatgcaaggkgaactcacagctcataagtaatgtctgcactgatgctctttctgctgagaagtattactacttcattcgcttgatggggcggaaagcatctcatgtggccttggaatgtgctcttcagtcacatccaaatatggtcttactaggggaggaggttgctgcgtcaaaacttacaatttctgatattacaaagcagatatgtgatgctgtgcaggcaagggctgaaaaagataaataccatggtgttgtacttattcccgagggccttgtcgagagtatacctgaattatatgctttgcttcaggaaattcatgggctacatgataaaggtgtttccattgagaacatctcttctcatctttcgccttgggcttctgcactatttgactttctgcctccatttatcaggaaacagctacttcttcatcctgaatccgatgactccgctcaactttctcagattgagactgagaaacttctagcccaattagttgaagcagaaatgaacaaacgtctgaaggaaggcacttacaaaggaaagaagttcaatgcaatttgtcacttctttggctaccaagccagaggtgccctaccctcaaagttcgactgtgattatgcttatgttcttgggcatgtatgctatcacatcttagctgctggcttaaatggctacatggccactgtgacaaatcttaggagtcctgtgaacaagtggaaatgcggtgctgctcctattacttccatgatgaccgtaaagcgatggtcacgaggaccagctgccagtcaaattgggaagcctgctgttcacatggctagcgttgacttgaaaggaaaagcatacgatgtgttgagacagaattcttccagcctttttgttggaagatgtctacagaaacccaggcccgctccagtttgaaggaccaaggtgccgattcaaagcctatttcattgtgcgttgaggatcaacgactatatgggcagaataaaaaagttgcaggaatacttggagaaggtgaagaggattgtgaagcctgggtgctcgcaggatgttcttaaagcggcgcctgagtgccatgtcttctgtgacgggaaacactgaacatcatgacttcatcttctaccggccagactccactgagtcattaggtaccatttcatggtatggatcataatccccacttttttcagtggtggcgattaacgagtttaggaacagcaaccctgggtatcatacgggttattcttttgtagccttttggagattctatcggttttggattcngtagtttatgaaggcttgttgatgagtttgagctcgaatacttttgaaacaaccggatgatgccatctttaataaaccaaatctgtgacgcatcacatttcgtcagtcacctgatgagaaaaaaaaaaaa

SEQ ID NO: 32006 - DNA, 1457 bp, Triticum aestivum
  Clone ID: PAT_TA_32006
atgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggtggtgctgaaattattgtttcccctcccgtcgtctccttccgtgagactgttcttgagaagtcctgtcgcactgtcatgagcaagtcccccaacaagcataaccgtctttacatggaagctcgcccattggaggagggattggctgaggctattgatgatggccgcattggcccacgtgatgatcctaaggtgcgctctaagatcctatctgaggagtttggttgggacaaggatctcgccaagaagatttggtgctttggacctgagacgactggccccaacatggttgttgacatgtgtaagggagtgcagtatctgaatgaaatcaaggactctgttgtggctgggttccagtgggcatcgaaagaaggtgctttggctgaggagaacatgcgtggcatttgctttgaggtctgtgatgttgttctgcacactgatgctattcacaggggtggtggtcaggtcatcccaacagccaggagggtcatttacgcttctcagctcactgctaagccaaggctgctggagcccgtgtacctggttgagatccaggccccagagaatgcactcggcggtatctatggtgttctgaatcagaagagagggcatgtgtttgaggagatgcagaggcctggtaccccactgtacaacatcaaggcttacctcccggtcatcgagtctttcgggttctcaagtaccctcagggcagcgacatctggccaggcattcccccagtgtgtgttcgaccactgggacatcatgtcttctgatcctttggaggccggctcccagtctgccacccttgtcacggagatccgcaagcgcaagggtcttaaggaacagatgacccctctgtctgattttgaggacaagctctaaacttttggttctgttatctcctatatggtgtagttggttttgctgctaagagagctgcactattattttctgtctattgtgtcgtggctgtattgctattgggatgtcctatctgtcgtgatactggcactttgtttttgatgtctatcgatgttaaaacttagattaaaaaaaaaaaaaaaaaaaactcgagacctcggccgcgaccacgctaatcacttagtgaattc

SEQ ID NO: 32007 - DNA, 1408 bp, Triticum aestivum
  unsure (1)..(1408): unsure at all n locations
  Clone ID: PAT_TA_32007
atatatatgctaatgctatcagaactgtgaccctgatggtcctcttatgctgtatgtctccaagatgatcccagcatctgacaagggtagattctttgcctttggacgtgttttcgctgggagggttgccactggcatgaaggtccgtatcatgggacctaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctgggccaagtctgatcctatggttctctgtaccattgaagagtctggtgagcatatcatcgctggagccggagagcttcatcttgaaatctgcttgaaagatctgcaggatgacttcatgggtggtgctgaaatcattgtttccccccctgtcgtctccttccgtgagactgttctggagaagtcctgccgtaccgttatgagcaagtcccccaacaagcataaccgtctttacatggaagctcgcccattggaggagggcattggctgaggctattgatgatggccgcattggcccgccgtgatgatcctaaggtgcgctccaagatcctgtctgaggagtttggttgggacaaggatctcgccaagaagatttggtgctttggacctgagacgactggccccaacatggttgtggacatgtgtaagggagtgcagtatctgaatgaaatcaaggactctgttgtggctgggttccaatgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgccaagccaaggctgctggagcctgtgtacctggtttgagatccaggccccggaggaatgcacttggcggtatctatggtgttcctgaatcaagaagagaaggaacgtgtttttaggagatgcaagaggctggtaccccgcttgtacaacatcaaagnttacctccccggtcatcgatcntttgggtctcaaagtacctcaagggcggcgacatctggccaagtttcccccagtgtgtgttccacaattnggaatcattctccggatcctttttgaggccggtcccaatcccgcgaccttgcacaaagattcccnagccaaggtctc

SEQ ID NO: 32008 - DNA, 1139 bp, Triticum aestivum
  Clone ID: PAT_TA_32008
cttgaaatctgtttgaaggatctgcaggaggacttcatgggtggtgctgaaattattgtttcccctcccgtcgtctccttccgtgagactgttcttgagaagtcctgtcgcactgtcatgagcaagtcccccaacaagcataaccgtctttacatggaagctcgcccattggaggagggattggctggggctattgatgatggccgcattggcccacgtgatgatcctaaggtgcgctctaagatcctatctgaggagtttggttgggacaaggatctcgccaagaagatttggtgctttggacctgagacgactgggcccaacatggttgtcgacatgtgtaagggagtgcagtatctgaatgaaatcaaggactctgttgtggctgggttccagtgggcatcgaaggaaggtgcattggctgaggagaacatgcgtggcatctgctttgaggtctgtgatgttgttctgcacactgatgctattcacaggggtggtggtcaggtcatcccaacagcccggagggtcatttatgcttctcagctcactgctaagccaaggctactggagcctgtgtacctggttgagatccaggccccggagaatgcactcggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgaccactgggacatcatgtcttcggatcctttggaggccggctcccagtctgcgacccttgtcacggagatccgcaagcgcaagggtctgaaggaacagatgacccctctatctgatttcgaggacaagctctaaacttttagttctgttatcatatgggtctagtttgcttttgctgctaagagagctgcactattattttctgtctgttgagtcgtggctgtattgctattgggatgtcctatcactttgttttgatgtctatcgatgttaaaacttagattatatatctgttatccactggtagttcgttgtttgtggtagatcctgctctgcctgattatttattgcta

SEQ ID NO: 32009 - DNA, 2217 bp, Triticum aestivum
  Clone ID: PAT_TA_32009
gtcgacccacgcgtccgcccgaaggccctctccgccgccgcttcctcatctcatcctcccggatcgggaggcggaagccaagccccaaggaacttaaattctcggtgtgatattcaaaagcagtcaagatggtgaagtttaccgcggaggagctccgtggaattatggacaaaaagaataatatccgtaacatgtctgttattgctcatgttgaccatggcaaatctacgcttacggattcccttgtggcagcagctgggattattgcccaggaagtagctggtgatgttcgcatgaccgatacccgtgcagatgaggcagaacgtggtattacaatcaaatccacgggtatctctcttttctatcagatgactcctgaatcactcgagatgtacaagggcgacagggatggtgatgagtacctgatcaaccttattgattcacctggccacgttgacttctcttcagaagtcacagctgctcttcgtatcaccgatggtgctttggttgttgttgactgtattgagggtgtctgtgtgcagactgaaactgtgctgcgccaagctcttggtgagaggattcggcctgtcctcaccgtgaacaagatggacagatgcttccttgagcttcaagtggaaggtgaggaagcatatcagactttctcccgtgtcattgaaaatgccaatgtcatcatggcaacatatgaagatgtgctccttggtgatgtccaagtgtacccagagaaggggactgttgcattctccgctggtttgcatgggtgggctttcacccttacaaactttgctaagatgtatgcctccaagtttggagttgatgagtcgaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgatcagaaggataagttgtggccaatgttgaagaagcttggtgtgacgatgaagaatgatgagaaggacttgatgggcaaggctctcatgaagcgtgtgatgcaaacttggctgcctgccagtcgtgctctgcttgagatgatgatatttcaccttccctctccctcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtaggttctttgcctttggacgtgtttttgccgggagggttgcaactggtatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggtggtgctgaaattattgtttcccctcccgtcgtctccttccgtgagactgttcttgagaagttctgtcgcactgtcatgagcaagtcccccaacaagcataaccgtctttacatggaacctcgcccattggaggagggattggctgaggcttttgattgatggccgcattggcccgtgtgatgatcctaaggttcgctccaggatcctgttttgaggaggttggttgggacagggatctcggccagaaaatttggtgctttggacctgagacgactggccccaacatggttgttgacatgtggtagggagtgccgttttctgaatgaaatcacaggacttttgtgtgggctgggtttcccatgggcattctaaagaaaggtgctttggtctagggaaaaacttgcctggcatttgctttttaggtctgggatgtttc

SEQ ID NO: 32010 - DNA, 1218 bp, Triticum aestivum
  Clone ID: PAT_TA_32010
ggatcctatggttctctgtaccattgaagagtctggtgagcatatcatcgctggagccggagagcttcatcttgaaatctgcttgaaggatctgcaggatgacttcatgggtggtgctgaaatcattgtttccccccctgtcgtctccttccgtgagactgttctggagaagtcctgccgtaccgttatgagcaagtcccccaacaagcataaccgtctttacatggaagctcgcccattggaggagggattggctgaggctattgatgatggccgcattggcccgcgtgatgatcctaaggtgcgctccaagatcctgtctgaggagtttggttgggacaaggatctcgccaagaagatttggtgctttggacctgagacgactggccccaacatggttgtggacatgtgtaagggagtgcagtacctgaatgaaatcaaggactctgttgtggctgggttccagtgggcatcaaaagaaggagcactatgtgaggagaacatgcgcggcatctgctatgaggtctgtgatgttgttctccacactgatgctattcacaggggtggtggtcaggtcatcccaacggcgaggagggtcatttacgcttctcagctcactgccaagccaaggctgctggagcccgtgtacctggttgagatccaggccccggagaacgcacttggtggtatctatggtgtgctgaatcagaagagagggcacgtgttcgaggagatgcagaggcaaggtaccccactctacaacatcaagggcctacctgcccgtcatcgagtccttcgggttctcgagcaccctgaggggccgcgacgtccggccaggccttcccccagtgcgtgtttgaccactgggacatcatggcctccgatcctttggaccccggcacccagtcggcgacgctcgtgacggagatccgcaagaggaagggtctcaaggagcagatgacccccctatccgatttcgaggacaagctctaaactttgggtcatgttttgctgctggctgttgctgtgaagggaggcgcggtatttttctccctatgtgtcttccttactatcttgttgtttgtatgtggtgctactgagactgtggttttgatgatggttgtggtgatgtaacagatgttaaacttagatgatatatttctggcatcccacggtggttatttttactgtgctgtgtttgcttttgtgcaaaaaaaa

SEQ ID NO: 32011 - DNA, 1579 bp, Triticum aestivum
  Clone ID: PAT_TA_32011
aggaattcggcacgaggccgacccgcacgaaaggcgtaacgatctgggcactgtctcggagagaggctcggtgaaatagacatgtctgtgaagatgcggactacctgcacctggacagaagaaggatctgtatgtgaagagtgtccagcgtactgttatctggatgggaaagaagcaagagtctgttgaggatgttccctgtggtaacactgttgctttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgtctggcaaagtctgaccctatggttctctgtaccattgaagagtctggtgaacatatcattgctggagctggagagcttcaccttgaaatctgtttgaaggatctgcaggatgacttcatgggtggtgctgaaatcattgtttcccctcctgtcgtctccttccgtgagactgttctagagaagtcctgccgtacagtcatgagcaagtccccgaacaagcacaaccgtctttacatggaagctcgccccttggaggagggactggctgaggccattgatgatgggcgcattggcccacgtgacgatcctaaggtgcggtctaagatcctgtctgaggagtttggctgggacaaggatcttgccaagaagatttggtgctttggacctgagacgactggccccaacatggttgttgacatgtgtaagggagtgcagtatcttaatgaaatcaaggactctgttgtggctgggttccagtgggcgtcgaaggaaggtgcactggctgaggagaacatgcgtggcatctgcttcgaggtctgtgatgttgttctccacactgatgctattcacaggggtggtggtcaggtcattcccacggccaggagggtcatttatgcttctcagctgactgccaagccaaggctgctggagcctgtgtacctggttgaaatccaggccccggagaatgcgcttggtggcatctatggtgttctgaatcagaagagagggcacgtgttcgaggagatgcagaggcaaggtaccccgctctacaacatcaaggcctacctccccgtcatcgagtcctttgggttctcaagcaccctgagggctgcgacgtccggccaggccttcccccagtgtgtgtttgaccactgggacatcatggcttccgatcctttggaccccggcacccagtctgcgacgctcgtcacggagatccgcaagaggaaggggctcaaggagcagatgacccctctatccgatttcgaagacaagctctaaatttttggtgctgttatcccttacctggtcttgtgttgttaaagagagccgcactattttgtatcgatgagtcttgctgttaatgacctatttgtcgtgatactgggaactatgttttgagatgtctggtgatgtaacggatgttttacttagattatgtatctgttgtccactggttcaaaaaaaaaa

SEQ ID NO: 32012 - DNA, 2248 bp, Triticum aestivum
  Clone ID: PAT_TA_32012
caacaaaaaaacacgcatcgacgatacgagcaacgcagccgcccctcgccggcgacgagtgctaggccatggattccgactacggcgtgccgcgcgagctctcggaggtgcagcagaaccggactctctaccagcccgagctgcccccctgcctccagggcactactgtgagggtggagtatggtgatgtggcgatcgctgctgatcccgccggcgctcatgtgatcagccacgcgtacccccacacatacgggcagccactggctcatttcctcaggaaggcggctaatgttcccgatgctaaagtcatatcagagcaccctgccgtcagggttggtattgtgttctgtggaaggcagtccccgggaggccacaatgtcatatggggactccatgaggccatcaaagctcacaacgtgaacagcaaacttattggtttccttggaggaaccgacggtcttcttgcacaaaaaaccttggagatcacaaatgaagttctttcttcctacaaaaaccaaggtggttatgatatgcttggtcggactaaggatcaaatcagaacaacagagcaagtcaatggtgcaatggctacttgccaggctttgaagttggatgctcttgtaataatcggaggtgtcacatcaaatacagatgctgctcaacttgctgagacttttgctgaggcaaagtgcgcaacaaaggttgtaggtgttcctgtaactttgaatggggaccttaagaaccagtttgttgagacaactgttggtttcgataccatatgcaaggtgaactcgcaacttataagcaatatgtgcaccgatgctctatctgctgagaagtattactatttcatccgtatgatgggaaggaaggcttctcatgtggcattggagtgtgctcttcaatcgcatccaaatatggttatccttggcgaggaggttgctgcatcaaaactcacaatttttgatatcacaaagcagatatgtgatgcagttcaggcgagagctgaaaaagacaagaatcatggggttatacttattcctgagggccttgtggagagtattcctgaattatatgctcttctacaggaaattaatggcctccatggtaaaggtgtttccgttgagaatatctcttctcaactttcaccttgggcatctgcgctatttgagtttttgccccaatttattaggcagcagctgcttctccgtcctgaatctgatgactcagctcaactttctcagattgaaaccgaaaagcttctagctcaattggttgagaccgaaatgaacaaacgtttgaaggaaggcacttacaaaggaaagaagttcaatgcaatctgtcacttctttggctaccaagctaggggtgcaatgccttcgaagtttgactgtgattatgcctatgttctgggacatgtgtgctaccacatcttggcagctggtttgaacggttacatggctactgtgacaaatcttaagagtcccctgaacaagtggcgatgtggtgctgctcctatttcgtccatgatgaccgtgaagggatggtcacgtggccctgcaaccacacaaatcgggaagccagctgtgcatatggctaagtgttgacttgagaggaaaagcatatgagatgttgaggcagaattcatccagctgcttgttggaagacatctacagaaaccctggggccactccaattcgaagggccaggtgctgatgccaagcctatttcactgtgcgtcgaggatcaagactacatgggcaggatcaagaaattgcaggaatacttggagaaggtgaagagcatagtgaagcctgggtgctctcaggatgttctcaaggcggcgctgagtgccatgtcttccgtgacggagacactggctatcatgacttcctcttctactggccagcccccactctgagggccaagcacttgggtgggttacgaatctactacgcgtttcctggttctcttttgctccatctgatggttgggattcgagacagtgatcttgtcatcccatggtttattcttttcctagtttttcggagagttttattatcatttttggctctgatagcgtatgcgggtgtactgtttggcgaggctcaacttgaataattttgatcaaactgtcggctgtgatctattaataatctaaatttcgagagggtccatctctagctttctctttgattcatacgagaaccaattctgatgagaaaaaaaaaaaaaaaaaaggccccta

SEQ ID NO: 32013 - DNA, 2854 bp, Triticum aestivum
  Clone ID: PAT_TA_32013
gaattcggcacgagctcacggatcgggagcgccgccgcttccccacctcgtctctcggcgaacccccaaggaactatattcccagtgtgatatccaaaaccagtcaagatggtgaagtttacagcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcactcgagatgtacaagggcgacagggatggtgatgagtacctgatcaaccttattgattcacctggccacgttgacttttcttcagaagtcacagctgctcttcgtatcactgatggtgccttggttgttgttgactgtattgagggtgtctgtgtgcagactgaaactgtgctgcgccaagctcttggtgagaggattaggcctgtccttactgtgaacaagatggacagatgctttcttgagcttcagtttgaaggtgaggaagcataccagactttctcccgtgtcattgaaaatgccaatgtcatcatggcaacatatgaagatgtgctccttggtgatgtccaagtgtacccagagaagggtactgttgcattctctgctggtttgcatggatgggctttcacccttacaaactttgctaagatgtatgcctccaagtttggtgttgatgaggtgaagatgatggagaggctgtggggtgagaacttctttgacccagccacaaagaaatggacctccaagaacactggcacagctacctgcaagagaggttttgttcagttctgctacgagccaatcaagcaaatcatagccacctgcatgaatgatcagaaggataagttgtggcctatgttgaagaagcttggtgtgacgatgaagaatgatgagaaggacttgatgggcaaggctctcatgaagcgtgtgatgcaaacttggctgcctgccagtcgtgctctgcttgagatgatgatatttcacctcccctctccctcgaaggcacagaggtatcgtgtggagaacttgtacgagggtccccttgatgatatatatgctaatgctatcagaaactgcgaccctgatggtcctcttatgctgtatgtctccaagatgattccagcatctgacaagggtagattctttgcctttggacgcgtttttgccgggagggtcgcaactggcatgaaggtccgtatcatgggtcccaactttgttcctggccagaagaaggatctatatgtgaagagtgtccagcggactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggctatgaagttctctgtgtcccctgttgtgcgtgttgccgttcagtgcaaggtggcatctgatcttcctaagcttgttgagggtttgaagcgtctggccaagtctgatcctatggttctctgtaccattgaagagtctggtgagcatatcattgctggagctggagagcttcatcttgaaatctgtctgaaggatctgcaggatgacttcatgggtggtgctgaaattattgtttcccctcctgttgtttccttccgtgagactgttctggagaagtcctgccgcactgtcatgagcaagtcccccaacaagcataaccgtctttacatggaagctcgcccattggaggagggattggctgaggctatcgatgatggccgcattggcccgcgtgatgatcccaaggtgcggtccaagatcctatctgaggagtttggttgggacaaggatctcgccaagaagatttggtgctttggacctgagacgactggccccaacatggttgttgacatgtgtaagggagtgcagtatctgaatgaaatcaaggactctgttgtggctgggttccagtgggcatcaaaagagggagcattgtgtgaggagaacatgcgtggcatctgctacgaggtctgtgatgttgttctccacactgatgctattcacaggggtggtggtcaggttatcccaacggcgaggagggtcatttacgcttctcagctcaccgccaagccaaggctgctggagcccgtgtacctggttgagatccaggcccccgagaacgcacttggtggtatctatggtgtgctgaatcagaagagaggccacgtgttcgaggagatgcagaggcaaggtaccccactgtacaacatcaaggcctacctgcctgtcatcgagtcccttcgggttctcgagcaccctgagggctgcgacgtccggccaggccttcccccagtgtgtgtttgaccactgggacatcatggcctccgatcctttggaccctggcacccagtcggcgacgctcgtgacggagatccgcaagaggaagggtctcaaggagcagatgactcccctatccgatttcgaggacaagctctaaatcttggggtcatgttttggtactggctcttgctgtgaagggaggcgcggtatttttctccctatgtgtcttccttactatcttgttgtttgtatgtggtgctactgagactatggttttgatgacggttgtggtgatgtaacagatgttaaaactttgatgatctatccgtcgtcagctggtggttatttttactgtgctgtgtttgctttt

SEQ ID NO: 32014 - DNA, 2883 bp, Triticum aestivum
  Clone ID: PAT_TA_32014
cgttcgctcacggatcggcagcgccgccgcttccccacctctcatctctcggcgaacccgcaaggaactatattcccagtgtgatatccaaaaccagtcaagatggtgaagtttacagcggaggagctccgcggaattatggacaagaaaaataatattcgtaacatgtctgttattgctcatgtcgaccacggcaagtctacgcttacggattcccttgtggcagctgctgggattatcgcccaggaagttgctggggatgttcgcatgactgatacccgtgcagatgaggcagagcgtggtattacaatcaaatccacgggtatctctcttttctatcagatgactcctgaatcacttgagatgtacaagggcgacagggatggagatgaatacctgatcaaccttattgattcacctggccacgttgacttttcttcggaagtcacagctgctcttcgtatcactgatggtgctttggtggttgttgactgcattgagggtgtctgtgtgcagactgaaactgtgctgcgccaagctcttggtgagaggattaggcccgtcctcaccgtgaacaagatggacagatgcttccttgagcttcagtttgaaggtgaggaagcatatcagactttctcccgtgtcatcgaaaatgccaatgtcatcatggcaacatatgaagatgtgctccttggtgatgtccaagtgtacccagaaaaggggactgttgcattctctgctggtttgcatgggtgggctttcacccttacaaactttgctaagatgtatgcctccaagtttggtgttgatgaggtgaagatgatggagaggctgtggggtgagaacttctttgacccagccacaaagaaatggaccaccaagaacactgggacagctacctgcaagagaggttttgttcagttctgctatgagccaatcaagcaaatcatcgccacctgcatgaatgatcagaaggataagttgtggcctatgttgaagaagcttggtgtgaccatgaagaatgatgagaaggacttgatgggaaaggctctcatgaagcgtgtgatgcagacttggctgcctgccagtcgtgctctgcttgagatgatgatatttcacctcccctctccttcaaaggcacagaggtatcgtgtggagaacttatacgagggcccccttgatgatgtatatgcaaatgctatcagaaactgtgaccctgacggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtctggccaagtctgatcctatggttctctgtaccattgaagagtctggtgagcatatcattgctggagctggagagcttcaccttgaaatctgtctgaaggatctgcaggatgacttcatgggtggtgctgaaattattgtttcccctcctgttgtctccttccgtgagactgttctggagaagtcctgccgtaccgttatgagcaagtcccccaacaagcacaaccgtctttacatggaagctcgcccgttggaggagggattggctgaggctatcgatgatggccgcattggcccgcgtgatgatcctaaggtgcgctccaagatcctgtctgaggagtttgggtgggacaaggatctcgccaagaagatttggtgctttggacctgagacgactggccccaacatggttgttgacatgtgtaagggagtgcagtatctgaatgaaatcaaggactctgttgtggctgggttccagtgggcatcaaaagaaggagcattgtgtgaggagaacatgcgtggtatctgctatgaggtctgtgatgttgttctccacactgatgctattcacaggggtggtggtcaggttatcccaacggcgaggagggtcatttacgcttctcagctcactgccaagccaaggctgctggagcccgtgtacctggttgagatccaggccccggagaacgcacttggtggtatctatggtgtgctgaatcagaagagaggccacgtgttcgaggagatgcagaggcaaggtaccccactctacaacatcaaggcctacctgcctgttatcgagtccttcgggttctcgagcaccctgagggccgcgacgtccggccaggccttcccccagtgtgtgtttgaccactgggacgtcatggcctccgatcctttggaccctggcacccagtcggcgacgctcgtgacggagatccgcaagaggaagggtctcaaggagcagatgacccccctatccgacttcgaggacaagctctaaattttggggcttcgaggacaagctctaaattttggggccatgttttggtactggctcttgctgtgaagggaggcgcggtatttttctccctatgtgtcttccttactatgttgttgtttgtatgtggtgctactgagactatggttttgatgatggttgtggtgatgtaacagatgttaaacttagatcatacatttctggcatcccatggtggtttatttttaaaaaaaaaaaaaaaaaaggccccta

SEQ ID NO: 32015 - DNA, 2917 bp, Triticum aestivum
  Clone ID: PAT_TA_32015
gggggccacgcgtccgctcccattctctccgggagcgccgccgcttcctcatcccccagactctcgcctctcggctcgggaggcggaagcgaaaccccaaggaactatattcctgccgtgacattcaaacacagtcaagatggtgaagtttacagcggaggagctccgcggaatcatggacaagaagaacaatatcagaaacatgtctgttattgcccatgttgatcacggcaagtctacccttacggattcccttgtggcagctgctgggattattgcccaggaagttgctggtgatgttcggatgaccgatacccgtgcagatgaggcagagcgtggtatcacaatcaaatccacgggtatctctcttttctatcagatgactcctgaatcactcgagatgtacaagggcgatcgcgatggggacgaatacctgatcaaccttattgattcacctggccacgttgacttttcttcggaggtcacagctgctcttcgtatcactgatggagctttggtggttgttgactgtattgagggtgtctgtgtgcagactgaaactgtgctgcgccaagctcttggtgagaggattaggccagtccttactgtgaacaagatggacagatgcttccttgagcttcaggtggaaggtgaggaagcatatcagactttctcccgtgttatcgagaatgccaatgtcatcatggcaacatatgaagatgtgctccttggtgatgtccaagtgtacccagaaaaggggactgttgcattctctgctggtctgcatgggtgggctttcacccttacaaactttgctaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgaccagaaggataagttgtggcctatgttgaagaagcttggagtgaccatgaagaatgacgagaaggacttgatgggcaaggctctcatgaagcgtgtgatgcaaacttggctgcctgccagtcgtgctctgcttgagatgatgatatttcacctcccctctccttcaaaggcccagaggtatcgtgtggagaacttatacgagggcccccttgatgacatatatgcaaatgctatcagaaactgtgaccctgatggtcctcttatgctgtatgtctccaagatgattccagcatctgacaagggtagattctttgcctttggacgtgtttttgccgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgagggtttgaagcgtctggcaaagtcagatcctatggttctctgtaccattgaggagtctggtgagcatatcattgctggagctggagagcttcaccttgaaatctgtttgaaggatcttcaggatgacttcatgggtggtgctgaaatcattgtttcccctcccgttgtctccttccgtgagactgttctggagaagtcctgccgtactgtcatgagcaagtccccgaacaagcacaaccgtctttacatggaagctcgccccttggaggagggactggctgaggccattgatgatggtcgcattggcccacgtgatgatcctaaggtgcggtccaagatcctgtctgaggagtttgggtgggacaaggatcttgccaagaagatttggtgctttggacctgagacgactggccccaacatggtcgtcgacatgtgtaagggagtgcagtatcttaatgaaatcaaggactctgttgtggctggtttccagtgggcgtcaaaggaaggcgcgttggctgaggagaacatgcgtggcatttgctttgaggtctgtgatgttgttctccacactgatgctatccacaggggtggtggtcaggtcattcccacggccaggagggtcatttatgcttctcagctgactgccaagccaaggctgctggagcctgtgtacctggttgagatccaggccccggagaatgcgcttggtggtatctatggtgttctgaatcagaagagagggcacgtgttcgaggagatgcagaggcaaggtaccccgctctacaacatcaaggcctacctccccgtcattgaatcctttgggttctcaagcaccctgagggccgcgacgtccggccaggccttcccccagtgtgtgtttgaccactgggacatcatggcttctgatcctttggacccaggcacccagtcggcgacgctcgtcacggatatccgcaagaggaagggcctcaaggagcagatgacccctctatccgatttcgaggacaagctctaaatttttggtgctgttatcccttacctggtcttgtgttgttaaagagagctgcactattttgtatcgatgagtcttgctgttatgacctacttgtcgtgatactgggaactatgttttgatgtctggtgatgtaacggatgttttacttagattatctatctgttgtccactggttcttttgctcttgtgcttgatctttagatttgcctattcttagtcggtataatctgctttctcataaaaagt

SEQ ID NO: 32016 - DNA, 2914 bp, Triticum aestivum
  Clone ID: PAT_TA_32016
tgcttccattctcttcctccgggagcgccgccgcttgctcatctcccacctctcgcctcgggagccggaagcgaaaccccacggtactatagtcccggtgtgacattcaaaagcagtcaagatggtgaagttcacagcggaggagctccgtggaattatggataaaaagaataatattcgtaacatgtctgttattgctcatgttgaccatggcaagtctacgcttacggattcccttgtggcagctgccgggattatcgcccaggaagttgctggtgatgttcgcatgactgatacccgtgcagatgaggcagaacgtggtattacaatcaaatccacgggtatctctctgttctatcagatgactcctgaatcacttgagatgtacaagggtgacagggatggggacgaatacctgatcaaccttattgactcacctggtcatgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctccttggtgatgtccaagtgtacccggagaaagggactgttgcattctctgctggtttgcatgggtgggctttcacccttacaaactttgctaagatgtatgcctccaagtttggagttgatgaggcgaagatgatggagaggctttggggtgagaatttctttgacccagccacaaagaaatggacctccaagaacactgggacagctacttgcaagagaggtttcgttcagttctgctacgagccaatcaagcaaatcatcgccacctgcatgaatgatcagaaggataagttgtggcctatgttgaagaagctgggtgtgaccatgaagaatgatgagaaggacttgatgggcaaggctctcatgaagcgtgtgatgcaaacttggctgcctgccagtcgtgctctgcttgagatgatgatatttcacctcccctctccttcgaaggcacagaggtatcgtgtggagaacttatatgaggggcctcttgatgatatatatgcaaatgctatcaggaactgtgaccctgaaggtcctctgatgttgtatgtctccaagatgattccagcatctgacaagggtagattctttgcctttggacgtgtttttgctgggagggttgcaactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggctatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggtgagcttcaccttgaaatctgtttgaaggatctgcaggaggacttcatgggtggtgctgaaattattgtctcacctcctgttgtctccttccgtgagactgttctggagaagtcctgccgcacagttatgagcaagtccccgaacaagcacaaccgtctttacatggaggctcgcccattggaggagggactggctgaggccattgatgatggccgcattggcccacgtgatgatcctaaggtgcgctctaagatcctatctgaggagtttggctgggacaaggatcttgccaagaagatttggtgctttggacctgagacgactggccccaacatggttgtcgacatgtgtaagggagtgcagtatctgaatgaaatcaaggactctgttgtggctgggttccagtgggcatcgaaagaaggtgctttggctgaggagaacatgcgtggcatctgctttgaggtctgtgatgttgttctgcacactgatgctattcacaggggtggtggccaggtcatcccaacagccaggagggtcatttatgcttctcagctcactgctaagccaaggctgctggagcctgtgtacctggttgagatccaggccccggagaatgcacttggcggtatctatggtgttctgaatcagaagagagggcacgtgtttgaggagatgcagaggcctggtaccccgctgtacaacatcaaggcttacctcccggtcatcgagtcgttcgggttctcaagtaccctcagggctgcgacatctggccaggctttcccccagtgtgtgttcgatcactgggacatcatgtcttcggatcctttggaggccggctcccagtctgccacccttgtcacggagatccgcaagcgccaagggtctgaaggaacagatgacccctctgtctgatttcgaggacaagctctaaacttttggttctgttatctcctatatagtgtagttggttttgctgctaagagagctgcactattattttgtgtctactgagtcgtggctgtattgctattggaatgtactcctatctgtcgtgatactggcactttgttttgatgtctatcgatgttaaaacttagattatatatctgttatccaccggtagttcttgtttaaaaaaaaaaaaaaaaaaaaaaaaaaaaacccacgcgtccgcccacgcgtccgcggacg

SEQ ID NO: 32017 - DNA, 3937 bp, Triticum aestivum
  Clone ID: PAT_TA_32017
cgtccgcccacgcgtccgattctcttcctccgggagcgccgccgcttcctcatctctcacctctcggctcgggagaccgaagcgaaaccccaaggaactatagtcccagtgtgacattcaaaagcagtcaagatggtgaagttcacagcggaggagctccgtggaattatggataaaaagaataatattcgcaacatgtctgttattgctcatgttgaccacggcaagtctacgcttacggattcccttgtggcagctgctgggattatcgcccaggaagttgctggtgatgttcgcatgactgatacccgtgcagatgaggcagaacgtggtattacaatcaaatccacgggtatctcccttttctatcagatgactcctgaatcacttgagatgtacaagggcgacagggatggtgatgagtaccttatcaaccttattgattcacctggccacgttgacttctcttcggaagtgacagctgctcttcgtatcactgatggtgctttggtggtggttgactgtattgagggtgtctgtgtgcagaccgaaactgtgctgcgccaagctcttggtgagaggattaggcctgtcctcaccgtgaacaagatggacagatgcttccttgagcttcaagtggaaggtgaggaagcataccagactttctcccgtgtcattgaaaatgccaatgtcatcatggcaacatatgaagatgtgctgcttggtgatgtccaagtgtacccggagaaggggactgttgcattctctgctggtttgcatgggtgggctttcacccttacaaacttcgccaagatgtatgcctccaagtttggagttgatgaggcaaagatgatggagaggctgtggggtgagaacttctttgacccagccacaaagaaatggacctccaagaacactgggacagctacctgcaagagaggtttcgttcagttctgctatgagccaatcaagcaaatcatagcaacctgcatgaatgaccagaaggataagttgtggcctatgttgaagaagcttggtgtgaccatgaagaacgatgagaaggacttgatgggcaaggctctcatgaagcgtgtgatgcaaacttggctgcctgccagtcgtgctctgcttgagatgatgatatttcatctcccttctccttcaaaggcacagaggtatcgtgtggagaacttatacgagggcccccttgatgatatatatgctaatgctatcagaaattgtgaccctgatggtcctcttatgctgtatgtctccaagatgattccagcatctgacaagggtagattctttgcctttggacgtgttttcgctgggagggttgcaactggcatgaaggtccgtatcatgggacctaactttgttcctggccagaagaaggatctgtatgtgaaaagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgctgttcagtgcaaggtggcttctgatcttcctaagcttgttgagggtttgaagcgtcttgccaagtctgatcctatggttctctgtaccattgaagagtctggtgagcatatcattgctggagctggagagcttcaccttgaaatctgtttgaaggatctgcaggaggacttcatgggtggtgctgaaattattgtttcccctcctgtcgtctccttccgtgagactgttctggagaagtcctgccgcactgtcatgagcaagtcccccaacaagcataaccgtctctacatggaagctcgcccattggaggagggactggctgaggccattgatgatggccgcattggcccacgtgatgatcctaaggtgcgctccaagatcctgtctgaggagtttggttgggacaaggatcttgccaagaagatttggtgctttggacctgagacgactggccccaacatggttgtggacatgtgtaagggagtgcagtatctgaatgaaatcaaggactctgttgtggcagggttccagtgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgctaagccaaggctgctggagcctgtgtacctggttgagatccaggccccggagaatgcactcggtggtatctatggtgttctgaatcagaagagagggcatgtgtttgaggagatgcagaggcctggtaccccgctgtacaacatcaaggcttacctcccggtcatcgagtcgttcgggttctcaagtaccctcagggcggcgacatccggccaggctttcccccagtgtgtgttcgaccattgggacatcatgtcttctgatcctttggaggccggctcccagtctgccacacttgtcacggagatccgcaagcgcaagggcctgaaggaacagatgacccctctatctgatttcgaggacaagctctgaacttttgcttctgttacatggtctagtttgcttttgctgctaagagagctgcactattatctgtctattgagtcgtcgctgtactgctattgggattcctatcggtcgtgatactggcactttgttttgatgtctgtcgatgaaaaaaaaaaaaaaaaaaaaaaaaatttttttttttttggaacggtcacgaaaaaatgcactcgagtccgtcatcatcaggctagatgcattagttcattgttcaacccatacaaggtctgcaccacgatctgctacctactactcctatctaggttaaaaatcctgctacactgagaccgagagtgcgatgattctacatgcaaccagcacgaaactgcattagccgagtctccagcatcatcgaagaaattgcttctctaacaaactgtgctccgatcgaacaatgtattggaagcacacatcttcacttctgttcatcctcagagtcctcggaagtttggtcgctttcatagtctggggttgctctaaaaatgtagaccttgaactttgcgctctctatcagctgaaaaaccaagcaatcgccattttcaaggtcatagtcgacggcaaactctctccaccccttgctgaggtagcagtgtctgccctgtctgctggcattgtacatcatgtgggactcgtcatccgcctcatccaccacgacgactggctcatcgtgcgccgggaggtactcggtgaactgcttcgggattgtcataaagtttgccctgctggcgcaggcgtgggtgatgggcttgacgaaggcgggccagcggatctggtgaatctggcgctggagatcctcggccttttgtttggcggcggcggtggccttctcctcgtcggttgcccctttccaaacttcattggcgtacagtccctggtagtcgcgctgctttgcgccctcgaggtagttgggctgctccgggaggccggcgacgcggccggaccgccggagatcgccgggctccggggccttgcgcttcggcctgggcttggggttgggcttgggcctggcggcggcctcgcggacggcggcggagaggtggtgcaggcggatctcctccagcttccggcggttctcctcaatctgcctccggcgctgctcctcgtacgagttcgattccgccattgccccttcctgattcttcttcttctttcttcttgtgtgttttcctgctttcgctctgtttggggggagaactggacggagcagggaatggggaaaagtggcgtggccctagattca

SEQ ID NO: 32018 - DNA, 2927 bp, Triticum aestivum
  unsure (1)..(2927): unsure at all n locations
  Clone ID: PAT_TA_32018
ttcggcacgaggctctctgggagcgccgccgcttcctcatctctcagactctcgcctctcggctcgggaggcggaagcgaaaccccaaggaaccatatttgcagtgtgacattcaaacacagtcaagatggtgaagttcacagcggaggagctccgcggaatcatggacaaaaagaacaatatccgtaacatgtcggttattgctcatgtagaccatggcaagtctactcttacggattcccttgtggcagctgctgggattattgcccaggaagttgctggtgatgttcgcatgactgatacacgtgcagatgaggcagagcgcggtatcacaatcaaatccaccggtatctctcttttctatcagatgactcctgaatcactcgagatgtacaagggcgatcgcgatggggatgaatacctgatcaaccttattgattcacctggtcacgttgacttttcttcggaagtcacagctgctcttcgtatcactgatggagctttggtggttgttgactgtattgagggtgtgtgggtgcagactgaaactgtgctgcgccaagctcttggtgagaggattaggccagtccttactgtgaacaagatggacagatgcttccttgagcttcaggtggaaggtgaggaagcatatcagactttctcccgtgttatcgaaaatgccaatgtcatcatggcaacatatgaagatgtgctccttggtgatgtccaagtgtacccagagaaggggactgttgcattctctgctggtctgcatgggtgggctttcacccttacaaactttgctaagatgtatgcctccaagtttggagttgacgaggcaaagatgatggagaggctgtggggtgagaacttctttgacccagccacaaagaaatggacctccaagaacactgggacagctacctgcaagagaggtttcgttcagttctgctatgagccaatcaagcaaatcatagccacctgcatgaatgatcagaaggataagttgtggcctatgttgaagaagcttggagtgaccatgaagaatgatgagaaggacttgatgggcaaggctctcatgaagcgtgtgatgcaaacttggctgcctgccagtcgtgctctgcttgagatgatgatatttcacctcccctctccttcaaaggcccagaggtatcgtgtggagaacttatacgagggcccccttgatgacatatatgcaaatgctatcagaaactgtgaccctgatggtcctcttatgctgtatgtctccaagatgattccagcatctgacaagggtagattctttgcctttggacgtgtttttgctgggagggttgccactggcatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgcgttggttggtttggatcagttcatcacaaagaatgcaaccctgacaaatgagaaggaagttgatgcctgcccaatcagggcaatgaagttctctgtgtcccctgttgtgcgtgttgctgttcagtgcaaggtggcctctgatcttcccaagcttgttgaaggtttgaagcgtctggcaaagtctgatcctatggttctctgtaccattgaagagtctggtgagcatatcattgctggagctggagagcttcaccttgaaatctgtttgaaggatctgcaggatgacttcatgggtggtgctgaaattattgtttcccctcctgtcgtctccttccgtgagactgttctggagaagtcctgccgcactgtcatgagcaagtccccgaacaagcacaaccgtctttacatggaagctcgccccttggaggagggactggctgaggccattgatgacgggcgcattggcccgcgtgacgatcctaaggtgcgttccaagatcctgtctgaggagtttggctgggacaaggatcttgccaagaagatttggtgctttggacctgagacgactggacccaacatggtcgttgacatgtgtaagggagtgcagtatctcaatgaaatcaaggactctgttgtggctgggttccagtgggcgtcaaaggaaggcgcgttggctgaggagaacatgcgtggcatttgctttgaggtctgtgatgttgttctccacactgatgctattcacaggggtggtggtcaggtcattcccacggccaggagggtcatttatgcttcccagctcactgccaagccaaggctgctggagcctgtgtacctggttgagatccaggccccggagaatgcacttggtggcatctatggtgttctgaatcagaagagagggcacgtgttcgaggagatgcagaggcaaggtaccccgctctacaacatcaaggcctacctccctgtcatcgagtcctttgggttctcaagcaccctgagggccgcgacgtccggccaggcattcccccagtgtgtgtttgaccactgggacatcatggcttctgatcctttggaccctggcacccagtcggcgacgctcgtcacggacatccgcaagaggaagggcctcaaggagcagatgacccctctgtccgatttcgaggacaagctctaaatttttggtgctgttatcccatacctgctattgtgttgttaaagagagctgcactattttgtatcgatgagtctatcttactgtcttgctgttaatgacctatttgtcgtgatactgggaactatgttttgatgtctggtgatgtaacggatgttttacttagattatgtatctgttgtccactggttcttttgctctgggcttgatcttanatttgcctgtcacaatctcgntcgttggaantaagaaattttggttgattaaaaaa

SEQ ID NO: 32019 - DNA, 1937 bp, Triticum aestivum
  Clone ID: PAT_TA_32019
atgaatgatcagaaggataagttgtggcctatgttgaagaagctgggtgtgaccatgaagaatgatgagaaggacttgatgggcaaggctctcatgaagcgtgtgatgcaaacttggctgcctgccagtcgtgctctgcttgagatgatgatatttcaccttccctctccctcaaaggcacagaggtatcgtgtggagaacttgtacgagggtccccttgatgatatatatgctaatgctatcagaaactgtgaccctgatggtcctcttatgctgtatgtctccaagatgattccagcatctgacaagggtaggttctttgcctttggacgtgtttttgccgggagggttgcaactggtatgaaggtccgtatcatgggtcccaactttgttcctggccagaagaaggatctgtatgtgaagagtgtccagcgtactgttatctggatgggaaagaagcaagagtctgttgaggatgttccctgtggtaacactgttgctttggttggtttggatcagttcatcaccaagaatgcaaccctgacaaatgagaaggaagttgatgcctgcccaatcagggcaatgaagttctctgtgtcccctgttgtgcgtgttgccgttcagtgcaaggtggcatctgatcttcctaagcttgttgagggtttgaagcggctggcgaagtctgaccctatggttctctgtagcattgaagagtctggtgagcatatcattgctggagctggagagcttcaccttgaaatctgtttgaaggatctgcaggaggacttcatgggtggtgctgaaattattgtttcccctcccgtcgtctccttccgtgagactgttcttgagaagtcctgtcgcactgtcatgagcaagtcccccaacaagcataaccgtctttacatggaagctcgcccattggaggagggattggctgaggctattgatgatggccgcattggcccgcgtgatgatcctaaggttcgctccaagatcctgtctgaggagtttgggtgggacaaggatctcgccaagaagatttggtgctttggacctgagacgactggccccaacatggttgttgacatgtgtaagggagtgcagtatctgaatgaaatcaaggactctgttgtggctgggttccaatgggcatcgaaagaaggtgctctggctgaggagaacatgcgtggcatttgctttgaggtctgtgatgttgttctgcacactgatgctattcacaggggtggtggtcaggtcatcccaacagccaggagggtcatttacgcttctcagctcactgccaagccaaggctgctggagcctgtgtacctggttgagatccaggccccggagaatgcacttggcggtatctatggtgttctgaatcagaagagagggcacgtgtttgaggagatgcagaggcctggtaccccgctgtacaacatcaaggcttacctcccggtcatcgagtcgtttgggttctcaagtaccctcagggcggcgacatctggccaggctttcccccagtgtgtgttcgaccattgggacatcatgtcttctgatcctttggaggccggctcccagtccgcgacccttgtcacagagatccgcaagcgcaagggtctcaaggaacagatgacccctctatctgatttcgaggacaagctctaaacttttgcttctgttacatggtctagtttgcttttgctgctaagagagctgcactattatctgtctattgagtcgtcgtcgctgtattgctattggaatgtactcctatctgtcgtgatactggcactttgttttgatgtctgtcgatgttaaaacttagattatatatctgtcgcgatacttttgatgtctatcaatgttaaaacttagactataaaaaaaaaaaaaaaaaaaaggaaaaaaaaaaaaaaaaaaggccccta

SEQ ID NO: 32020 - DNA, 1176 bp, Triticum aestivum
  Clone ID: PAT_TA_32020
cctctctctttcaaacacagtactcaactctgttaacactttcgacgaattcatccaagtcttctttcacagggacaggacagggctagctaaaaatcatcatcctcaaaggcggcacagcgcccccaattgcggggccacaggcagcagcaagtaccacacacgaacaatgcgacacgcttgcacacaactctgttaacaagtttcgacgaattcgccgatgcgcaaataatggcagcaggatctccacccaatcgacggatcaccccgcaaactcaacctacatttccaatttcctaacaactcacagatagcagcagatctagtgccactagctggcaatcacttcagttcagtgtccgatgaccgaaaacacgaccagtgacaccaggaccgccagcaggtagccactctgttttagcgcgggggacgccgagctcgacgttgacccgtgtggcttctgagccttttgtttttccctgaggaggccacagaagagggcgttgtccggcaacaccgactcggtcacgttgtagcctccgtcaggatccaccacccggatgtacgtctcctggccgaggtaccaggtgtccagattctccgtgcgcacgttccagaaccccgggctgtcgagcgacaacaggacggcggtccatgctccggggaacacctgagtggtgcaacgggaaacgccatcccacttgttgtacgtagaacgactttcgttcgtcctctctccatagtccattcccacgacccagaaggggtatccgtcgatgtggtaggtctgaaccttcgtgtcgttgttctggaacacaatcgccaggaagtgcttgtacgtcgagttgatgacagaagatccgatcgctggcggtccatcagacggcatggttgggaagtccagtgtgtagacttctttcttgtcatagagatccgcaagcctcaatggagtagcaggcggggagtaagagatgccgttcagtgtggtccgccttttgccattgatggtaacaggtggcatgttcctcagcttgtacacttgggtcacgttgatttcgccgtagtgaaatgatccttgaggattcgggcgagcagcaccggtggtcacattcatcctgattgaccgtgcctggttcatggagaaagatttgtcgtacctcggccgcgaccacgcta

SEQ ID NO: 32021 - DNA, 886 bp, Triticum aestivum
  Clone ID: PAT_TA_32021
ccaccacataagaactactcgaaaagcacttggatttcgtgacataactagaccagtttacaacgaacaaagacgatgtgagttcatcacacataaatcataaagcaataaattcaataggctgctagacaaagtagcatctaaacaaatctatatctgtagacaaaactatctttctgtagtagaacagcctcacgtcaatcttgagtacggcactggtctggccaaaacgcagacatttgaatttccaattagaggttgcaaaatccccatctgcatgaccccacaatttctgccaagatgcacttccagttagccttctgaacatcctcatctggatgacaatgtagtttcaacaacgattcgattaccgaaaaagttccagagctcggaaacttgttacatgtacacacacctctgcagctcgatctgtcctgtttcagcgcataacggagcaagcagcagtggtggagaagagcacaaagtggtcatggtcgaaccagtgctgccgtgaacatcacctgaacagtcgccgtaaccagccgaccatatcggagacaagattctactatctcctcccgtgcactcatgccaaccaaacttcaatccaaacagcggcaaggttgtcatgtagtagcccaatgcagcgctgccgcgatcacctgccacaactccggtaggatcaccagccccagctccgtgcatggcgcggcccaagacctatgcagatgccgcacaccacgccgccccaattgaccagcgaccacccaacgccgagaccagaccgcccctctagcatatgccaaacatggcttcactccgggccaaatcgccaccgagcaccaggccgccgttcgccgtcaatacaatcgaaaccgtatgcagc

SEQ ID NO: 32022 - DNA, 582 bp, Triticum aestivum
  Clone ID: PAT_TA_32022
aattcgggcatgtttggattacactcgatcagccccagttccaccggatgcacagagaaactgagctaaaattccctgccaatccgaaggaatcgggtctggacaacgcgataacgcaacataaaaactttcctgtaggaatgataagtgtatcgtcttgccctcaacatctatacaagaatatcagccctctttcagaacctatccccccaccctataacatctacacattcaagtgagcggctctgatctctctgcccccagccacaggccttcctctctagcacaagctcggctcctcaggacgatgcttgccatttgccgcaggataatcccagttcagccatggcatgtcacaaaagaatggcatgagctggtgcactctgtgccggcagggaaaatgtcacgaggcccggagaaggtcgggatcgcgcaaacactcctgagggttagcatagaagtagtcctcttccttgggcttgtcaggaatcaccgtccttctcgaagctgatcccatccggtttgcatggacggacctgattaatttagagaactcatcccacggcaatgagccgctcttat

SEQ ID NO: 32023 - DNA, 1031 bp, Triticum aestivum
  Clone ID: PAT_TA_32023
aaaaatgatatcccatagattgcagtcttctctaaaaatcacaacatcagcaacagcaagctgtcgcacacgcaaagcacagatttgatggctatagaaaaaattaaattacatcaccgctgacgttaagtaagaaatgcccgtgtttagatgacaaatccgtacgcagccattggtcctggcgaagatgaaaatgaatacacagcgtgcagcagtgtcgcttacagaaaattgggttcgaacggtccagatttcttggtgccacaagcattgcgcctgtgtccaagcacaccacaatttgaacactttggcaatttccttggcgccttgggcagatcgcctctctctgggcaagttgtgcatttgtggccctgacctctacagatcgtgcagaaccgcgatctcttcaaatgttcttcatacggagctttgtcacggcttgttgtcggtctacaccttggccttttgttctgctgtcctgcaatcactgaacaacttgattcaccatcacatgcagaccttgtcgcacagccttgcaactcgagtgcctcttgctggttctgaacaagcaactgattttgttgttccctttcggctagtcccatgccatccttatcactacttaacggcacgagagcagcttgcacctccttcatcatagcgcagaaaacatcatagcacttaacattactatcaccaagcaacacacattcacttaacattactatcaccaagcaacacacattcaagcgccttcatgtacattgtgtgatgcctgaatgtgtcactagaaggagggcctctgtctctttggtaccgtaccaaatgtgctggaagaacatctcgtgcatctcttgtccgtcgtttcattatatgtttctcgggtatcttcgacagacggaccaacaccataacctgcaatgcatggcaacacaccaagccagagtgttcaaatgtgccacattcgcaactaaaaaaactctcgtcatcattcacttcaatcttgaaccctaccttactccatttttctc

SEQ ID NO: 32024 - DNA, 629 bp, Triticum aestivum
  Clone ID: PAT_TA_32024
tttttttttggaacaagagcaaaaacattagtactaaaaacagacagattacaagcattacaaagtgtaaccgatgcattccaggctcaacaagacattcaccaagcacattgaggtgcctaacatcacaaacgagctcctccacgccaagaatgcgtcgcttacagcctctggatacaaacggaagaagaaggaagaaccacagacgaaacaagaggaagggaggatattctcggaggaggaacagtaactagttaaaagatgcctagaaaagagagagagagagagagaaagagagatatacatatatctcggaccataacgcctcaattccccaccgcacgctcgcaccggacgcctcatgcatgctcctagtcgtggagcagaggaggacgacgcagtgagagctcaatgcgagccgctagctcgcgcgcccgcccgccatctcctatccgcaaggcttgccgccgtcggactcctccgctctcgggtctccaaatgctggccaggtcgcaccggctgctgctgctgctgcagaggcaccgaggagctccattgctggggtaggaggaagatggggcattttcttgagaggaggagattaccggacgcgtgggcggacgcgtggg

SEQ ID NO: 32025 - DNA, 621 bp, Triticum aestivum
  Clone ID: PAT_TA_32025
aaacccaaatattttcatgaatgttacagatcatttttgttaatgtgtaagtacatcaaacatgttccaacaagcaggaaaattgtagaaacatacaaatgatgggcagttcctaattcctagctatcatggaatcactgcatgatgcattgcactgagcaccttctgtgtgatatggagatgggcagaggcaaagatcaaggaattaaaattcgaaaagaataaataagctgtcagtaagccaatagaaatcgacaaaaaaaagtttacttcagtaagccgatatggatcgacgcatttggaggcataactaccacaacaaagattccatcgttgtaataatagccttagtgctgaattatacttcttaaaatatgtctcgggcattttcttcaagtaccttgtaggcaacaacaatgacaatgattctagggaatgaaattctctcgcaaacaacctgacttgtatatactgattgtaaattcacctagctgaacttccaagaaatcatcaaagcagaagtggcttccctcccatcaataaacttccaggtgaacaggagaagcacgaccatggagaatcatagctgaatacctgaatagagagtcataattgtcctgc

SEQ ID NO: 32026 - DNA, 897 bp, Triticum aestivum
  Clone ID: PAT_TA_32026
attggatcaaaaaatctcattaaacggtagtttggctctgccctccaagctcctgcctcctcgcactagagcttcagcaagagcaagtgccaaaagaagttaacaccctctgttatctatatgcattgatgatttaggcactggcttgggccactttgttaaccatgccaagaatctgagcaacggtaataggattctcagatcgttggaatccttctgtaaaagggatcatttctttctcaaagagtgtcctgacccaatgagtattcgcatttccctcttcggggttgccaaaaacagtcaagtacagagaagtctcgatcaagctgatcttgttctgctcagcagtcatagaaaactccgggttgttagcggcagcaacctgaagacgatcctttcgggcatcagcggcctcctggatggagatgtagggcgcacgaaagtgctgtaaggttgacttccagatgtgagggtccaacctcgaattgtcaccaaagtaaatgtcgtcacggctcaagcttccgtcatgctcaagaataccaggcttggccaagtcgtcaaggttgaaggaggtaccatcgcctgtatccaacgccttcttgccaacgagggttgtggcggctgggtccaggttgatggcgtcggtgaagccctcgatcaagtcatcaagtgtgatgttgaggccgtcacgagggaggtacccatggttagcgagggagttgaccatgggacaagggcttcggcgatcccatttagaagggccgtgccactcatttgagtcatcagctgagtgatggtgagccaaaacagcggagcaaagaaaaagtaggttgaaaagcatggtgagaatcgtagctatcaacggacgcgtggggttgaagatcccgacccggccgg

SEQ ID NO: 32027 - DNA, 418 bp, Triticum aestivum
  Clone ID: PAT_TA_32027
acgaggcaccgtgcgggggcgggcccagcaacaccagcgacaacttcccagacgcgcgggccgtcttccagcagtccgagcccaccacctacatcaacgccccgctgctgggcctcctcgcctacttctccgcccaccccaacctgccccagtccgatggcaccgactgaagaaatgtggttgaagtggcctctttagctgtggtgggccgaggaaggaaggaagcctggttggtggtccttgttttgtatgggctgcagtgggctgattcgtcctgttgctttgctgcccctgcattattatttctactactacgtgtaacggatgccgctcctttcctgtaaaaaatggcaggaaaaggatcggtcgtgccaagacaagcaatatatctccatctactactactatataaaaaaaa

SEQ ID NO: 32028 - DNA, 415 bp, Triticum aestivum
  Clone ID: PAT_TA_32028
cgtccgcccacgcgtccgcccacgcgtccggtccgcgacaaagctgctgggtgcatctgtccatcttcagatctgagtgaagagggcatccgtccatatcaaaaggtttctttccaaacttaacaatgagatactaggtgaaagaaatactccctacaaggaaaggttgagccgcctagagaatttagtactgatcatgggttgatcgacgtggactaccgtgacctggtctgcgtcgtgctcttcaaccacacagagacggacttcaccgtgaagcctggcgaccgcgtcatatagatgattgtccaggtgattgcggcgctggaggtcaccgaggtggaggaccttgacgccaccgtcctgagtcgtcgaggtggaggacctcgacgccactgtctggaggctggccaagtga

SEQ ID NO: 32029 - DNA, 551 bp, Triticum aestivum
  Clone ID: PAT_TA_32029
tctcccacgcgtccgggccctccaggaagtactcctcccacgaccttgccgcccacacctccctcaagcccagtgattacctcttcaagctattgcttattagagactcaggtgttggcaggtcatgtcttctgttaagatttttgcaggtgatcgacgaggactactgcggcccgatgggagtcgtgctcttcaactactcggaggcagacttcaccatgaagccccgcgaccgtgtcgtagagattatcgtccaggtgattgcgacgcaggaggtccccggggtggaggacctcgacgccaccgtccggaggtcatcgagctggaggacgacgccaccgtccggagttcctcaaggtggaggacctcgacgctttgtacatacatctagagaagtggtctggttaggttggtggtgaaatgctagggaaggtgccaaccttttgatgatggttgtgtgtgtcctcgggatctcttcgaattgagatgttgaatgttgcatccatgaacactgcaagtgttaagatggttctgtgaaatttattttgcac

SEQ ID NO: 32030 - DNA, 805 bp, Triticum aestivum
  Clone ID: PAT_TA_32030
cgtccgaaagcatttgaatttaagctagtagatattgagctttgtgattgaagtgtctgttgaatacatctaatctgaacaatttcacatttgcttctctgataagtaaggtttgttttcatttacaagtagaagatagtgatagagtttgaaggtatgtgcaaagatcttctcctgcgtcgccgtccgcgacaaagctgctgggtgcatccgtccatcatctttagatctgagtgaagagggcatccgtccatctcaaaaggatatggatgaccatctgatggtatgcaggtttcttcctaaacttaacgacgagatactagctgaaagaaatgctctctacaaggaaaggttgagcagcctagtgaatttagtactgatcatgaggtgatcgacgcagactaccgcgactcggtgggcgtcgtgctcttcaacaactcggaggcggactttgctgtgaagcccggcgaccgcgtcacacagatgattctccatgtgattgcgatgccggaggtcgccgaggtggaggaccttgacgtcaccgtctggaggtcgtcgaggtggaggacctcgacgccaccatctcgaggttgccgaggcggaggacctcgacgccaccgtctcgaggttgccaaggtgaaggacctcaatgccttggtagatacatctagagaagtggtcttgttaggttggtggtggaacactagggaaggtacccacctttcggtgacggttgtgtgcgtgtgatgtataaatggtatctcgtgatctctttgagttgagatgttcaatattgtatccaaaa

SEQ ID NO: 32031 - DNA, 540 bp, Triticum aestivum
  Clone ID: PAT_TA_32031
cccacgcgtccgcagcggacgagccgccgtcgccgcagccctcctcgtgcgcgcagcctgcctccgtccaccgctcctcccccccttggcgacatgggcatggagatgatcacgaatgtgtccgagtacgagaggctcgccaaggagaagctgcccaagatggtgtacgactactacgcctccggcgcagaggatcagtggacgctcaacgagaacagggaggccttctccaggatcctgttccggccacgcgtactgattgatgtgacccatatcaacatggcaacaaacatcttgggattcgacgtctccatgccgatcatgatcgctcccacggccatgcagaaaatggctcaccctgaaggagagcttgctactgcaacagcagcagcctctgcagggaccataatgacattgtcttcttgggctacttctagtgtggaaagggttaactcagtaggacccgggattcgtttcttccagctttatgtttacaaggacaggaatatagtccggcaactcgtgaaaagggctgaaatg

SEQ ID NO: 32032 - DNA, 1931 bp, Triticum aestivum
  Clone ID: PAT_TA_32032
gcagccgtccggtcgtcggcccccccgcccccccaccccgccctccgccacccccctcgtgccgccccccgcccctctgccacttcgcctcgtcgggctggagagaggaggccatgacgccatcaccatcgccaccgtggacatggaagtagacatgggggtggacgcgacgcacatgggcggggcaccggcggcgtacgggcggctggggtgggcgaccggcggcgggcggaggtacatcagctacgacgggctacgggggacgatctattgtactaccggccagggctgccctactacaactgcccaatcagcagcaccggaaacccctacacccgcggctgcgagtcaatctcccactgtcgtgagggcgacccttcctcggttgtaaacagaatccagaaattacggaagactacgcagcgtgaacctatagacttatttggtttttactaccacactgtagataacagcagctatacagtcgacgtaattttgcagtcggacgatgagagtattggggaaagccctgataacacccaagaacgcaagggattagtagaatgagacttcgagaaaatggaggaagagttcgaaagtatatgcaaagatctttacctcgatcgccatccttgataaagcggttcggggtagccgaccaccttccaaagctctgaaaacaccagtgatggatatggtcgtcgaggaccctgatagtgaacttctcgtatacatcactggcaaaactgaaagagtatggcatggaggagaagaatatcacctctgcgacgccatgtaaagcacccatgaagtttgcgtgttggcggtcaagtacccgactttggcgagctcgataaaggaggaggaattcgacatcgggaaaaggaacaaatgaagtcgaagaaaatgaccgatggcgcaaatcttatcctttgctgagcaaagcggagagctttggttcctgggttgattgccttggcgctagacgattttaaggtgtcccggcagttcacgcgtcctgtggatttatcacgtgaacgaaattgatgccgcgggagatggcgatgtgttggtcattttgtaactcagcgctgatcaatcattgattgaagctgaagtgtcgcgaggggatgtaaatggaatccagaaattacggaaacctgcttatcttgaacccacagacttaattgatgtgtactacgagtctgtagacaacagcaatacacttgaagaaattttgcagtcacaggatcagtatattagggacgtgcttggtaattcgctagttccaaaggcagcggcaacatcagatatggtcgttatctgcgaggagtctcatactgtacatgacatgtcatttgtcatctacattgcaagatgcatgcctgtgctcgcagctgatctcctttcctatgcctcaggcaacagtgaccacgttgaggcgttaagagtgtatttgctgtcaaggtccatttccagattgaagaacgaattccagactggaaatggcaagattacggtcaggtgcatcgaaggctatcccccaattgatctgcagctagggaagcatgttttccttagcgctggcgatttttaccaggctaaccgctcttgattcttgtctccgagcatcccagttttgagtagttttgtcattttcaaccgcaattcattctaatcaggctgattctgtttgtgcctcacaaaagcaatgtatttacttaaatgtgctgccaaggatcgaagggaaagggaattgtcaattgtgtattcagagactcatgtgtatgaagtattacagtgtgctcgtgttagtgtacacattgcaaatagcagcttgccacaagtattgcgctttgtttgtacttaaattcagtgggctgatgtcgagttctaaagtccaacttcttgaaaaaaaaaaaaaaaaaaaa

SEQ ID NO: 32033 - DNA, 602 bp, Triticum aestivum
  Clone ID: PAT_TA_32033
ttttttttttttgcatcccaataggaaattcccatgattctgtaccatttgctcgtttaatacttgtgtcagttctgtaaaaaaaacagaagtatatttttttcctttttcatcacggggcttagcatttgttcagtctgattcggacccagaggttcagaaccacatgagacaacgcaagcccaagtaacaaccagccttaagtatgcaactcctgccaagtaacagccagtcaatggatcatggcccagatgcctatgtggccgattccgcaaagacagcgatcggccattttcgatgtatatagagctcatgtggtatatatcactaagtatatcccataatgctcgtaaacccccgtgggggtcatcaagtgtgcggcgttaccagcttcatctctgctgttccgctgcgttcctccggacccgaaaggggtaccggcgggaaccgcttccattcggttcgacggtggcaggctccgatggagatatcagtagcccacaggaactgcgggtacgccgtggactggggtctgatgattcgtgtgtgaccatcctctgatttcttagcttagatacgatgttttctgtccgacgaatggg

SEQ ID NO: 32034 - DNA, 413 bp, Triticum aestivum
  Clone ID: PAT_TA_32034
ggagcagtattcggagttcttggcgatggctgcggctgatctggctaagaagggcgtcagccccgactgtgctcaggaaatgatcaccaagaagcggaggcgcgacgagcagtcgtcgatgcttggcgcggccgacgttcttgcggcccacgcgcagcagcagatcaccgacgtcgacagcgtcctgctcaaacatgcgagaaagatgtggactacttccgcggagcagacgcagagccagacgaggcttatcggccgcggctgatagggcgaagaagggcggcagccccgacggtgttcaggaaatgatcaccaagaagcggaggcgtactgacgttcttgcggcccacgcgcagcagcagtcatggagggtcgaccgcatcctgctaaaacatgcgaaaaatatgtggact

SEQ ID NO: 32035 - DNA, 2002 bp, Triticum aestivum
  Clone ID: PAT_TA_32035
gcacgaggctcgcttttattcccatcccgccccttttttggccaatacggcccccgattcggtcaacccagcccgacccaacccacctgatccccagtaaagagaggctaaatagatccatagatccctcggagagaggaggggaggcggcgaagcaaggcgttcgatccaggcggcgcggaaaggcgcgggagggaggtgggcggagcacatgccgtcctccgagggggaccggtaccaggccgccaacgagccggtgggcgtcggcctctcctggcgccgctactcctgcggctccccgaagcggaccctcggcggggctttggcggggacggacgacccgggcggcccgaacataagggggccggccgcgtccccgggcccgcccgccggcggcgcggggacggagccggacgtgcggacgggcgagcgcgcgggcagcccggcctccgcgccggcgccggggacggcggcgggaggagcagggcgtcggcgagggcctcgaggcccgctgcttagacaaccgcggcgtcggccgcagcaccgtccccccgcacggatcctactactcgacttcgatggtggcgagggacgctctggccttgatggaccatctggggtggaagcagcacgccggctgcggtcgctccccgcgcgcggtcctcgccggcgtgcccccgccgctcccgccgcgccggcgggcctcgcccccggggcggtgcgccgccgccggcgcgcgcgcgcccctccccaagggcgaggactcccgagcaaagagctcttgtcgacttggaaacccactataccaaggaatacctcgacgaggaagttgaatcctgcacaaggagagcgatcctatataaggaatatgtgaaaggcatatcatcttcagggatccaatctaattgcgggtttgaaggtcaaattaacgcgtgctggactcacaaagtgacaactaaagtccattgatcccatgcgggccgccggttttctcgtttcagttattcatggaagacatgatattatttgcgcaagtatgtcatgcgcggcggcggcctcataggcttccgcctgttgcccgtgcgggagggcttcctcgtgcgcttcttcctgctgctagaatggtggatcttcatggtgcacatctagtcagccatgaaagaccagaagaggtcaacaacgccctaatggatctgataaaggccacaaagtatgcgatggcacctcaagagtggtcgtcccagccggagaacacatcaggcctgatagtgatggcgtttgagcatgtgaggaacattgtaagagtaacgaagcccgtgagggtcgtggcgatccagtcatcataagaaacaaaagacatgtaaattatacccccgaagccggcgaggagatcatatttcatgtctcctccgtataccatctgtggagatgagacgaatttagagtagcatctccgcaagaattgaacctatttttcctcctcccttgagaaaggccctctgctctcggcagaaacaacgtttcaagactgaagaacagaggagctatacctgcattgcgcgcacctgggcagaagcgtcgcagggcgtggtgattgagatgtgctgccatacattgtattattactgtagctcggagagagcaaatggatcggatgtacctttgtgtgatgagtgtaattaagctgtgaccaatatgtacacggccgcatgttgcgttgcgtgggtgctgtcgccgttcttgtgtactccattgttgtgctgtgatcattcctttgaataaatcggctcgatcttcaaaaaaaaaaaaaaaaaaaaaaaaaaaaaaaaaaaaaaaaaaaaaaaaaaaaaaaaaaaaaaaaaaaaaagacacaccaataatcggcactcaaagaggatcaaaaaaacaaaactcaaacaagatcggtcacaaacctcctaaatcaaaaaaacaggcggtcgctaaaaaaaggggggccccccaaaaaatcccccccttctcg

SEQ ID NO: 32036 - DNA, 1596 bp, Triticum aestivum
  Clone ID: PAT_TA_32036
ctccgtcctcgcgcaacagggaccaccctttagaccgttgtaatccaccccatcgctccctcaggaggccgtgacttcccctgatcttgccatggtctacgaggaccattaggagtagactatcaatttccgtctggaaagtgttttctctgctgaagtggttagctttatctctcgatacaactatttcttttctatagattatttacatgttgccgcagactcatgtttcttggactttatagacacgcgtgccagttcttgtgtattttttctcgtttgacgtactctcaattgacatcatattaactcttgattgcagaatttttgaacaatcagtactccaccgcggtaatctacacgaaggcaaggaggactatattccacattgcacgagatccgtccaattattggctcaaactcctttgcaagatattacgagtctattttactaccggagattttcaggtagaaagaagactgatggtgatgatatatacttatatgcccattatcgagtgatatatagctattgttctctactaatggtatgttgacggctggaaactgtatgccaatgttcgtccatacaccgacaacacgcttcagcggggagaatcaccacgacggactgcatctgcccagacgattgttgcaacggccacgacgaagtgcatctctcaattccgggatcagcatgctggatgaatcctccttgcctgttaagttgcaacggtgcaaccaaacaccatggaggcttagggacggtgaatctgcatcgacagtgatggatggaaattgctcgccctccttcctccataaaccacggggaccttgtatagttgtattagcctccccatctatccgtcaggaagccctgactttccctgctattgctgtcgaaaatgctacccttgcagaacatgaactgaacttaagtatggcacatggagcttcaggtaacaaatctaaaagaaccagaattaatgtatgacatgtcttttgtctgttcctctgtttttaagtcaattgcttttcactgaccataatcatattcaattcagttacttgtagatgaaggtgcttactgattcactctttatgcaacactcatcttttatacctgaatgtgaagataacttgaagcctcaaatggggatgacatttgaaggactgaaggctgcggaggagttctacaagtcttattcacaccactctggttttggagttcgtattggacaacaaaagaagttagaaaatgaggtcattcacaataaaagctactgtacatgtttggtaatgatacctacgagatagtatcatgggtcgagcaccagtcattgccttgtgtcaccagataagcgtcatttaatcaaatcaaatcgttgagttagtgagaggacaaagaacacattgtacatatgaagcaaagcaagcagagctcattaatacaattttattagttttactgaatgttgaattctatgtaatggatgagaagttgtgtttattctccaattatttgtcctatttctatcacaaaatgtatcatgggtcgaacaccaatcattggcctggtaacccgaaaaaacgtaa

SEQ ID NO: 32037 - DNA, 520 bp, Triticum aestivum
  Clone ID: PAT_TA_32037
aaaataatgctagactgcattcactgcatacaacattactaaattgaacaacattagtgcttccgcattatatttttccattcccatttcaccgcccaagtgaaaacccaaaagattacatcagagtattgcctacttagctacccaccggagatcgagcgatggagaggagaaaacaacatgagttattacgaaggatcaatcatgctgatattttgtaacagaatcaatcatcaaacatgaacctctagtgatcttcaagtcattttgtaacagagtcattgcagctgatcttttgtatgataagatgccaaatgggatgatacacataaggaagaacacggtaattctcaaaaacaagggccacactcgtttcttccatactgctctcatcgtttgctagcagccaaccccttgcccttgtctccagccgtggtcttgtttgcagtagactccttgaccttggaactgatctcacatccacccattttgcccttggaactgcacttgtggcccggcc

SEQ ID NO: 32038 - DNA, 417 bp, Triticum aestivum
  Clone ID: PAT_TA_32038
acggggtggcgaccttgccgccgccgccggaaccactgcccgggcaccattccttgccctcccatccggggatcacggtgccggcatcacgggggctctcatcgccggtggggattgcgcggatccagcgagacgacgtcgtttccgtgcatgaggaggcagatcaggatcgggatcgtgaccggtcctcgggctttctccatccggcgagatggcgagtcagattagaggatactcggacacccggccatcggcgcgagggtctgctgtattcttattcaccgttgaggtggacgacggtgactgatctcgagggagacatcctcgccggccggcacctggatgatggtgagcaactggtcgaagattatcttccgagccactgcgttgatccatatgtggtcgctactcactccg

SEQ ID NO: 32039 - DNA, 584 bp, Triticum aestivum
  Clone ID: PAT_TA_32039
gaagtggctcatgatctgtctttcatcggagtgccgtggaaggttatccccttttcccactggttgaactccaaaagcaaatgggtcgccggtattctatctggacggatcaagcttccatcgaaagatgaaatgcccacgcgtccgaaagccatctactcgagactggaaactcgtggatggcccaagagatatacccacaacttcagtggtggttatcagttcgaatacgatgactggctcgcggagcaatgtggccatccacctgttgaagaatggaggaagctgatgtatgctgctaatgcaaagaataaggctgctcgtccggaaagatatcgcgatgagtgggatgatgatggtctggtggcactagcaaatgaggacttcaaaaaatacttctaatctatgttgtggactgtgattatcattttcattgccaggacgcggtgatagtcattgcagtaaatattttacaggtaaataattttgtattttgtacatgcaagctcaaaattgggatgcccatgaccttaatcgattgtgaattacttttatcaccatctgaggattccatattatctcga

SEQ ID NO: 32040 - DNA, 762 bp, Triticum aestivum
  Clone ID: PAT_TA_32040
catcgatccaaggagtatactatcccctccggcccccgctcgctgcttcctcctccatttccgatcggtcgattgcggttgacagctccaccgtctgctagcttgtgcttgtcagatcttgttgcatggacggcgagtggagcgacggggcggtgtccggtggcgagcagaaggccagcggggacggcgtttcggcggactgcaacagcccggggtcgccttcgccaccggcggtgccgtcgactagcgggaggaggcggtcgttgcacaacccagtggtgaccgtgcctctcgccgatttgaacgtcccgcggcccaagggcgtcggagagggcaacacgccgacagactcgtgggcgtggcggaagtacggccagaagcccatcaagggctcacccttcccaaggtacgttcatgtacgacctaatttaagtcaccataactctgcaattaactcggagtttggcctggattgggacggcattcaatggattacagtttgcttcctgtgatatggtcttgcgctcttcgattgagtccatatgcatggcgaggtttgctgatcttcgtttggtgttcaattgcgagcagggcttactacaggtgcagtagctccaaggggtgcccggcgaggaagcaggtggagaggagccaggccgacccggacacggtgctcatcacctactcctacgagcacaaccactccagcacggtggcgagggcgcagagccgcccgaccccgacaccgaaacccaacaagga

SEQ ID NO: 32041 - DNA, 712 bp, Triticum aestivum
  Clone ID: PAT_TA_32041
tcgacccagcgtccggctacctagacacgaacatgaagagccggtgccagcaatggcaaaggggaaggtagggagtggtaaagtgaaagagaaatattgaggtgtgaagttagtatacgagatatagatgctccacaacatgtgtattgttgcgtaactcttggctctctacatcagccttcaatcacatgaaggtacaccccggtgctggtttgtgatcacatcagatttgaggtgtatttataacaatcacataaatggaaggttgcaggacgattttggaaatgtcaatggcgttaacaaagacatcggacaagagctatcatatattctaattcagacacaagtgatgatacaacaatgctcttcgccaaattctaattcaggcgagcatagcttagcttgggaccatgcccgtgcaacagttattgtcatcttcatgccccatataagttgcttctgtcatgcatagaagacaaagacgccatcaacagcagcgacacacatagtgaggtcattgcctgacaggattttgctttgagctgcttggagacatccagcgtcgttgtattcctgctttattgccctgtttttacactgaaaatctgaacatatgtagttgatttccaatattcgatcgtactgcaatattttttgacttggttatttgtacatagtacaagcttgaatattgaaaaaaaaattgtgcatt

SEQ ID NO: 32042 - DNA, 1703 bp, Triticum aestivum
  unsure (1)..(1703): unsure at all n locations
  Clone ID: PAT_TA_32042
agttgaacacgagcgcgatgtgggggctagggtttaggtggctgctgctgctgctgctggcgttcgcggcggcggtggagctggaggcgcggtttgtggtggagaagaacagcctgatggtcacgtcgccgacagctctgcgggggcggcacgatagcgccataggcaacttcggcatcccgcagtacggcgggagcatggctggtgccgtcgtctatcccaagggcaactcagacgcctgcgaggccttcaacagcggcaggaaggagcacctcttccgcaccaagcctggagcgctccccagcttccttctcatagaccgcggaaattgcctgtttgctaagaaggtctggaatgcacaatatgctggtgcctcagcagtgcttgtagttgatgacaaggatgagccactgataacaatggacttacttcaggaagatgatgaggctgcaaaatacatacagaacatatccattccttctgctttaattgataagaaatttggagaacaattgaagaaggctgttaaagatggtgaaatggtaaacgtgaatcttgattggagggaggctgtcccacatcctgataaccgagttgagtatgagttgtggacaaatagcaatgatgaatgtgggcctaaatgtgatatgcttatgcattttctgaaggaatttaagggagtgcgcagttacttgaaaaaggtggttatagtcagttcacaccccattatattacttggtattgccctcaagcatttgttgtcagcaaacaatgcaagtcccagtgtataaaccatggaaggtattgtgcacctgatccagaacaagattttagtactggctatgatggaaaagatgttgttgtagagaacttgagacagctttgtgtgtttaatgttgcaaatgagataaaaaaaccatggatctggtgggattatgtgactgattttcacataaggtgcccaatgaaggagaagaagtataacaaaaagtgcgcagaaacagtcattaaatcactaggtttggaagtgaagaagattgataagtgcatgggagatccaaatgatgattctgaccaccctttacttaaaatggagcaggactctcagattgggaaagggtcaagaggagatgttaccatattgcctactcttgttgtgaacaatcgacaatatcgaggaaagctaggaaggaaagctgtcctcaaagctatttgtgctggctttgaggaaactactgagccaaatgtttgtctgagtgatgacatggaaacaaacgagtgtctgagcgataatggaggttgctggcaagacaaagctgctaatgtaacagcttgtagggacacttttcgtggcagagtgtgtgaatgccccacattcaatggcgtgcaatttaaaggagatggctacagcaactgtgaacccgctggtcccggaaaatgcttgataaaccatggtgggtgcctggcatgacactcgcaatggaaaaccatcctttgctggtcaggaaacaggagttatttcccctggtccnaggctgggcctaaaatccntattnacatccaggaaaaaantncattnccnaatcnctnaaaanaatgggggtatatggcntttnggnactttgtnacaggncnaaacntctattagnannttagtaanaaaagccncnnggggtttgaccttgtnttngagacntngaaaa

SEQ ID NO: 32043 - DNA, 701 bp, Triticum aestivum
  Clone ID: PAT_TA_32043
gcaaaaagtactgaaaaagttgtactgctcaggttagtattcaagttgctacaggacataaacatcgccgcttttccatacaccgtacaaacgtccgatctttccatccgtgcgtcgcattaactaacatgtcgtctacgtccctaaaataccgcaagtgctccatatcccaatgcaattggacgcctaacgataccgtaagcaggcgagcccgggtatttcaatgaattttcgggcgctggaatttctttcaacttaaatagatcatacacattaccacttaaccttttgttatctatattgtctagttactttttatttaccatatgtatgtttagctagctattctgcccggattgatgaagacgtcgaagccagccaagcagcctccccgttgtatggtcactgtgaaatttgaaatcttgcttcgcagcagcgccagctccgtgatccagatccttggctgaacggaatcctgcaagctgtggagcatcaagaaaactcttaggtggaaagctctggatcttttcgtgattaaaagatgtgtgttttacaaaccctctagctgctctgatcatttctggaaccactttacaggctttcaaaaaccgcttgctgctatccacatcagcattgtagatagagccagaactttgaatgacattaaaaatatctagatcaatctgcggacgcgtgggtcg

SEQ ID NO: 32044 - DNA, 636 bp, Triticum aestivum
  Clone ID: PAT_TA_32044
ccgctacctcacccttcgccccggcatttgtccactcatatgtaaatccatatcgatcgattatctctttatatgttacaattaattacctttgtattttccttggtgtggttccaatgtgtccccaacctatacaaatgcatactacacccaatcttttctcacctactaataattcaccctgccagcagctcaacatatatactccaccaagtctgccctccccctggaccgtacctaactctcccctgccggccggtgatcctctatattgatcatgcgcgatcgatgcattgaccaatctcatgtcacatgaacaagagatccaccgatcgatatcatggaaccctatgatttcgatcgatggtgcaggaagaagtaataatttagaattactcgatcgaccggaggatgcatgatgatgatgatgatgcattggactggatggatcattggcatgtcatggaatcgggccgcccctgcatgagctgctccggtttcaatccatggctggtacgtgcaggaagaagttataatttagaattactcgatcgacgcggaggatgcatgatgatgatgatgacggactggatgaatcattgcttccccgcctgccgggccggaggggcccggagg

SEQ ID NO: 32045 - DNA, 1203 bp, Triticum aestivum
  Clone ID: PAT_TA_32045
gcacgtgcgagcgcgggccccagggcgtggactccggcctccgcggccccctccccgccgtcgagctaggaagacggaggaggcgcctgacacgccgctggacaacgccgtcatgaacaggctcaagcagttcaaggctatgaaccagttcaagaaagctgcgctaagggtcatcgccggatgcctgtcggaggaagagatcggggggctcagggagatgttcaagagcatggactcggacaacagcggcaccatcaccgtcgacgagctccggaagggcctggggaaacaggggaccaagctcacggaggccgaagtggagcagcttatggaagccgccgacgccgacgggagcgggacgatcgactacgatgagttcatcacggcgacgatgcacatgaacaggatggaccgggaagagcacctctacaccgccttccagtacttcgacaaggacaacagcggctacatttccaaggaggagctcgagcaggcccttcgggagaaggggcttctggacggcagagacatgagcgaaatcgtgtcggaagtcgacgccgacgacgacgggaggatcgactacagcgagttcgtggcgatgatgaggaaaggggcccccgagggggccaaccccaagaagcggcgcgacgtcgtgctataggggacggcggcttggtcgaggaagccggcggtcgatccgcaacagaacagcaagcgatcgagcgtgcgtgcgaggcagctcgcgacgacgacgatgacgagctcatgtacatttttcacagaagaggtcgagtagcaaatgttcatatatataccgtgggattgggagtcgaaaatgttcgtacgctgtcgggcacgtatcttcttctctggttctgctggttcccttgactgccaggggaattagtttagtatgtactgtatacatcagttgagtaagttggacatttttaacccggaaattgcacccggtttcaggcttgaaaagtataaggaaggtaccttaattgaccaacaaagtgtgttttgaacgtctctctcgcttacaaaaaaaaaaaaaaaaaagaaaaaaaaagagaaaaaaaaaaaaaagaaaaaaaatataaaagaaaaaaacaccaaaagaaaaaaatttaaccacggtaaaaaaaaactcgttttaagaaaaaaaaaaggggggccccaaaaagttttaaatttttt

SEQ ID NO: 32046 - DNA, 642 bp, Triticum aestivum
  Clone ID: PAT_TA_32046
atttggttcgaatctgttgtttatattcggaccagttaggaagtgagtacagtccttgacgtcataatataagaacgttttgcaagctaaaacaacttgaaaaataaacttataatatgaaatggagggagtaataatttataatttattctgtagcacaatcggcaggcgtcgcagtcatctggcggcagattagcacacacctttcgtcttcccggaaacaagcgacacgctcctgtgaccggacaccgcctccctcttgacgaccttgacggacgcctcctccttggcgctcctggccggaccgagctcgatggtgagcctcatcttgggcacggggcccttggccgccaggtccagttcgctcagcgccatgcgcacgtgcgacaggaacctctcggcgagcggccggccgaagtcctcccggacgaccacacggagcaccgtcatgtgctccaggttcgccggcatcgtgtacgccggcacgatccacccgaaccggcgcaggttcgccgacagcttgaacgccagcgagccgtccctgatgcccctgaaggtgaaggccaccagcggcacgccgtcttccttggagatgacgtcgaaacgccccgtgcgcaggagcccctcccggagcgtcctggc

SEQ ID NO: 32047 - DNA, 661 bp, Triticum aestivum
  unsure (1)..(661): unsure at all n locations
  Clone ID: PAT_TA_32047
ctgccacgccaacatggacgacgagaccaatgggggtggcgccccacgcgtccggggacttcgtgcgccagcaccagcagcagaaggccaaggcccagcgctgggccgccaggggccacctccacctcagcctccagcgccacggcgccatggcttcgcagtaccacgcgctctccagccccatggccgcgctgctgtctccccagtctccgctggtccacgccgccagctaagtcgaaaccactacggtcggtcaagtgagccgtgcgtacatttgctacgtacacacttttttcgatcgcatgcatgcatgcatggggccttgatggatgcatgcgattgtttgggaaggtttagacatgcaaaatgcggcacgtaccatatagcttaacgttttacggaggttgcaatggcgcccgatgtgggcaagccgtgtgtgaccacgcatggtattacggtcctcttgtttcgtttatatggtttggtttggtctgatcggatcaaggcttctcgatcagatgctgtaataaacttgtactaaggtacctacaatattgatgttgtatatcaccctcaaaagagggtccatgttgtaccacatgccgcacgagtgatgagtttaaacttgattaagggtttatctacatttgttattanaaaa

SEQ ID NO: 32048 - DNA, 2032 bp, Triticum aestivum
  Clone ID: PAT_TA_32048
cccacgcgtgcggccctccagctagaagcttcaccaatctccctatcaagcccacgaaccttcatcggctagattagcgcataacattcttggcctctcttcttggccgtccctgtttcccctcatccactcatctttagctacctgaccctcctcggccagagagcgcagatggcaagcagatccgccgagcttctgtcgaggatggccgccggcgacggccacggcgagaactcgtcctacttcgacgggtggaaggcgtacgacatgaaccccttccacccgcaggacaaccgcgggggcgtcatccagatgggcctcgccgagaaccaactctcgctggacctgatcgaggagtggagcaaggcccacccggaggcgtccatttgcacggcggagggcgcctcgcagttcaagaggatcgccaatttccaggactaccacggcctcccggagttcagacaggcgatggcccagttcatggggcaggtgagggggtggaaggccaggtttgacccggatcgcgtcgtgatgagcggcggcgccaccggcgcgcaggagacgctcgccttctgccttgccaaccccggcgaggccttcctcgtgcccacgccttactacccaggattcgaccgcgactgctgctggaggtcaggagtgaagctgctgccgatcgagtgccacagctccaacgacttcaggatcaccagggaggccgtcgtggccgcgtacgagagcgcgacgagcaacggcgtccgcgtcaaggggatcctcatcaccaacccgtccaacccgctgggcacgacggcggaccgggcgacgctggccatgctcgccaccttcgccacggagcaccgcgtgcacctcatctgcgacgagatctacgcggggtcggtcttcgccaagccggagtacgtgagcatcgccgaggtgatcgagcgcgacgcccccggcgccgaccgggacctcatccacatcgcctacagcctctccaaggatttcggcctcccggggttccgcgtcggcatcgtctactcgtacaacgacgccgtcgtggcctgcgcgcgcaagatgtccagcttcggcctcgtctcctcgcagacgcagctcttcctggccaagatgctcggggacgaggagttcatgtcgcggttcctgcgcgagagcgcgcggcggctgggcggcgcggcacgagctgttcacgtcggggctccgcgaggtgggcaatcgggtgcctgggcggcaacgccgggctcttctcgtggatggacctgcggggcatgctccgggagaagagcggcggaggcggagctggagctgtggcgggtcatcatccgcaaggtgaagctcaacgtgtcgccggggacgtcgttccactgcggcgagcccgggtggttccgcgtctgccacgccaacatggacgacgagaccatgggggtggcgctgagccggatccgggacttcgtgcgccagcaccagcagcagaaggccaatgcccagcgctgggccgccagggggcacctccacctcagtctccagcgccacggcgccatggcttcgcagtaccacgcgctctccagccccatggccgcgctgctgtccccccagtctccgctggtccatgccgccagctaagtcggtcgccacggtcggtcaagtgagccgcacgtacatttggtacgtacacacttttttcgatcgcatgcatgcatggcacggtgcacgcatggggccagggtgcatgcgattgttttggaaggtttagacatgcgaaatgcagcatgtagtagcgtaacgttttacggaggttgcaatggcgcccgatgtgggcaagccgtgtgtgaccacgcatggtattaccatcatcttagttttgtttatggtttggtttggtctgatcggatcaaggcttctcgatcagatcctgtaataaacttgtaccgaggtacaagattgatgttgtctaggtccatgttgtaccacataccgcaggagtgatgagtttaaacttagtttatctacatttgttatt

SEQ ID NO: 32049 - DNA, 809 bp, Triticum aestivum
  unsure (1)..(809): unsure at all n locations
  Clone ID: PAT_TA_32049
cgcgagctgatgactcgcgcttactaggcattcctcgttgaagaccaacaattgcaatgatctatccccatcacgatgaaatttcccaagattacccgggcctgtcggccaaggctatatactcgttgaatacatcagtgtagcgcgcgtgccgcccggccgcggtcgcgtccgtgcacctgggctccaatgcctacaagcaggcgagcacgctgctggccctattcgccggcggcgacgggtacaaggtggaggagaaggagggctgcctgacgctggggtggcacacgcgcccgctgatcgccacctccgcatggcgcctggccgcgccgtgaccgcgagttttgaacgctgtaagtacacatcgtgagcatggaggacgacacaaccccggcggccgccccggctctccggcgcacgcacgcacgcacgctcttgaagaagaagaagaagctaaatgtcatgtcagtgaacgctgaattgcagcggccggccacgatcgaccgtccggcgtgaagagacggacgacgacgaactccgagccgaccatcccaccggcatgtagtaatgtaatcccttcttcgtccccagttctccaccgcctccatgatcacccgtaaaactcccaagccctactactactactactactactactactactatcatgtttaaatgtctattattgcaatgtgtaattcctccaatcgctcatatcaaaataagcgcgggccggactttgttagctgctccaatgagaatgaaaatgactttgtacgcaataaaaaaaaaaaaaaaaaaaaaannnn

SEQ ID NO: 32050 - DNA, 758 bp, Triticum aestivum
  Clone ID: PAT_TA_32050
tggcgatgaagataaatataaggcttgtttctcaaaacattcgcagatgccgcctaagagctttcgcccagccaggcttgagagctaatgctgctaattccttccttggatgtctgagccttatgaataatgtccccgtgctttgttttcttttatttgatttttttctatgtgggtgcacagtttgaatgttttagctgatgttcttgcatccagagtttacaatgctcctgagattattcaggtggcgcttagagcactaatccgtacagatggatgttgggttacgctcgcccccatattctaagctcttctctttcttattttttggaattgatccttttttggtgcagtgattatagaacattcctcgtactgatgggaaaatccctatgaacgacatctatacacccatagaatctgagcaccaatgtgtattattatgttattttactctttgttttcctttctacgactcccatattatgtgagagctaatgcttttacccagctgagccatcagttcttgcgtggtgccctgttcattatctatataatgttcggagaccgtagcaatagatgatcaatctaaactccaccgtcagtgagggttcttgctctgtgtttgaagcattgaaacagtacatgttattgatctgaatttcactctttggtttctactgatgtacatgttgaaacagagatttattgatgagattaattgctggtgataaaaaaaaaaaaaaaaaaggccccta

SEQ ID NO: 32051 - DNA, 729 bp, Triticum aestivum
  Clone ID: PAT_TA_32051
gcgcgcgggtccgtcctgccggctcttgcgttacgcccgccccctaactccagtttaagctctgttctttttgtggtgtggttgattgatcctgttttggtgcagtgattataaaacattcctcgtactgacgggaaatccctgtgaacgacatctatacacccatagaatctgagcatcagtggacactttcttctggtttcaatgcgtatttttatgttatttcctctttgttttcactgagagtttgctttatgattcttatggaacaatctagctagaagtgattgtgcagcagtgacatctttgcgaatgactacactagaatctgagcaccccggagatgcttttgaatttgcaagtctgccaccagttcagttagaaactgtggagcaccgctcagttttgtgtcactacctggcagcacaactggagaatcattccaaacaccactatactgctcgttttccgggaggtccattgctttgttgttggccattggtgtctgtaaatctgtgcacaaattgtatttccatgttgaaattgagatgatgtaatgagatttctgctatccccatattttgtagccttttattcgatgttttatctccaagccccgagcgccaaccgaacggcaggcatgccgtcctggcagccccagtttcctgcccgcctgagttgtattcaggtggcttttaaagcacagatccgtccagatggatcttgcgt

SEQ ID NO: 32052 - DNA, 420 bp, Triticum aestivum
  Clone ID: PAT_TA_32052
ctgctatgagcgggagcgactgcgagaggacgcccggttgcatgagcaagtgatggtgcggtggtgttgttgttcacggagttgctcccgatgaaactgggcaacgggaaatcatgtaccgtcttgtctggattttccttcgtccagttgatgatagctggaacgaagttagtagcgaaatcatttctgcaggcagttacagctgcattgactgcctgctgtagcaactcatttttctcctcggctgtttttttcgcgtcctcggctgcttttttctcgaccgcaagcttcaccttctcattgatgtccgcctgactaaacttctttttctgcttcttggcctccgggacctcgttgtaaaacaccttccatgtgacgccgtctccagcgccgtgcacacgaccgtattgcggccgctct

SEQ ID NO: 32053 - DNA, 723 bp, Triticum aestivum
  Clone ID: PAT_TA_32053
gaaaataaatgcttgataatttggcaataataaaaggatccttttaataataaaaattaaaagaaacatagccccaaactatgtaatagcaaaatgcaggcattctctatatacaattttgctatgttagctggaacttcggaatccacgtcacgctttctccttgatgtgtttttgataaactctcccctcccactcctctggatccatagcattttgtcctgcacagcccctttatacgcagggtccgacattcatatagatacagaaatatctatgcgacatcatgaaatttgcaaggtgactataaagcatgcacatgccacatcatataactatccgaaacttgaatggcttttatatctgattcaaaactgaacccagttgtaaatatgttacaacattcaacaaagattgacgattctgtacctcacatgtaccagaagctgtgcccattttactctactcatgtttctataaaaaattcatatggctctgaaacggcgagcttcacaaaacaccacctcccgcttcttcctgacctcgtagaacttgtcattgaagttagcctttgatagcctccgagatcttgctgaattcaagcttgtcctcgttcttcagtggtaaggcagagaacagaggcggtcaatccaaggtgtgattttcccttaacaatgcagtatgggacctcccaacttcctgcacagggctgggaaccacaac

SEQ ID NO: 32054 - DNA, 459 bp, Triticum aestivum
  Clone ID: PAT_TA_32054
cctgggtcgacggggatgattccacggatgaagacgacgacactgacagctgctcgacgcctctgcccccgccgccgccgcccggtatggagtgggagtacacggacccaatcactatgcgccccttggattttcttccatcttcgttggctgatcgggacgataaagaagtggcctcacaagtcagcatggatgacgattgggtggaaacgaacatagaatttgatggacaggatgaaagcgtctctggcaatgctgatggcatacttaggcgtgtggaattgcatccagcaaagagtagggttatgggtgatgaaaactcatcaatgatgagcagctgggtaacaaaggactcgaactcttcggtgatggcctgggcgactgacaagtcactggtagaaatagccaaggagattgatgagtacttcttgaaagcagccgcaagtgggactgatgttg

SEQ ID NO: 32055 - DNA, 737 bp, Triticum aestivum
  Clone ID: PAT_TA_32055
caaggtacttcacgaggtagttataagccggcgcataagcaacacttccccagataattctaactgaaacaataagacagttgggcgaatgcaacacattcaaggaccggattcttagaagttacatgaacgatgatatagataataaagcagaggcatatttcctcacatcatacgacagaattaaaaggtcttggagaaacaggaaacacggccacatggattttttatgcataggacgttgggttatcggtcgtcaatggcgcgtcccagaggcgaataacaggcgagacctacttggactcttggtggtccggtgcctcttctttgcaggcctcaacacgaatatccgtatacgttcttctgctgcttcctgtacatggcagtccatataagcttagcaggcttgagatggttgcggaaatagcgcttgcactttgagttggacaaaaggaagactagagtgtatgaattgaccaatctggtacattccccgttcatgtcttgcatcctctgattcagatccaaccgggccgcgctgttgacgccattgctggcgcttccacctccttgcaccttctgagtcaggctttagattttgtcgttcgaacctagggcagagcacatgctatgaaattgaacaaatcaagaataaaggcttcaaaccatgccatagtttccttttagacactccctaagttgagattgtgaataatgagagaaaaaactatcgaata

SEQ ID NO: 32056 - DNA, 446 bp, Triticum aestivum
  Clone ID: PAT_TA_32056
gtccacgggccaggggaggatgatgcttatggggacgaccgcgctgattacaggaaatctgaacccactacctacatcaatgctcccttggtaggggttcttgcctacttcgttggcaacccaaacccaggccatatcagacactgagcataagcactttgccatgtagatagagaagagtgacagaagctataaataggtacacaggaagcaaataggtttgtgattggatggcactacatgttcataggagtggattgcagagcatgtgttctaccaataatgagagcttatctttcatgatttttcttttgtttgggtttgcactgaattttgttttgtgtgaaggtgtgcacagtgcaatttaactgcactggtgtagtcatgagtgaagaaagcttgcattttgcagaaatatttggtatggaaggtactcctgtttcaag

SEQ ID NO: 32057 - DNA, 1731 bp, Triticum aestivum
  unsure (1)..(1731): unsure at all n locations
  Clone ID: PAT_TA_32057
cgagaaggacccgctcaactggggcgcggcggcggccgagctcaccggcgtccgcctcgacgaggtgaagcggatggtggcgcagttccgcgagcccgtggtgaagatcgagggcgccagcctccgcgtcggccaggtggcggccgtggcccaggccaaggacgcgtcgggcgtctccgtggagctcgacgaggaggcgcggccccgcgtcaaggccagcagcgagtggatcctcagctgcctcgccggcggcggcgacatctacggcgtcaccaccggcttcggcggcacctcccaccgccgcaccaaggacgggcccgccctccaggtggagctcctcaggcatctgaacgctggaatctttggccccggcgccgatggccactcgctgccggcggaggtgtcccgtgcggccatgctcgtgcgcatcaacaccctcctccagggctactccggcatccgcttcgagatcctcgaggccatcaccaagctcatcaacaccggcgtcagcccctgcctcccgctccggggcaccatcaccgcctccggcgaccttgtgccactgtcctacatcgccggtctcatcaccggacgccccaacgcgcaggccaccactgttgacgggaagaatgtggacgccgccgaggcattcaaggccgctggcatcgagggcggcttcttcaagctcaaccccaaggagggtctcgccattgtcaacggcacgtccgtgggctctgcgctcgcggccacggtgctgttcgactgcaacgtccttgctgttctctccgaggtcctgtccgccgtcttctgcgaggtgatgaacggcaagcccgagttcaccgaccacctcacccacaagctcaagcaccaccccggctccatcgaggccgcggccatcatggagcacatcctggccggcagcgccttcatgggccacgccaagaaggtcaacgagattgacacgcagctcaagcccaagcaagacaggtacgcgctccgcacgtcgccccagtggctcggccccctccgcgaggtcatccggtctgccaccaagtccatcgagcgcgaggtcaactccgtcaacgacaaccccgtcatcgacgtccaccgtggcaaggcgctccatggcggcaacttccagggcacacccatcggtgtgtccatggacaacacccgtctcgccatcgccaacattggcaagctcatgttcgcgcagttctcggagctcgtcaacgagttctacaacaacgggctgacctccaacctggcaggcagccgcaacccgagcctggactacggcttcaagggcaccgaaatcgccatggcttcctactgctctgagctccagtaccttgccaacccggtgaccaatcatgtccagagtgccgagcagcacaaccaggacgtgaactctctgggccttgtgtcggccaggaagaccgccgaggctgtggacatcctcaagctcatgtcctccacatacatggtggcgctgtgccaggccatcgacctccgccacctggaggagaacatcaagacctccgtgaagaactgcgtgacgcaggtgtcgaagaaggtgctgaccatgaaccccaccggcgacctctccagcgcgcgcttcagcgagaagagcctcatcaccgncatcgaccgcgaggccgtgttcagctacgccgacgacgcctgcagcgccaactacccactgatgcagaagctgcgcgccgtgctcgt

SEQ ID NO: 32058 - DNA, 2586 bp, Triticum aestivum
  Clone ID: PAT_TA_32058
ctcgccgtcacccaccacctccgcaccatctcctccggctcctcttcggctctcctgctcctcctcagcctcctcagcgcagttcgccggccaccagacaccacccaccgagagaatggcaggcaacggagccatcgtcgagaaggacccgctcaactggggcgcggcggcggccgagctcaccggcagccacctcgacgaggtgaagcggatggtggcgcagttccgcgagcccgtcgtcgaagatcggggccgccagcctccgcgtccgctgaggtggcggccgtggccccggccaaggacgtgtccggcgtctccgtccgtgctccacgaggaggcgtggccccgcgttaaggccagcagcgtcggtggtatcctcagctgcctcgccggcggcgccgaaacatctacgggcgtcaccacccggcttcggccggggatcctcccacacggggacaccaatcggcacggcttcccaccgctctgagctccggtaccctgctaacgcggtcagcaaccgcgtgcagcgtgccccgcagcccccccaggacgctcgctctccggggcttgtttcgcccaggaggcacgccgaggctgtggacaatctcacgctcatgtcctccacatacctgcgtgccagctgtgccaggccatcgacctccgccacctggaggagaacatcaagccctccgtgaagaactgcgtgacgcaggcctcgaagcaggtgccgaccctgaagcccaccggcgaccggtccagcgcgcgggccagcgagacgagccgcatcaccgcgcggcttctgcaaactcagcgccaaggcgggtcccgccaacgccaacggcaccgaccgcgggttctgcactcgctgcccaccggtgctgttccgactgcaacctgcccggctgtgctctccgaggtcctgtccgccgtcctctggcgaggcgatgaacggcaaggcccagagttcgccgagccacgtcactcacaagcgaaggcaccagccgggctccgtcgacggccgcggacatcaacgacgacctcccgcaccctcatgagccgagagcaggccgcgcccactatgccacctcgtccgcgacgagctccgactgcatgtacctcagccagggagaacctgctgtcccccagcgaggagtgcaccaaagccagcctgggcggcactcccgacaaagcccatgagccccaggccaaatgtgccacaaagaatggcatcatcaacgtccacccatcgcaaggtacacccatggcgcgggccacccggggaggcagatcgaggaggaccacggccagcgtacgtcccaacatcacacgcataatcagttccgttgttcttgtacttctccaatctcggcagcgttttccatttcaatgttctggcctcggagttgaccgacatccgcaacttgttcttgaatgagtggctgcacggccatggcggccccgcaggccttcaactactctgagtgccattacctttccaaggcgagtcgacctaaccatgtccaggagtgctgagcagcacaaccaggacgtgaactctctgggccttgtctcggccaggaagaccgccgaggccgtggacatcctcaagctcatgtcctccacatacatggtggcgctgtgccaggccatcgacctccgccacctggaggagaacatcaagacctccgtgaagaactgcgtgacgcaggtgtcgaagaaggtgctgaccatgaaccccaccggcgacctctccagcgcgcgcttcagcgagaagagcctcatcaccgccatcgaccgcgaggccgtgttcagctacgccgacgacgcctgcagcgccaactacccactgatgcagaagctgcgcgccgtgctggtcgaccacgccctgaccgccggccccggcgaggccgagagcgaggccacggtgttctccaagatcaacaagttcgaggaggagctgcggtcggccctgccgcgggagatcgaggccgcccgcgtggccttcgagaacggcaccgcgcccatccccaacctgatcaaggagagcaggtcgttccccctgtaccgcttcgtccgcgaggagctcggctgcgtgtacctcaccggcgagaagctgctgtcccccggcgaggagtgcaccaaggtcttcctgggcatcagccagaacaagctcatcgaccccatgctggagtgcctcaaggagtggaacggcgagcccctgcccatcaacgtctgaagcatcgtccgtgcgaccgtggaggagaggaggaggcttccagagtacatccaaaaataagacgcttaattcgttcgtgcatgttcttcttcttcagttcctatcgccttttgcctttcgttgttcgtgcgttggtgttgatcgacgtgtggccttgttgttaattgtgtagctgctctgccgcagctttacctaaagatattattgtcgttgtattttggggtgaatcatgctaatactatgtggttctttttttgcttgtattattactgtcctagtaaaatgttttgcttctatataatacaatacatgcaattgctctgggtgagaaagaaaaaaacgaacccagg

SEQ ID NO: 32059 - DNA, 479 bp, Triticum aestivum
  Clone ID: PAT_TA_32059
cgctcgtactcctttgttattgaaatatatcaaatccggacagttaatcactagatcacacacaccacatctagcacactttttgtgcgtgcatgcatgcaccatgtttctactgcgggcaggtcgggatagggatgccgcaggaggcgagggtcttgcgggcggtggggctgttgatgtagccggaatacgccgggttgctcgcgtacttgcagaggcagccttgctgcgccttcaggttcgagcagcacgattccgacggctccgccccgccgatgatcgccgccgcgcacacgatcagcttccccgcatcgcagtcctgtgctgccaccgacggcggaccgaccaccaccagcgctaacagcgcgcacatggccaccgccgccaccctagccatggtcttcgatctagctccggcttctccaaacacgacgttctccggactcgggtgtgagtgtcagcccacgcgtccgcggacg

SEQ ID NO: 32060 - DNA, 1316 bp, Triticum aestivum
  Clone ID: PAT_TA_32060
ctcgccgccgccgcgcacaatcgtcgaaaaaaaaaaagaccacgccgcagtccctctccaccctcctcccccatccccgtcgtcgctcttcgattccgccggcgatccgcatcagagccccttttcatctcagatagaggtgagtagtagagcgagcggggatgctacaggttccgcccgcgcgtgtgtgcgggaggggagaggaggagcagggatggcgcaggcggtggaggagtggtaccggcagatgcccatcatcacgggcgcctacctcaccgccgccgtcgtcaccaccgtcggctgcagcctcgggatcatctcgccctaccacctgtacctcaaccccaagctggtggtgcagcactacgggatctggcgcctcgtcaccaacttcctctacttccgcaagatggatttgcattttctgttccacatgttttttcttgcccgctactgcaaacttctcgaggagaactcattcaggggaagaacagctgactttttctacatgctcttgtttggtgctactgtcctgactagcatcgttctgattgatgggacaataccttacatctctgagatcttcgtcaggattctgttcctcaagcaattcatcgacatttatgatggttgatcgcctgctggaaagcacaataccataattcacttgagggaataacatctgattttctctacaggctcctgtttggtgctacggctcctaaccagcattcattctgattggtgggaccatacgttttaatcttgagagtatgatccaggatcatgttcctcagcaattcattgacgtttatgatggtttatgtctggagcaagcacaatacacttcattcacatgaaggttcttgggtctgttcaccttcactgctgcctacttaccttgggtccttcttggcttctctgttctggtggggagcagcacatgggttgatcttttgggtatgattgctggccatgtgtattacttcctggtaagacgtggaacccccgttgacgggccgtcgccccctgaagaccccttccttcatcaaggcgctgttcgctgacgacaatgtggtcgtggcggcccggccccccaacgccggggtcgcggctgcaaggttcggtggtgtgggtgcagcagacccccagttccagtgatgatggacatgcagtttgttggatataattttgtacacccgtgtccgtgatgatatgtgcaaaaatacatagagtataattctcagttaggggttgggcttgatgccaatgcgctgctaaccaaagtgtatgtagctgggctcgtgaagccgtct

SEQ ID NO: 32061 - DNA, 1298 bp, Triticum aestivum
  unsure (1)..(1298): unsure at all n locations
  Clone ID: PAT_TA_32061
gcgtgagaagctcgaaagccgcttcattttggatgtaacggtgctggatggcacacttatgtcaccttcaagcccgttcactaagatttggcgcatgcacaacaatgggtctatcatgtggcccttgggcacacagctaatttgggtgggtggagatcaatttgcactgcagacctctgtcccactagagattccattgaatggatttccggtggatcaagagatggatgttgctgttgattttgcggcacctgcaaggcctgggaggtatatatcttactggagactggcatcaccttctggtcaaaaatttggtcagcgagtttgggttcatatccaggtggaagatccatcttttgtcagtgacaacaagactgctgctgttaacttgaatcagcctcaggaaagcaacatcacaaacacaagtgggctgcctcaggaaagcaacatgacaaacacaagtaatttgattgatgtcaacatggagcctgctaaccaagtcctagatgaacatgtcaacggcactagaatggaactagcggttcctttctagtgccgtgaagctgctgagcccaagaaatccccctcagcattttcagcagctcctccataccccatggtcgatgttccgtcatccagtgaaaatgcagctgcttttgtgccaagtgttactgtacttgcacctgaagtcattccgagacctgctgtgactacacctgctgatgtgcccacaagttcgcttactagtatccctgtggatctacctgtagctgcaaccacacctgtggatgtagcatctgcgccgcttgacatcgacagtcttacagaagagaaactgctgcaggagctggaggaaatgggctttaagcaggttgatctgaacaaggagatactgaggcagaataaatacaacctggagcagtccgtggatgatctgtgtggtgtcaatgaatgggaccctctgctggcggaactgaatgaaatgggatttgatgacagggagacgaacaaggagctgcttgccaagaatggaggaagcatcaaacgagctgtgatggacctcatcgccagggagaagaaggacaagtngaagatcgtgtgctctcgagcacctagttatctatatctcgttatctatgcgtaaataatgagacgagtggtactgctgttgtgctgctccactgtgtctcgtggtttgcttatgaactgctgtgaagcgtgttgttggtgtgactttgtgtgcggtggaactctattatgttgtgaccgtggtgggtcagctgcgtgtggttgctgta

SEQ ID NO: 32062 - DNA, 628 bp, Triticum aestivum
  Clone ID: PAT_TA_32062
ataacaatagatactgacttttcttcttgccgaaagagggcccatgagggaaacttcagctaagcagccgttgctgttggcttgttccgtttgcttgagctctcaaatgcgacggagccaaccgtactggacaagctttgtgctgctctaaacatcaataaaaagagcgtggatagagaccttgacgtttaccgcaacttactctcgaaactggttcaagccaaggaacttctcaaggaatacatcgagagggaaaagaagaagagagaggagagattggagacgcccaagccgaatgaggctgttgcaaaattcgatggaagcgcttatcccttgaagcattaactcaacctttccccagaggacagcttgtccggataacagatattaacagttatacacatctggatagcgttgagaactattgggggcatctttggctgctcttcgcccgagtgtagtactcggccgtacaaaaagatccagattattcgtagtattgagtttggtattttgtaatttctccttctatgtgttcgaatgtatcgttttcttcacttctttgacaatatatgaagaggtatctggtgatgaatgttacaagatgagaaaaaatatatattttggt

SEQ ID NO: 32063 - DNA, 1127 bp, Triticum aestivum
  Clone ID: PAT_TA_32063
cttttgccctcaccggcggtgtcgaccacctgcccctggcaattacccttttgccctcaccggcggtgtcgaccatccgccgccgtatcccgtgagagagccggtggtagcccgaggactctcccatggcggccatatcatcgcttccgttcgctacggctggtgatatcccacctactgtggcagatacaaagatgaacttcctgaagtcatacaaacgtcctattccaagcatttacagtacagtcctacaagaacttttggtgcagcaacatctgatgagatacaaaagtacctatcagtatgatcctgtgtttgctcttggatttgtcaccgtctatgaccagcttatggaagggtaccccagcaccgaggacagggatgccatcttcaagtcatacgtaacggcgttaaatgaagatcctgagcaatacagggctgatgcacaaaggatggaagagtgggcacgctcacaaaatggtaacttgttagttgaattttcttccagagatggggaaatagagtccattctgaaagatatatcagaaagggcccagggtaagggaaacttcagctacagccggttctttgctgttggcttgttccgtttgcttgagctctcaaatgcgacggagccaaccgtactggacaagctttgtgctgctctaaacatcaataaaaagagcgtggatagagaccttgacgtttaccgcaacttactctcgaaattggttcaagccaaggaacttctcaaggaatacatcgagagggaaaagaagaagagagaggagagattggagacgcccaagccgaatgaggctgttgcaaaattcgatggaagcgcttatcccttgaagcattaactcaacctttccccagaggacagcttgtccggataacagatattaacagttatacacatctggatagcgttgagaactatcgggggcatctttggctgctcttcgcgcgagtgtagtacattattcgtagtattgagtttggtattttgtaatttctccttctctgtgtttgaatgtatcgttttcttcacttctttgacaatatatgaagaggtatctggtgatgaatgttacaagatgaggaaaaaaaatttttggtaaaaa

SEQ ID NO: 32064 - DNA, 3264 bp, Triticum aestivum
  Clone ID: PAT_TA_32064
gtgagattgattacaccagaatagacaagcctatcctgcccacaagttatctcaggaccctaatttgtgccggaaaatccattcacgtgcttcaatgaagtcaaagcgtgagaagcttgaaagccgcttcattttggatgtaacggtgctggatggcacacttatgtcaccttcaagcccgttcactaagatttggcgcatgcacaacaatgggtctatcatgtggcccttgggcacacagctaatttgggtcggtggagatcaatttgctctgcagacctctgtcccactagagattccattgaatggatttccggtggatcaagagatggatgttgctgttgattttgtggcacctgcaaggcctgggaggtatatatcttactggagactggcatcaccttctggtcaaaaatttggtcagcgggtttgggttcatatccaggtggaagatccatcttttgtcagtgacaacaaaactgctgctgttaacttgaatcagcctcaggaaagcaacgtgacaaacacaagtagtctgcctcaggaaagcaacatgacaaacacaagtaatttgattgatgtcaacatcgagcctgctaaccaagtcctagatgaacatgtcaacggcactagaatggaactgctggagcctttgatatacccacgcgtccgaggacacgtccctcccttcccggacgagcaatagccccacctcgcccctcccccgggcctgttacctttcctcttgccctccccggcggtgtcgcaccatccgccgccgtatcccgtgagcgagccggtggtagcccgaagactctcccatggcgtccacaccgtcgcttccgttcgctccactgcgccgagcggccgactggaggccggcgacggcgactcccgcggtgagcgtctccggtggcgtcatgcccaggctcggcgggctcccccgctcacttgcgttcggccgctgcgccgctacggctcttccggttggatatcccacctactgtggcgagatacatagatgaacttcctgaagtcatacaaacgtcctattccaagcttttagcagaacattcctagcaagatcttttggtgcaggaacatctgaatgaaatacaaaagtacctatcagtatgttcttgtgtttcctcttgtatttgtcactgtctattgaccaccgaagctgagttgacacgcacgccatctgcaggggataggtatctgcgttaaatgaataacgtcgagaaatacagggctgcagctcaacagatggaagagaaggcacttggaataaatggtaagtttaaagaagaattaccttgaggagactgatatatagcgtcaggattgaaagacataaacctaaaggacccactaaaggggaacctcaggctaaagcccgttcttttctgtggacttgtttcgtttgcccgagttcgcaaatgtgacgtcccccagcgaaaaaggcaccacctgtcctgccaaaatcttctctactatgaacctatgtaaagccgacgacctgcagtgcctacacctgttgataagcctacaagctaggcttactagaaatcactgcatcttcacgggaaacagcaacagagcctagagatggagaatctgcaccgcttgacatcgacagtcctaacagaagagaaactgctgcacgagctgggaggatatgtgcttgaagcagcttgatctgaactaaggagatacttgaggcagaataaagtaaaacctggtagcactccttgagatgacctgggtgatgtttaggaatctggtccgtctcgctgggcgggactggaatcgaaatgggatttgatgacacggagatgaacatggagcttcttgtcaaagcatggaaggaatcatcaaacgagctgttatggtcctcatcgtcaggatagaagaagaaaaatttaaaatcgtgtgctgtcggagcaggtagtaatatatatgtcgtaacatatgcaggaaaacgggactagagtggtactggctggttgtgctgctccactatgtcctcgtggtttccttaatgacccgccgtgcattgtcatgcagctcctactttctgtgcggtgtgaactccattcatttagtgaaaaggcagctgttttcgtgccaagtgtttgtgtacttgcacctgaagtcattccgagacctgctgtgactacacctgctgatgtgcccacaagttcgcttactagtatccctgtggatctacctgtagctgcaaccacacctgtggatgtagcatctgcgccgcttgacatcgacagtcttacagaagagaaactgctgcaggagctggaggaaatgggctttaagcaggttgatctgaacaaggagatactgaggcagaataaatacaacctggagcagtccgtggatgatctgtgtggtgtcaatgaatgggaccctctgctggcggaactgaatgaaatgggatttgatgacagggagacgaacaaggagctgcttgccaagaatggaggaagcatcaaacgagctgtgatggacctcatcgccagggagaagaaggacaagtgaagatcgtgtgctctcgagcacctagttatctatatctcgttatctatgcgtaaataatgagacgagtggtactgctgttgtgctgctccactgtgtctcgtggtttgcttatgaactgctgtgaagcgtgttgttggtgtgactttgtgtgcggtgtgaactctattatgttgtgaccgtggtgggtcagctgcgtgtggttgctgtaatggccttagttgctttgttcctactatcgtgactggaagaccttctatgtggatttcacctatattatgtgggtttcgtgtacctcaaaaaaaaaaaaaaaaaaactgagacgagagtttgaggcccaacccgaatgaggctgttgcaaaattcgatggaagctgctgatcccttgaagcattagctcaccctttccccaaaggatcgtcacagcttgtccggataacagatattaccagttatacccatctggatagcgttgagaactattgggggcatctttggctgctcttcgcccgagtgtagtactcgcccgtccaaaaagatccagattattcgtagtattgagtttgggattttgtaatttccccttctatgggttcgaaggttatcgttttcttcccttctttgccaaaaaatgaaaaggtatctggtgatgaatgttccaagatgagaaaaaatatatattttggtgaaaaagaaatcattccgcct

SEQ ID NO: 32065 - DNA, 1220 bp, Triticum aestivum
  Clone ID: PAT_TA_32065
cgcccactctcccccacgccgccaccaccgccgctgcggcttacggctacgcagctctcgcgcccctcgccgccgccgctgctctccgaggtttccggccgctaacttcgtctcgtctaggattgacccgctcctccgcacgatcgccgcctcctccgcctcctccccgagggtttccccgccgccatgtccggcctgagcgcgccgccgttcgacggcctcgcgtcggggcccgacccgtgggacgtcgtcgtcaaggtcaaatatggtgacacacttaagaggttcaatggttatgtcaacggaacacacttcactttgaatctatctgctcttcgttccaaaattgcgagtgcttttaagcttgcccctgatgctgacttcattctcacttatactgatgaggatggggatgttgttatgctggatgatgacgaggacttgcatgatgcagctatccatcagaaattgaaccctctcaggattaatgttcagttaaagaatagccatgctggggcatctcacattaaccggcaggattcaagccctaaacctcttggggccaccactcaggatccgttagctcagataaaatctgttattgatgaagctttaaagcccatatcagaacctttgagatccactgcaagggaagatccactagctcacttaaaatcagctcacgcgatgaagctatgaagtctatccatgagccagttcctgaatccgttgcaaaactgtcacgtgaagtacttgatgcagcaccaccacaattaactgatctgataaaacctttcgtgaacttgatcacatcaaccaacagtagccaatctgctgggcatgctgagagttcacctggctcctccaggggtgtgcgtgggcaagcacgggttgatctcaaagctgatggtcagcctaaagttgaggcaagtttgggttcacgacctttgaatcaacgaaaccctgtatcatctgagacaggaggtcttaagagtgtgttagttgaagttcccgctgcagtcatcactgaagcttcttaaggccaccaaagatcattatatccttctgttgaggatttgctgtacacattcattttatgtggtaataggtctggttgcatggatatgactgttgcttcaatagtaagggaatgtttgttttgccctttgttgaaccacttaattagttcactgttcccagattttgttcaagttactaaa

SEQ ID NO: 32066 - DNA, 1519 bp, Triticum aestivum
  Clone ID: PAT_TA_32066
ccaggccgtccgccacgcccaagcccaaaccccaacacccgcgcggctcccgccgccgccgcaccggagatggcggcgtacctgagcatgggcgaggcgcaccgccgcatcgccgactacctctcccgcttggacgacgctatctctcagtccgacggcgccgacctcgcctctctcctcgccatctcctcggcgcccgcctccaccccgctctccgacgcgctcgccgcttttccggatttccgccgcctcgccgccgaccgcttcccccacctctccgacttcctccccccgctcctccgcgccatccactcccactccctccgccgcttcggggacgcctactcctccttcgagaaggctgctagcgcgttcctgcaggagttcaggaactgggagactccttgggcgatggaggcgatgcacatggtggcgcttgagatcaggctgctagctgagaaggcagatagagagcttgtgatgagcgggaagaacccagacaagctgcaggctgctgggtccttcctgatgaaagttttcggggcacttgcggttaaaggacctaagcgcgttggggcactgtatgttacctgccagctgtttaaaatttatttcaggcttggtactgttaacctttgccgtagtgtcataaggagtatcgaaacagctaggaattttgattttgaagattttccagtgaaagataaggtcacttatatgtattatacaggtcgcttggaggtgtttaatgagaattttcttgttgctgatcagaaactaacttatgctttgatgcattgtaatcctcaaagcgaatcaaatttgaggaaaattttgaagtttctaatccctgtaaagctgtcaattggtgttttgccaaggaggaccctcctggagaaatacaatctgcttgagtatgcagatattgtgacctcacttaggagaggggatctgaggctccttaagcaagcccttgatagacatgaagaccagttactaaaatgtggtgtctaccttgtgttggagaaacttgaactccaggtctaccgaagattagtgaagaaaatccatatcatacagagggagaaggaaccatcgaaggcgcatcaaatcaagctagaggtcttggtaaagactctccaatggcttggaatcaccatggatgtggatgaggtggaatgcatcatggcgtgcctaatatacaagaatctcataaaaggatactttgcccacaaaagcaaagttcttgtccttagcaaacaagatcccttcccaaagttgaacgggaagcccgtttagttcgtagcgatacctcataagcttgtacacctaatgaaagtttctcttatcttcgatgtatggaacatgacaggtttatgtaaaattaccgcgattctgattgtaacatcatttgtattctagctgcaatgtttgtaaacatttatggttggtagcctccacttaaacggtgttttcatagcttcagtgaggtacaatattgtaaaaaaaaaaaaaaaaa

SEQ ID NO: 32067 - DNA, 1782 bp, Triticum aestivum
  unsure (1)..(1782): unsure at all n locations
  Clone ID: PAT_TA_32067
agggggcggaagcgagggaggcggcccggcgcgcccaggggcctcgtcatggtgaagcgggagctgctcgcccgctgcatgacgtgcccgctctgcaaccgcctcctccgcgacgccaccaccgtctccgagtgcctccacacattttgtagaaagtgtatatacaagaagtttaatgacgaggaggtagagtcctgcccagtatgtgacattgatcttggctgcactccagtcgagaagctcagagctgaccacagtctgcaagatgtaagatccaaaatcttccccttcaaaagaaagaagattaaggctgaagatgttgcatctcctgattcacctcctaataaaaggaaagagagatccatctcttcattagtggtccatacacctagattaacaccgacaggatcgactggacggcggacaaaggtagttaccaggaaagctgctgctgccttgcacagccttggtcctaccgttgacaatcctgtgaaaaaggaaaacagtgacaagagtgctcatagctcaagcttgcctgctaatttgggcaaagtgccaaaaacaaagagacagatattgtcaaatgcggaggaggcatctaactattccagcaataaagatactgaagatgatagtaaggacatggcagataatgctgagctctggagacctttaaattgtttgggtcgaagctgcaaacaggacaaagtccttcaggccgagtttacaaggttcaggtgtttaaaagagagcagcttaatggttctcccnagtaccacaaatggcatccaaaacaaacccaaaagagcatcccgaagagacccaaaactgaggatgataagaaagatgctccagttccaccagtgacgcttaaaaggaaacttttagggactgggccgagaaggaccgctcttcgccctccagccgatggggatcctgatggcgcatcttacacagaacgaaaagagatgcatctgcatatggttttcgttggttgcgtcactcgaacagaaaggggactcacctctaccacagataccttcacactatttgcgaataaaagatgcaaatatacctgcttcgtctatccaaaagtacctcgtgcagaagctcagtctcccaagtgagtccgaggtggaaataaattgctgcgggcagccagtgaaccctacacaacctctgcgcaatttagtagagttgtggctgagggggcgatcagcacaggcaacacaggccattgtaggctcccccgcggaagagtttgtgatggtgctaaattatggacggccaaagcccatggaacctttgagtgcacagtaatgattcaacccatttccttttgaaaggtggggtcttttctgccatagccagccatttgctgggccgatggaagaggttgtcgaaagatgaagtccccgttggtacacaacgtcgcgatgtggctggcttcctcgacagccaaccctcgtcgacatattcatgtattcattcatgttggtaggtgttattgttcttcgattccattatgacatatttttttcttatttattatacaccaaagatagatgaaaaatgatctttagattggatataaagagagggaacggtctcaaccattgatgcttctgattgtaagaggtgactatgactatgagtggattgaaaattgccatttggttgtgtcatgacttgttgtagcacgacatgtatttaatgggtaccccgaaaggctgccggatttgctggctggttatgggggccgnacgggcccaaatatcttac

SEQ ID NO: 32068 - DNA, 1591 bp, Triticum aestivum
  Clone ID: PAT_TA_32068
tctgcctgtcattctggtgcgaactgtcggttggccgcgcgtggtcgagagggacagcacgagccaacctcccgtttccacctctctatcctatgggatagagccgccgcgacagccataggatatcctcgctatgatcccatcagcgccctctccttgagagcacgaggccaacctcccgtttccacctctctatcctatggatagaaccgccgcgacagccatagatatcctcgctatgatcccatcagcgccctctcctttgtagcaccatctcccctcccccaccccacccccgggtttatttgacaagatttgatcccaatcctcgcacgtttcttggccgagtgggggagaagattccagaaatggccgtcgccgtagccgccgggaccctccgtacctgttccggcgtatttccggcggcgtccgggaaccatccgcttgccgggtggcggccacttgcaccggcagcgcccgctaagctgagattattgtctccagctttgagggttcctagagctgcttcgcctgcagctgttgagaatgggagctctagcaacagtaatacagtccctacaccgaaagttataatagatcaagactcagatccggatgcaactattgtggaagtaaccttgggtgaccgtcttggggatcttcttgatactatgagtgccttgaggaatttagggctaaatgttgtgaaagctagtgtttgcctcgattcttctggcaagcacaataagttcgctataacaaagtcgtcaactggtcgcaaaattgatgacccagagttgttagaagcagtaagactgacaattattaacaacatgcttgagtatcatcctgaagctagcagtcaattggccatgggtgcaacttttgggctagagccccctacggaagtgtagttaagatcattgctgacagttgatgtggacatagcaactcacatagagatctatgacgatggtcctgaaagaagtttacttgttgtggaatcagctgaccgtccagggttgttggttgatctagttaagatcattgctgacatcaatatcactgtccaatctggagaatttgacactgaggggctactggccaaggcaaaattccatgtcagttaccggggcaagccattaatcaaggctttgcaacaggttctcgcgaatagcttgcgttatttcttgaggaggccgacaacagaggatgccagtttctaagcagatgattacaaacccacgccttatcatagctcatgagacatgatatttgtatgaagtttgcactatcatccaaattattcctgaaatatgcataattccccaaaaagggaggtacacgatatatcatgtactcatagtttcatgtgaaggcagcttcatgctgtatgaactgcactagccttccaagttaagttatgagatggcagtataacacatggttattttgctacccgggatgcatgtttgatgataaaataagagggccgcttgtgtggccaatcgtctatataaagaaaaaaaatataaataagtttcgaaagtaaaaaaatgttttaataattaaatgtcgctgtgtaccgtag

SEQ ID NO: 32069 - DNA, 737 bp, Triticum aestivum
  Clone ID: PAT_TA_32069
gaagacgatgcgtggagcctgtttgaagcgaacgccggcgaggaggccatccgcggcgacgcccaaatttccacacttgcaagacaggtggctgcagaatgcaatggcatgcctctcttcctcgccaccgtcggccgtgccatgtccaacaaacgtacagcagaggagtggagcgatgcactcgacaagctcaagaagccgcagctcacgagcagcgcgcccggccatgacaagagcgcgcaccctctcgtgaagttctgcttcgacagccttgagagcgacacggtgagggagtgcctcctgacctgtgcgctctggccggaggaccacaacatctccaaggacgagctcgtgcagtgctggatcggcctgggcctcctccccaagtacgacgacgtcgacgagtcgctccggttcgggcacacggtggtctccatcctggagtcggcgcgcctcctggagcagggcgacaaccaccggcacaacatgtgcccgtccgacacgcacgtccggctccacgacgtggtccgcgacgcggcgctccagctcgcgcccggcaagtggctggtccgcgcgggcgtcgggctccgggagccgccccgcgacgaggcgctgtggcgcgacacggagcgcgtgtcactgatgcacaacgccatcgaggaggcccccgccaaggccggcggcgcgctctcggacgcgcagccggcgtcgctcatgctgcagtgcaaccgcgccct

SEQ ID NO: 32070 - DNA, 770 bp, Triticum aestivum
  Clone ID: PAT_TA_32070
atgacaactcgaatcatatattaataatattgtaaaaaagaattatatataatttgactatacaaagaatcatgtaggcacgatcaatcacggaaaaaaggagagagagagaaaaaaaattataatggcgccagctgcttggcgctgccgttgttcactagtagagaagcatcaaaccagccaggacggcggccagcccgagcgctagcacaggctgagcaccagcctgagccgccgagctcggctgtggcgttgtctgtgtgcaccgctgcctcgcccctctccctcggcatctcaccaccttggaccggacgttgacctgtaccttcatgccaccggcgcagtgcccgggcaggccgcagatgaagtaccgggtcccgacggcggcgagcgggatgacgtcgttgccgctcgggaacgtggcgacgggactagagctgctgcagttgtcgtaggccgtcttggtcacctccaccacgttgtgcgccgcagccgggtactggaaccggagctcgtcgccggcgtagaacctgatggtggaagtccatcgggtgtagtttgtccggaggtcccacgagccggccggtgcgccgactgtgtaggtggcgccgagcgccgtgccgaacaacgccgccgcgatcaccgcggcaacaaggagagctctggtagctgccgccatggatgaatgccgagcgactagtagctctagcacttgagaaggtgacccaagaagggttggaatgttgagatgatcgagggatgtgtcgcag

SEQ ID NO: 32071 - DNA, 869 bp, Triticum aestivum
  Clone ID: PAT_TA_32071
gtccacttgtttttagtgtattacctaaaaaatatttaaataaaaaaaaataataaaaacgaaaaatttgactatacaaagaatcatgtgcgcacgatcaatcacgcttgagagaggagaaagtcatcacggaaaaaaaaggagaaagataatattattttttacagaaagttcctatggaggttgtcgttgatgactagtagagaagcatcaagccagccaagacggcggccagcccgagcgctagcacaggctcagcaccagcctgagccgccgagctcggctgtggcgttgtctgtgtgcaccgctgcctcgcccctctccctcggcatctcactaccttggactggacgttgacctgtaccttcatgccaccggcgcagtgcccgggcacgccgcagatgaagtaccgggtcccgacggcggcgagcgggatgacgccgttgccgctcgggaacgtggcgacgggactagagctgctgcagttgtagtaggccgtccttgtcacctccaccacgttgtgcgccgcagcggggtactggaaccggagctcgtcgccggtgtagaacctgatggtggaagtccattgggtgtagtttgtccggaggtcccacgacccggccggtgcgccgactgtgtaggtggcaccgagcgccgtgccgaacagcgccgccgcggtcactgcggcaacaaggagagctctggtagcagacgccatggatgaatgccaatcgagcgactagtagagctagcacttgagaagatgacccaagaagggttggaatgttgagatgatcgagggacgtatgatcgaggtcgcggctctggtctgttgtgttgttacccggccgcctcgagcgccgcacagg

SEQ ID NO: 32072 - DNA, 3300 bp, Triticum aestivum
  Clone ID: PAT_TA_32072
ctggagtcgttctccctccatccctccgctcgcctctgcccagccacagccagagccagggccgtcgccgcccgcgccacgccactcccaacatctcccgcgctgctcttcccaagaaaacaaacccaaaccagcaacgcaagtagggaaagaatccgagtccgacccagacttttttaacaactacgcgccgcgccgcaagattccgtggccctccgtccgttaaacccgcccggcccggcggcggggtccggtgagtgagcgagctaggcgccgcaatgtcgtcgaggtccggggccgccaggatgcgagcgtgcgggccgtggggcgagggcggcagcggcgtcgtcggggacgcgcacgcgctcgagagggagatgtcgcgggacggcagccactacagcctctccagcggcatcctgccgtccctcggcgcgcggagcaaccgccgcgtcaagcttcgccgcttcatcatctcgccctacgaccgccgatacagattgtgggagactttcctcatagttctcgtggtctactctgcgtgggtctccccattcgaatttggcttcattcggattcctacgggaggcctagctgcgacggataatgccgtgaatgcaatcttcgcagttgacatcatcctgaccttctttgtagcttacttggacagactgacctatttgctggaagatgatccaaagaggattgcttggcgttatgctaccagctggttggttcttgacgttgcctccaccatcccatcagaaattgctcgcaggatgctaccttcaaagctcagatcatatggattcttcaacatgcttcgtctatggcgtctccggagagtcagctctctctttgctagattggagaaggatagacacttcaattacttctgggttcgatgtgcaaagctcatttgtgtcacactttttgccgtgcactgtgcagcatgcttctactatctccttgctgataggtacccggacccaaaggaaacatggattggcaataccatgccagattttcattccaagggcttgtggattcgctacgtaacatcagtatattggtcaatcaccacacttaccactgtgggttatggggattatcatgcggagaatataagggagatgattttcaacattttctacatgttctttaaccttggactgactgcttatttgattggcaacatgaccaacttggttgtccatggcaccagccgtactcgaaaatatcgggatacaattcaagcagcaaccagctttgcacttaggaatcagctaccacctcggttgcaagatcagatgatatcacatcttagcttaaagttcaggacagattctgaaggtcttcaacaacaagagacacttgatgcgctgcctaaggctattagatctagcatttcacaatatctgtttctcaatctggttcaaaacatttacttgtttcaaggagtatctaatgatctgatttttcaactggtttcggagatgaaagccgaatattttccacctagggaggacgtcattttgcagaatgaagcacccactgacttctacattttagtttctggtagtgtggaattagtagaggttccaaatggtgcggagcatggtgcagaacaggtggttggagtggccaagtcaggagaggttattggagaaattggggttctttgctataggcctcaactattcacagtccggacaagatccttatgtcagcttctacggatgaatcgtacggcctttctcagcattgttcaatccaatgttggagatggaactatcataatgaacaaccttattcagttactaaaagagcagacagacggcgtaatggtgggtgttctgaaggagatcgagagcatgctagctcgaggccgtctggatttgccaattacactctgctttgcagtgactagaggagacgaccatttgttgcatcaactacttaagcgtaatttggatccaaatgagtcagatcaagatgggcgtacggcactgcacatagctgcttccaaaggaaatgagcaatgtgtcaagcttctattagaatatggagctgatccaaatgccagggattcggaaggaaaggttccgctatgggaggctgtgtatgcgaagcatgatacggttgtgcagctgttagtcaagggcggtgcagaactatcatctggggatacgagcttatatgcttgcaccgcagtcgagcaaaacaatatagaactgctcaagcagatactcaagcatgtcatcgatgtaaacaggccatccaaagacggaaacattccgctgcaccgtgctgtctgtgacgggaacgttgagatggttgagttgttactgagacacggagcggacatcgacaagcaggacagcaacggctggaccccaagggctctagctgagcaacaaggccatgaagaaatacaaaacctgtttagatcagtgatagcaccaaggaagtacacatcaaatggtagggtgacacctatgttgctaggcaggttcagcagtgatccctcgatgcaaaaagtgatccatgaagatgttgagcagcaacccagcaaagttcttccgcaaagaaggaaagtcagcttccacaactctctttttggtgtcatctcttcggctcatccgcgccgggagactgaccatctgctctcaagaggtcttgcggcaacaggcggtccgacttatcctcaggcccatcacaacccactcatcagggtgacaatcagctgccccgagatggggaacactgctgggaagcttgtgatcttgccggggtcgataaaggagcttcttcaactaggtgcgaagaagtttgacatgatgcccactaaggtcctgacaattgagggcgcagaagttgacgaggttgagctcatcagagatggtgatcaccttgttctcgccagtgatgactgggtaccagatgatacgcaaataagaggtaaaaattaggcagagaattacgttttccggtttactgtaatttgggtaaaacggggaatgttgaaccacgcttgtaacaaaaaagccaatggtgaaaaaataactggaaatcaccaatggctactccacgactcatctccaccacgtctccaccgtgataaagatggtgaaatagggttatgcccagcaggtgaaattaataatctttttgaagtggtatagggtataccttgtatagaaattcttgtctgctgggcatgcagaattttcattgtatagaaattcttgtctgctaggcatgcagaattttcaaaaaaaaaaaaaaaaaaaaaaaaaa

SEQ ID NO: 32073 - DNA, 2613 bp, Triticum aestivum
  Clone ID: PAT_TA_32073
tctggctatttacggttcttttaacagataacaatgacatggtcacattttattgtgtcaaataagcaagtatgattcaaattacattgccaccccagagctcatgaaaacaaaaaacaaagctctaattgtcccactttaatgggattctgttcccatttctcaatcggcatcaaatgaacagaggaaatctgctcaactgaaaatctggtagccggacttgaaattgtacaacatggcttcatgggctgatcttccattttaagtggaaggaaattctaaaacgactggatgctaggtacaggccgaggcatgggcttatcttgcaagaaatgctcaaaaagcttcaaggcttgccgtggacgatggaggggaacctcatgtcctgcgcctcggattgtcaccaacgtcaagcctttgtacacttggcaccaaccagcaacctcttcctcatcataccacggataccaattagtgacggtcggaagatatagtgcatcaatggagtatcttgtaccagtgagaggtactacggaatcggcatcaccactgaagacccatattcttatgccagctgcaatcagctcatggtaaataggaagcatggaccttggtgaatctttccaatattcaaacaagacatcactgcagctagtccaggccttccggtttcctgtggcatgcgcacgaaaagcttcccgcacttctggctgattactggtcgccgcggaggactgctcagtgcaggcaccatgccctcttggcaccccgcgcctgcggcccctcatttcccgccgcccacgttccgtgacatgtttgttgatcggatcatgtcagtaactgggtctgggtgttttcttgcctgctccctgttcgggcgtgttgtccttgcttaacagataacagtagcatggtcacattttattgtgtcaaataagcaagtatgattcaaattacattgtgacctcagagctcatgaaactgaaaacaaagctctaattgtcccaatttaatgggattctgttccgatttctcaaccaatatcaaatgaacagagaaaatctgttcaactgaaaatgtgggaaccgaacttgaaattgtacaacatggcttcatgcactgatcttccattttaagtggaagaaaactctaaaatgactgaatgctaggtacaggccgaggcatgggcttatcttgcaagaaatgctcaaaaagcttcaaggcttgccgtggacgatggaggggaacctcatgtcctgcacctcggattgtcaccaacgtcaaacctttgtacacttggcaccaaccagcaacctcttcctcatcataccacggataccaattagtgacagtcggaagatatagtgcatcaatggagtatcttgtaccagtgagcggtactacggaatcggcatcaccactgaagacccatattcttataccagctgcaatcagttcacggtaaataggaagcatggacctcggcgaatctttccaatattcaaacaagacatcactgcagccggtccaggcatacggtattccagtgacattggcacgaaaagctttctgcacttctggtagattatagtacttcgtggagtactgttcagtgcagggatcatatcctcttggcaaccagggcctgcggcccttgatttgccttcgcctatgaagcgaggtcttcttacaggtaggtgtgtagatgctgtatgcgtcgatcgggccttcctcagcttcagcaacatcataaattttgttgcatgcatcggaagcgtgctcagatgaatcgaattcacaagccaactgcagcttctgataggtgtcatcagagatcagcccgtgcgtccaccaatactcgaatgttccaacgaaatcatggtaatcgtcaataaccgcatttccgaccatgaagcctttgaagttcaggatgggcttcctcactcccttgttgttcctgtacactagctgagacaactgagggacatagtgccctccatagctctctccagcgatgtagaaatcacggtacttgtactgcggaaacctctccagccaattcaccaggaaagtgtacgaatcatgagctgtcttgttgtcgccgggggcgagcagatcggagctggtgttggagtaggagtacccgacgccggcgggggcgtccaggaacagcacgttcgccattttgttccaggagtagggggttgacggagagcgtcctgccgtcggcgttgatccggaaggcgcccgagctcctcggaggcgcgcgtagccgacggaggagcacccgggcccgccgttgagccagagcacgagcggggcggactcgggcttcgcgacggcggcctcgatgagccagtagaagagggcgcggcccgcggcggcgtcgacggtgacgtagcccgagtacatggagaagttgaccggcggctggcccggcaggcgcgtgatgcggtcggccgccgccgccgcagagggggacgcgagggagagggggagcggggacagcgccaggatggcggccagcagcacggccgccgccattggcgctcgcggtggctcaacggggaccaggactgtgtgctgcgaggagtgagccaatggccctcgtgc

SEQ ID NO: 32074 - DNA, 603 bp, Triticum aestivum
  unsure (1)..(603): unsure at all n locations
  Clone ID: PAT_TA_32074
ccnnnnnnnnnnnnnnnnnnnnnnnnnnnnnnnnnnnnnnnnnnnncacgcgtccgatcctcatggcgctgctcatcggcaacatgcagacgtacctccagtccatgactctgcgtatggaggagatgcggctcaagcggcgggactcggaggagtggatgcgccaccgccacctccccgatgacctccgggagcgtgtgtggcgacacaaccagtacaagtggctggagacgcggggcgtggacgaggacggcctcgtgagctgcctccccaaggacatccggcgggacgtcaagcgccacctctgcctccgcctcgtccgccgcgtgccgctcttcgccaacatggacgagcgcctcctcgacgccatctgcgagaggctcaagcccagcctgtgcacggagaccacctacgtggtgcgggaaggggagcccgtcgacgagatgttcttcatcatcagaggccgcctcgagagctccaccaccgacgggggccgcgtggagttcttcaacaaggggctcctcaaggaagggagacttctgcggcgaggagctcctcacatgggcgctggaccccaaagctgcggcgaacctgccgctgtcc

SEQ ID NO: 32075 - DNA, 824 bp, Triticum aestivum
  Clone ID: PAT_TA_32075
atcaaataggcaatctatgtaacaggtggtgaagtatgcgtggctataactgaaacataacaagtgtgtccagagcacatcgcaactgatttaccctcctgagtgacaattgggacgacgtgacggtgattctagaagaaggagaccacaagccagaacccggagaaagaagacgcggcttgcaatgaccacgtgatgaacgcgagggcgaccgagagctcgaactggccgcagggcagccgccggtactcggcgcagaacttcacgtccttcatgaagaagatggtcacgctagccgcggcgcaggatcccgagaacatgagaatcgcgaggacctgcaacgcattcgcaatcgacgtgatcactcgggtggatctttcctagcccaagattccttccaagaacggctcgagtcaaggaaacgatttcacccgaagtgaaacagacttacccagtcgccgatggcacggagcagtacaagttccggctcagcgtgaagatcctttttgttcctcaaagcaaagatgtcctggcaagcaaagcccatgctccacagaaactgcaggaccaacgctgtattcaggtagaagtaggcgctgtagttgagggagccgaaggcggaggacatggcggcggaggacgcggcggcgaaaacgcactgcgacacacgcagcgccatggggctccccacgactgggctccccacgacgcgccggacgcgtgggcggacgcgtgggccgtgtgggggctcgcccggctgggtctgggcctcgcggggtgtgcgcctggcgcgggccgggtggagctggaagcctgaaactgaa

SEQ ID NO: 32076 - DNA, 1343 bp, Triticum aestivum
  Clone ID: PAT_TA_32076
aaaaaataacgtagggttcctccgccccaatttatatccaccgcgcccgtgcccgtcgcggggtcgtgggtgtcgcccgtgcccgcctgcgtcgcctgccgctgctgaagtcaccatccatctggcatgaggtgatcaatatagagagaatggagacaagatttatgtccatttttttctataatggaatttgtacatacatgtcgcaaaactttattcgggccatatttttctaggacattgccatatgccttgatgtatgtatgtatggggctcaggactcatcagttcgtagcagacttgagcacgtcgtacaccggcgcccagcccgagcgccactcgtagatccggaggtggccgtcgtgctccagccgcatgtactgcaccgtgcctgccccgacggtgggcagctggatggctgccagcggcggggctccgggacgagcggaaaccgtgaggctgccgttggtgtacgtcgcgtaggcgccgggtgcggtctcgctgaggccgaggtggtagtagcgctgcggcggcgtggcgttgacgtaggcattcagtccatcgtcgtcgacggcgaggtagagcctcccatcgcgccagtccgtggtcgacgcgttggcggtgagccgcgccccgtgcttcagcgactgcccgacgaggagcgcgttcgtggggtggtcgaacgactgccacaccgtggcgttgcgcccgtcgaacagcaccaggttgccgtcgctgccgatgcgcgccccggcgacggaccggcccttggtgccggccgaccacacgaccgcgccgttactggacctgagcacgaggtcgccctccggcgtgagctcggccgcggcgccctcccggacggggctgccgcggttggccgaccagacgacctgcgggacgccggccgtgacgaacgtcatgcccgcgccgctgttgcagtacacgacggcgacgccgagaaggaactccgtgcacggggccgcggggccgttgccgcgtggttgactggcggtgcagaagaagccgaaggcgtaggaggggccgaggccggccgggttgagacgcagcagggcggcgcgcgccacggagccgtcggtgtagacgacgtggtgcggcagggcggcgtccgtgttggcccaggtcgtggccagcctcgccgccgggtagtcgaacggctgcgcgcgcgctccgccggctgccacgaggcagcagatcagcgcaacgagcgcgatgatcgtagcacggtgcatcatgatcatgggctgtgacttggtggattgtgaatatcgtgatgtggtatgggactggatcgacggagcgtgcttttatgcaagcgattggtg

SEQ ID NO: 32077 - DNA, 750 bp, Triticum aestivum
  Clone ID: PAT_TA_32077
gaagcatatcaaatagtttatcctagattattctggaaatctcagttacataataaatgtgcaacgttcttgtctagagcacaacaaacacaaagcgttagagatactttttcttttacaagattgtcacgtttttttaaaaaaaaaattatgagctactaccagctacagcaagaggaacacatgcaacctagggggatcatgaagctgccatagagccgggctaaagacaagcataacagcacacacgcaagttaagagcagcatataacgattgtgaggagtagattcgagagctatccattttccaaaccggggaatcctctttttctgaatgttgtggtagagcgctgctgtgcacggacgctagctgcacttgacgtgcacggacgcttgtcggattgcacgcgaacgagccctgaaccgcacgcgagagtcgccaaaactgcatgtcatggtcggcagattgcaggggaagagatggcccttgccggactccacacgcatgagccctgaaccgcatggcgaccgtctccgagctgcagaaccatggtcgacggaccacaggggaagagatggagatggcgctctctcgactgcacgcacacaagcccctaaccgcatggcgagcatctccgagcggcacggccatggtccagctaccaatgggaagagatggcgctcgctgtattgcacgcacacaagctccgaacggcatcgcgagcatctctgagctgccctcgtgccgaa

SEQ ID NO: 32078 - DNA, 797 bp, Triticum aestivum
  unsure (1)..(797): unsure at all n locations
  Clone ID: PAT_TA_32078
ttctccttcccgccccgccnnnccgncgccncttnnngcttgaaaactcgagttctttattggagaacaaaaggatgaatcccggtaatttcaggggctgcctataaccagcaaatgcgttatgccctcgtcagatttgtagtcgccccccttcctttgcatcaataaagaccaaacgaggaagccaaccaattgacgccccaccaatgatctaccttcttccgctcgccttcgtcaccacgcctcttttttagggtagagcaatttatgccctcgacatgacaccccaggcacggatgatgttgtcagtgtaaccagcgaacagagtctggccatcagcagaccaagccaagctgacacactcaggctctcggctcttcttgccggcagcggggaaccggacccgtgggcggacacgcgggcggatcttctcgagatcgaagatgatgatgctgctagcggtggcagcgcacagccagtatcggttgggggagaagacaagagcgtggatctcgtcgttggcgttgagggagtagaggtgcttggactcgttaagatcccagagcatggtagtaccgtccttgccaccggaggcgcacagggaaccgtcgggggagatggtgacggtgttgatgtagccggtgtggccgatgtggtcagtctggagcttgcaggtggagagctcccaaaccttgacaagcttgtcccaaccagcggaaacgatgacagggttctgggggttggggctgaagcgaacgcaagaagcacactcggtgtggcccttatcagagatgaat

SEQ ID NO: 32079 - DNA, 1289 bp, Triticum aestivum
  unsure (1)..(1289): unsure at all n locations
  Clone ID: PAT_TA_32079
agntctttcctaccggtgcgggttgcgtttgcagcctgcggccagcaacgatagcgttagtcgccgacgacgtggatggatttacggtcgctcagcgagcagaggagatcctgttcattcgcgtgcccggggacagttttgcagtgcgtcccaaactgttcgcatcacgagtgaccggatgcggtagggactgaatggatggaactggagtgagctaagtcctagcgttcgcatgggttagtacgcgtgttagtaagggtagagcagtttatgccctcgagatgacaccccaagcacggatgatgttgtcagtgtaccccgcgaacagagtctggacgtcagcagaccagggcaagctgacgagactcaggctctcggctcttcttgccggcagcggggaactcgggcttgagctcatcaaccttgctcttcttctcgagatcgaagatgatgatgctgctagcggtggcagcgcacagccagtatcggttgggggagaagacaagagcgtggatctcgtcgttggcgttgagggagtagaggtgcttggactcgttaagatcccagagcatggtagtaccgtccttgccaccggaggcgcacagggaaccgtcgggggagatggtgacggtgttgatgtagccggtgtggccgatgtggtcagtctggagcttgcaggtggagagctcccaaaccttgacaagcttgtcccaaccagcggaaacgatgacagggttctgggggttggggctgaagcgaacgcaagaagcccactcggtgtggcccttatcagtgatggtgtacttgcagtcaccgagggtgttccagagcttgatggttcggtcgcgagaaccggaaacgatctgtcggttgtcggcagagaagctgacggagaggacgtcgttagtgtggccgacgaatcgtcgagtggtggttccggtagcaagctcccagagacgcagagtcttgtcccaagaggcagacagagcgtaggcaccgtcagaagagataacacagtcggagacgatgtgagagtggccgtggagagatcgcttggggtagccgtattgggtctcatcgcgggtgaggttccagatgatcagggtcttgtctcgggaagcagacaggagcatgttggggttctccatggaggtagccaggctagtgacccagccattgtggccctcgagggttcccttcaagatcaattgttcggccatttttgcggtgacgaggcgatgcagaggatcaaggtgcgtgaaggggagccgggagagaaatcaaaggct

SEQ ID NO: 32080 - DNA, 1077 bp, Triticum aestivum
  Clone ID: PAT_TA_32080
gttttttttttttttttttttttttttttttttttttttcacaagaaaaggcctctgtattgattcaatgggctacagcacagaagatgcatatattgttatgctgcaacgggccatcacgctgaaatacatatgaataatcgactcgatatctgtaatgtacacagcatgctcgcagttgagccaaacttgattgcaaatttacacacctgcagctcctcattgttagcccgaactacgtacagagtagctggctacttaggatcggacgaagtcgaggatgagatgaactacacagggcagcggctgtgtggtactagcctactactacttgcactcaagtatactaccgaagcaacaagcagaatggcaaagcacacttgcaagtgctgcttacacacacgcacacatatgtagtagtactacacttgagacttggctggatagaaatgaaatggcctttttggtttttttttttttttttttttttggatccgaaaccatgcaattcttttttgtttattgctattcgatcggcttctatgtgaccgaagttcgggtgtcgacgtccagatcgtcacctcgtaatgtaggcacgaaatcatatccccccgtacaccataccgaaaagcaaagccattttcccgtttcgctaaagtccacccttaaacctcagcaatctctcggagtcgtcgcagagttgatcgcatagcggcggcagcgggggtggcaacggtgtaagcaccaccggcgacggtgcgcttgcaagacttgcagtcccagataccggtagcctggcgcttgacggtgacctttccgcagaaggtgcaagtgtacttggcgtgctgggtgatttccatcttcttaacctgctttcgcagggaagcaccgtaacgggtaccgtatttaccggtaacaccgaccttctttgttcgcttggtcatcttgaaggtaatgtgtgggacgtcttgggagggatgaagacgagaagatggtcgggcggaggtgaatgttgctcgactgcggtcgggagctgaccccgaaaaggccggctgaaagagccccggaccggccggc

SEQ ID NO: 32081 - DNA, 676 bp, Triticum aestivum
  Clone ID: PAT_TA_32081
tttttttttctcaatctcccagcctctgttctcaaccagagcacccacttctgcatttctcccaaatcgtatctcaatgtttagctactatgaacaggtttcgaattcaacaaaaaaggaaaccagcgatggctacatccatccatggcggaacacactatagcagtatcaaatcttaaaaactttgacgaaactaaggaaagagcaggtcagttcggatactccaacagctcgatcttgccattctcttcttcttctgaatccttccggttgtcgaagaacttcgcgacgaaggaacgaacgaacgagatgtgcagttgcagtatcaaattggaacaaattctaagcaactaagggaaaggggagcgggttggttactccagggacttgatcttgccatcgtcttcttcctggcggtcggcgtccccctccccctcccccagcggatccatccagttgtcgaagaaggtggcgatgaaggaggagcactcctcggaccagctgcggcggttggcggaggcgcgccactgctggtcggtgatcatctccggcgagaggccccactcctcgagctcctccttggtgtggtgcatgaggaggctgtactcgccgccgggcccgagctgcatcaccctgaactcgcaggtctcggagttgttgaggcgctcgaactgct

SEQ ID NO: 32082 - DNA, 529 bp, Triticum aestivum
  Clone ID: PAT_TA_32082
ttttttttttgtgtccatgatgataaattggcatatgcctgcattattgctcgaatacaaacattttcaggtatcctttacattattgcgcagaaagccagtgcagcaatttcctcttttcttgtctctgaacaggcggtgttgcaatttctgaaccgataggcctgtacgcggtgcggcaaaagttgcagcaacgcctctgcgaagatcacacgcaagaagcagagcatttcaaaacaaaacagagcatcatatctcatcgatcatcctatacacagtactgctacaacgtatccttacaaattgcaccatagtaaattacaccaaggtcgaacaggtggacgtgtcagggtcgaagagcgcgggaaggaggtacttcctcccgttggccccgttggcattgtagctcgccccggtggtggcgtccaccgccaggttcccggcgtagccgggggacgcgccgctgccgtagacccccgggcacgccgtggcggcctccagcggcgcctccctggggccctggtagaac

SEQ ID NO: 32083 - DNA, 1467 bp, Triticum aestivum
  Clone ID: PAT_TA_32083
tctcgtgccgttttcggctcgagaagagatgcttttattaactcaaatatagtatctaacagatgtacaacataataagtaacatcatgcctgtgtatcgttaagatgcacacagccaaacacagacagagtgacaagagaaaataaaagccgtcatattattgggcaccagtaaagtcggaaaggaccgacactatgcctatgtctaaggaggtggttgaccgatccggagattatgttgccatccgtgttggagaaaaacctcccttactacccagtcaaccgcgtgcaccccattttgaacaaccgttgtgactctgttcggtgtagtatggaccacatacgaagcccgtgtataccacaaaaaatcacctttattagcaaatcaattgtaccttggagacaatctaaatgacatcttcgaataagaccttggagatatggcaatcaattgtgtcatgtgggcaaagggtgacgtagttgaagctcttcaccacgtgcataaaagtctgcctggtcagtccgctgacaccgttgcagctctgaagaacatgttgagtgagttctcgcatatccaaatccacttgtcggtctatatcctctatgttttccattttttgtccaccctgtgaaagaaccctagatgaaagtttgcggcatatggaagaggtgagcccctcgagctgggtatactccgaaatgttcagttgctgttgggtcgagccatgccttcctgagcagacctcgactgtgcgaactaacagcaacgctgtactccattcacatggtccactgctctcctttgcagtccatgtcgtgaaccagtccttccaagcttcgcgaagagtgtcggcggcattgtcaaatttgctgaggtccatgatcagctcattaacaacatgtggtatgctattttctactgaatccattgccccccttgctagattgtggctgtggccgggagtgaggatagcactgagccgttccctcaactcgggagcgcaaccgttgcgttggaagtaggaggagacagcctcagcgagcatcgccgtgcgagcccatgccaggcgctctgctgctcgggtcggctcaaagatgtttgctgccgctaagaagtaagctctgagtgcgctatttgcggacacaccatacatttccagattattcctctcataccaccttttcaggccatgccactcaagtcggcacattctctggaagttggtgaaatcagctttcgccgtccttttcaaatttcttcagtgcgcatggattgacgtggtagccgtttaaacggaggagacggaaacccatcgcggtatcatcgatatccgctgctgagcacgaccctgcgtggctcagtccatcgtcttcaacctgagtccaatgcctgtaagtaaaatctaagcactccttgatttcacttgtgaagtgcctcgatatgcccagacgcgtcggacgcgtggg

SEQ ID NO: 32084 - DNA, 798 bp, Triticum aestivum
  Clone ID: PAT_TA_32084
tgtttctgcacatactactgcagaagataactatacattgcaggcaccttgggtggttttgcgcccagcaggcatcagaattcacagcagaaaccagcacttggacaccgttgatgcagagacatttcaccttcttcttttttgtttgcctccccatcttcaatgggttcacagtaaccccttccaccggcttccgtttggcagctgtgagccatgtaaacctaacctacaattttttttttgaaacaataacctacattttacattctactgctataagccactatgccgacaataccaattttttttctttttttgtcagaggctatgccgatatactgaccagtactacacatgcgcttgaataaccatcagagcagaaccaggtcagtttcatgatcttagtgcacctgggagctaataaaagaataccctggtcttcaggttccctttgctaggggcaataaggagatgacaagaaacccacagacatgattgagtatcggcccgatgatcatcatataagatgcttgcaaaagagtaagtgccagatgatccaccaatatcctagccaattgtactccaacagtcagctgctgcctggtaggccaccccatactggtgcaggtgccgagagtaaaatgagtcattgtacatgctttttggcagctctgatgcgccaacgagggacaacgtcagctccgagtctgtacatttcacctttccatagacatcattgatgacatatttcatgaaatcttccttcagagagataggatcaagaagagtatctgattg

SEQ ID NO: 32085 - DNA, 688 bp, Triticum aestivum
  Clone ID: PAT_TA_32085
tcgtttttttttttaacaacaactgcatgattcgttgatttagcaaatctgactaattctgactcatttttacactgtctgtaaaggcgcatctaacccactatgattgacgacatgcgaacattcggaacaaagcgaataagagattcaggcgacggcaatctaaaaggaggtgaacttggtgacggccttggtgccctcggcatacggcgtgcttgggcgagctcgccgggggaggacgaggcgcacggcgggctggttctcccgggaggtgatggtgggcttgctgttgtagccgggcgaccttggccgactcgccggacgaccttgtcgaagatgtcgttgatgaaggagttcattgatggacatggccttggaggatatgccgatgtcggggtgtacctgcttgagcaccttgaagatttaaatcttgtacgtctcgactctctctttggccttcttctgcctcttgtcggcgccgccgtctttgccgtggactcgctcctcggccttgggcttctcctccgtgtccccggctttctcctccgcggcgggcttcttggcggccttgggcgccatgacaagttcgagcggggaggaggagacgagagatcggatttgggggcgcgtaggtgggaggactggaggatttgcgttgggcttcggaaagttcccggcccggccggcc

SEQ ID NO: 32086 - DNA, 543 bp, Triticum aestivum
  Clone ID: PAT_TA_32086
cgggcacgcttcacactccgggtactctatcgcaatcatacaagcatacaataagcaatcaagcaaaatcacgagtaaaactcaaataagagatctaaccagaaagttcaacttaagaactctggttcgcaaaaagaatcaaatcaaacgaagcaagaatactcaagcggtgagagaaacaagcttcgtttattaatctggactaaggtcaaattttacagtagcaaaaacttgtttaagttggataaacggaaagagggtttcgagacgaaactctaggcgcttgaatcgcctgattccgataaatgagcgaaaagttatactagaacgaaaatcggatcagaaatcacgatcaaaaaataaccgcggaaaatccgaaaaaaaaaaaaaaagcggcggctggcggcggggcgcgctagggttagggcggcggtcgtgggctagctcggctcgggcctcgggcgcgccttataaaggcctcggccagcggtgtcctggccgagtacggcccatagtcagttccgcgtttttttaataattcct

SEQ ID NO: 32087 - DNA, 1048 bp, Triticum aestivum
  unsure (1)..(1048): unsure at all n locations
  Clone ID: PAT_TA_32087
gnttttttttatcgcactgtaaacctgcacctgctatcccagaagcatttatcgcggtgcccaccctttgaggccagatgttgttttattattattctcaaaattaaaccacaatcaacataccacggtgacacatgtggtaagcaatccaaacaataatgataataataataataattaaaacaatctacctaaggttctcctctcaccaacaagaagcagcagagtgcaaaggagaacagaacacatgacaaatgactcttgctcaaaacacgagcccggaaccatggagcttctgctggacgatgcggtcgagcttctcccccatctcgcggctcatgtggttcgcccagtcccctacctcgcctttcctgtagaacacggagttatcaacgtgaactctattcccgtggctgacgccgccgacctgtttcacctccagcccggtgagcgactcgaagctacacatcctcgccaccttgtccgcgacgccggagctctcctcctgctcggtcagcgggacgccgaggaagctcgcgagcctcctcacgacccgcgccgggtccagcttgatctcctcatacttgaggaagaggatggtgtctggcctcgccacgctctcctcccagtactcgaggcagtggtcccagaaggggccgtagggcgagaacccctcgcagaacatgccgaaggcgtcgtccatcgacgggccgacgccgccgcaccgcgccgccagcttgttctcgaagtgcagcctggagacgagcgtgtccttggggtcccggcacaggtacaccacccggcagccgagcgaccgcgtctccggcgggagcagcgacatgggcatgtgcgtggcgaggagcctcggggacgggagcgcgccgaggttgactacacggccgccggcagcaccagggatctcgatgtacggcacgaggtgatgcgggtagcaagtgaggagcgggtggtcggcaacgaggccgtggcgggaccgcgtggcgacggtgaaggcgagggccttgagccaggtggtgccgcaccctcgtgc

SEQ ID NO: 32088 - DNA, 952 bp, Triticum aestivum
  Clone ID: PAT_TA_32088
ctccttttttttttttttttctttttcactcatctaggcctacttttttttttttttatctaggcgatgcatgatgccatgttcaacagaccaaaaaatcttgagtaaataacagcttaattagcgccacaatattactagtaacacgcgctctaatcacaggcaggaaaatggagtatgtagttaatagtctgctagtcaatcgtcggcggcacagtggtactgcacctcgggacgatcttcttctccggcggcctgctacttggcgccgcggttgagcacctccttgtagttgagcagcgagttgagccgctgcagccgcagctgcttccggaagctgttgatgaagtcgtccgcccgcgcgtccacgccgccctccacggcctcctccatcggcggcggcggcggaggcggcggcagcatcctcgcctccgagctcgacttgctcatcttcgcctccgccccctgcttctccccctgctgcttcttgctcttcttgccctgctcccgcgccggctccgaccggctcctgctgtactgcgtcgacgtcttcttctcgtctgccgccgcgacggcggccacggcgtggtccggcgaggcggagagttcgggcgcaaggttgccggagttgaagcggtagaggctgaaggagcgcaggcgctccaggacggacggcgcgcgcgccagcggcgccggcctgtatggagggacgtactcctcgcagtagtactgctccccctccggctcctgctccggcggcggtgtcgtgaagctgttgtaattgtcggtgccctcggtggccggcctcgcggcgtgctctacgaggtcgtcgtcgtgctcctcctcctccagcacggccggctggaccacccgagccgccggcgtgaagaagccctgcacagcctcccacgcgccgagcgccgcggccgtcgcgccgccgtccatctgagaa

SEQ ID NO: 32089 - DNA, 975 bp, Triticum aestivum
  unsure (1)..(975): unsure at all n locations
  Clone ID: PAT_TA_32089
gggagagctgatcgatgctgaaagggcaataggtcatatacagggacacgcaccaacccaacagtgaaagatttgggagttagctggaaaaatacactccgtagctttctagctgaactttcgggtattttccagacagatggatcaaactcgtgcggacaagtaatctccagtagtttacatggacatgaatggatcaaactcgtgcggacctatttctgtctggccatcctcaagcaagttgtacttccagctatcgtacccgtcgacgctgtcccggcactcccggccctcggccgcggcgcggcggcgcttggccacccggtcgacgacccgttccacggcgacgtcgaacgcgtccttgaactggacgccctttgccgccggctccctgtacatcacggccggtatgagccggatgacctcctcccgcatccgcgccaccttcgccggcggtatcttcctcagcacctcctcgatgctcgcgttccggccgatcacgtcgcgctgggggatgaacaccgagtaggccctgtagtccctgggcaggtaccacgtgtactggacgtacgcccggacgcgggggaggaagaccgggatgcagccggcgaggatgggtgtcgaagatggacttgcgcgtgtacgagtctccgcgcggctgtatgcagaactcggcgctctccagcagccgcatggcatggctcggcgagtactccccctgggtgtactcccccgggctcttggtcaccgctgctttgccgagcaaggcgcagcggctcgacctgccgcactgctcgatgatctggttgcgcccggtcttcctgctctcatggcgggacccgccggcgaagcaccatagccgccggcgctccagcccgcgcatgcggctctgccaggccacgacctgggcgtcggaggaagggtggaagtgcgacgggtacggcacggcgaagtcgttgcctcgtgccgaattnc

SEQ ID NO: 32090 - DNA, 760 bp, Triticum aestivum
  Clone ID: PAT_TA_32090
agggggccaagtatcaccaagggatgcggctacatcggcttgtctagatgggatggatcaaaattcaacttatgtgctgaaaatcaattttcttgccaacccaaaaaaggctagaaaggatatcaaatgcttttgttttgataaggttatttattccgacttaacaaattataaggacttggttgattcaatcgtagtgcactactcggctcgttatttggaagttgcacatgtttagtactatgatgatgttcttaaaatctaccctgaagtaacatctgaccaagaattggtgtcgatgtttgagaaaaactctaagacaaaggttgtgcacatgtttgttgcatattgtgatccattggaaccatatgagcttataacggagtggcatagtgatgccatagccaacctaacaacatagaacaagatgatgatgattatcttcacaacccaatacctgagagtgagcatgttggtgttgatgaggaaaatatttatttagaggatgaacctatacctcttatcatggttccttgttccaacaaagaaaaggacaaagactatgttcctgatcatgagatcgtggctgagagcgaggttgaaagcgaggatgagaatgaggatgagagcatgttagaggttgaagtagaggaagatgaggaatatcacgaggcagatccttcaatgaatataataaattagatccttcaatgagcgaaggagaaaatatcccaatatggcagagtttaaattggcgctt

SEQ ID NO: 32091 - DNA, 549 bp, Triticum aestivum
  Clone ID: PAT_TA_32091
gattcggccgagggccttaaccaaacaccacctggctaaacacgcgggcagcagttttgacctctgaccgtgtcacggcgcccgcggaatatctacaccgtggagatgcaggcctcgccgccgccgccgagctcgctgcggcgcagactgcgggccacggtgtgctgctgcttcggctacggcggccgggcgcggtggggcgggcgggacagccgcggcgtcggcaggtacgacccgctcagctacgcgctcaacttcgacgagggccccgacgacagcgacgacgacgtcgactacgacgacttcagcgacggcggcctcctctaccgtagcttcccctcgccgccgccgccgctgcctcagccgacccgggcgcggacgtcgtcgataccgccgccgcggccggccgtcgcggccgcgtagatcttttgctagctcggtcatatgatgtattcgctgtgtctccgtttcatttccatgtttgctgcgtgtatataactagctaaaagatgttgatcacgtttcacgtgtgctaaaaaaaaaaaaaaa

SEQ ID NO: 32092 - DNA, 579 bp, Triticum aestivum
  Clone ID: PAT_TA_32092
gttccccccactccctccccccttcgcgcgcggcctgtgcgtgcgttcgtgttgggcgggcgggccggctagttaaatgggcgacctggcaggcagagactgccgggaggaggcggcagcgccggcgccggcgccggccgtaggcgggcccgaccacctggtgatcatggtccacgggatcgtcgggagcacagccgattggaaatatggagctgagcaattccataagttgctagaagacagagtcatagttcattgtagtaacagcaacatgcacaagctaactttagatggcattgatgtgatgggtgaacggttggcacaagaggttatcgaagaaatcaacaaaagaccacagataacaaagatatcttttgttgcgcattccgttggaggattggttgcaagatatgctatcggaagactttataggcctcctggacaatcacttgaaaattctcctcaaagtttgacagacagcaacagaggcaatatacatgggcttgatgcagtcaacttcataactgttgcatcaccacatcttggttctagaggaaacaagcaggttcctttcctttt

SEQ ID NO: 32093 - DNA, 1965 bp, Triticum aestivum
  Clone ID: PAT_TA_32093
cttccacccacctccggccccctttgcgcgcggcgtgtgcgtgcgttcgtgttgcgcgggcgggcgggcggctagttaaatgggcgacctggcaggcggagactgccgggaggcggcggcgcccgaggaggaggcggcagcgccggcgccggcggtaggcggggccgaccacctggtgatcatggtccacgggatcatcgggagcacagccgattggaaatatggagccgagcaattccataagttgctagaaggcagagtcatagttcattgtagtaacagcaacatgcacaagctaactttagatggcattgatgtgatgggtgaacggttggcacaagagcaagccaggttatcgaagaaatcaacaaaagaccacagataacaaagatatcttttgttgcgcattccgttggaggattggttgcaagatatgccatcggaagactttataggcctcctggacaatcacttgaaaattctcctcaaagtttgagagacagcaacagaggcaatatacatgggcttgatgcagtcaacttcataactgttgcatcaccacatcttggttctagaggaaacaaacaggttcctttcctttttggagttactgcgatagaaaagtttgcgtgctgcatccttcggacatcatcaatcaggggggcctccgaactacccaagtgggttgattcgacaagcaaggtttatccacatattgtatacgaggaactatccaaagcagaaactcttgatcaatgtgctgatgttgctgatatggacaaggataactgcactctcgaagaaaggcttttgagaggacttaagcgtgtgtcatgggaaaaggtggacgtcagcttccataatagcaaagcaagatctgctgcacacagcgtaattcaggtgaaagatcccgtcatgcatagcgaaggggccgatgtaataaagcatatgatcgaccatttcgttacctagtggacagccccccatctctggaaacaaagattgtgttgtgatcgtacacgagttgctaactgcggagtcgccgagcctggtgagcacgtttatggcaatcccaggaatcaagttcagatagacggcgttcagaaagttgaaagtggtttgcatataagtaaatatatgtaaagggtctgtgccatgtcgttcactaatctttcgcaattattatgcaatatgtatgttgtgcggtgtgagcgtagtatcggctttttatacttgtaaatgtccaccactgttttatcaatgtcgacatgctccccatcatcttgacgaaccggcaagtacctatttcttactgcattatgatgatggaaagcctccgttgttgcaacttatggtggatgattgtgaggacctacggttcatatctgctttgcaagcatttcagcgaagagttgcatactccaatgttggttacgaccacattgttggatggaggacatcatcaatcaggggggcctccgaactacccaagtgggttgattcgacaagcaagatttacccacatattgtatacgaggaactatccaaagcagaaactcttgatcaatgtgctgatgttgctgatattgacaaggataactgcactctagaagaacggcttttgagaggacttaagcgtgtgtcatgggaaaaggtggatgtcagcttccataatagcaaagcaagatctgctgcacacagtgtaattcaggtaaaagatcccgtcatgcatagcgaaggggccgatgtgataaagcatatgatcgaccatttcgttacctagtggacagccccccatctctgaaaacaaagattgtgttgtgatcatacacgagttgctaactgcggagtcgcgagcctggtgagcacatttatggtaatcccaggaatcaagtgtcagatagacgcgttcaaaacgtccggaatgtttgatagataagtatatatatatataatatatatata

SEQ ID NO: 32094 - DNA, 691 bp, Triticum aestivum
  Clone ID: PAT_TA_32094
gccgaaaacagggacaaggggctgcatagcgacgacgaggaagagcctcagccgccgaacacaggaggacagaagagattccctccacaagtgaaaacggtgaacatgatatacgcaacccacattccaagagggaacggaagcgcgcactaaggggacgtctatgcgatggagccagtcgcccccaagttcaacccatggtcctcttgtccgatcaccttcgatcgcagggaccaccccactagtatctgtcatggcggatctgccgcattggccctagaccccatcattgacggatttcacctcactcgagtccttatggacggcggcagcagcctgaacctgctctatcaggatacagtgcgaaaaatgggtatcgatccctcgaggatcaaacccagcaaaaccacctttaaaagcgtcatcccaggtgtagaggcccattgcacaggctcaatcacactggaagtggtctttggatcaccgaacaacttctgaagcgaagagttaatcttcgacatcgtcccgtttcgtagtggctatcatgcactgctcggacggacaatatttgcaaaattcaatacagtgccgcattacgcatacctcaagctcaagatgccatgacctcatggggtcataacagtaaatggaaacacataattctcgctctgtacccgtgaagagcacactg

SEQ ID NO: 32095 - DNA, 451 bp, Triticum aestivum
  Clone ID: PAT_TA_32095
gggtcgacgggaacttcctacattcatggaagggtgcatgaactctcccaaaagacaactccttttgtttcggcgccggtcttgggatattgccatatttcctttcaactttcgcaaatcaacttgtcctcatctttggtgtatgatcccgtctgaatgctttcctcctcttttgtgcattggcctttaaggtgaggtcatcaatgaacaacggctcctccttaatgtctacgccatcttcttcatcttcacaataaatgtcttcatgccatggctcgccttggccgtcagtcgcttcttgattgttgtggctgccaatgtgctcgacaccatgatcttggctgtgaccgtcttgactttgggtctcgtcgcgatcgaaggcttggccatggccctcggggtggaaggctttggcactaccctcatagatgatgttctccatgaaatcgtt

SEQ ID NO: 32096 - DNA, 630 bp, Triticum aestivum
  unsure (1)..(630): unsure at all n locations
  Clone ID: PAT_TA_32096
ataataataatccatttattattgcctctagggcatatttccaacaaaactaaccagccccaaaagtaaggcaacatcaagttcaatgcagccatgagattgcaaaagctaattagttgacattaagttcagtagtacaagcaggaacattagagagcaaatgccaacatagtggcagtggatgcactaaaactacgaagccatagttaggcatactgatagatagctttggttcaactaccaccatgagtgccattccatatgaatctggtctgaatagttcgtaatatagagggccacatgatggttttgtatagaaaatacacttgtgatttccttctaaagcgtatggacaggacagggagcaataatttccccttataatcttgaaggcgagatccgtatcttgagtatatgctattctttcattcccgccgccttgacaaaatctgcccaattggtactgtggccctcttctgtgttcgtcaccggccccctgcagacatggttccggnccgtgacaccttttggagccttttcatattgtgacaactcttgtaggggactaacanccanccggaagataaanccaacataccccccacatacccantaggcctgcattttcct

SEQ ID NO: 32097 - DNA, 1289 bp, Triticum aestivum
  Clone ID: PAT_TA_32097
ctcccaaagatggagaggagtgttgaagcatttcaaattgacaatccatatgagcctgtggcagacaatacgtatctgcctgcaccagattgcgaggaaccaaggttggaagaggacagaactgctgcgcaaggcgtgaatgcttgtcgtcgcgtgaacgatacgctacggtcgccgatgccggacaattatggtcttgaggagcttagggaacttggtcctggcacgtccggaactgtttaccatgggaaatggagaggaactgatgtggctatcaagcgcatcaagaaaagctgttttacaggacgatcatctgagcaagaaaggctggcacaagaattctggcgagaagctgagattctgtcaaagcttcatcatccaaacgtcgtagccttctatggcgtggtgaaggacgggccgggcggtaccctggcgactctgaccgagttcatggttaatggttctcttcggcatgtcttgcagcggaaggacaagtgtcctgatctccgcaagcggctgatcatagcgatggacgcggcgtttgggatggagtatctgcactcgaagaacattgtgcatttcgacctgaagtgcgacaacctgctggtcaacctcagggaccacgcacgccctatctgcaaagtgggtgattttgggctgtccaaaatcaagaggaacaccctggtttcgggcggcgtgagggggacgctcccctggatggctccagagttactcaacgggagcagcagcaaggtgtctgagaaggtagacgtgttctcgttcggtatcgtgttgtgggagatcctgaccggggaggagccctatgccaacatgcactatggcgcaataataggtggcatcgtgaacaacacgctgcgtccgccggtgccggccaactgcgggccggagtggaggaggctgatggagcagtgctggtcgccggacccgtcgcagcggccggccttcacggagatcgcggcgcggctgcggtccatgtcggctgcggccaaccagcaggccaaggcagcggcggcggccaagtagaaagaagaaaaagaaatcgccggctggggctgggttctgcttctggtgatcggtggagtctgctgtatgtattgtctgtctgtctgtctgttatagagttgcgcgttgtgagtgtaaaaatattggtgagatgaatgaaatgaaatgaatcatgtcctcggtcgggtgtaaaaatatacacacactatgtactattattataaacaaataatatatattattatctctatatatataagtggatc

SEQ ID NO: 32098 - DNA, 824 bp, Triticum aestivum
  Clone ID: PAT_TA_32098
cccacgcgtccggcggcgcggctcgacctggaggtggtccccgccgccggcccgccggtggaggcgggccaggtgaagaaggaggacgtggagaccaaggtgtccgcgtgccacacggcggcgatcgccaaggtcaacaaccgcttcaagcgggaggaggtggtcatcaacgggtgggagcgggaccaggtggacaaggaggaggcctggcacaagagggtcgaggcgaagcacgacgcagaagcgcagccaaggccgtcggagacgaacggagggctgacgttgtccaaggctgggggaccgagcaggtcgagaagggcgtccggctggctgcccagcggggggctcaagctggccgaccggcccgccagctcggcgaacttcacgcaggacgtcggcagggtgccgcccaagcggtcgtactacgagcgggcgtcagccggggcaggggagaaatcctatgtggtttagcctatgggtagtacgtaaataataagggcctgtggtgctgctgccgcatccgatcgatccggcaacctaattgtactaatgaacttgaaaacttgctgttggtgttgctgcctacattgtatactagccgccgtgggggatcacacggcggcgcttttttgtttgtgcttgtaagtacacgaaaaaactggtgtgagaatggaatgaatagcgtgtttgctacggacgtgcacggaatcacacggtggcgcttttttgtttggcttgtatatgcacgcaaaactggtgtgaagattggaatgaatagtgtgtttgccacaaacctgcaaacattcagagcatttgttcaaaaa

SEQ ID NO: 32099 - DNA, 595 bp, Triticum aestivum
  unsure (1)..(595): unsure at all n locations
  Clone ID: PAT_TA_32099
ggccgaaataatccttagtttccacgtagagaagatgaatcgaaaccttgctgctccgcagccacaaggtccttatctgctcgtgcgccaatggttcccgccacaacctggtcaacaaacgcctgtacgtggggggccgacgacccgccggccgccacggccgtcctcgccgccgcgcaccacgccctggccttctcgagcatcgcgccggcgtccggcccggccacgacgtcctccacggcgtcgcgcacggggtccctccgcagcggcgtgccgatgcgcacccccatcttgaactcctccacgaggtacttggcgtccgtgcactggtcgccccactgcgggaacgccaccacgggaagccccgccgcgagcgtctccagcgtggagttccagccgcagtgcgtgaggaagcaccccgtggacgggtgcgcgagcaccaggtcctgcgggctccacggcaccaccatgccgcgcccggcgacggagtccaggtacccctccgggagcatcgcgttgcagtccggccgaaccacccacaggaaggggcggccggtggacgcgagcccgtgcaccatntcggccagctcctcgg

SEQ ID NO: 32100 - DNA, 1803 bp, Triticum aestivum
  Clone ID: PAT_TA_32100
ttccccgtccatttccacacccacctcccttcgcctggtccgggggcgggcatccatggactcttcctccgaggcgccgctgctgcccagcagggggaacgagcacaagggggtgcccgatgtggcgggaggcaagcggccgtggtggagggaggcggcggaggagtccggccggctggccgcgctggctgcgccgatgatcgcggtggcgctgctgcagctgttgatgcagctcatctccaccgtcatggtggggcacctcggcgaggtcgcgctcgctggcgccgccatcgccaactccctcaccaacgtctccggcttcagcgtcctcataggactggcatgcggattggaaactatttgtgggcaggcctatggagcagaacagtatcataagttatccttgtatacctacaggtccatcattgtacttcttattgtgagtgtgcccatcgccattgtatgggttttcattccggaagtacttcctctcataggtcagcaaccagaaattgcaaatgaggctgggaaatatgcattgtggcttatccctggtttatttgccttcagtgttgctcaatgcttttcaaagtttctgcagtgtcagagcctcatctttcctatggttcttagctccatgatcacactcgctgtatttattcctctgtgttggttcctggtttataaagttggtatgggtaatgctggagctgctttatccgtcagcatctgcgattgggttgaagtgattgttcttggtctttacatcaagttctcaccttcttgtgagaaaacacgtgctccactcacgtgggaagcttttaaaggaattggcagtttcatgagtttggctgtaccgtcggctcttatgatttgccttgaatggtggtcttacgagctgcttgttctgctttctgggatcttaccaaatccagcacttgaaacttctgtgctttctatatgcatatctacagtggtgctgttgtacaatcttccttacggtattggaacagctgcaagtgtgcgcgtctcaaatgaactaggtgctggcaacccagaaggtgctcgcttggtggtaggtgttgctttgtcgattgtagtttgttcagcagtcctggtgagcacaactcttctagccctgcgccacttcattggaattgcattcagcaacgaggaggaggttgtagattatgtcaccagaatggtacccgtactttccatttcagtcattacagacagcttccaaggagtcctttcaggtgtttctcggggctgtggatggcagcatttaggcgcgtatgtcaacctgggtgcattctatcttgttgggatccccgttgcactcttttttggttttacaatgcaactacgaggaatgggattttggattgtagcgtggtcgcggccgaggtcacaggtcactctcctatctgtgataactgccactacaaaatgggacaagatggctgacaaggctaaggagagagtatttgaagacaggcttccaacacaataagacttgaagaactgccatgtcaaaattttgaagagctaaataatcagagaattctaattacctttaattactttgagaaaagcatcatcgatgttcttgtcacgtgcaaagaaaattttcacacaattggctcagtttggcatggtgtggtttcatggtggactggtggtgttttactgtttctttctttcttgataggttgttttattgttttgcgtggtgcctatcttcccttgtattggatttttttgcgggcaagctttgtacctgcccgggcggccgctcga

SEQ ID NO: 32101 - DNA, 1209 bp, Triticum aestivum
  unsure (1)..(1209): unsure at all n locations
  Clone ID: PAT_TA_32101
aagcaacagaaggcgcccaacaaaacacatgccgactcctgagcaatggactaatgttttcaatccagcctatgcatattatgtatactattgctatgctaacttgtacacactgaacaagcttcgtgattccaagggcatgacaacaatcaaacttcgtccacactgtggagcgactggcgatattgatcatcttgctgcagcatttctcacttctctcaatattgctcacggggagaatttaaagaagtctcctgtcctccagtacttgtattatcttgctcagattggtcttgcaatgtctcctttgagcaacaactcattgtttattgactaccaccggaaccctttcccaacatttttcttaagaggcctgaatgtttctctctcaactgatgaccctttgcaaattcacctaacaaaagaacctttggttgaagaatacagtgttgctgcttcgctgtggaagcttagctcttgtgacttgtgtgaaatagccaggaattctgtgtaccagtctggtttctctcataggctgaagtcacactggattggtagaaactactacaaaagaggccccgacggcaatgacatccaccagacaaatgttccccacattaggattgaattccggcacaacatttggaaagacgagatggagctgatacatttcggaaatgttaagctaccagaagaaaccgacagatgaagaagatgttgcggcagttttcaaaggagcccacgcgttccaggcatcgcaccccattttctgggctttgggagaaggaagcaaacctattatgcaatccgtgaaagagaagaaaagtgcccgagtaccttttcgatgagtcttttactcctgttgcttgtataggcaaatgttagcatggaaggatgaggaggaagacgctctaggatttcagtggaacatagtacatcagatctgtcgtcgctcgctcgctcgatacatcaaattagtgaccttgagaataaacttgtatctttgcttttatccagatatcttttacagcatgttaaatctgatattgttagtactatttgttagagattcaccagttatatcgattaaaaaaaaaaggggcggtaccaatcncccaanatgancgtntancgnccacgggcgtcgtttaaantctgacgggaaaacccggtancaacttaacgcctgagaaatcccttcgcagnggg

SEQ ID NO: 32102 - DNA, 705 bp, Triticum aestivum
  unsure (1)..(705): unsure at all n locations
  Clone ID: PAT_TA_32102
tgntccgcccacgcgtccggccttttaagggcaaagaaggttataaatccatcatcgacgggagcgattttgtgtggacataaacagatgactgaggaaattactagagctcttgttgctgatggtatgtccaaagataaaatcctaacaaacttctgagtttcactagaacacgtatcttgcccttttggctgttgtacacctaccaccacaatctagtggctcttgtttacagcaaatgtgatgcgacttagggtcgtgaaaaagatactgctacgtactaacaaataagggcaactcattttccttcacgctgcatgttgcccatcaaccattggatgttgatatcctgatatattaatctcaagaaagaagaaaaggcttggtggtgccctgagacagcattcccctggaaggtgctgatgcactcgaaaagcccctttccagaaaagtagaagggggctcaataggggacattggttgtaagttagtaaaatcattttttagtttgtatgccttcagatataagcggctgcaagtgtttctgccgtgaaattttggtatatttgaaggttgtaatattttttggaattgcctggatgtatttggagccctattctctcaactggcagtgtgcctggatgtattgtggaaacagctttctccactgacgacaaaaacaatacatgaaaaagggttttgttc

SEQ ID NO: 32103 - DNA, 896 bp, Triticum aestivum
  Clone ID: PAT_TA_32103
gatcaagtatgtcgagatagagaaacatcaaaggcacgatcctgacgaaaggccgttcgatgacattgatacactctacgaggcagactgcttgaagaagcccaaagtaatgggctggaaggccatgacatggtatagaaggttctcttgtgaccattggagcaaggggtccgtggcttatgataaggaaatctcagttgaccaaccaatgcattcagtgttattgcctgagctgacggatgatactgccggagagttgacactaaaggacatgctagcatcttaccctgtctcgagcttggcagatcattgtgatgatgttgtttacatgttgtgtgaatcaaaatctggcagcaaaaagtcatggctgatcactgttgacctgaaaaagaagatattggtcgaattggcaccatttcctcttgaaggatattacagcccagcccacccttctgaactgtccaattatctgaacgtagctccagcagaggaagaagatacttcagaaggaccctgagaaggagctggtgacaagggcatgtgtggtgctccagcgccatcctcgccatccagaacccaactcaagcctccctgggaacgcaaacatggagatttttctggtgtctcaacctctgttctcgtcttctccacaactctgctgctcccattttatttactgggctatcttgtgttttgctgctacctttgagtggatgtcgttttataatttgcttagctttctgtgttagttgaatggtgtacactgttttggttaactggtctttgtataggccttttggtttgctttctctcaaatcctggtaatggaaaaacttactgttggtcgaagatatattaagtggcgtgaaaataatctgttatatataaaaaaaaaa

SEQ ID NO: 32104 - DNA, 1066 bp, Triticum aestivum
  unsure (1)..(1066): unsure at all n locations
  Clone ID: PAT_TA_32104
gcaggnaattcggcacccggcccagactcgtcttagaaagaggacgccgacactcgccgccaccatccacatccagatgcatcctcgttagctttcgccatgccggcagcttccacgctcatgcggttcgctagtgccggtcgctcagctgcggcgaccgcatctcgcttcgcccgtttagctgaacgagcggccctctccacgaaggcggtggcggtcgaatgtcacgctcccaccttgggttcccaccgtgcagcctccgtagatctgcgtctgcaccgtcctcccgtcgtcgttcctccccccgccatgaccgcacctgcctcccagacgctcagctacttaaaagaacaaacgccggaaggtaaggtgaaatttgtggcagaggagaaagaccttgagtcagatgaaaccctttgggccttgtacgagcgctggtgcgaggctttcaaccaaaagcgtgaccatgatgagaaggttcgccggttcagcacattcaagaagaccgttctgcacatccacaacaagcccaatgtgggctacagaaggggaataacccaattcgctgatggaaagctaaggaagccctgttgcactgatctgcttgatcgtaagattgcagagcaggttgacggctataatgttgaatttgtaacagatggcagtggcaaactttacaagcgagtctacgctgattataaggtggttcaagacagactttatgtccatttacccaagggggttgatgtgaaaaccatcaccagcaaccctgaatgggctgagctggaaaagtatgactccaccaaccctgaatgctaagctgttctagtgctatgctgtattggttggtcttccttctgccaaagaagacatctgtactaagttgtgctttggcaatgcatccgtatgcttaataatatgtgtaagctatgtgtatgcagactataataatgcttttgtaagatatttatgaagtttgcctaaggtgttaagataaaataggaaacaaaaaaaggttgcaatgaaatggagtgtggagtttgcgaaattctttccaaaaaaaaaa

SEQ ID NO: 32105 - DNA, 736 bp, Triticum aestivum
  Clone ID: PAT_TA_32105
gcgcctgcggttgcaatttcttacatgttctggttcgagaatatggacctaaatacggcttatgacaagctaacctcccataagaccgtgtggaccgagtaagaaagctatccgctctgcaacctatgatctagctaagagtgatccaaataaagaagcttttgagaccctgccggagcgtgctttcgagggaatatcagtttcagagaggaagttaatacaagaccgtgtccgttccctccacaaggcatgagaaagggaaaacatcacgagagctggacaggggacggggtaaacttttgctatatgatagacctgattgctagatttctacaagctgttggaaagtaagaggtttgagccaagctattctcagaataaagcttaagaccgaccttgttgttggttggtattgtaataagaagaaaataaagaggcatgaaaagatgttatctaccacatatggtgaacttggatgcagtttaccacatcttttcggtcttgaagatcaatgcatcaatatagatgtcatgcgtttatcattataatcatgttgttccgggaatattgcttcatgtatttagtcattgatggcaacagattgaaactattactcaaaagtacaagcatatatcatgtcgtcgccaaatgtcatgtgtatgctcattttggctgtgccgtaaagtttctcgtgttacattcacggatgaaataaagtttcttctgtatttgcacg

SEQ ID NO: 32106 - DNA, 1023 bp, Triticum aestivum
  Clone ID: PAT_TA_32106
ggatccatgagcatgggcatggactccccgcagaagaagcttggctccatatccatggacggcggcaagacgcctcctctgctgcttgaggttgcggcccagctggccaagaaggcgatagccgcttctccgttcccggatgcacaccggctggccagcgcttgggcgttcgtcagcgccaggttcttccccgtctccatcgccttgggctccctcatcgaccttctactctgcagcaagctggggtggtgccattttctggagcgcgagtgggaccggcccatagacagcgccctctggatcggcctgtggtgctgacccgcactccaggcggccgtggcggcgctcgctctgctgctcccgtcccgccaccgccggatccgccgtgcccttgcctacctcgccgtctcggtcgccatcgtcggccattctttgatggccagcctcgtcccccttgttgtcgctgcctacccagggccagggctaggatacctcctgctcatcgtcttgttcgtctgcgccgcggcggcgctggcgcagatgctcccgtgcctctccctccggatccgccgtgccctcgcccacctcgcgctcgccatcgtcggcctctgtattttggccagcttggccctcgccgtcgacacagcattcctcatcctcttgatcggctactcggcggtaatcttcaccctcgcggtgggtgacctcctcagcttcctggccctcctcctcggaggcgaggaggagtagctgctgatcggcaagccgcgagctccatatatctccatggatcagctcatgaggtactcacgtacgtccgactgatgagtagttgtacgtagtagtaacttgatcatggatctcctaccacttaatctgcctagtattggaccttaatttgatgtggaattaattagcctgtacgttatctgtgtgatgtggagcttgcctggattagtattgatgaacaagctatacatatatggagtcttaatttgatgtagtatatatggaccttttctc

SEQ ID NO: 32107 - DNA, 655 bp, Triticum aestivum
  Clone ID: PAT_TA_32107
gcacgaggacgagcagatgccgggcgtgaaggcggaggagaggaaggagaagatccaccggtacatcaagaagaggaacgagcggaacttcagcaagaagatcaagtacgcgtgcaggaaaaccttggcggacagcaggccgcgcgtccgcgggaggttcgccaagaacgacgagtactgcgaagcgtccacggcgatcggatcacagaaccacgaggagtacgagcagatgccgggcgtgaaggcggaggacatgctcgaccccgacgcgctggcgcacatcagcgggatgagctcctacatgtacaaccacacggtggagtcgtggatataatctgactcacgacgaacacgagcccgctaattccatttttcaccaacctattttacacgtgcagatttttaacagcctgtttaacttgattttggtcccgtggaataattttgtagctcctgaagcggcgagttgaatttacttaccatgtagggtcggccggtctgttgtgtcagtcgaaatctgcttttcgcttgttgcagctaattcttgcaggtgaatgtgaggttctagagtttgcagaggagttgtgtacttgttttttttaatagaaaacacagcttcagcgatcaaaaaaaaaaaaaaaaaaaaaaaaaaaaa

SEQ ID NO: 32108 - DNA, 1000 bp, Triticum aestivum
  Clone ID: PAT_TA_32108
accaccagcgcgtacgcaagatcaaaaccagcaatggccttgatgcccgtggagctctgctacgccacggtcgcctctccggtggcggcgccatcggccaggagggtgccgaggcggcgggcggcggtgcggtgcgcggcgaccgcgccggcgccgatgggggagaagaccaagtacagggacgggccgctggagcgcgcgttcatggggctgttcgcgcgcaagatggagaagttcacgggaaggaagaagaagccgggcccgggcggcgaggaggagaagaaggcggtgtgggagtgggactacgagagcttcgtggacgtgtcgcggcgggtgatggtggggcggtcgcgcgcgcagcagcaggaggccgtccgcgaggtgctcctctccatgctccctcccggcgcccccgagcagttcaagaagctcttcccgcccacgcgctgggcctgcgagttcaacgcggccctcaccgtcccattcttccactggctcgtcggcccatcagaggttatcgaggtagaggttgacggggtgaagcagaggagtggagtgctcataaagaaatgcaggtacttggagaacagcgggtgcgttgggatgtgcgtcaacatgtgcaagatccccacgcagagcttcttcaccgacgagttcggactcccactcaccatgaatccaaactttgaagacatgagctgcgaaatgatatacggtcaggtgcccccacccttggaagaggatccagtgtcaaagcaaccctgctaccctaacctctgttccatgtcgacgccgtctgcgccggtctgtcccaagcttcaggcgtaggtatacatgagattgagttcatgtccagtgcgcattcagtttcgtcagagaatccacacagttgaaacactctatagtggtagtataggccatacgttgctagtaggagaccgttgccttgagatggatggtttgcacacggaaattggtttggtgagggaagtatcattag

SEQ ID NO: 32109 - DNA, 574 bp, Triticum aestivum
  Clone ID: PAT_TA_32109
gtgaatctttgctgtgatccagacacgcgccgggtactggcagtgggagaaccacatccgtccgggtaagccgaaaggcaccaacggaggcctcgccatctccatcagcggctgcaacgacgaggggtagtcatcggagtcgagcgtccaggggttctccgataccgctgccatcggcgccatgacggacagcttcatcagggccgtggagtccgagccggggacgacctacgggcggctgctgagtgcgatgagggcgacgatccgcgacagccaggggaccggccgccgcctccccgggaggatcggctccttcgtccgcaagatgatcacttccagcgccgtgcaggagcctcagctctgctcttcagagatgttcgacatctaccggaagccctttctcctgtgactctgcctcgcgccggagttcttcggaatcatgtaattcgtttgccttaccaatgatgctgtcgtcctgctgtgtgctgcactgcacttgtgagcaaagtgaacggatcatttcagttgaaatgcagtagaaaaaaaaaaaatgagtaatatcacatgtttccag

SEQ ID NO: 32110 - DNA, 1101 bp, Triticum aestivum
  unsure (1)..(1101): unsure at all n locations
  Clone ID: PAT_TA_32110
taaaatttttttttttttttcgtcaagactacattaacaagaagttttgttcgaccagtcattgacaaaatgattctgttagtgtaacgcagattaaatgacatggcacgcacacacagctacttcaggagtattacattaatcagacaatttgttcagcacatggtagctatataaacagaccaaatatcgttcatgttgacagaaattagcaatgctcacggctacatacgaaattggccagagacaattttctagcatcttctatttttacacagcgtcacatgccaagttttcaaagattgaacttaataaaggcatgccttcacgtccatgcaggagatttagtgtcgatctgcccaataaattgctccgatgctggcgacgaatctttcgttcaagcttctatagcccctccgccgcatagatctggccgtctccactcactcgcctcataggcagcagctgctccacgtgcactcatttctgtctccactcactcccctcataggaatactacacgtatttgatttgttcccatgttctatccaccttcccattctccactaattcctccttcaagtctccatcttctgactaaattcaatcagatctgaagctcatgcatcctcctttttgtattggtcttcgtatggtcttcctaccttttgtattgcccttgttggctttgctttcttctactcggaaataccagagcatcttacgaaaatgaagctttccagtactactctttgcaattttaatccaagaagctccacgaccnattgtaacagtcggttgggtgggttgtggtcatgtgtgatgaggatagtgagcccggcagcgtaaatgtcgtcagttatctgctcctccgtggacgctgacccaaacacactggagcccgacttgctgtagatgagcgacaagatacccatctggtcattagtggactccctgataggttgtcctctgtgtatagcaccatcctatggctttgtttggcgaatatcttggcattccctgaagaaaaggttggccagcagcacaagtttaggtcctagttttcagtacaatcagttcggttcgatagtctcatttgcc

SEQ ID NO: 32111 - DNA, 1498 bp, Triticum aestivum
  Clone ID: PAT_TA_32111
cccactcgtacaacccgaactacctataaacattctgctaccatcgggacatacacatttgctacgctacataggtgggagttggcagtaaactttccaaggatgaatggaaggatgttcttctctgcttcaaagaatcatcagcacaaacctttattgcattctctaaaattgtaaggatgatgcaagacatcgacattccagatagaatggaatcttattcggaagctgatcactattcagatcatgaaatttatagtaacgatgaagatgaagctaatatggagacaacttcttacgccattgtcaaactgaaaaatcatatggccctaatcctcttaatcgttcagggcattattaaattgtacgaggagcagggaaaatatcttcatgctgagcacattagcattcttttggagatgatatcaagtattgcaactcatgcaagtgaagtgagctcagactcttcgttacagatgaaattccataaatcatgttcccttctggaggcatctgagccagcagttgtccattcgagaacgagacataccaaagctacctcaagcttctccaagctgtgctccatgggtatccattcttatcggaagacatggacatagaatcacgactacttgatacctgtgagaaaatactgcggacatatctgaagtgcgccgggaatggaccatctgatgaagcttctcacggcaatcaaactttacattccatagtgccactgggcgctgccaagcaagaggagctgtctgctaggaccccgttggttcttctagcgatgcagttactgcataacctagagaagaattcatttaggagagtactgccccgctttttcccgctgttgattgatctgattcgctgcgagcatagctctggagatgttcaacacgcgctgtataaaatcttcaaatcatcaataggccccatgatagaagtataatggcacattcctgtcctgttaggcgcacgattttgtgtcaacattctgacatcctgaatgagcccttcaagatcctggagttcaagtgcatattactagtccagatatcaggcataaagaggaaaatacattttgcttacatccacttcagctcatgagctctatcatcggaacaggtgtcccgaactcggaccctttctcctggaatcccgagctattcaaccgcctgtatcaaaaggttctttcccattcatcatacgtcccgcaggggggcctctgcgacacgcccacagaccgccccacaacgttctgggggcattctggccgttgtaacacgtgccacggcatcagccgtgttactagagaaaaccatttgaagtatgattgcttttgtaatgtcctgtttttcttatgatttgatccacagtaggttgtgtttgtaattctttttgtcaatatataaacatagtgcagtgttcatgtaaacggatgaaatgttacagggttagctgttgtttaggcagatagctatgaggacct

SEQ ID NO: 32112 - DNA, 745 bp, Triticum aestivum
  unsure (1)..(745): unsure at all n locations
  Clone ID: PAT_TA_32112
gccggccgggtttcgacgtcgcctcccccacgtcttcgtcccgtccaacaacgtaccatcttgaatcttcttcccctaggctagctatatacctgctcttatcccgctcagccatggccatgatgggcatcatagcgccggagacggcgtacgagacggaggccgtgtctccggccacagccagcgccgccgcgggcgcgccgcagcgcaggggcttgctccggaggatgatgccgcgggggcactactcgcccatcggcgccgaccagaagacagaccctggaagggcgcccgaggtggcaccgatcgctgcccgtgactcggatgtcgcggagaagccgcgccgcggctggctgcggcggctggtaacgcagcggcggcgctggaagaatctgggcggcgccagcgcgtcgaggctggccggactgtcgcgatcgctgcggtggaagcggctgtccgtgaacctgaggggcagctgggcgtcggcgctgctggacaccgtcgcgttccgcgtcatgtacgtggtggaagccatcgtgcttggcctggcgctctcctgtttcttctgctgctgcggctgccagatatagctgcccatggcctgccccttgctgtgattcatgcaagctccttctgcttgccattgggcgtgtaatctttgtacccccgtccttgtttatctaagatgcttaattctctaatgaaagaggatttttttgctanaaaaaaaaaaaaaaaaggccta

SEQ ID NO: 32113 - DNA, 1309 bp, Triticum aestivum
  unsure (1)..(1309): unsure at all n locations
  Clone ID: PAT_TA_32113
gcacgagggagagagaggagaaagaaagacacaccactcttccaccacttccacccgatgcccaacctcccccgatctcgctgccgccccccgcttcccctgccttccggcgccgccgcccccagcttaccctgccacacggcgccgccgccccccgcttcccctgcatccaggcgctgccgccctcccgcttcccctgccccgaggcgccgctgactcaacctcccgcgtgccacctgacttccttcccccgccgccccttgctccggtgggcctcccaccgctaccaaccagcgtcggaaccgtccctcgccctggatcgcaccgccgtcactgcccacgatggggatcgcgccacaggcaccgtcccacgatggggatcgagccgcaggcaccgtcccatgatggggatcgcgccactgcaaccgcatcgccccacctcccgtcgtcgggatcctgctgccgcgcgacaaccaccgggatcctcccaccgtgcgaccttccttcacctgccaccgtgaacttcttccaccctccactgtgaccttcttccctcccccgcctcgatcctgacatggctccatgtttcgttgatgttgtaggcggtcgctactcacgccgcgcgcgtgtggcggtggacggacgcgacggtttcctttgacatgaacgaccgcaaagagtggctcgtcggatgctgttgccgtggatgacgatgatctcgttctcgataggagaatgaagagacacaggagaggggacgaggatcatgtgctcaccgtgcaacacagcgtcacctcttcgctccggagcgtcgggattcttgctagagagcattcagtgtcggatttcctaatgtgtattgtccttctttcatttgtggtccactgtttgctgttgtaggtttacaggtttggaaggcagccatgctgctaacctgactttgtgttgcacaagagcttcacgtcgtctgaattcgacggtgttactgccatggagatcggtgttgggacaggtgatggcttgttatgaaatttagtgaatgagaaaattgtgttgtgcttgtacaactgtgtattttttttattttttatttgtttttgtgaatgtcaaaatgttgagtccgagaagttcaagtatgttagtttaaactgtattattgagatgctccaactggttgtaggagtgcattgagaaacagagtgaaaaacatcataaaaatggaagttcaggaggntnaaaanagaanaangaagaaagaaaaagctcaaaattccggcnntgaaattttaacgacaaccagttaaaaaaa

SEQ ID NO: 32114 - DNA, 982 bp, Triticum aestivum
  Clone ID: PAT_TA_32114
caaacccattgtctgttcgaacaaaggttcgcaccatcaaggatactacatatctggaagcctgcatagagaatcatacaaaatctaacctttacatggatcaagtagattttgaacctgcccaacagtggagcgctacaatactggaagctgatgagcacccctcagtggtgaagtctacaatacgggacctctgcaaacaacctgttctgattagagcggcaggaggaatatacaattacctatatcagctcagaccatcgtccgatgagcctggtcaaatgaagacagagggtagcagcatacttggtaaatttcagattacatggcggacaaatcttggtgaaccaggccgcctgcaaactcagaacattcatagcactcctactccaagcaaagatgttgaccttcgtgccgtgaaaattccacctgttatatttctagaaagaccatttatggtcaatctatgccttacaaatcaaacagagaaaacagttggcccttttgaagtatttctagctccaagcgtatctggtgaacaaaaaactgttctggtcaatggattacagaagttggttttgccattagtggaggcttttgagtccatcaactttgacctgagcatggtagctacccaacttggcgtgcaaaagatctctggaattacattgtatgccgtgcaggaaaggaagcactacgaacctttgccagacatagagattttcgtcgacgcggaatagaacaccgcatccacatcgggagacccgttggaagtgctagattagaccttcagggcgaaccatattctcgttgatgtacttctgtttattgtactactgatatcatcatgttgtaattaaccacaccttttatatcaaaagtaatgcatccgtgcatgttcgttgtgtaattgtagcatgaactggttgagtcaggcaagaaaggattttttttacaaaaaaaaaaaaaaaaaaggccccta

SEQ ID NO: 32115 - DNA, 644 bp, Triticum aestivum
  unsure (1)..(644): unsure at all n locations
  Clone ID: PAT_TA_32115
gctggtgaaggtggtctctgatcgccgggcagctgccgggcaggacggacaacgagatcaagaactactggaacacgcacatcaagcgcaagctcctctcccgcggcatggacccccatactcaccgcccgctcacgcccgtcgacggcgccgcggcgtcccgcccggcacacatagctgtgccagcgagggcagcgccacccacgatgttcgcccccctgacgacgaagcagcctcccatggagtcgtcgtccgacgacggcagcagcggcgcgacgagcacgggggagccgcggtgccccgacctgaacctcgacctgtcagtgggcccgccggctgccgacacgccgacctcgcacccggtctgcctctgccgccacctcggcctccgcggcggggcggtgtgcagctgccgtcaggccgacagcccgggctcccaggggggcgggttcagatatttcaggccgctggaggaaggccagtacatatgagacgagacaggacggctaggccctaggctccacagcaatttgtaagacggtgaatttttccacctccacagcaccaccgtctcacaaaacggtgaaagaatatctaatctgttcataatatttcagccatgaaaaaaaaaannnanaannnan

SEQ ID NO: 32116 - DNA, 1077 bp, Triticum aestivum
  Clone ID: PAT_TA_32116
gcaaaccacaaaagtttagggtttcttccagaggcatccacgctgcggactcttcccccccaccttcaaccttaccccccaccacccggggaagaatccggcggcggacggcgggcggcgagcggcgagcggcagcggagcagggtcagagcagagcagggcggcggattctagctttccgaggagggagatggcaggcatgggcgagatgtcgatgaggccgcggccgggcccgccgatgcaccgcggcccgcctcccatggcgcgcccccgccccgaacccatcgaccgcgagaagacctgccctctcctgctccgggttttcaccaaggttggtggccatcacctaaatgaagagttttctgagagagggaaggagccaaaagatgaagttcagatttacacgtggaaggatgccacactccgggagctcactgatcttgtcaaagaggttgctcttccagcaaggaaaagaaacgctaggttatcttttgcttttgtatacccggataagaatggtcgttttgttgtcaaacaggtgggttcgaccttttcttatggtcatggaagaggggatgatgccaaatctcttggggatcttggcttccagataggtgattacttgagcgtgtcgatcatgtgagcctgtgccatcttgcaaaatagtgtctgatgccacaccaagcagaatagtttttctgctgtgctattatcttgagctgtgcgtgcgtgggatgaagctttccttactggtcgccctgggggggaactgcagccagaactggctgtgataggtgacgaaattcggactagtatgtagtgactggacattttgaaatagttgatgtgactggacgcttgggacatcttatgtgattgcttcctgcggaccgattctttgttttggtcgcaatgtttgtaagggctatgtgaacgtatgtccccggcagaacatatgttaacaaaggtgcgacatagcactttggagactaagtttacccaatgtttcatgagctgtgccgctaacaactttttgaaaaccgaaaactcgagactagttctctctctctctctctc

SEQ ID NO: 32117 - DNA, 1546 bp, Triticum aestivum
  Clone ID: PAT_TA_32117
cccacgcgtccgcccacgcgtccggtacgaacccaaaacaccatacgaaccgcgagcaagccccctcgcaggaaccgccgatccatgccctatgccgctgccactgcctcctcctcctcctccacctccattcccaagcgatggcgcccacggccgcggttttctcccccagccaccatggctgcagatccacccacggccgatcgtctaagttgcaagcatggatggatggatccaggaaggtatccttcctccctaggtggagctagctgcacatcccgttcggccctctggagtcggccatctccgcctcctcctcgccgccgccgccaccgaggatcacgtcttcaccaagcgcgagctccgccccatctgaccgaccgcaaagggggatatttgaagctagggcaatccaagtaagatagcttcatcctcagtcaacaggtttatgttatcttatcatggagtcatttttaagtttgtgcccaacgccttcatccttagaatggccgcccagatggcaagccaccatactcaggcgactgtcgcgctatctgggtgctcctcttttggctgatgtacaatgattcgggatcaaatatttttacaatttctttgttgttcctttgtactggataactgtgcatttttagaggtgtgaagatgtaatgcaataacagtaactggacgtaggcacatccgtctcgataagcattatgggaacggacaaaggcaaggcattccaatgtaagaaatggatgaaggcaaggtatgtcattctaaaaaaaaggcaaggcaaaggatgacggggcaggtctggaggcgcggaaagccgtccatggcgatcctggtggcgttgctaatggcgttagtggcactgccgctcctcatggtgcccgacacgctctctatgccaggctccaacggcgtggatcgcggcgccgccctgtcgctcccacgcccgtgcttcagcagatccgtgtttgaggaggccggacctttacccgcctcccctccaatgtccacgactctgatataccgtgtgtgttagtcttgactggtgcttgtgctccgcatggttgtgcgggaggcgggtgagcagctggtagacttgtgttgcgtcgacagctgttccgttcgtccgacgtggcaacacctgctccatgcgtcctgcgcgccatctccgtctcccgtgtgggccgtgcagtcatcgactgcattctttacgtggcacaggtcaagcatcagaacagtatgttgtactatttggtttcatcggtcaatatggaaattcaactagcaaggcactggaacatagaacaacttcagatgtacctctaccccatctagatgacctacattaccgagggattccagatatatgtaaagctatacatggcaaagatcatgcgtactcactatgacattgtatatacataatgattatttttgtctggtatggcgctgtaaataaatgaacccgaggcgagtttgattgtttcgctggtttttgcaagcatatttctaaggcgcagtaaaaaaaaaa

SEQ ID NO: 32118 - DNA, 262 bp, Triticum aestivum
  Clone ID: PAT_TA_32118
ccaccatcaattactgcggtgctagcttcagactcgatccagagatacctaggttggctatcgctatgtagagtggttatatgctgagagtggacattatgtgtcactctctcgtgatgttctggaatgacggttctgtcgtatcacagagttctgcgtcttaagtatcctccgagtgagcctttaactgatcatagttcaggtgatgttgatcttgaaagagctagacactctgaaacgctccaagagtgaaagggataga

SEQ ID NO: 32119 - DNA, 636 bp, Triticum aestivum
  unsure (1)..(636): unsure at all n locations
  Clone ID: PAT_TA_32119
aggaagctgttccagtcgttcgactgggtgtcggtgagctcgttggccaccgacgcggccaccaacaagagccacgccatcaacgtccgngacgacggggacacggtgtggctgtggccgtcgtccaggagtggcgctggggccagggtgcccaagacggtgtccgaagaagcacccctcgccgtgtacgtcgtcgacgccgtgctgctgccgaaccacctgcgacagaagctggatggcggcgacgagccggctgctgcgtgcgagccgtccggtggctatttcggctggctgcacccccgcatcccggtctggcaagtgatagccatgcccgtggcgagcatcgcgggcttcctgaccgggtttcttcttcacgatgcagtggacaagatgagcaccaaggccaatttatctggttaagtttatctgtacactagtagtgaataatgctctagaattatggttgtggtgtttatatatatattgctgaaagcatgttcgatcgcctgtcgtggcatggcacgtactcttctgtcggagttaagtgtgagttcctgtgtttggctcatgtgctacagcttaatttgcgtaacatgatttagtgtggcatttacgtcgtctttgacgttttctccc

SEQ ID NO: 32120 - DNA, 1508 bp, Triticum aestivum
  unsure (1)..(1508): unsure at all n locations
  Clone ID: PAT_TA_32120
gcgctgcactgcaactaccagcctagctagccatagccagaagccactcaggcacctcccctccctcgcgttctcttggtgcaggcgcgatggccgcaccttttctgctccttctgctcgtcgtttctggaggcgctgcagcgggcggcgacggcgaggcagggctgccccggctcgagctccgaggcatcgacgacacgggccgtaggcacgggcccttcgcgctggaggagccggagttcatgcccggtatctccacgcacgacgaccaggcaggccgacgtgccgggcgaagctccccagcttcgagttccgaggccatcgacgactcaggccgtgggcacgcgtccgacgcgccggacgagccgttgttcatggcccacctcgacgacgagccacccgcgcgcccccccgctggttccgggcgcggcggcgcgggcacagagaggagcctgtgctcaggacgcggcgaagcgcccgggctcgagttcccgaggcatcgacgactccggccatgggcgcgcatccgacgcgccggaggagcgggcgttcacggacgttatctccacgggcggcgcctgcgaccacttcgcccgcctcgtcgccgagacggggaacgcgagccagctcttctgggagcgcgccgcgggcgccggcggtctcacggtgttctgccccgaagacaaggcccttgccgagttcgagcccaagttccgaagcctcggcgccgacgaccggctcgccgtcctgctgtaccacggcgcggcgaccacctacggcaggaagttgttccaggcgttcgactgggtgtcggtgagctcgctggccaccgacgcggccaccaacaagagccacgccatcaccgtccgcggcgacggggacacggtgtggctgtggccgtcgtgcgggagtggcgctggggccagggtgaccaagacggtgtccgaagaagctcccctcgccgtctacgtcgtcgacgccgtgctgctgccgaaccacctgcgacagaagctggatggcggcgacgggccggctgctgcgtgcgagccgtccggtggctatttcggctggctgcactgctgcatcccggtctgggaagtgatagtcatggccgtggcgagcatcgcgggcttcctggccgggtttcttcttcatgatgcagtcgacaagatgagcaacaaggccaatttatctggttaagtttatctggttacactagtagtgaataatgctctagaattatggttgtggtgtttagctcagcatatatatatatattgctgaaagcatgtcgatcgatcgcctgtcgtggcatggcacgtactcttctgccggagttaagtacgtgtgagttcctgtgtttggttcatgtgctacagcttaaattgcgtagcatgatttagtgtggcgttacccaacttaatcgccttgcancacatnccccttttgccagctggcgnaatagcnaaaagcccgaccgatcgcctttccaacanttgngcaanctg

SEQ ID NO: 32121 - DNA, 696 bp, Triticum aestivum
  Clone ID: PAT_TA_32121
gcatatgcttgtctcaaagattagatcgagaagatcatggaccccaacctcgccggcaaggtcaacccggagtcgctcgccaagttcgccgagaccgccgagaagtgcctctgcgagttcggcagcgaccgcctctccatgggcgacgtgctctggaacctcgagtacgcgctgcagctgcaggagtccaacccgcccgacgccgcctccgcccccggggggcccgacccgtccaccgtctccggcgcgagcggcctcaccaccgtgcccgaccaatccaccacctccgccaacgagctcttcgcgcagctcgccgacatgaaggggagatgatccatcgtctgaatcgatcatccatccctccacgcgtcgccgtcagtcctcaccgatcgagcagcaccgccctagttcgtcaatccgtgcgcgcgccttctgcatgccagtccatgcatgcatccatggtgggacggatcaaggaaggatccgatcataactcaaaaccaaaccaggtcgatcgaagagtgtatatgtgtgtaatgtatgtatgtgtctcaatcgcgtttaccgatgcagaaaattccaaaatgtataccgcaactgtatgtaaaatcatggcgtcaattacactttgtctcacaaaaagtgttgattttgttagcatgcattcagctggagctcatttctcttttcccccgc

SEQ ID NO: 32122 - DNA, 631 bp, Triticum aestivum
  Clone ID: PAT_TA_32122
cccgctcgccggttctcgtccccccccccgccctgccccctctcgcccgcggcctcgtcctcctccccgcccccccgcgctgccccggcggcgccgtgctcgcccgccggaagctgcgcgccccggactgcccgccgccgccgccgctctcccccagttcctctgcccgcgcgccctccgcctccgccccggccctgggctcccggtgctcccccatgctcgcatttccgccagcacgggctgcggagagctcggcgccgccggcgctctgccacagttcgtgaacccagtcgcccgccggaacaatccgtgttcttggctccatttaatttcaaaaataaaaattagtaccagcagtgatctgtattaggttgtagtagcactagtaatagaagtagtagtagcgtcagttttagcaggtgtgtattttggattggtgacacattggttttggggtgccggcgataagcggtggagatggatgaacaagcaagagatccatgtctagtagtagtagttggtttgttagaagcaataagtgggtctctttcggaggcgagagagatgttttagctgtttgtagcaagcgctagagatgataatgttggagtgaaatgaggctaatctcaaa

SEQ ID NO: 32123 - DNA, 900 bp, Triticum aestivum
  Clone ID: PAT_TA_32123
ttcaattttcatctgaacatgtccatggtttgatacttggcaccagcaaacttgagatattccggtctgaaagttcgacatggcttgaggatgataccttggaccgagatataaatatttctgggcgaacacacttatttgttaatggaatgttgtatgtgtctgttgggtatgaagttttgatgttcgaaggcctggaggcaatgagtgatggcataccgccctatcatcagatcataagtttgccgccggaagctttggcaaatcttcagggatcttacactatgcattgccacatgagaatggtcgcacgattgttgtttggacattggatgattttggtcaacattcatggacttggactaagatgtgtcatcttagcatgactgatgcgtttggaaaggatgagtttgttcactacgacgatggtggcgatggtggtgaggataaatggttttggaactgcgattatcggattgtcgacctcgacttggagagagggcttgttttcctccatgaccagaaggcaaataagcttctttcatacaatatcagcggggggaaactcaacgagatacaagacgcctttgggtgggatcgatactatgtctacgtaccatgctactcagagcttccagcccaagaaacttcagttcagtgaatgccaacttctgttcaatgtgcatctgtggttgttctgctgcgatatgctgaaccaccttgtatattatgctagccggagtcatccgtgtgaccagtccaggaaccctgccatttttactttgtcgatgcagagttacgttcctgtactaacctaaaactcttcaccatgttcctagttaaataccttgtttaagtttgctatatatcctttatgtaagatttgatgagctaaaacaa

SEQ ID NO: 32124 - DNA, 1074 bp, Triticum aestivum
  Clone ID: PAT_TA_32124
aaaagatctagctgtacaatgccttctagttggtcaatgacagacccgacaacattcttaatacggggagaatcctatttgcttgatcgtcaaaagatcaaagcagagaatacactgatgcaaatggttggtgctgactggataaaatctgataagcgtgaggatgatcttgctggtcgtcctggcggactagtccagaaatatgcagcacaaggaggcagcaaatttttcttcattgtaaatatacaggttcctggttctaccacgtacagcttagctttgtattatatgatggataccccattggaaaaggttcctctacttgaaagatttgtaaatggagatgatacattcagaaactcaagggatcttggattgtgaagcagagtgtgggcaagaaagcttgtttggttggtcaagcactagaaatcaattatttccgtggaagcaactatttggagcttggagttgatataggctcgtcaacagtggcacgaggtgtggtgagccttgtgctcgggtacttgaacaacctggtgattgagatggccttcttggtacagggcaacacgcaggaagagctcccggagttcctcctaggcacctgccgactgaattatctcgacgcctccaaagctgtatcgctagacgaatgctgacctgacctctcaaggtcaaggaggcgtcaggttgatcccaattctctttcgaagcctgagtacagcacatcaaagccgaaaaggctcaagctactccccgtgtccacccgccatacactcatttgtctgccttgccgcccacaaaagtgtggggtatttgccgcagcagtgtacattcatttctcctcctgcaaataggaggtgttgcggtgtattgattgattgattgatgatggcagtctactactcgtgtgatgcaaagccttgctcccattctttggccgacaactcgtcatttcattcatcatgtaaaaattgagacaaaaggaaagtgtattctaaccctgacctcgtgtcgttcatttggaatctaatctgggatcggatcagtgatcgtcagataaaaaaaaaaaaa

SEQ ID NO: 32125 - DNA, 694 bp, Triticum aestivum
  Clone ID: PAT_TA_32125
tcccgcgctgggttcgcctccctcctcggcgcctccttcctcgcggctcctgcgcagcgccgagccgctcgggttcaaccaccgcccgacgaccgccggcgacgagctctcggccgccccgagcagatacctgacgcgggaggagcgctggatgagccagcgcctcgaccacttctcccccaccgaccaccgccaattcaagcagcgctacttcgagttcctggactaccacgacgaccctaacggcccggtgttcctgcgcatctgcggcgagtcctcctgcgacggcctccccaacgactacctggccgtcatcgccaagaagttcggcgcggcggtggtgacgccggagcaccggtactacggcaagagctccccgttcgacagcctcaccaccgacaacctcaggttcctctcgtccaagcaggcgctcttcgacctcgccgtcttccgccagtattaccaggaaaaactgaattctcagtacaaccggagcgcggggttcgacaatccgtggttcgtcttcggggtctcctactccggggctctcagcgcatggttcaggctcaagttccctcacctgacatgcggaagcctcgccagcctccggggtggttcttgctgtgtacaacttcactgatttcgacaagcaggtcggagagtcggctggccctcagtgcaaagccgcccttca

SEQ ID NO: 32126 - DNA, 962 bp, Triticum aestivum
  Clone ID: PAT_TA_32126
cccacgcgtccgcccacgcgtccgctccaggaccggttgcctccagtcgggcaccggagatgcaggcggcggtagcggcggcggcatggacgccgaccacctcgccgtctacctcctcctccttcaaggttggggtctcaccgcgcttgcgtgggaggagaacgccctctgccgcggcaacttcggttgccgtgtccactcgccagccgctggaagttgttcgacccattgccgacccgaatccggtggtcgattcgccattaaccgctgaaaatgtggagcttgttctggatcaagtccggccgtatctcatggcagacggcggcaatgttgccttgcatgagatcgacgggaatgtagtgaggctcaagctgcaaggagcatgcggggcgtgcccgagctcggtgatgaccatgaggatgggcattcagcggcgtttgatggatgaaataccagagattgctgcagttgaagctatcacggacaaggaggctgggcttaagctgaacgaagagaatgttgaaaaggtactcgatgagatcaggccatacctcaccggcgctggaggcggtaatctcaggtttgtcgcgatcaacaaattcttcgtgaaagtccaactcaagggccctgcagcaggtgtggcggccgtccgagttgctatagcacagaagctcaaagagaagatcccatccatcgcagctgtccggctactgccgtaaacttcaactgcaaagcattgctgtgaatatctggttatccaggaaaatgctatgaatgcgctaactgatcagatcaccactgtagctgttagctggtagccccatggagagtttctcatctctagtcagatgatatgcgactattgatgtgaaatgttgtaacaaggttcttttggtctcatcctcttgggaaggaaatggaaaaggtcaatcttggtcgaaattaactcgttgctttgcctg

SEQ ID NO: 32127 - DNA, 1487 bp, Triticum aestivum
  Clone ID: PAT_TA_32127
cggcccctccccctggagctccccgcacccacacaccctaaccctagcccccacaccgcgccccccccggctccccgccctacccgccgcccccccccccccgcggcccgccgccgctcccacgacatcaccctcctcccgaccccgaccccaccgccgtccactgcccccggctcaccgtcgccctcccccgagtccgccgtccccgccgccacctactccgagccgaccgccgcccccttcctcgatcccgccgtcgccctccccttctcccaagggctataaatggcagggagacagcgcataggtcgccagtactatgaggaaccacgaggatttcgtgatggccctcctcctcgacttgcacgagaaaggtctgtctcaccacggcgcttcgagggagagctgtctagccgccgtgatgagatccgcagaatccgtgatgacaaccaacatctgggtggatgaaattgttggactcaggcaagcaatgtctcgtttgaaagaagatctctattcctcaagtcaggctatacctaagctccgtgcagagaaagaacttgaatcgagggagctgactcagaggaacctgaagctggaagctagagcttcgctcgttaagagccccataggcaagatgccttgcatctacgatctgaagtagggacgctgaagtctttaagacccggcgcaaacgttgacgtacagggtctaaaaaaggagcgtgagcaacagtactctgagcaccagcgcatacctgccatgatagctaaacgtggtcagcgccggcggcaccggtgccggccgtgggcggcgctcgtgtgagtgtggctcgcgaggccgagaagcttagggctgagattgacaagagaagggcactacctagggtcagcgcccatggcgctgacgcgccgcgctggacgtctcctgggatggacttgcaaggcatgtacgatgcgggctataactcctacacccacctcctgggatgggcgtgcaaggcatgtacgacggcggctacaatacctacacagacaggcgctaccgtacgggtggtggaccatgggacccccctagctacccgcgcccttgatttgggcttttgctgcttctgggttggcgttcatggtcgcgacaaagttcctgatatctctggtactgaagcttgtgggtgctggtgccttgttcagaagattgtaaccctggattcccgtgggccattttaggaagcaattcattctagttaagtggttgtggacactttggatgttgttgctaatcttctgattggtgaacattattgcctgccaaaagtgagggctgctgccagctgcaaaccctgcctgggcctcccgcatggcgccggtggtcatgggggccgatttgattttcaagtttgagagtttgtgtatatttctggaggggcgttctcttcccggacaagtgtgagagtgagaaaaaggatgttcatcatgtcaacaacatat

SEQ ID NO: 32128 - DNA, 1211 bp, Triticum aestivum
  Clone ID: PAT_TA_32128
cgctcgccggccgccgcctgctcctcctgcggcgatgcgcggccgggcggcggctgctcggcacggcggcggaggcgtctccgggcggggaggaggcgggcggcgaggcgggctacgggaggaagccctcgtcctcgtcgacgcgggacgagacctcggtgtccatgcccatgtccttcatgacggggtccgtggtggggaagcggttctaccgcgacgccaccgtgcgccgcgcagacgacggggcgccgcggaccgtcatgctcgactgtcgcagctcatgctcgccggccgcaccctgccgctcacggctagcaccccgctgcagcggcactcgctggcgctcgccatgggcgtcgccgccgagtgggagtaccaggaacgagatggtatccggccttttactatgcctcttatgaagcttgcttgtactgcactgtagagagttccattgacacgaacgaaaataattgccaatttgatgcaaaaattccatcaagatttggtattttgtcgctcacctgccgatgatgaacttaccaaaggagtctatgaaaaacagaaggagaaaattgacccaatactggactgggtcaagactgagtttgggttcaagcctgttgtgtacacaagttttttaggagggaagcatgatgagcggctagttaaggctgtagaaaccgttctgagatttgcaaatgattgtgagttggcgtctattgatgctatggccgcagcagcccattccttggtaatccctcttgcaatatttagaggaaggttgggagttgatgaatccattgagctaatcaggcttgaagaagatcaccaggtggatcgatggggcttggttgaaggaggtcatgatgttgatattgcggaccttaaagtccagatgtcatcggctgttgtgttccttcaactttcatggctgaagtaaccttttgttcagtaatctgcgtaattgttttctgctttttttttgagcttgtatcatgaagagttgtagaataataattagccgcagatggttaagagaaaacaaagtgccggtattcaacaggtgctgatgctgaacttttggttaaacagagctcagtgtgctatgttagcaagggtgtatgaaaacccagcatcctttttttggatcccagtggtctctggttatgtagggaaataatgctatcagtatcggctggctggcttggtgt

SEQ ID NO: 32129 - DNA, 781 bp, Triticum aestivum
  Clone ID: PAT_TA_32129
gctggccgccccccccctgtcccccgcctcctcacctctccccccccgccctcccctccccgtcccccgtgccgtcgccgtcgtccgcccccgccccttccctcccctgcgccaccgcccctccccacctgaatccagactaggcccgactgaactcccgtgcgaacgagccggacgtctcctgctccgcctacgcgcgggatggccaacccgatgtacggctccgggccgcttcgatccaggaacgcgtcgagctcggacgagatccagctgcggatcgacccggtgcatggcgatcttgacgaggagatcgatggggtgcactcgagggttcgcatgttgaaaggcgtcgcccaagagataaactccgaggccaaattccagaatgatttcctcaaccaactgcaactgacccttacgaaagctcaggctggagtgaagaataacatgcgaaggatgaacaaaagcatcatccagcagggctccaatcatattgtccatgttgtcctatttgctctgttatgtttctttgttgtctatcttttgtcaaagttctctagaagatagttattctgttaggtgaagccaaatcgaatcaactgaaatgtaccatgtgttgtatttagtctgaaaaaaagtgtgtcgcgagtaacgaaatggaatggaaaatgggactggactgtttacatggtatatttgacttgagaacaagttgtgtatccagcttcctgtcatgaaagagagaccatttcacaacttctgggcttgtaagataaaaaaa

SEQ ID NO: 32130 - DNA, 402 bp, Triticum aestivum
  Clone ID: PAT_TA_32130
gggtcgagggccgggcggcggcgaaaagttccactggtggtgcaggggccggatctggccgaaatcgggctgaaggcgggggagttcccttcgtctccgtgtgaagagaggaggagctacatcggcgtcgtgcggcggtattccccttcatcgccgtgcacgaggagtacccttaggctccggcggcgatcaaagagacggaatccatggcggggttgcagccgctcgcgccgcctgctcgcgacgtccggaccaactggctgctggcgcgctccgtgatgcaggtgctcttctcgaagcacggcgagctcaaacgcctcgacaacctgggtgcctccctctgcggcgccaggattccctgcagcccgacggcgctggacctccactccggcagccatagga

SEQ ID NO: 32131 - DNA, 947 bp, Triticum aestivum
  Clone ID: PAT_TA_32131
cccactcgtccgctcagatcgtccctccccgctgcccctgccgccgcatcggcatccctgccgccgtcgccgaccaagcccggccgcgtcgtgctccactccaccgacggactatccgacgatgcgtccttcttcgacgcccaggagacccccgccaagattaacctccccgctgagcccatcgacgacgactgggagctcgttgaccaggacggctacgaccgggactcccttgcctcggggccggcgccggcgtctgatcccgacggcatgctccgggatttcccggccaggtgcccacccggcggcgacgaagccgtggtgctctataccaccacgctccggggcatccgcaagacgttcgaagactgtaacgacgtgcgcgctctgctggataacctcgccgtggcgtttcaggagcgcgacgtgtccatggaccggggtctccgggagcagctctgggctgccaccggcgaaaaggccgtgcccccgcggctcttcgtccgcggccacgacctcgggggcgccgcccaggtgctcgcactccacgaggacggtcgccttacctccctcatccagctgccgtcactttcgcccccggaggcggcggtcagcagcaacaagaaaagggagaagtgcgaggcgtgcggggggctgaggttcgtggtatgcggtgagtgcgatggcagccggaagttgttcgacggcgagcgcggtggtgtccggtgccacggatgcaacgagaacggactcgtcatgtgcacactttgcttgtacccgagctgaagtaatgtaaattaactagcggttaattgccaatcacctgctcctttttttacttaattaattaccgaccatagtggtaccactttggggtttgagtgtgtaattggattttgtggttgtcttgtcatgtacatacattatgctagtatacgtttatgttt

SEQ ID NO: 32132 - DNA, 780 bp, Triticum aestivum
  unsure (1)..(780): unsure at all n locations
  Clone ID: PAT_TA_32132
taggctactacagccaacatcaaccaaaaagctatcgcctccccaccctacctcgctggcgccgccgtcgcctccaactctgcaccgacggcttcgaggaaatccctggtgctccttcgggctccgccggcctccacccatatatttcacctgcgccgccttcccctacaccccgcggccacaaatcctgaatggacaaccggccttctcaggctggctagaaaactgaaagaggtagatgaggacgtacaaaggcacaatgaactatttgaattagtgaaatccacaccatctggcaaaattggtgatgttgttgctaagcgccgtaaagatttcacggtggagtttttcaaccacctttattatgtcgcagagtcgtataaggatgagcctgctaagcaaaaagagttggcaacacttggaaatgattgtgtggatgctcctgcaagctcatgaatgacatgtgctggcagtctttaagcgctgaatgttgcggaactaaagctaaaggacatactcaattcagcttcaggtggacgctgcatgccctaaatgatcgattgacattggaccgaggaagcaagaactatactctgccgcttggctgtcgatgcctttcaaaacgtcgccgaggggtaggcgagcccgttccaaggcattggcccctaanaaagttccacccanacatacgncgtggcaaccccaaaggnaaatgccaaaggaancngatactgaacacctaaaagntgnggttcacaaaacccgatggtttaatgacct

SEQ ID NO: 32133 - DNA, 534 bp, Triticum aestivum
  unsure (1)..(534): unsure at all n locations
  Clone ID: PAT_TA_32133
agtttnggtgtcgttgttatcccattcccggaagggngtcggtccgttcccngntgcctaacgtcgttgagggagaaaggagcaacttntcagctcnagggagttgntgggtttgtggcggaaccaggtagcaccttacaaggtaaggtcagggaaggtggcattcgtgacggacatccccaagaatgcgtctggcaagatactgaggaaggatcttatcaagctcacgacgtccaaactctgaaatgttgttgatccatcctcctctgcattatcctctgaaatgtcaattgattcatccttgactcttcatcattgtacaattatttctctttcaccctctgtcccaacagccatgagtatctgtaaactgaaggatctctgcagttatgtagtacatgaggtctctgtgtaaattctttctataccacatacgggaacgggagggtgtaccctgcttagttgtacctatgcttgaataactaaatccaaaataattttcgattatgatgcgtaaaaaaaaaaaaaaaaaaa

SEQ ID NO: 32134 - DNA, 1447 bp, Triticum aestivum
  unsure (1)..(1447): unsure at all n locations
  Clone ID: PAT_TA_32134
ggcacctcggcacgacgcgaagctgctggagggggagaagctggagatcgtggacttcacgagctacgtggagaagtcgagcgacccgggccggtacgtgatcttctgggagctgagctccgaggccacagacgatgtcctgagcgggtgcgccaacgccctggacctggcattcctcgacgcgggccacagggcgtcgagggcgtcctggcccggcccgccgcgccggctccggggccgctgcggcggcacgctcggcgagtgcctccgccccgtcctgaccctggcgcgcccggtgggccggttcgagccgccccggtccccgcgcccccccctcggcaggtgacttatgctgttctgccgcagactggttattttgagttcattcctttggagaagcctacaggggaggagacggagaacagtgcagctattcattacatcgagtcggagccggttgggttaactgaagttgaggttggcaaaatctatgaagttgtgctgactacctttgcaggcctatatcgctacagactaggagatgtggtgaagatagcgcgcttccacaactcgacgccggagctccagttcatctgccgcaggagcctggtgctgagcatcaacatcgacaagaacaccgagaaggacctgcagctggctgtcgaggaggcggccaagctgctggaaggggagaagctggagctcgtggacttcacgagctacgtggagaagtcgagtgacccgggccgctatgtgattttctgggagctgagctctgaggccacagacgatgttctgagcgggtgcgctaacgccctggacctggcattcctcgacgcgggctacatggggtcgaggaagatcaagaccatcgggccgctcgagctccgggtcctgcggaagggcacattcagggagatcctgctccacttcctgaccctaggaggcgcggtgagccagttcaagacgccccggttcgtgagcccggccaacggcaaggtgctgcagatactgaaccggaatgtcgccaagagctacttcagcaccgcgtatgggctatgacagaagcaagaataattgcctgctgctagatttagcaggggcgtgtaattacctttctttttctgttcttttccttttttttgctggtaccttttagtagtctcctcaagaaggaaccgtttgttttagtctgttggaataatgttttctttcttatgatcaatctggtgccaaggctactgagctagaatctatgtaaattgccgcagttgtagcgaaaggtatgaaatgaggaaaaagaaagaaaactggtgttgttaanaangaangaaagaaagaaactagtgtnaattgcatgactggtaatgcgtgacanaatgngtcacaccatagtgaatcancatataantttcaanttagtcaaaaagggggcccgtaccaattc

SEQ ID NO: 32135 - DNA, 725 bp, Triticum aestivum
  unsure (1)..(725): unsure at all n locations
  Clone ID: PAT_TA_32135
acctgaggccgccgagcagcccaattcccctggagggaaaattttacctaggcacgccgtgccgatgagctgaggcgtggccgcgttctccccctggctacggcgccaataagcccccgacgcggcggcggaggccgccgcgccggctgcggtggcggggcatgcggcgacgtggacgccgcgctctgcgacgacctgctgcaggaggtgttccgcctgctcccgcccgccgccgggccggccgtctccctcgtctcccgccgctgggtcgcgctcctccgagcctccacgtcccgcctcaccctccgcctgccgccggccttcaccggagcatcggcctccgcggctgcgggtcctctggctgacctgctctcgcgctacccgtatctatccgcgctggccgtcgtctccgcgtcctcggccggtgctcacgacgccgacgcgctcctgctcgcggtgtccgcctcgccgtcggccaccaggctcactacgctgcggttctcggtcggttcgcccgtctcgccccctgcactgcgcgacgtctctggcaccctctccggcgcttcctcgctccacctcgccgncgtcagccccctgtcgttccgttggctcgcctgcttgccctgcctcaaatccttcggcttttcaactccgccggtgcttgcgttgactcggccggttccagctccgatgaagacctcagctgcgagggcgacgccgtaggg

SEQ ID NO: 32136 - DNA, 930 bp, Triticum aestivum
  Clone ID: PAT_TA_32136
cggtcaaacaatcccgggtcgacgaaggttccttacagcacgtacagcatagctcaggtctcctatgagctcaacgtcttgggaacccgaggtcctaggcggatgcgctgtgtaatgcactccatccctgcctcatcgctcgaggctggtggcagtgtcccttgccaaccggatatcatcttctcccgttccctagacgaatctttcagcagcatgccggtctcgaaatcttccgtcatggaccattccatgcgttttagcagtgccagattctccgacgtctcaataggaggtggcccggcgatcagaggacaagccttgagcgacggcgatgatttgaaggacacgccgttgattctccgcaacaaggttccaagatggcatgagcagctgcagtgctggtgcctcaacttccgtggccgcgtgaccatcgcttctgtgaagaacttccagctcaccgcggcgccgagccagcccgcgccgccccccgcaggggcgccgaccccgaccccggccccgtcgcagcccgccccggcgccggagcaggacaagatcatcctgcagttcggcaaggtgtccaaggacatgttcaccatggactaccgctatccgctctcggcgttccaggccttcgcaatgtgcctgagcagcttcgacacgaagctggcctgtgaataaaaccggcgaccggcggaggtcgacgacgacacaggcgcggtcgagggaaggaagcagtagaaccctcatccccccataggacttccattctagatcacggacacgccctttgtttgcttgtaattctgctttgtttgtagcttgttggaactggactcggtagcatgtgatgcttcgcaccatgattgcttcctttgaagctaagtttcgtggatgcggttggttccggatttaacctaaggttccgtcacc

SEQ ID NO: 32137 - DNA, 699 bp, Triticum aestivum
  Clone ID: PAT_TA_32137
atagtctacgacacgcagcccccctacatggggctatagttccttccattggacggagtagccggagattcaactccaagaagtgtctcccaaggtgccatctggtagctacaacatagctcaggtgtcttacgagctaaatgttcttggcacgaggggccctaggcggatgaactgcatcatgcactccataccggcctcgtcggttgagcccggcggcatagtccctgggcagcctgaccagatcatgccccgagctctagaggactcgtttcgcagcatgagctccttctccaagtcatccatcatggaccggtccacggatttcagcagctcccgttatttcagcagctcccggtttttgtccgacatcgccggaggtgcgataagccgcgacgaagacggagagaacaaggagaggccgctggtgctccgcaacaaggtcccgaggtggcacgagcagctgcagtgctggtgcctcaacttccgtggccgcgtgaccatcgcctcggtgaagaacttccagctgatcgcggcgccgagcctgcccgcgccgcagccctctctcactctcggctagaggaagaagaagacacaagacacgagattttccggtcggcgcacgaacgccgccacgggcgcacgaacgcccgaatctttttcctctttgcaatgtctacatggtgctcaactcagtac

SEQ ID NO: 32138 - DNA, 953 bp, Triticum aestivum
  Clone ID: PAT_TA_32138
gccgtccagttcttcgccatctgcctgaccagcttcgacaccaagctggcgtgtgagtaaataaacagattctcagtgcaacatcagccgtcattgagtaccgtctctccgtcgagattccgcgcccgggcctgggaacggaaatgaagggaacgaacgaatgcatcaagtgcatgagcaaaattctctgcaaattgttggttcagtttcagtccccccagtgtgctggttaaagctgttatcaattgggtaaagctggtatcaataggtaggggagatgatgtgcttgttaaagctgttgatagggttaggggctgaaggtgtctgtggttcagggacaggcttccactaaggatgtgattgattgctacctatgcctgtatgatgctgcctctgcctgggactggtatgaaatgtgaagagatgtcgagttacaaggtaatgctagtgatgttgtggtcttgcaaggttgagttgtcctggtctctcagtctcgggcattgtaattgtacctgtgggtgcccagacagcaacatgtagtggaagttactgctgaatgctggactgatgtgaccatggatgtatgaaatcttgattagtcagttgatttgcttgcttgcagaaaaaaaaaaaaaaaaaaacgatcctcaaaaggctgactgtcccccaaattaggtggggactccattctgttgctgggtgtcgctgatgccatcgcgacacccgaaaactgaggaattagaagggttcctcagatttgtgctgctgatttgttgtcactgtacttgatctccattgcttggatccttggcttggcgacggctgtgtacgtgataatgttatgagcaaactccatggggttgttcactgacgatgtatttgccgagtgacctgtacattcataacttggtgtgtttgaaattgaacttggttaaactatgacgcttcattgc

SEQ ID NO: 32139 - DNA, 1319 bp, Triticum aestivum
  Clone ID: PAT_TA_32139
tgggcaccatggggcccgaggcgtatgcagtgcacgatgcattccatcccggcctctgcagtcgacccggatggcgtggtgcctgggcaacaccagcagctgctccctggtccctagcagtccttccgccctgccgggcctggtaagaaacgaacgagctgcctgacctagcgcaggagtccattggctggctccctcgacatccggatgtttccgtttcccgctccccagacgggcccgtcagccgcctgccggttgcaaggcgtgatgcactgcatcttgcccccgttggttgagccaggggctgaaggtgtttggcgttcagagaggggcgtcccatgagcacgagacgcctcccttcgccggtcgacttcagcctcccccttgtcatgctccggaatgtcgatgtaagtggtcaagtcccgcggttgcgctagggacggttcggccttgcactgctgcgtccgcccggtcacatacccgctcgcggcgtttgaggccagcgccatgcgcctggcgcgctgccacaccaacccggtgggtgcatgaatagatggagtgtctgtgacttgagtggccaggccgtgtcggctctccctcggggatccgcgcccagctctgcgtaccaacgcgcgatcctccggccccagcccctgagtcagtgccgctgcgaaacatggggaggccatggataggccagtgggcctgcgcaagaaggtgccgatctggcatgagcagcggcagtgctgtcagagccttctgtcgaggcagggtgacggtgccctccgtgaagaacttccagctgacggcagccgcgccagagttgacggccgctgcgctgccgccgtcggaaccttcgctgccgccccagcagcagcagctccagtcgtcaagttcatcgtcgtcgtcgacgtccgatcacgagaacgtgatcctgcagtttggtaaggttaccaaggacatgttcaccatggactaccggtacccgcctctcggcattccaggcgttcgccatctgcttgaccagcttcgacaccaaactggccctgtgaatgaatagaccagtacagtggcacaagtgtttatgtggataagtccatcaagatctttttctttctcctattgctgttgttgatttacttgtttatttccccgagtgtcaagaatggcaagaaatataaaggtttggtcgttgctatgtttttcatgcctctgaactttactgtacattgtaagtatcagcaaaagatataaacatctttgaataaaaatacgaggccagtcccggtccccatttgcccctggcgcgccctttccaa

SEQ ID NO: 32140 - DNA, 767 bp, Triticum aestivum
  Clone ID: PAT_TA_32140
gtctaactaatttttatagaacgcttcacgagtgagcaggttggtgcttgattctctatgtccgtggcggagacacttggttggcatcaatcaccttgggctccaccctctcgacatcttgtacacaagcctcacccacggcgaccatcaagagcgcaccggatcgacggcgtatgtcatgccctcggcgatggagatctacgaggccggaatccatttcagggtgagcgataccgacagcctcctcgacgtccacttcgaacgtggcaagctaagcatgccggcgatcagggtcgatgacaggaccgagaagaagtttctgaacctgatggcgttcgagcggctccaccccggcgctggcaacgacgtgacggcttacgtgatcttcatggacaacatcatcagctcggccaaagacgtggcgctgctgagatccaaaaacattatcgagtgtgggctgggcagcgacgaggaggtggtcaagctactcaacaacacgctcaacaaagggggagtgatgagcccatctagcaggctacatgatgtgcaacggcgggtgaaggcccaatgcacgatgaggaggaacaagtggcgagccaatttcatacagaggtacctaaggaatccttgggtgtttatctccctcgtagccgccgtcgtcctacttgtggccactctattgcagactgtgtatactgttttgcccttctataagattatttagtaccacctgaatatgccatgtaagctggctaatattgaagcat

SEQ ID NO: 32141 - DNA, 1542 bp, Triticum aestivum
  Clone ID: PAT_TA_32141
cccccccctctcgtcccaatctctcgcccctacgccggggacccccttctctcgccgccccgccgccccgcgagttccgtcgccgctttcgcggcccccccccccgtcggcgaccgccgcctcggcccccgcgcgcccccccccgccccctcccgcccctcctcgcctccgccgtccccctcccccacccccgccccctcccccccggcgcccccgcctcccccacctcccctctccctccccctaccgccgccgccgcttccctggccggccccctccgcccctccgctgcctctcccggccaatacgcgagacgaccccgtgcagttgggttgcggccagctccgggctgagaagtggacctctccagggatatcgggtgttcccaccgtcgctcgaagggatttgttcttattggaaggggggaagaacgcttgattcacttttcagtggcttgaccctggacaaaaaagagtagaaaaggttgattcatttttcggggcttgcccgtggtcagagaatacttgaagatgatctaattgtcttccctgatgaggctgtctttgagaaggtaacagaatcttctggaagggtgtacatcttgaagttcaggcatgatagcaggaaattcttcctatggatgcaggagacaaatgctgatggggactcgcaaatatgccgccaagttaatgcctacataaatcggcccttggatggcgatgcaatttctattgaggcagaaatgtcacacgaggatacagctgatgatgacatctcttccagagctgggaatttagttgatcagagcatgaccgctgatatggctggtgaagtgacttctgccgctggacctgtacgactggctgaccttcagagaatattgagttctatacaaccatctgatgctacggcagatcctgatgctggattgagactaggagacatcttgaagcccgatttgatattgccactaattgaaactttgcccatcgaacagttggcatcacatcttccagagggttcttggactgccggtgatattcttgagctgctgcaaagtcctcctttgcgacagcaactggatgcttttactcatgtgctgcagactggccaaatagatcttgctcaatttggagtggaccctagcaagtataagttcacagttgcctcattcctggaggcattggaagactccgtggcaaaagcttctacagatggaggcaatgattcaaaggccaagaaagatggtggaaatgatcccatggacgagagttgattgcacagcgcacctaggggtgtagcctttatctgagttgctcatgccgtcatgcgcggtggaacttgtcatgttagcaaatctgatggcacacaaagcaaaggacgttttattttgtcaccccctcaaaatctagatgctattttgctgtgaatttttagatactatcagtcgcttccatatgtcccagttgattccatgtcgtgactcgagtattctgatgaaaaatgcttccataggttccagttggtacaaaaaaaaaaaaa

SEQ ID NO: 32142 - DNA, 565 bp, Triticum aestivum
  Clone ID: PAT_TA_32142
ccctctttcagagctcgctcgtccggcagcgcccggtgcctcctttggcgtcgggtgtggctccccttcctacagttgcaattccggcctatacttgacttcctcttctccgactcgtgctctgacggccggcttgggattgctcagaatttggccaggggggaatcctgcattctgtgctggcagcggcgatacttgtggctgtcattcccttcttgaaggcgctgtcatggccgtgatctgtgcccctcttcgagcttcagggggaaaccctaggtccggtttccccgatcggacagtggcggcggcgtcttggtgtcgttctccttcgtgaaggcgttgtcttgtttgctcgcggcgtcctccgtgctgacttcggagatgttggtcgtctggttgctggtcggtgaaagatcgaggatgtcgcctagaggggggggggtgaataggcgctttaaaataattacggtttaggcttgaacaaatgcgaaataaacctagtggttaatttgtcaagcccaaaacctaaaacgactagtctcccctatgtacaccccccccttat

SEQ ID NO: 32143 - DNA, 990 bp, Triticum aestivum
  Clone ID: PAT_TA_32143
tgagagtctactcaggccaatgtgcgcacgtctcggaagaataaagcgtctgcttgtgtgacctccaacaaaaagtcccaaagcaaagcaatctggagtaaggatcgccgccgaagcaatggcgacggcgaggggcaccgagcggcggcggcagggcggggatcgcacccgggccaggctgcgagagaggatcaagtaccgccacgacaggctcgtccaggacgcctgggaggtctccgagctcttcgcgccccacctcgccatcctcgccttccccgcagttggcaaacccctcctcttcggcaaccccaccctcgactccgtcctccgcagtgtcttcctcgacgccgacgccgggaccgagacggcggacgaggccgcggcgcgggtggcggcggtgaggcgtgaggcggggtggatcgaggcgcaggtctcgcacgagcaggcgcggctgcgcgccgtcgcggagaaggtcaaggcggcgcaggaggaacaggggagggcgcactggtgggaggtggatgtggacgcgctccgggaggcagagctccccgagttcgccacggcgctcgatgctctcagggccgacgttctgcggcgcctcgccaagctggccgaagcccggaagccaccgcggcggcagtggtagtggcttcgctgtggggatcggcgcccgggttcgttcattgcttgcctaatcaggtcattgttcgggattgggacagcagtacgtagctgcatatagcaagatgttagtacaactttagcttgaatttttttgttcattgcgtggaaaatcttctcgatgattgaatcggagtatatgcataatcaggaatgacgtggtagaacaagttgttgctccctggagtatggttttattctgaatttttgctgatgcatctgatctgaaggtacaagtatatagttcagagtgtgcttgatctacggcagtccggaagctattgtcgaaattatgtttttctggtc

SEQ ID NO: 32144 - DNA, 894 bp, Triticum aestivum
  Clone ID: PAT_TA_32144
cccacgcgtccgcccacgcgtccgcggacgcgtgggtgaatggggtaattctatctccatactgattcctttctatgttacgggaaggcctactgtgctggttggggattccctttactggctgcttgctgtgggtggaattcttgagattgatttgaagaggcagagtctagctgtgatacaatggccgatggataagggtaaattctcgctgatgcgggcagagggcggtggacttggtctcttctttctatcggaccttggcgcccaattatggaagagaaagactgactgtggtggtgttgcttcatgggagctgggaaaaactttggaactgaacgagttaaagactcggtctgggttaaactccttgacgatagtagggtttgctgaggacaataatgtggtgttcctgtcgagaggttcaacctttttcatggttcagcttgagccattggagctcaaggaactttctgaggtcgacaattggtgtttctattatgcattcgaatctgtctatactgcaggcatgggcatttgcggtggacatggtggagctgaacatctgcacaacgcataagatcatttgtctggatagacgtgctatcatgatggacggagtgagcaggtatcaagacttcaagaggtaccttttggtggctgatatgggagatggcttgttttgtgtaggttcttcggttgcccgtgatgtgtgctccacaaggaatatttaccctctggtgaaatgtgaggcgaactcgtaggaagtaacatgttctggctagtgcccaaccgtgtgaagtgtgaattaatctctcaagctgtgaacttcagtctcttacttgatttatgtaagacaccattccaactgtcgtcaagacagatttaacctgc

SEQ ID NO: 32145 - DNA, 412 bp, Triticum aestivum
  Clone ID: PAT_TA_32145
atggggcggctgcaaaagcaaggctggtcgccggcgggagcgccagccacgcggggttgctcgccggaagcatccgatgcaaggccgctcaccggaagcatctgatgctactgacggcgaccggcgggcggggtgacggcggatgctggtgttgcgaggatgacgaataccctagccaggtcgtttgcatcagcttttcatctcaaagatgtatctcctgttgatccatgtacgctcgaggcttcttacgaattttaattcaatgacgtatataaattggtatgataaaaaaaaaaaaaaaaaataaaaaaaaaaaaaaaaaaaaaaaaaaataaaataaaaaaaaaaaaaaaataaaattaaataaaaaaatttattaaaatattaaataataaaaaaattttgggggggg

SEQ ID NO: 32146 - DNA, 888 bp, Triticum aestivum
  unsure (1)..(888): unsure at all n locations
  Clone ID: PAT_TA_32146
tcgcggccgcgtcgaccctcccttctcttcccttatctccgtccaacgggngaaccccactgtcgcacaagcaagagccgcccccagggcttctgcaagctcgtgccatatccagcaacaaccatgctctgcaagcaaaatccagacatggtgtgtttgacggcaattagctaacggcggcgagaagttgcagcagcggcgagcgttcttgcacgactctctcgtatgaggggtatagcaacaatggggcggctgcaagcaaggctggtcgccgacgggagcgccagccccacgaggttgctcgccggaagcatccgatgcaaggccgctcaccggcgggggcgggagcgccggtgctgcagggccactcgccggaagcgtctgatgctatgacggcgaccggcgggcgtggtcatggcggatgctggtgttgcgaggatgacgaaggatcgtgcgtcgtcttaaatgggccgaggaggtggctgattttttcagcctgtgtattctgttccttttccgttctttatcccatttgcacttctgctttcctttcttcactgaagatgcagccgagtaaggctgtttttcaagggctggccattttccatcttagttgtggcgacgctgcaggttgtgtggatcgtgcgtcgtcttaaatgggccgaggaggtggctgattttttcagcctgtgtattctgttccttttccgttctttatcccatttgcacttctgctntcctttcttcactgaagatgcagccgagtaagggctgtttttcaagggctggccattttccatcttagttgtggcgacgctgcaagttgtgtgcccaatatatatccctattttttttaataataaagcacggattgaatccgtcgggttc

SEQ ID NO: 32147 - DNA, 1413 bp, Triticum aestivum
  unsure (1)..(1413): unsure at all n locations
  Clone ID: PAT_TA_32147
cacgaggccctctccacccacagctgccgattcctctccctctctgctcccgattcagatccaaccctagtccacctccagccacagccgccgcctcctctccctctctactccatccatgcggggttgccatccccacgatctactgcgctgctgtcccaaccatcttccactccacctccgtctcccacccgctatcgctctttcgccgcccccaccctctccccctatgcagccttctcagatccgcgatgggaacacgcggtggtagcagtgctcccgcatccgcgtcaaggtcagccttgtgctcgtcatcatgggcgcggtggtcatgacgaaggtggttgaggttggcgagatggacgttgtcgcctatccactgcccaggaccaaggacggctgccattttaaaagtggcaaattgggaaaacgcacgggctccttctctaatgcgtgctcgcctcgatccgtaatggcgccgccatcgtcggcggagtgtcttcttcttcggccaccatccgccgcccttttctccttcccctccctatccggccttaatcttctccggcgccacccgtagcctcctcaatccccaacctacgctctctgatttggatcgaagttggatttggatcaaagttagagtccgtgtccttctccagcacaaagccatggagagacttggttgccataagaaggaaggagcctcgaccggaatctctatcaggttacatcccttgaacagaatcaacatcgagctctgctgagttcgccggctgaagaagaatatccgtcaagccgtacaatgtcgcctccgctgagttcgtcggaggaacaacatccgacgtctgaacgtgcttcagcagaggtatgcatcccctaaacataatcagttgatagaagcctgtgatacaggttacgtttctgattgctgccaattcggattgctcttgttcagttcattgtttctgaattggccattagatagaagcccctgaaatctgacccaactatgtattggcgagaagaagcccctggttttgtgttatgcaccaagatggcttagcatcaaatgtttcatgtgtcaatttctactttgttttatggaacaattcgtttctgaactggccagtagatagaagcccatgaaatctgacccataatatatatgcagtaatgatttatcttgatagagatgcagtggattcgcaagtagttttagtgtttttttctagaagatagaccaagtacttaagcttccgcaatcatgaaacanaaggtgtcctgcagctgctcaacctaattaagtaacaataatcaaagggaccaatagtcaggttctattattttcacatctattaacctatatcttgatatagatacactgtattcgcaagtagttttagtgttttt

SEQ ID NO: 32148 - DNA, 1104 bp, Triticum aestivum
  Clone ID: PAT_TA_32148
ggcccgccgtgcccttcggcgacctccgctgcaagaagagcctcagcgacatgttccaggtcgagggcatcccgcgcctggtggtgctcgccccgggcggcgccgaggtcgtctgctccgacgccgtcgagctcgtgcaccgctacggtgacccggcgttcccgttcaccccggccagggtggcggagctggaggccgacgagcggagcaagttcgcctcccagacgctggagaagctcttctccgtcggccacgtcaacggcggcgacgaacaggtccccatctcgagcctggtcgggaagacggtggggctctacttctcggcgcacaggtgcgagccgtgcgtcaagttcaccgcgaggctggccgccatatacggcaatctgaagggcaagtcggcggagttcgaggtggtgtacatccccatggacaaggaggaggatgggtacgagcggtcgcgcggcgacatgccgtggctggcgctgccctacgacggcgaaggcgtgccgtcgcgggcgctggccaggtacttcgacgtgcgggagatcccgacgctggtggtgatcgggcccgacggcaagacggtgacgagggacgggaggaacctggtgaacctctacttcgacatggcgttcccgttcacggacgcgcaggtcaggctgctgcaggagcccgaggacgagccggccaaggggtacccgccgtcgctgcgccacgccgggacaccggcacgagctcagcgtcgtctcggacaagtccggcggagggccctacgtctgctgcgagtgcgacgagcaggggctcggctgggcgtaccagtgcatcgcctgcggctacgagatacacctccggtgcggccgggacgcggagggcggcggcgccggggctgctgggcggcggcccggtgtccgcgtcagccctattttccatctagccggctgctggctgtccgggctcggggctatgtctggtccctactgtccggccccttgctcgttctaggccggtcctgaagtgcccggtgtggtctggctcggccctcctcggatgatagtagaatagacgagaaatgcgcagtgtagcttggttacggctggctggctg

SEQ ID NO: 32149 - DNA, 1097 bp, Triticum aestivum
  unsure (1)..(1097): unsure at all n locations
  Clone ID: PAT_TA_32149
ttattgatgagatntnggaaattgttggtacaaaaagtgaataaaagatcctgaatataattactattgcctgtcaaatgaatatgtatacaaaacctctgcgcgtacgacacttccatgcacgatctctgcccgacataataaatccagtgaagtgccgtaattctgctctaatcatggatgattggatgtgcagcatcgtacactactcggacgtctcgtatgcatagcgggctcaattgtagcttgttatagcaaaataaatgccgaaaagtgccattatccaaaacaaaccagtcgacgctgaaggaaccatccacggtggctttattgtactgcgttgaaacagcatgattgaggccagtcttgaaacaccaactctagacagcatagctggtgcacaacgaatggccttggatgcaagggtgctgatgtaagtgtaggctagaatactggcacctgcagcagaaatggcataatacgcagttcccctgggtatcaccaggaagagtgctagagccacggtacacatcacagacagggccgcaatacccaggaaaaactttccactaaccaggtttttcaggcgtgtagagccatccgacatggcaaaaccagcacgcacacagaaaaatgtggccgttgcagagcaaacaaatgtggcggtgtcgatcgtcacaaagatttggaacaaaaatccatttaaatccagtttgtccttgtggctgagtacattaaagggcgccaggagtgctgcattgaaaatgagcaccgcgcacacggtcagcatggatgctgacttgcccactttttttgattccttctcccagtctggtttaaccacatttctggtaagatggtcccaattaaagataccaaaatcgccaccgccttgtaacaggaggaaaaatatccattccttaaaccccttggagctcacttccaggtgacggctcaagaaagccaaatcgaggggcgtgtaaccctccttgttcgccaaattgaggagaacacgcatgttcgccattaaactgtagaagatatcctcacttgcattatttacggccagatgaagggctgtatttccatcctgatcc

SEQ ID NO: 32150 - DNA, 639 bp, Triticum aestivum
  Clone ID: PAT_TA_32150
gcacaacaagatgtagcaaaatttcgtttcatttcattgatcaaagcatatttgtaatcactcaattcatagttttgaacattccaatggcaggactgacaggactgaccgtcgaacaatcatacatatgttgtcaactctccgcttcgatggcaggggctaggtcaacctaggttctaggggaggaggccatcatacccagtgccagttcctaaaaggcatccgaggaggtcggagaggcttgcctcaagcaggagcctagggacgttgtcccatgcccggcaacgccagccactgcagcacctcgcttgacaactcaacattctttaaacagcctttccaaagcacgaaacttgcagattgccacccatcttcagtcacacttgagaccagagagactgaaactggaggcgctgggatagacctcatcttcctggaggtaagagttattcaagagctcacttgcaggaagtctttcatctacaggagatagttgctttcgaagagcaaaaagtttaacacaacaggagtccagcatcgaatacaaatagtagctacatttgttcagaacaaagaatgtagcattcaaagcttagttgccctttcctcagttaaacaatacgtgctagcttgcttgat

SEQ ID NO: 32151 - DNA, 872 bp, Triticum aestivum
  unsure (1)..(872): unsure at all n locations
  Clone ID: PAT_TA_32151
cccgaaacagcgccttcttgttgccatgctttcggaccagaagtttatttcaaattacctgaaagttaacagagagaggctgcgcaaggcgtacaatctgctcgttgatgctttgaaacaggtgggcatcgagtgcttcaagagcagcggagggttctactgctgggcagacatgagcaagttcatccggtcttacagcgagaaaggggaacgcagtctttgggacaggctgttggaggaggcgaatgtcaatgtcaccccaggttcatcttgccattgcatttgattagcgtggtcgcggcccaggttcacaacgttgagggagcaggatattcctgtggtggtggaaaggctcaggagggtcacagatggccacaaatcaaaccgctgaaacgcctagagaactccttttgggcctgtagggtgtcaagaaataactgcttcgccaggtgcttcgaagaaaacgcaggaacacacagggaaaaaatgcctacctgttccgataagagggattccgtcttggcatctaccattggggtaggtttgaaactgacaattgttggaaacagtcatgcctttggtggtgggacaaagaacagggatcatgttcatattgggccatgtcctctctgttcctgttgaatccaagcacggnagctcctccggaagggtgtaattgtggtcgatcctcatccgcctccctgtaggtgtcaaaaggcgggnaaattgcccgtcctatggtaaggcgtggggccagtctcctgttcttncgcctggnaaaacctgttanccnctttttttgggcaattttgtctttggnaaanaagtaangngaggaatcagttctccgtnntgcancggaaaanaancag

SEQ ID NO: 32152 - DNA, 1729 bp, Triticum aestivum
  unsure (1)..(1729): unsure at all n locations
  Clone ID: PAT_TA_32152
atgggcctagcagagaaccacctgtccctggatttggtgagggaatggatggaggagcacgcggggccggcgatgacgccggcgcgaggcgacgaggagagggacctcaccatcagcgggctcgccacgtaccagccatacgacgggatacttgccttgaagatggctcttgctggatttatgaggcaaataatgcatgagtcagtatcctttgatccatctcaaatggtgataacatctggtgcgacgcctgcaatggaaatactgagctcctgtattgctgatccaggaaatgcatttcttgttccgtcaccatactaccctgggtgggacagggacataaaatggcgaactggtattgagttgatacccgttccttgccgtagcaccgacaactttaacatcagtatcactgctctagaaatagcctataaccaggcaaagaagcgaggagtaagggttcgtggggttctcatatctaatccttccaaccctacaggaagctttgttcccaagcaaacactgcgtgatcttctagactttgctactgagaagaacatccacttgatttctgacgaagtatttgctggctcaacatttggaagtggtgaatttgtcagtgtggcagaggttgtgaacgagctagaagactttgacagaggcagggttcacataatctacgggctctcaaaagacctatctcttgcagggtttcgagtcggagtcatatattcgtataacgaaagcattgtggaggcagccgccaagattgccagattctcatctgtgtcgaccccgacccagcgccttcttgttgccatgctttcggaccagaagtttatttcaaattacctgaaagttaacagagagaggctgcgcaaggcgtacaatctgctcgttgatgctttgaagcaggtgggcatcgagtgcttcaagagcagcggagggttctactgctgggcagacatgagcaagttcatccggtcttacagcgagaaaggagagcgcaggctttgggacaggctgttggaggaggcgaaggtcaatgtcaccccaggttcatcttgccattgcattgagccgggttggtttaggtgctgtttcacaacgttgagggagcgggatattcctgtggtggtggaaaggctcaggagggtcacagctagccacaaatcaaaccgctgaaacgcctagagaactcctttcgggcctgtagggtgtcaagaaataactgcttcgccaggtgcttcgaggaaaacgcaggagcacacagggaaaaaatgccttaacctgacctgttccgatcagagtgattccgtcttggcatctaccattgggggaggtttgaaactgacagttgtggaaacagtcatgtctttgggtggtggaactaagaacagggatcttgttcatacccatcatgtcctccctgttcccgttcgaacccaagcgcgggcagctctttgggaaggttgtaattgtgtcggattctcnatcttgcttccccgtaggtgtcacaggcggtaaaattgtccgtctccatggtaggcgtgggtcaaatcttgtgttcattcacccgttcaatcctgttatcttcctttttggcaattttgttctttgggtaacataagttagtgtcgaggaatccggtttctgccgttcttgtcatctgtaaagtatccagtttggaattcaggttcttcctccttttgcaactcggttctttggt

SEQ ID NO: 32153 - DNA, 569 bp, Triticum aestivum
  Clone ID: PAT_TA_32153
ccgtcggatccaaggccgcgcacacgtccgcgggcagcaagaagatcgtgggcgtgttctaccaggccggcgagtacgccgacaagaaccccaacttcgtcggctgtgttgagggggccctcggcatacgcgactggctcgagtccaaggggcatcactacattgtcaccgacgacaaggaggggttgaacagcgagctggagaagcacattgaagacatgcatgttctgataaccaccccattccacccagcctatgttactgcagagaggatcaagaaggcaaagaaccttgagctgcttctcactgctgggattggatcggaccatattgatttgccagctgctgctgctgcaggcttgacagtggcagaggtcactggaagtaacactgtctctgtggcagaagatgagctcatgcgcatcttgattctgctcaggaacttcttgcctggctaccaacaggtcgttaaaggtgaatggaatgttgcaggcattgcccatagggcttatgatcttgaggggaagaccgtcggaacttgcggggcatggttgtaatggcaggctttt

SEQ ID NO: 32154 - DNA, 543 bp, Triticum aestivum
  Clone ID: PAT_TA_32154
cccacgcgtccggaaaggtgtaatcatcgtgaataacgctcggggagcaatcatggatacccaagcagttgctgatgcttgctccagcggtcacattgctggatatggaggtgatgtctggttcccccaacccgcacccaaggatcacccatggcgctacatgcctaatcacgcaatgacccctcacatctctgggactacaattgatgcacagctgaggtacgcggctggagtgaaggacatgttggataggtacttcaagggcgaggacttccccgcggagaactacatcgtcaaggaaggcgagctcgccagccagtacaagtagtaacccaaccctcggcgctgcatggtaacatatctgaagcgaggtgcgagagaagaaaccattgtgttgttgtatgagtgttctctgagaatggaaataatggatgtctgcgtggggttgcgaccataattcagaggacatcgtcaattacctcttattgaaagaaccatgtgatgtttgatggcttgctatatatgtgatggttgatggcttct

SEQ ID NO: 32155 - DNA, 1554 bp, Triticum aestivum
  unsure (1)..(1554): unsure at all n locations
  Clone ID: PAT_TA_32155
cgtccgccatcacgcgacgttcctcgcctccaccgcctcccctcttttcctcgctcgccgttccccgtgaagcgtgaagggagattgctcctccctccgccgggatctctccgtctccatggccgcgatgtgcaggggcagcgccgcggcgaggcagctcgtggaccgggccgtcggatccacgcgccccgcacacgtctgcaggcagacaaggaagatcgtgggcgtgttctgccaggcctgggcgacgaacagccgacaagaaccccaacttcgtcggctgcgttgagtgcgccctcggcacacgcgacaggcctagaggtacaagggcacatccctacatgggtcggccggacgacaacggagagccgtagaacaagcgaggctaggtacaaatcatcatttcgaaccacattgccctggtcctggtaacccaagccccgattccaaaccgcacctatgtttctgcctagatgatcaaagaatgggattggacctcgagctgcttctcacagctggggattggctcggaccatattcgatttgccagctgctgctgctgcaggcttgacagtggcggaggttactggaagtaacactgtctctgtggcagaagatgagctcatgcgcatcttgattctggctcaggaacttcttgcctggctatcaacaggttgttaaaggttgaatgggaatgttgcaggcattgcccatagggcttatgatcttgatggggaaagtccgtcggaagcgtcggggccaggtacgtcttggcaggctacttacttagaggcgccataacgcccttcaactgcaagcaagactctgcgacgtagacagaagatcacgtagctaccctgcttccatgagtgtgaagtcattttgatcaacatatcatctagatgagaaaagctatggtcacaaactataatgtcattgagatcaaagaacctcttactgataaaactagaggcatgttgaacaaagaaagattgctaaaaatcaagaaaggttgtaatgctccgtgcagaacgctcattgctggaatatggaggtgatgtcgcggttcccccaacccgctcccagcggtcacactgctggcataaggaggtgatatctggttaccccaccccgcacccgaaggatcacccatggagctacatgccaagtcacgggatggaccgacacatcattgggaatagaaacgtcgaggacctgagctacgcggctgaaatcaacatagatgttgaatacgtactcgcaagcgagtagaattcccaacccagcactacaccctgcaggaaaacgtgttggaaggcaagtgcgagaaaaggaaccattgtgttgttgtgtgatgtgtggcaactgagatgaagaatgatgggatggaataaacgagtttgttgttatatgaatgttctcatagaacggaaataatggatgtctgcctgggattgcgaccatggcagtgaataaaaaagctttgggatcaaaataacaaaaaaatgtgtgttgtgcaattttccgttactactttgntcnaaaaaaaaaaaa

SEQ ID NO: 32156 - DNA, 1148 bp, Triticum aestivum
  Clone ID: PAT_TA_32156
gctagactcacaactttggttttcaggcatcttcaccaacaaatattaccctgcaaatcaaggactttagagcctggtcgcagacctcacggagcaccaacgatagcctcaaggtgattcagcagagcaaggtgatgagtactcagctggctggccaatatcaatgatcttatcggccggcaaagcggagacggacgaccacggtcccgaccttgccagcaggcggagacaataaatgggatcaagggaagttggtcgggctccagcggcacatgcttaccactgctgactgttgccgggaaaggtatgttggtttgattctttcaagatcccaaactaaaacaagtcacctgtgacatttgaatgatgcaaaggtttgttgtctcttcccaagaaattgtgtgcagagaagctgccttgattttacatgctgaacctatttttgcataatcaaacactgacgataagagagatgaatgtgcagtatgctaaatttgggtatccaattgcaaaagaattggattattatttacattagaagccaggttatcactatgtattttaaattgatcgctcatggaccgctcaattggccataaacacaacataattcgatccctcccttcaaattggcaactaaagggaaggtgagttaaaatgtctcagcccctgtgacctggctggttatgtttatattacatccaatattgcgcgtgcgcgtgtgagcgagggtgatcttgtctcgcgtgttttttttgtcacgaacaaatcgatgaaccggcggttcaaccggtgacagacgcaacggttcagttgcccgttcggttttaaaaaatatagtccgatggccatggtggaagaacacgacatgaaggacgaggagacatgagcatccggtggcagtgcttcgcactttgagcagtagggatacttgatcatagggaaagggaagggagatgagttcgtgcttgcatgatttttagggaaagagcgtgtgtattgtacttctatgtgcatgaagtgttttgtttgggccaagcccaaataatgaaaataaaacactatctctaaaactattcaaatccttttgcatttattatcttctgcaaaaaaaggggaaacaaacaatcgacgagaggggcgagctc

SEQ ID NO: 32157 - DNA, 1221 bp, Triticum aestivum
  Clone ID: PAT_TA_32157
gaattcggcacgagcatacgaagagcagtcagatttagtatggcagttcttatgcaacattcctgtaaatatgctggcagagttccttccgtggctctcagcccctgtttcatctgacgagcatcaggatattcgtaactgtttatgtaaaatagttcctgaagagaaacttcttaaacaggttgtattcacttggatcgaagggaaagcaacaagagaagtggcacagagtgttgtcagtgataatttggaaagaagtcattgttgcaaggatgcttcctttgttaatcaagcggagaaacttatttatccacttgaacagtctaaagttgggcatataaagtatacagaatctaatgattgtcaggctgacaggcaccccatagatgagattttatattggcataatgctatccgtaaagaattaaatgatatagcagaggagacaagaaggatgcagcagtctggagattttgctgatatatcagccttcaatgcgagacttcagtttattgcagatgtgtgcatcttccacagtatcgccgaggatcaggttgtatttcctgcagtcaatagtgagctgtccttcgtgctggagcatgctgaagaagagcgtcgatttaacaattttagatgcttaattcagcaaatccaaatggcaggagcaaaatcaactgcagcagagttttactctgaattgtgttcacatgctgatcagataatggaggcaattgagaaacacttctgtaacgaagaaaccaaggtgcttccccaagctagggttcttttctctcctgagaagcaaagggaacttctatatagaggtctttgtgtcatgccattgaagctattggaacgtgttctaccatggttggtgtcaaaactgagcgatgaggaggcatcttcttttcttcagaatatgcgcttggcagcaccatcatctgacaccgcattggtcactcttttctctggttgggcatgcaaggctcgctcagaggataaatccaattctggagaatatatatgcttaacatcaggggcagcaagatgcctgttggatgatgtagaagagctgaaaaagtgtcaatcattctgcccatgtgcttcacgtatcagtgcagatgttgctcttcatctggaaaatgaaaatggttctaggccaggcaagcgaggaaatgatgcagaatctgttcctggtacctgcccgggcggccgctcgaa

SEQ ID NO: 32158 - DNA, 519 bp, Triticum aestivum
  Clone ID: PAT_TA_32158
aaagagtctgaaagtagtgccaagcactggtgtgatcacattctcggctgggttgtcggcataactccgaatagccttctcaaacacactgacgcgatttgggcagggtgttcttctcggtgcctcagccctaatccccagcctctccggccctccaggcggggcgccctcctgcgcgcccgcgctatccaccgctcctggctgctacacctgctgctcttccaccgtagcacctcccctcagcccaggcgctacagcggccggcaccattgcaccaagctctctcctagttcctcaaggacactggatctgccgcttggatgcatcggaaactccatggtggatcgccgccggcgctcttctctctccgccgaagactcccctgtttccaaatgagcaccgctctgggcaaagaacactctggatcctgcaatcaatttgtctgcctgtccccacccgacggaaaagctaacttccagggccatggaccaggcggggacacgcgattcggacgcgtgg

SEQ ID NO: 32159 - DNA, 647 bp, Triticum aestivum
  Clone ID: PAT_TA_32159
aggattttaatcatgcagcacaaatttttgagcatcagaactgcctcgccatcacaatggcagagtatagaacaacacatatctaagaaagcacaatgcataaacaaatatccattgaaattgaacaggcacttctcatcaacacgatctgacatgatgacatgcattataccaagcaactcacagtcggataacatctgtagaaatcactaaagatgacatcgcatgattattttgtcgcatttttgcaagttgatgctgatatttggcagtacaagtttgtttcagccacactgactgcctagcatttacggcatcaccaggcatggcaagagattgagcaccctgcatgagtaagttgtgcttcacgatgacgaagaacatgacctaggtacctgcacaggcggttgtaaacttcatcagcggagccaattttagctactcgttaggcaaaaaaatcagcaaaaacatatctgcaagttcaaacaacactaggagaacagtttctaccagttaaacatgttctcgcatttctttgcccatctcagtataaaaatgacttacagcagaccatagaaccataggctgccagaggtgaatactgtactccatagatacatgtcgccaccacttccggcgcaagaaac

SEQ ID NO: 32160 - DNA, 547 bp, Triticum aestivum
  Clone ID: PAT_TA_32160
aaggcaaccttagtccaaaaaacattctgggtaaaatatggaaacagtaccaaatactgaatagcatttacaaacacaaatctaaatacccgacgaacatatatcccataacatggccattacttactcatattatgaataaactgtaatgtgctgcacatttacgctctactatatgctacaaaatcagctcatttttttcaacatagatatgaacagtgcaagcacggatctaacggaatcctgaaggtggaagtttcaaatttatagcataacaggcttcagatccttgacaacattgacatagctggcttgtcagtgaaccaggtcatctctccgtcttgcggctcaaccatctcaacgggcagcaaatctgatgaactttcattgcctgaaagcgctttgtgaactgcaccagctttcccagcaccagtgaccataagtgcgatatgtgccgacgaattgatcacagggaatgtgaatgttattctctctggtggtggctttggagaatccttgacacaggtgaccaacttctggttttcgt

SEQ ID NO: 32161 - DNA, 792 bp, Triticum aestivum
  Clone ID: PAT_TA_32161
cggcgacgtcgtgctcctccgctccgacctttccatcctccgtggtccccacttcctcaatgaccgcatcatcgccttctacctcgcccacctatccgccgccttcgaaggcgacgacgacggcgacctcctcctcctgccgccctccataccctacctcctgtcgaatctcccggacccggactccgtcgccgccgtcgctgagccgctccgccttgcctcccgcagcctcgtcctcctccccgtcaacgacaaccccgacgcctcggtcgccgaaggcggctcccactggaccctcctcgtcctcgacgccacaaacggcgcctcccgcccgcgcttcgtccaccacgacagcctcggcgtcctcaactccgacgccgcgcgccagctcgccgccgtgctccgcccgctgctccccggtgccgcctacggggccctgctcgtcgagggccctaccccgatgcaggccaacggacacgactgcggcgtctacgtcattgcattggccagggctatctgtaactggtggagggaccgtcgagggcagcagcaggagggtggagcagattggttcgacactgtgaggaaggaggtggacgccgaaagcgtcaaggcaatgagggccgagctgctgcacctgatcgctcgcctcatccaagacaaggaggatgagaagaagaacaaggccggtgagggccgcaaggaagattgacctcttacttggtcagtgttcccagttctgtagcagcttgccttagtgttgcctgttatgttttggaccgatgatttcgt

SEQ ID NO: 32162 - DNA, 763 bp, Triticum aestivum
  Clone ID: PAT_TA_32162
ggccgcgtccgccgggcgtccgggaagcgccgccattctcccccttccccttttcctcaccgccgcaggagaagaagcagacgcgcggaggagagcttccaggcggcgaccatggtgaacgttccaaagaccaagaagacctactgcaagaacaaggagtgcaagaagcacaccctccacaaggttacacaatacaagaaaggcaaggatagtctttctgctcagggcaagcgtcgttatgaccgcaaacagtcaggatatggtggccagacaaagcctgttttccacaagaaggccaagacaacaaagaagattgtgctgaagctgcagtgccagagctgcaagcattactcgcaacgcgccatcaagaggtgcaagcacttcgaaatcggtggagacaagaagggcaagggaacctctctcttctaagctgatgatacccctgttatgttcagagtgttgtgccagaacttcccactcgaacaatgtattatctcgttaatttctgggtataactctatgggctatggagcatatgttttgcctttgtgtcaagtgtcaactactctcgtcagatccatgagacaagtaaaatgttctttatggcctgagttcgttatgcgtgttcttgatcttactaggattgtatatgtttctggttttacgtttcaaacgtgtgctccctctgtctcaaaatttatgttaggattttagctttgaatcatatgaagtgctttcaaaatagtaatttgttagttgttac

SEQ ID NO: 32163 - DNA, 774 bp, Triticum aestivum
  unsure (1)..(774): unsure at all n locations
  Clone ID: PAT_TA_32163
ggccgctcgannggccggccgggctgcgaaaaaaaaaaaaaaaaaaaaaaaaaaaattaaaaaaaaaaaaaaaaaaaaaaaaaaaaagctttcggcggcggcggcgcactcctcgcgttctcacccaggggcgcactcctcctcctccactcgccgtcgtcgtcgcggatcctccgccgcttccgcagacatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacaacgcgctatcaagaggtgcaagcactttgaaatcggtggagacaagaagggcaagggaacatctctcttctaagctgatggtatcctgttatgtttaggatgttgtgccagaacttcccacaagaagaatgtattatctttaattttctggttataaccctatgggctatggagcatatgttttgctattgtgtcaactactttctccagatctaatcgacaagtaaaatgttgtttatgctcggagtgcggtatctttgttcttggtctgattagaattgctgtcgcagtgtatgctcatgatgggatgaatgccctttgtttttagttctcctgtct

SEQ ID NO: 32164 - DNA, 783 bp, Triticum aestivum
  unsure (1)..(783): unsure at all n locations
  Clone ID: PAT_TA_32164
ggccggganttacacccaagcgccgccattctcccctcacccaatttccgccactcccccccttccccctttcctcaccgccgcccgcaggagaagaagcagacgcgcggaggagagcttccaggcggcgaccatggtgaacgttccaaagaccaagaagacctactgcaagaacaaggagtgcaagaagcacaccctccacaaggttacgcagtacaagaaaggcaaggacagtctttctgctcagggaaagcgtcgttatgaccgcaagcagtcaggatatggtggccagacaaagcctgttttccacaagaaggccaagacaacaaagaagattgtgctgaagctgcagtgccagagctgcaagcattactcgcaacgcgctatcaagaggtgcaagcactttgaaatcggtggagacaagaagggcaagggaacctctctcttctaagctgatgatatccctgttttgttcagtgttgtgccagaacttcccactcgaacaatgtattagtatcatattggtattctgggtataactgtatgggctatggagcatatgttttgcctttcctgtcaacgactctcttcagatccttgagacaagtaaaaatgttctttctgcttttgagttcgttatgtttgttcttgatcccattaggactgtatatgtttctggttttacactttgattgtgtattctctctgtttcaaaagtaatgtttagatttaaaaaaaggcctagctntgaatgtggtttaatagtattttgttagttgttac

SEQ ID NO: 32165 - DNA, 1163 bp, Triticum aestivum
  unsure (1)..(1163): unsure at all n locations
  Clone ID: PAT_TA_32165
cccacgcgtccgcccacgcgtccgcggacgcgtgtgggttcagctttcggcggcggcggcgcactcctcgtgttctcacccaggcgcgcactcctcctcctcgccgtcgtcgtctcggatccaccgccgcttccgcagccatggtgaacgttccgaagaccaagaccgcgctcccactccccctcctcgcccgcgcgctccccgaggcagcctcgcgtcccgccgccgggcgcgcagtcctgcctcctgaacccgccaccgccaacacagaccgtcagcagcaacaagagccacaagcaccgcaccgacgaacaagatacacaacgaaaagacggtatggatcatgtgacgccccgtcgtgaaggccaccaggtgccagaaaagcacggatagtcttgccgctatcgcgcagccttgctacgagcaaaagaaggctcggtacgaaggaccgcagccagagccttgaagaataactcgccgagctagcaagacctactgcaagaacaaggagtgcaagaagcacaccctccacaaggttacccagtacaagaaaggcaagggatagcactttttgctccgaggggaagcgtcattatgaccgcaagcagtctggatattccagaccaataataaagcctgtttctctacaagaaaggcgaaatacaacaaagaagattgtgctagaagttgcagtggccgaggttcctgcaagcattactcaccaacgcgctatcaaagaggtgcaagcactttgaaatcggtggaagacaagaagggcaagggaacatctctcttctaagctgatggtatcctgttatgtttaggatgttgtgccagaacttcccacaagaagaatgtattatctttaattttctggttataaccctatgggctatggagcatatgttttgctattgtgtcaactactttctccagatctaatcgacaagtaaaatgttgtttatgctaaaaaaatactttaaccatccgtaagaaaaaccgtcatgaaattttgaaaataggtctgctaagaattgctgtcgtacttatgcttatgatgcgctgactgcccttcgttttcnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 32166 - DNA, 1022 bp, Triticum aestivum
  Clone ID: PAT_TA_32166
cgtccggccaaacgcccaacaccacctcgtgacttcgtccgcagaccttccctcgcgcttcgactcccactccgatctccggccatggccgcggcgcgccccggatcccctgcccccagacggctgcccccctccacgctcctcctcctggccgccgtcctcctcgcggcctcgccgccggcgcgcgccctccggttcgacctcgagtccggccacaccaagtgcatctccgacgagatcaaggtcgactctatggccgtcggcaagtacagcgtggtcgcccccgaccccagctaccccgacgcacagctccccgagtcgcaccgcgtctccctcagggtgacgtcgccgtacgggaacagcatgcactactccgagaacgtgcagtcggggcacttcgccttcacggcggtggaggccggggactacctggcctgcttctgggcgcctgaccacaagccacccgtcaccgtcaccttcgagttcgactggaagagcggcgtcacggccaaggactggtccaacgtcgccaagaagggcaaggtcgatatgatggaactagagctgaagaagctagaggataccatcaaatctattcatgaggaaatgttttatctacgtgaaagggaggaggaaatgcagaacatcaacaggcagacgaactcgaggatggggtggctgagtttcctctcactcggcatctgcttatccgtggcagggctgcagctgtggcatctgaagacctttttcgagagaaagaagctgctgtagtttcccccatgatcacaaacaaatcgttgcgaattagggtatattgtttctgccagctgttaacctatgtttccaagcgaatactcgaaccatcagtaagaaagaaaccgtcgatcatcatacttgtgaaatgcctttctgtgccctatcttctgcccgatcaaatacagttgtaaaatgtttccccttttttcttgaacagggctgaaatgtttctgttgatggtttcatatgatgtaacgtagtgcgac

SEQ ID NO: 32167 - DNA, 1100 bp, Triticum aestivum
  Clone ID: PAT_TA_32167
aaggtaaatgatgttagcagagagcaccggaaggcaagttttacaagaaacatcaaagaagcagaacatttgatttcattcatgcccaatctcgccaactatcgttgcatcaacagaattttacacttggattcagacataagccctgagcatcatgacacatatgcacatccggtgcatgatgaacattattgctgtggtgtttacaacaacaggccaattacgcccaccatcaacatacatgggttgctgccaaaccagttcttcagacttgatacaacaaacaggcagagaatcacagggctgatgatttcatcgcagagggatccactgattcttcccttttttcccctttcgataacacgcacgagagatccacctgttctgttcgaattgtgccatggtacagaataattccttactcctgctctggttgcgctgatgggacgagcggctgatgttcatcagcaccacttgatattctgtccatgccacacaactcgggggattttataagcacaaatggtgatttgtgtagagcagcgaaggccttgtttccttcaccattgctccctaaacaaatggcatcaccccggccgtgccagacaccacactggcctgcattctgccacagggttctccccgcccggctcagggggcgaccacggccttccagacggccatcactccccccgagactgccctctgtcccccggatattgaactgtttcctgattcttcttcggaagtaaccggtgtagattgctcccacgtgtacagatccatgtcccctatagagatatacatgatgccttgttacggaaaaggcaactaagctgaccagaacagcaactaatgaaatgaagtaagccattgcctgaaggaagcaagatccgagattggctctccgcgtgttcttgccaaacctatagcatgggcaacaggcggcctcgagcgccctccgcccgtcctcctagcaatcaatcacgacgtccccctcccacatcctctgcacccctcctccgccggcgctctcggcgccgcccgagcacgccgccaccgcctcatgccggcgcccttcctcctctccgccgacatgc

SEQ ID NO: 32168 - DNA, 823 bp, Triticum aestivum
  unsure (1)..(823): unsure at all n locations
  Clone ID: PAT_TA_32168
tcccacgcgtccgtatcagcacataactctaccgagagcagagcacaggcaaatcaacaccggcgactctcgccggtaaagcagaaagaagaaaagcaaaggtaaagagagatgcctcgtggtctcctatccttcttcctgcaactccttcgggccggcaaccgtcatcgtcaggttcgccaccgttaccacggcatcggcggacttcagagggcgtcgccatggtcttagacttggcgcccgagatcttggcgctcgccacagtgctggaccctctggtgctccgcctgaaccggctatgccggaccgctccgatgttacaggcggacgaggtcttggagcccgaggtcgatgcaatcgacgtcgacgccgccggcgttgagccggatcttgcggctccttcaccaccgcccccgtgcccgatgcaccgctgggggccatgcccgaccccgccgttgtctcctccgcaggactacgaggtccaggaggaggtcgagcccccgccaccaacgctgcccgcggagcccgcacagacggactcgccgcgccttccgtcgccgactccggcgcacgaggcagtggccgctggggcttctgcggcaagcttcgggctggggatgcacatgccctcgccggttggtgcgcgcgccatgaacatggacgccggcgcctcttcgtcgagcgcgagcctcgggctgcgcctccccacgccgctgttgcgcgccgggacgtcttcgacacggagccggcagctcctnccggtcatcggcgcccccgcgctgcacatagcgccgcgcgctgtcctgcacgcgcccgtcgtcgg

SEQ ID NO: 32169 - DNA, 1013 bp, Triticum aestivum
  unsure (1)..(1013): unsure at all n locations
  Clone ID: PAT_TA_32169
gctactgcaggattactcaccacctcggcgcccctattcacccacgaatccacctacagctcattctgcatagccaacccaacaaaccaagcaacacaaatccgcaccctcccctcctctggatttaaacaacgcaacataccaagcaagacaaatccgattcattcccctcccaagctccaatcccgcgaattctcaagcgtggtcgtcatcatcatcacccagcatgatccgtttcatcctgttgcagaatcggcaggggaagacgcggctggccaagtactacgtcccgctcgaggactcagagaagcacaaggttgaatatgaggtgcatcggctggtcgtcaacagggaccccaagttcactaacttcgttgagttccgtacgcacaaagttatctacaggagatatgcaggactatttttctcaatatgtgtagatatcacggataatgagttggtatacttggaatgtatccacttatttgtggagatattggaccatttcttcagcaacgtgtgtgaacttgatttagtatttaacttccacaaggtttacttgatattggatgagtttattctcgctggagagttgcaagaaacaagcaaaaaggcgattatagagagaatgggtgaacttgagaagctggattaagaagaaactgtgtcgccagcgtgcatggggagataactaaacgcaaaagcaaaacccattccttctgccatgtcgaagaattttctccgtttgtacaattctgttgtagctgttattatgattacccctggttcaccaactttatggctgccttctagaaatggctgctttctagaaaaaaacattatgatggttgcttggtggggttcgttgtggatcgttctgtaactaggtgccgtggaattccttgccatcttcacgcatttcattagcaatcatgatggcagtcttttctccaataaaaaaaaaaaaactcgagggggggcccggtacccaattcgccctnctagtgantcgt

SEQ ID NO: 32170 - DNA, 1602 bp, Triticum aestivum
  unsure (1)..(1602): unsure at all n locations
  Clone ID: PAT_TA_32170
gcacgagaggcagggagggagcgaaggccaaggcactcacacacagcagtgcaatggccgccgaggcactcccgcgggccgccgcgccggcgcgccggccgtccgtggccgccgcttccgcctcgcgcctcctcctcggccaccgccccttcctcgcgccgtccgcgtcccgcttcgccgccgggcgcgccgcggtggccggcccggccgccagcctccgcccgcgcccgcgcaggccgcgcctctcggtcgtcgccatggccggcaatgatcgccaagtgcctttggaggattaccgcaatattggtattatggctcatatagatgctgggaaaacaacaactacagagcgcattctgtattacactggaaggaactacaaaattggtgaggttcatgagggaacagccacaatggattggatggagcaagaacaggagagaggaataaccattacatctgcagcaacaactgccgtctgggacaagcatagaattaacattattgacactcctgggcacgtcgatttcactcttgaggttgaacgtgctctcagggtgttggatggtgccatatgtctctttgacagtgtcgctggggtagagccacaatctgaaactgtgtggcgccaagcagataagtacggagttccaagaatatgttttgtaaacaaaatggatcgccttggagctaacttctttagaactagggacatgatagtggcaaatttgggtgcaaaacctttggtgatacagttgccgattggttcagaggacaatttccaaggagttgttgatctaataagaatgaagctattgtatggacaggggaggaactcggtgcacaattttcataccaagacatacctgctgatctcgaagagttggctcaagactatagacttcagatgatcgaaactattgttgaattggatgatgaagctttggagggctatctagaaggaaaggaaccggatgaggcgactgtgaagagattaatcaggaaaggaacaataggtgccagctttgtccccattttatgtggttcagccttcaaaaacaagggtgtccagccattgcttgatgctgttgttgattacttgccatcaccacttgacctgccaccaatgaagggtactgacccagatgacccggaattgattcttgaaagacgtcctagtgatgatgaaccattttctgggttagctttcaagatcatgactgatccatatgtggggtcactaacgtttgtccgcatatactcagggaagctgatcgctggttcatacgttctcaattcaaacaaagataagaaggaaagaattggaaggctcctagagatgcatgcaaacagtaaggaggatataacagttgcagtgacaggcgacatagtagctcttgctggtctgaaagatactattactggtgaaacactctgtgacccagataaccttgtagtgcttgaacctatggaatttcctgatcctgtcattaaggtgcctgttcaacccaagcccatcgctgatgcggatatgacggcaaacggctcaggagtgctccctcactnccnaacagaaaccaccagcanttttaggangggatt

SEQ ID NO: 32171 - DNA, 791 bp, Triticum aestivum
  unsure (1)..(791): unsure at all n locations
  Clone ID: PAT_TA_32171
tcttgaactgcagggcccggaggttccgctggtaacaagttccgaatatcgcttggtctgtcggtggcagccactctcaactgcgctaataacactggtgccgagaacctctacatcatttctgtgaaggtaatcaaggggcgcctgaacaggctcccttctgcctgcgttaatgacatggttatggccaatgtcaagaagggaaagccacacctggggaagaaagtcatgccgtctgtcattgtgagacagcgtaagccatggcgccgaaaggacagtgtcttcatgtactttgaaggtgctggagcagctgagcggacagtcaccggtgttatccaaggcgaggtacattgtcaggtcgttcggtaccaggcgtaatgagaagatttcatgctacgtaactatcaggggtgagaatgcgatgtagctgctggagagtggcctgaatttgaaggagtacaagctgctcaggaggaacctcagcgacactggatgctttgcttcggtatccatgagcacatcaatctcggcatgaagtaggttgaattgttggcaacacttcttgtgttagtgagctaccgagccccttgagtttgtggtgatggcagctgaccccaagctgatcgaaatcaggcgctcgcacctgaagccccctgatgataacacgggcgcccgtggaaggcatgttgccgttttgtttgttccccagcctgnattatggtcgtccagcgagtccggcatgttgttcatttgactatggtcgcccggcgagtccacatgntgtcattttc

SEQ ID NO: 32172 - DNA, 1650 bp, Triticum aestivum
  Clone ID: PAT_TA_32172
ttttttttttctggcacagcaaagtacttctgcatagctgagagagcaatacaaccaaccatcccattacacggcatactaagcaaatgcgcagaataggcatgcaagggcgtcgcgtcgtcacaggccaaccgaatcgaatgtcaatatcgagagagaacgctagcggcgcaccaagcaggtgattttatgcgcagacctttcaagacttttcctgtacattatactgaaccagcacaatcggtgcagccccccacccagacacagacccagagcttcgttttatactcgacgctctactcagtccgcctaatcggtcagcatttctccactggcggcaaggaaggaaaagcctatcttttctttgaggttcctactagtaacagtcttgttgtactcttgtatctatactcatgatcctgaggctgaacatggtcaggccaggcctgatgtttcctgctcctgctctgcaacttcttcgtcgtatgcagggcttgtttcttccgccggttccggggccacttcgctggattccggtgcaggattcagagggccctgcggggtgccaaacagggtggagaatatctggccggtggcactcgtcgcagaaacagaagtatgagaagtggccttcgtcgagaagcttgtggacagtggctcctggaaccatcctcctggcaaactcggtcaccgacgggggcaccacccggtcatccattccctgccaaatgtggattgggcccagaaatcccacccactctcgttcagcctgactgaacagagacttcataaattcaaatactccctgatcctctttcttctgcatttgaatatctgacaagctgaaaccccaatcagatacttgcagcacagcttcctcgacaaatggctgcgcatctccctggcgcacagactctgcaacatccttttcccagaatgtgttgaatgtaggagcttccagtaaagttttatccttctttcccattgacaatgataaccaactctcagtctgtccttgctttccagaaaggaagcttccctgatagaagaggcgtaatagtgatgggaacctccgagctaaaatgtgcattagttttcgtttagttgaccatctgtcccatattttacgtttctcatccttggtcatcttggagtcatatggatttgccataggggcgaacattgctgcacctgccacccggtcaggaatgtagcgcagagcactccaagcatgcatgccacctccagaatagcctacaacccagaacttgtccacaatcccaagggcatcggccaaatgaagcatgtctaatgcagaagaattcagatttcggcctggatgaggatcactttcaccaaaaccaggaagatcataggtcacaagtcgtgccccaaattcctctagaagggatgagctgattccagggattcctgctagccttgacgaaagaaatgaatggggagcaaccagtgaaaatcttgccctgtcagctgaaattcctttttcttcgtaagccagatgccgtccatcaggaagttggaatcttttagcatttggggggcttatgtaaagtttcttcggttgctccactggggtatcatcgctacttcctacacctaacacgaggagcgcgacgaatgcgacggcgg

SEQ ID NO: 32173 - DNA, 685 bp, Triticum aestivum
  Clone ID: PAT_TA_32173
cgctgatgagacgatgccgcgacgccggcgaccgccgccgccatcgcggatcaccaggacgccaccgccgccggtccctgcgtccggtcgtggaataccagaacgcggccgtcgcggatcaccaggacgacacctccttcccctcactccaccacacaccgcctgccagatctcgccgtgcatcgatagccatcgacgacccactccaccctacctgccccggccctgacgccgccacataccaagcgccgccacagctgcatcgatctaaggtgcaacgcgtcccatcaccactgatctatgattgtggttcgagacgggtctgcggcaccggcggcgagaggagccgcctggttgagaagctcatccatgacgtttgtgtcagcccgtggtcgtccggcgtgtcaagccgtcgatctggagtcccaggtccatactctctgcagggtgcttgcagaatggtgtggcaaaatggagtaacatcacagggcttcttgtcgcgcccacacaccgtggagccgccagcctacccgagccaccgttgatcagcgtcaactccataagggaaatatatggtactgatttcttaggttgttaggttctatgttcccctaggatttaaaagttactgtgactgtaatcggatatccatttcaataagaacttcagtgcttgagtttttctg

SEQ ID NO: 32174 - DNA, 903 bp, Triticum aestivum
  Clone ID: PAT_TA_32174
gaacctccaaaatttattgataaaacaaaaaataaataaaatgataacagaaataatccggtaacaggacagaaacgacataaaataaacaaaatttcgtttgctttttgtattgaactgcatcaacctagtttttggatttgattgtaaggactgaataaatcgcactttggagttcccagatgtatcgcacgataacagagcatggcaggaaaacagaggatacagatacgtacatttttcgtaggataggtctccgcaacgcatactactaaatcctaactgtcacgtacagtaactgtcctaaaacagaaaaccgggtgcctggtttttagccaagtactagcaactctgatacacggatacaccatcgattgaaattagacggtagtcccggcatgaaagagagctaggctgcaagcgaacagaacaacaagatgtactcatctgctaaactgcaaatggtgaacagtacatcttatggtctccttgacagattaaggcattgccttccatattccttgcttgcacattttgccttcgtcccaacaacaccgcaaaatcctcgttaattcccaaccatggcacttttcttgtgagacccaagcatgggatccagtacggaattacatgtgagccacggtcaccgtgcagcgtcccgctgtcttttgaaagattgtgatgctgaactccctggtccagagctgttgcggccaggatgctgctgcgactgattaaatctaccagccgcccacgcgtccgacctaatatgccctgaaccaccccctggatgattagatgacttctgatgatgaggtgcattgggcggtacgtccgatagcaatgacataaggaaaccgccaggcggaataaaaccaactttccttccctcagctgatccgc

SEQ ID NO: 32175 - DNA, 690 bp, Triticum aestivum
  Clone ID: PAT_TA_32175
ctctccctctctcgagtcccgatttgcgccggcgacggaagcagttcatctccatggcggcgaccgcgctccggatcggcggccgcgccgtccggccatcgctggccgcggcggcggcgcagcagaaccatcccaccacctttcggctctttcacagcacggtcaaagaggagctctaccgcatgatgtccgaaaacagggacaagataggaaatcagaagggcctgatcaagcacctctcatcccatgtggagcctaaacccgaggaccccgttctggcgcttctatcgcagggcaaaatggtaccatttagtcatgatgtatagcccagcattcctttatggctacatgtctatgttggatgtgcctgatggcaagaaggagatgacgccagctgagaaggatgattttaacaagaggatggccgcgttgatgcccaatgtagaactttgaggacagctagttgcatagcgactaaccccagcactttatgtagttgccattgctctgtttggacactgcggctttgttagactaaattatctgtcatgttcagtgcggttatatgttatggtaaggctgaactagctgtgatgcttggtgaaaagtgctatcttatatgttaagactgagttatcagtgagaatgttggctcaagtggtatagtactatattgatgttatttgggcc

SEQ ID NO: 32176 - DNA, 944 bp, Triticum aestivum
  Clone ID: PAT_TA_32176
cctacactggggagctcgcgggccgagcagtcgcttcctcctcctccccctccgcctcactcgcgtcactcgtcgggcccgtggacgacgacgagcctttctgtgacaaggaggaggggcccatcgagctcaagcagttcgacgccaagcgcgtcaacaacgtcctcatcctcatgagcgacactagcggggggcactgcgcctccgccgaggccatcaaggacgccttccgcattgagttaggcgacgactaccgggtcttcgtcaaggatctctgcaaggaccacgccggctggccgctcaacaacatggagagctcctacaagttcatggtgaagcacatgcagctccggaaggtggccttccacggcacatcgcccaaatttttccacaacttctacctcgccgccctcgcctccttctactccaaggagagggttcagagtaggggtggcgggggcgtttaagttgtactggcagtctgccatcggcagggccctcatggagacactggacgagatggtccttagccccgatcttgccatcagcgtccaagtacagttcgacgagttcatgagcagtggacaaccagctcaagagcaaggcctttttcaaggttattcatatatgttcgcgatggctccgtatgtggtctattctgcaaaggccggaggacatagacctttttatgatggcttctactcggctagagcgttcggccagggagattttttacccccatggatggcggtgtgatcttcggttaggatcggcctccctataggcatttttatttttctcttgttctggctgttttgccactttatttcggtttacagtactttgaacttttggctgtgtgcatctagctatgcagaggctgggtgatctttgatgcgattgtatcaactcgatatttcaattcaatgaaaagccctttatcg

SEQ ID NO: 32177 - DNA, 189 bp, Triticum aestivum
  Clone ID: PAT_TA_32177
gatcgccggcgccgacggcaaggtcagggtggacgtcacttggtcgacctcgtaaagcagcaagagtgatcaaaacatctcgctcgctcgatttctatgttttgtactgcaaaaatgctacacctatgaaacttcttacttttttttagacaatctcacgaagcttttatttaagtcgtcacaatgttt

SEQ ID NO: 32178 - DNA, 1586 bp, Triticum aestivum
  Clone ID: PAT_TA_32178
ttctgtattggaagaatgacagatagtttctctgaataccgcaaattaggcagcggctcatatggagaagtttatatgggagagagtaaggatggaaagaagattgctgtgaagatgctccatgacactataggacttaacaatgatcaatttgacacagagtgtctcaatctcgcatctcttcgccaccataatattgtgcaactggttggctattgccacgaaacccggcgagaatacgtaaggcacgacggaaaacttgttcctgctcacgggacaaagagggcactttgcttggagtacatgaataacggaacccttgaaaaatttctttctgatgaatcgaaggtacatgattggtgcacacgtttttcaataatcaagggaatctgcaatggtttaaaataccttcacaaggatctggaatctccaatgtatcacttggatttaaaactagccaatatattgctgaatgagaatatggtaccgaaaatcgcagatttcggcttgtcgcggctctttgaaggtcaaaagacacaaaggacaaagagtattataggaacacgaggatacctaccgccagaatatcgtaatggggaaataatctcaaataagtttgatatatacagcttaggtgttgtaatcataaagataatgacaggacctcggggctactttagtagtgctgagataccttcctgggaattcattaagaatgtgcacgaagaatggaggaaaaggctacaggtgacatccgagtatctgctagagtcgtattctaaacaagtcaagaggtgcattgagatagctgtaagttgcttggagactgatcgaaacaaaaggccaagtatatgggacatcgtccatgagctgaataagacatatactatgcttcaatttggtagtggattaacaaatgaccaagggttatcgttttcatcaatagaccagagccctcgttgaagatgacaaccagcagcgccaactgcatgatgctcacatcaagatcactacggattgccaacaacctgccccagtactggagatggatttctctgccagccgatcccagatttgcagaatgcgcggagctcctgagtgtgtactttttcgccgtgataggcgagatcccgccgagggacctctccgctggcacaagctacatagtttacctcgtgtacaagctggcgaacagcacgtccggcctgaaaggctgcgtgcagacgtcgtcgctcaggcttcacggggagaggatcgtccccggcagcacacgcggggttagcctccaccccaaagtgcgcgggtcagccagtgacgttacctaccccgtgacaaggggtgacggctggttggagctaaagctggccgagtttgaaaatgatgacgatatgctcgcggagagggggttgatagtagatctccgcgaggagaacgacggcgtccagaagagaggcctcatcattgggggcatggaattcaggagcaactagtgtggtcataatacagtacttgtgtaattcattccattatttcaatggatatgtttgtttctcgaaaaaggaggttaataaatatgtttgtaatac

SEQ ID NO: 32179 - DNA, 780 bp, Triticum aestivum
  Clone ID: PAT_TA_32179
cggacgcgtggggctgatcagctaacatcgagttcttgaagacacactgctattcttgagagctagtagctagctagaatacgatgggtgatctgcagatcgtgctggccggggggacgatcgaggcgcagcacgtggagatgaaggtgccgctctactcctacggctgcgagaagaagatcaagaaggcactgtcgaatctcaaaggtacgcatcatgtcataggacctttctacgggataaaccgcctgagcaatgggaacgttgaggcggccatgcatgaatgctaagcttgctgctacttgcagggatacactcggttcaggtggattaccaccagcagaaggtgacggtgtgggggatatgcaaccggaacgacgtgctggccgccgtccggcggaagcggcgagcggcgcggttctggggcgcggaccagccggatctgggcgaggacgctaggctgctgggggacgccccgaagcactacctgcgagcgttcgccgcgtacaggagcaggaagtcgtggaagaagctcttccccatgatccggctgtaacagcagcaggccgcgagcgtgatgttttgtctcggtgcctgctgcatgcgtggccgcgtgcgtgttgcactgcaggaatggccaggagttgctggtagtttggtacagtagcgcatgatgttacatatcgaataaatgtgctctgttcttgtcttttgggtaatctgttggttggcaaacccttgccatgcagtcgacatagattttcgagaaaacttccaatc

SEQ ID NO: 32180 - DNA, 923 bp, Triticum aestivum
  Clone ID: PAT_TA_32180
aatgaaagcgcgctcaaaagtgaggtcgatggtgccatgacgaggcccctgcgcacatgcgccgggatctgcaagattatccaattagctccgtcgccttttagcctgtgtatataagtgccgggtatgccgttctcgaggtttatctgcacaccgctgaatgctgatcagctaacatcgagttcttgaagacacactgctattctctagaatacgatgggggatctgcagatggtgatctgcagatcgtgcttcgagggggagcacgtggagatgagggtgccgctctacagctacggctgcgagaagaagatcaagaaaacactgtcgaatcggaaagggattctctcagttcaggtggattaccaccagcagaaggtgacggtgtgggggatctgcaaccggaacgacgtgctggccgccgtccggcggaagcggcgagcggcgcggttcaggggtacggacgagccaggtggatgagaagacgctaggcggggcgatgtggggaagaaccacctgcgggggtttgccgcctgcaggaggaggaagtcggggaggaaggccttccccatgatccggctgtcacagtcggggggagggagcgagatgttttgtcgcagtgcctgctccatgcgtggccgcgtgtgtgttgtactgcagcaggggccggccggagccactacttgcgagcattcgccgcgtacagcagcaggacgtcgtcgtggaagctcttctcgatgattgggctgtgccagcagcaggccgcgagcgtgatgttttgtctcggtgcctgctgcatgcgtggccgcgtgcgtgttgcactgcaggaatggccaggagttgctggtagtttggtacagtagcgcatgatgttacatatcgaataaatgtgctctgttcttgtcaaaaaaaaaaaaaaaaaa

SEQ ID NO: 32181 - DNA, 1126 bp, Triticum aestivum
  Clone ID: PAT_TA_32181
acctctccacatccaaagattttcctgatgagctgctatatttgatgcgggataggtacaacatttgcaaacttattcacttgcctgcacaatcaggcagcacagaggtgctggaacgaatgaagcggggttatactcgagaagcatatttggagcttgtgcagaaaatccgtaatgtcattccagatgttgggctaagcagtgatttcataagtggcttttgtggagagacagaagatgaccatgccgacactcttagccttgtaagggatgttggatatgatatggcttacatgtttgcatatagcatgagagagaagacccatgctcatcggaattatgaggatgatgtccccaatgatgttaagcagaggagacttgcagaactgatcaacaccttccgtgagaccacaagaaagatctatgattctcagattggtaccacacaagtagttctagtcgagggacccaataagcgagctcctgaaacagagctgtttgggaaaactgaccgggggcacagggtttcgtttactagtctccctgtaccacatacatctgaaggtgacggagctcgtaagccagtggttggtgactttgttgaggtaaaaattctcaggtcgtcgacagcatcgttatctggagagccaattgcacgcacaagcttgggcatgtactgcaagaatcatgcatctgacgcacatgttgttggtgcataagtagtagttgagttcatggtagtccacatctgaagtgaatcagttaagtctgggtaatgtttgacttgaaatgactgcaattgggagcataccatgcaatttaagttggtgttgacatgttttcatgatgagacattggttgtctagttttgggtgggaaggtagcatggtgttatgcttggagcagttgaaatacaaagatttttccgcattatatgcatgctaatcgtgtggtgaagtactttttctttagagggaaatagttgtaaagttgacatttttcatgtaattggttttgcttactgcaagccctagaattatttcttgctgaaacaatatatacactgattatattttcatgctcatgacttccagggtaagaagattattttcttgttaaaaaaaaa

SEQ ID NO: 32182 - DNA, 1581 bp, Triticum aestivum
  unsure (1)..(1581): unsure at all n locations
  Clone ID: PAT_TA_32182
gccggccgggccgggagaagcagcagcctgggctggcagccaccagtccaccaccacttcctcgtctccggcgagccaccgatgatgggtagcagccgccggcggggcgaccgccagctccagttccagctcctgcaccgcctcctcgcgctctcgtcgctgctcctcctcgcctccggagaggtcatcttcgaggagcgattcgaagatggttgggagactcggtgggtcaaatccgattggaagaagagcgaagggaaagccggtatgttcaagcacacggcaggaaaatattctggagatcctgatgacaaaggcatacaaacaacgatagatgctaggcattttgctatctcagccaagatacctgagttcagtaacaagggcaggacattggtggtccagtactccataaagtttgagcaggaaattgaatgtggcggcggctatattaagctgatgtctggctatgtcaaccagaagaaatatagcggagacactccatacagcttgatgtttgggccagatatatgtgggactcaaacaaagaagctgcatcttatactctcttaccaggggcagaaccaccctatcaagaaagatctgcaatgcgaaaccgacaggctgacgcatgtttacacattcattctaaggcccgacgcatcttatagtttactggttgataaccgtgaaagagaatctggaagcatgtacactgattgggacatcttgcctcctcgtaaaattaaggatgttggtgccaaaaagcctaagtacaaggatgacagagagtacattgataatccagatgttgaggatgatccagacttatatgtactgaaacctctgaagtatattggaattgaagtttggcaggtaaaagccggctcagtatttgacaacattctcatttgcgatgacccggaatatgcaaaacaggttgccgatgaaacatggggtgcaaataaggaggctgaaaaggaggcttttgaagaagctgaaaaggagaggaaagctagagaagataaggaagctcaacaagcaagggaggaaggagagcgacggaggagagagaggggtgatcgacaccgtggcagggaccattacaaggacagatacaaaagacgcaacagagatcactgggatgactaccatgatgagctttgaagccccccaaaatcttcaatcattccaaaggagaaactgggatttgacacggacattgtgttatagttgctgcaaataaatgataattgaagtgtttcttgtctcgtgtgagggaaactgattgaattgaccgcgaagatcatcctatgtgacagcaggacaggcaattccacttatcctcaaaattcaaaaacttggccttggacctgaaatgtgatgttgtgcgtgtaatgtacatggtcggtgatgtacttccttttgtaaactcagaacattacctttgctgatataataaagaggttccatatttattgcataacacaagcaactgttgttactgaggagttctcactcaatttgaatacaaaattctatgttgctcctgtaaaaaaaaaaaanaaaaaaanaannngg

SEQ ID NO: 32183 - DNA, 1737 bp, Triticum aestivum
  Clone ID: PAT_TA_32183
ctcgtgccgaattcggcacgaggcatgctcccttctcgctccctgctccccccgcactgccccaccgcgccggccccgactccgactccgacaccccccggcggcgcgcgctcgccgagctcggtcgcgctgcggttcggatcccccggaggcgtgcggcttcggcgcgggcgagggtcggcggcggtcgcgatggcatccgacgggcgcgtggagcggatcgcgtccagcatccgcgccatcccccaacttccccaagccagggattttgtttcaggacatcacaaccttgcttctcggatccgcaggccattccggtgacaccactgacctctttggtcggagcggtacaaggacaaagacataactgtagttgtctggtgttagaaagccagaggaattcatttttggttcctcccattgcattagccaatagggtgcaaagtttgttccaataaggaagccgaaaaaaattacctggtgaggtgatatcggaagaatattctctggaaatatggcactgacaaaatcgaaatgcacgtaggagctgtgcagcccaatgaccggagtccttaattgtggatgatctaatttgccacagggggaaccctttgtgccgctgccaaactttattgagcgtggttggagcaaaggtggttgagtgtgcctggtgttattgaactgccagagctgaagggccgggacaagttgggggacatgccagtttttgtccttagtgcaggcagacgaatcagtatgaaacaagttgtgacttcttgagttgttccaatgatgttccccttcttggaactatactgggaagcagcaaagatatccgttacaatcttaagctaaattcctttctctggagctgctcaataaaagtttcatttttaaatttgtcccttcttggtaactggtttgggaatggcagacttgattgttgtatccctgtaatacgtggcttatttctgtcaaaaacagtgcaaattattcatgtcaatgaaggatgatagtctgtactgtgaacatttacaggtaaaagtcggtaggctttatcactctatatttgtgatgacccggaatatgtaaaaacaggaggctgcatagaaaaattgggtgcaaataaggaggcttgaaaaggaggcttttgaagaagctgaaaaggagaggaaagctagagaagataaggaagctcaacaagcaagggaggaaggagagcgacggaggagagagaggggtgatcgacaccgtggtagggaccattacaaggacagatacaaaagacgcaacagagatcgactgggatgactaccatgatgagctttgaagccccccaaaatcttcaattcttccaaggagaaactgggttttgacacagacattgtgttatagttgcttcaaataaatgataattgaagtgtttcttgtctcgtgtgagggaaactgattgaattgaccacgaagatcattcctatgtaacagcaggacagacaattccacttatcctggaaagtaaaaaatcttggccttggccctgaaatgcgatgttgtgtgtgtagtgtacatggtcggtgatgtacttcctttttgtaaactcagaacattacctttgctgatataataaagaggttccccatatttattgcataaaaaaaaaaaaaaaaaaaaaaaaaaaaacacaaacacgggcggccgctcgaaatcactcagtgaattcaaatcactagtgaattc

SEQ ID NO: 32184 - DNA, 1381 bp, Triticum aestivum
  Clone ID: PAT_TA_32184
ccccgcgtccgcggacgcgtgggtttgcgctccggatcgaacatctctccgcctcccgtctccttgtcctcgcgtaggcttcgcacttgcacaacgtatctttctttccagccctcgccgcagttatatgccactccagttagcaagcgaggagctcgtcttgctcgatctcgcaagggctgaacagccgtttggatcgagatgtttgaagggatggaggggatgagctacggcggcggtgctgctggcgctggtgccggggcggcggcgctgtcgccgcgggaccccaagcagcggctgcggtggacgccggacctccacgaccgcttcgtgcacgccgtcgccaggctcggcggccccgacaaggcgacgccaaagggagtgctcaggctgatggccatgaaaggcctcactctgtaccacctgaaaagccaccttcagaaatacaggctgggaaagcaaagcaagaaatccacagacctggaattagccaacagtggagattttaccacgcaggacatcaacttccaaatcggtgcgcctcttgtcgttcctgctgaacgcgacaccggaagagaaataccgcttgaggacaccctcaggtatcaaattcaggtccaaagagaactgtgcgaacagcttgaggtgcagaagaagctacagatgcgaatagaggcccaagggaggtacttaaaggaaatactagagaaagctcaggaaaacatttcctttgatgcaaatgggtctgttggcctagagaacaccagatcacagctcacggacttcaacctagctcttccgggcttgtcggacaatggaacacaggtgtatgaagaaagcggtgaacagttggtgaaacatatgtctgatgacaatcttcatgataataatttggattttcagctctaccgtgtacgaagtcaggaggctaagagtgtcgaatgcaccccgaaaactgaggacctcctcctattagacttgaatataaaaggaggatatgacctgtcttcgagaggaatgcaagggtgagtcaaaatctgaagattaaccagcagaggaaatagagatatatttcagcaagctgacagtttttgggagtttcactgtttgctattagaatttgtttgcctgtggcagtgcttaggatgcttggtcacaagtttgacttgctctgtggtaatgttaaatttgctgaagaaattcatgaacgcttgaagcctgtagtatatgcatatgttatgtagagtgcacatgggaaaggatgaagcatgtaacaatcagatatcaagatatatgtatattttaaattgtgctttatgtaccacacgttgcataatttgatgtgcacagagccacataacatgttccaccttttgctttt

SEQ ID NO: 32185 - DNA, 1167 bp, Triticum aestivum
  unsure (1)..(1167): unsure at all n locations
  Clone ID: PAT_TA_32185
tgctgatgaaagcgacgatggactccatcttcaccatcgccgtcggcgtggacctggacacgctgtcggggtcggaggaggggagccgcttcgccgcggcgctagacgacgccagcgagttcaccctgctccgtttcgtcaatgcgttctggaaggtgtcgaggttcctcaacgtcggcgccgaggcggcgctccggcgcaggatcgaggtcgtcgacaagttcatgtacaagcgcatccgtgccagggcggaggagatatcggacggcgacattggcaaggcacacgacactgttagtatgcgaggcttgaaactgaggctcaggttccccctgacgttgatgacttgacaggtgtccaaggatgatctgctgtcgagattcatacaggcaaccaccagcgacgccggggaggtggactacaagcacctgagagacatgatactgaacatagtcatggccggcaaggacccgaccgccggagcgcttgcctggttcctttacatgatgtgcaagcacccggaggtccaggagaagataagtgaggaggctgccgacgccggcgaggccacgtcgtccatcgacgacttctcccggagcctcaccgacgaggcgctcaacaagatgcactacctgcacgccgccctgacggagacgctccggctgtacccttcgctcccgctggtgaacaaggagatcttttccgacgagacttcgcacaatgccctcgccgtcggcaagggagacatcgtgttctacgccccttacgccatggcccggatggagcggctgtgcggcgaggacgccattgccttccggcccgaaagatggctcgacgagcgcggcgtgttccntgccggagagccctttcaagtctcacggctttccaggctggtccaaggatctgcttgggaaaggaattcgcgtacaggcagatgaagatcttcgcggccgtgctgctccgcttcttcgtgctcgcgttgcatgacaaggatgccagcgtcaactacaggaccatgatcacgctctacatcgaccagggtctccatcctgacggctacggccagaggcatcgtgtagccacctttgtactcaagatacgcgtacgtacgcgattgaatatctcttcttctttnnttgagactcgcgattnaatgtctcaagtatt

SEQ ID NO: 32186 - DNA, 1532 bp, Triticum aestivum
  unsure (1)..(1532): unsure at all n locations
  Clone ID: PAT_TA_32186
cgcccccactcgtccgggcgacctccgccccccgatcttttcgtcggattcaagcgagcgcgagaaccacttggtcttggggaccgtctgctgccctataccacgtcaggcgttggggctcgtactccgtcggatcggcttcgaattcatccatcgatcaagaatgtcgagcctcgaggaaccacttggccttggggacctgccaaagttgagtattaatagacttggaagcttctgccaaagtgcctgcagatcaacagctgatgaccgcagcaccggcaattacacgcccagcaacagtggcaacaaccagacgctctttcacagcacttcccactcatggcatctgcaaggccagtataccgactcgtcctgcaatggagcggatatggagtttagaactcttccacaaaagggtttcgtgggatctcccaaggtttgtgaaggtggttgaggttggaccacgagatggtctgcagaatgagaagaacattgtaccgacatcagtaaagattgagctgatacacaagttggtggcttctggcctgtcagtagttgaagccacaagttttgtttccccaagatgggtgccgcagctagctgatgcaaaggatgtccttgaaggtatccagcatgcgccagatgtgcggtttcctgtgttaactcctaacctcagaggatttgaggctgctgttgcagctggtgcaaaagaagttgcggtttttgcatccgcctctgaatccttctctaagtcgaacatcaactgcaccatcgaggaaagccttgctcggtaccgtgatgttacttctgctgccaagaaacatggaatacgtatccgcgggtatgtttcatgtgtggtcggctgccccgtggaaggcgctgtgcatccatcaaaggtagcatatgttgccaaggaactctacgacatgggttgcgcggagatttcactcggtgacacgattggtgtcggtacgccaggcagggtagttcctatgctggaggcggtcatggctgtcgttccggcagacaagctggccgttcacttccacgatacatatggccaagcccttgccaacatcctagtctctctccagatggggatcggcgtagtggactcgtctgtgtcgggccttggagggtgcccatacgcgaagggcgccacgggcaacgtggcgacggaggacgtggtgtacatgcttcacggcctggggatagagaccaacgtcgacctcggcaagctcatggacgctggcgactacatctgcaagcacctggaccgcccgtcaggctccaagactgcaacagctttgtgcaggctaacggcctgattgtcatactggaactccacaaggggtagtacacgtcattgctgtccgtctagcatatgcatttacgcaagccattttggttgttgtataccgcatcaatttactcgggtcaggtgaaacttatcatgaaacattgatatgtactctcaatttgtatctcagttctcatatgaccttgaataatcagagccctcttcgtnnnnn

SEQ ID NO: 32187 - DNA, 1033 bp, Triticum aestivum
  Clone ID: PAT_TA_32187
ctgtcccagattcgtaatgagaaggccaggagatatttgactggcatgaagaggaaacatcctatcccctttcctagtattttttgtaacgctgatcctcaggctgtccgtctcctggaacgcttactcgcatttgatcctaaagatcgacctactgctgaagaggatttcctaacttggaacatgagccttcaccacaccccttttcaaaacttgagtttgaatttgagagatggaagctaacaaaggatggtgtaagagatctgatataccgagagattttggagtaccatccacagatgcttcaggattatatcagagctggaggacagactagtttcgtctatccaagtggggttgatggtatgaggctgcagtttgtacatcttgaggagaaccacctcagaggagaaagaggcactccactgcggaggcgacatgcatctttgccaagggaaagagtctgtgcaccaatgggtattgataatcaagactgtaacaatgagaggaggacagcatcttctgctgcccaaattaccataagatcacaacaagaggggctgacacatgcatatgtttatcaaaatggcacaggcattccggacttctgctcagggtattacttgcagaatggtagtaccagtgcttccagttgtggtatcgaagagcatgaaggcccaaaggagaatggcgtctccgcggagaaggtggcctatgaactgtcagaacggcttgccaggatctagccaggatgcacctcctaaggcagccatgatcccgacgcagctccaaatttcagcgcagtggttccaccatgtagtctgatggatcccggcagcacagaataaactccaccagggcggaggtgctgcgaacttcacaccaaccattcacattatctgaaaacatgtaataaatctgagttgaaaaatgtcgcgccgatctgcatcggtatacatccggtgtaaattatgtgggtaccgtagtgtgatgtcgtaacagaaattgcagacattcagtttgtgaattggtc

SEQ ID NO: 32188 - DNA, 593 bp, Triticum aestivum
  Clone ID: PAT_TA_32188
gcacatctcttattacaatttgccacaattttgaatggtaacttcaatggctcgaggtctcaccattgtagtattcttgctagtgtttgttgcagcgacgatatcatctacctatgcggtgaaactccaggcggacgattcccctaatgtggccgaggggcccgccgacacttcttctgaggctgaggggcctgccgacaattcttctgaggctgaggggcccgatggccctgctttcgtcgagatggttattaagaacccctacccagcttccagccttaactcacgctctgatggcctcccggttgacccaacaccagatgggctccctgttgatcccacaccagacggccaatttaaataaaaacgacctcgatgttttgacgattaatgtttgacactatgtatgtgtatgtaagatgatcaaaagaatttgccatgtagatttatttaagtgtatgttttgaaggatacatggaaaactttggagccatttcatctctcttcaggtgctatagattgaagggcactggttgtatatctaccatgtgatttgtattggtccgcgttaaaaaatattaatgcttaagaat

SEQ ID NO: 32189 - DNA, 525 bp, Triticum aestivum
  unsure (1)..(525): unsure at all n locations
  Clone ID: PAT_TA_32189
gatcgaaaccaactatctacataattaggtactgaacattaggagtagagatagatctgagtcgcgccaccgcacctttctgcctcgacgccggtgactctcacgtactggcggcgccgtgacgctggaaagtttagcgaactccacacatccaaacagacgttgatccatcgacccgaaccaagaatcaacaccgagagctcggcgagatgatgtcactgaagccctctgcatccgccgccgccgaaggctgcaggattgcctcaacccctcgctccgcgctgacggcgaggtcaacaccattgcaagtaattaatattttgggaaacttcgttagaatttggtctgtgtattcgttgtatagccacttgtccagtactggggattcaatagtgggtttatcttcaattgccttgtaccagttctgtcatcttcttaatcttacagaaccttggaaaggtcggctttncccaatcanagattgttcctaanagtgtcaatggcggattccggcantatactcnt

SEQ ID NO: 32190 - DNA, 1534 bp, Triticum aestivum
  Clone ID: PAT_TA_32190
cccccctccccgcgccgccgcaggggcccccccctgccctccggcgccgacgccgctccggcccccgcccccggcgcggtctgtctgggcggatggcagaaggtagaatctcacacccgatggatccgtcgccatgctcagcacttgcgcataagctagcaagactggtgctcgccctgtccccttgctgcaccggttgcccttggactccccagttatgccctaatgtgcgtgccacggggcgtgtcgtgctccctccatcggtatgatcggatcgacgatttccaagacatgtcggtctaccaagggaagccgaacgctttcgccaccctgcatctcgcggctccgtgtccgtgactctgtggggctgcgcgctcgtctgctcacccggtgcccaccacatctcgttgctgcacttgttggcattggtcacaccagtcagattctaatgtgccagccaggggccttgtcgtggtcagtacgcgcttacgaccagtgcaaggattttgaagacatgtcgttctaccagggcaagctgtatgccattgccaaggacgagaacctccttgtggtgaacatcagccaggaccatagcaccggcgatccacaggtttctcggattggacgggtcatcaagggtgattctcctccatggtatgatgctgtattcgaggacaacagttcggccttcaagaagctctacctggttgaatcgcgtgggatgttgctgatggtacgcaggacgatttggtgtcagtttcctgaacctggagaagacgataaagttattgctggaaagaacgagtttgaggttttccaggctgactttgagcattcacggtgggtcaaggtgtcgaccgtgggggatgaccaagtgctgtttctggggcgaaagtgctcgaggtccatgtccgtgtcgcagtacgggttgccgggcgatcgcatcttcttcttggatgatgatgaggataatcgcatagagtatgcctatgaggaggagaatacttctttcggcgtctattccatgagatcccgcagcatccgttccggtgatccaaatatttcctggaagcgctgcgctgagatgtatctggcagcatggctcttccctcaggaccgctgagaggttcttatattgttagcccgttatcgctatgcaagctgctcccaggttatctgaccatgctattgatgttgtcgttatgctgttattctgcaagctgtgttgtttggcttccctacctagtacgtagaaattatctgttcctggttgcggtgcgctgtgccgtgtcccgccgctgcgcgcctccccctggtccggtgggcgcttcttctcctcttgcccgcccgttgccgctagcctcccgcctccctggggggtttcgcccctggccgtgcttgttgctgtggcgctgctgtggttgttctgctcgccgcgtatgcgggtggccacttcttccggtccgggttacccggtggcgggcggctgctgcggttccggcttgaacttattgggtcgtcactactactacta

SEQ ID NO: 32191 - DNA, 672 bp, Triticum aestivum
  Clone ID: PAT_TA_32191
ttaaagttcaactgcccccagtccgtcggtgtcagcagcctagcgccgctggacacggtgacgcccaacgccttcgacaacgcctattacagcaacctgatttcccagaaggggctcctacactcggaccaggtgctgttcaacggcggcggtgccgacaacacagtcctgagctttgcatccagcgccgcgacgttcaacagcgccttcaccacggccatggtgaagatggggaacatcgcgcccaagacggggacgcaggggcagatcaggctcgtctgctccaaggtcaactcgtaatctccgcgccgccgacgctcttctgaagctacgcatgaatgaattaaataaggtctctgagaccagtaccagcacctacgagtacgtagcgtgtgtatttcggcgggtggttggaaattgtacttgtgcatgtgtgcgtctacatgtgtaacgaaattctcgtgcaaaagcacggatgattgcttccttttcgcgtgcgtctgtccacatgtgcaacgaattctcgtgcaaaggcacggaggattcctttcgtttatctcagtatgtcacactgccagatgatgaaaaaatggcaaaaatagattcgaacttgtgaccaagtgctagcgaccgcacacacgtcgccaacagaaaagactagcggagttggtt

SEQ ID NO: 32192 - DNA, 1711 bp, Triticum aestivum
  Clone ID: PAT_TA_32192
tgattgccaacatgggggaaaagtgtgaggcagaggcaccacttaacattgtggtatattacactagctagtcgctagagtagtagcgatggcctctgcctcttgccttggcttagtggtgctcgtggcaatggcctcggcggcgtcggcgcagctgtcgtcgacgttctacgacacgtcttgccccaacgcgctggccaccatcaaggccggcgtgacggccgccgtgcaaaacgaggcccgcatgggggcgtcgctggtgcggctgcacttccacgactgcttcgtcgatggatgtgacgggtccgttctattggcggacacggggagcttcatcggcgagcagggggcagccccgaacaacaattccattcgaggcatgaacgtcatcgacaacatcaaagacccaggtggaggccgtgtgcaagcagaccgtctcctgcgccgacatcctcgccgtcgctgcccgtgactccgtcgtcgcgctgggtgggccgacatggacagttcttctccgggaaggagggactccgccactgcaagcaagactacaggcggcagatgagctgccacctcctacctgcggcctctacaacctcaccaccttgttcggtcagcaagcagcgctgtgtgagcggacatggtcagcgccatcagggcgcccacacgagccgggcaatccgctcccaccggtggcttgaacgtccacgataccacaacgacgaacgtcaacgccgcgtgcaagcagcgactcccctccaccgccatcctcgccctcgccgcccgtgacttcaccgtcgcgctgggtgggccgacatggacagttcttctggggaggagggactccaccactgcaagcaagaccaacgcgaaaaaggacctgccacctcctaccttcgacctcccaaacctcccgaccttgctcagcaacaagcagatcagcacgacagacgtggtgacgctctccggcgccctcacgaccgccctgtcgcagtgcgggtaacaccgcgaccagaacagggacgcgaccgacattcacactcccttcgtcacatcttccactcccaaccgcctcgccgacactggtctgctacgcatgaactagataaggtcttggaaggccagtgccagcaacaacggcgtatccttgtatgggatggccaggaaaatcgtacctgtgcatgccgtggcgtttatccacatgggtaacgacgcgctcatgcaaaggcattgggagaaattcctttcctttatcctcagtgacgacatgcaggctaggcgcatgaacaaagcggcagcgaaagattgagaagcttagtgaccgaaataccagtacccgaacaaacggaggacggtggactgtggttccagatgtgttttggtaaaaaaatgcacctttgaatgtacgaccaagtcggacgggaatttctggcgtaacggcgccaatgtttacttgtttttttcgcaaaaatactaaactggtgtgtatgaataaactgaataaggtctcgtgtaccaataccagaatctacggagtagggtggtgtgtggttacgtatgtgtgttggttcgaaactgtagctgtgcatctacgtccacatgtgtaacatgctaattgtatgtcatgctgcgagatgataacatctgccactttccactcgacggccctcatgtccgcccctatgcaaatgtcatcacggacggactgccc

SEQ ID NO: 32193 - DNA, 1277 bp, Triticum aestivum
  unsure (1)..(1277): unsure at all n locations
  Clone ID: PAT_TA_32193
aaggggaggacggaggggaagatcacctgcgaattgagatcgcgaactcggcggcgttgcctgcagcggcggggcagcggccaagcggggcaggatggcggcggcgctggcgccgggggtgtcccggaagctgaagaaggtgctcgagacgcggacggacagcccagatctgctggcctcgctgggcgcgctctccaccttctacgagcacaacaccccgcaggcgcgccgcaacctcaagtcctccgtcgagcagcgcgcgctcgccatcaaccgccacttcctcgacgcctccctccccgcccagaaggcgttggatcgcgtcgagggggaagtgcacgcgctggacgattcctggaagaagattgaggaagcattgagcagctgtagtgcaagtacaggggatatcatcagtacaacggagaggttgcaacaagaacttgaggttatcactcagcgccaggaaattgtatcatgtttcctgcgggattaccaactttcaaatgaagagatacatgcactccgggaagaagatatagatgagaaattctttaaggcactattgcatgtccaagaaatccattcgaactgcaaggttctgctgcgaacacaccaccagcgtgctggtttggaacttatggatatgatgtccgtgtaccaagaaggagcttatgaaagatttgcaggtgggttcaagttgagtgttaaaaactaggtgatactgataatcctgaagtaagtgaacttttgaagaaggctgttcggtgcctgaaggaaaggcctgttctgttcaagtactgcgcagaagaggttgccaatatgaggcatcatgccttattcaggcggttcataagtgctcttactagaggtggacccggagggctcccaaggccaatagaagtgcatgctcatgatcctcttcgttatgttggcgatatgctgggatggctgcatcaggcacttgcatctgaaagagagcttatagctgcgctgcttgatccggatgcaataagtgacagtggtccagctaatcgtcgtcattctgtaagagaaggtgattcatccaaaggagaatctgatttcacttttgttctcgatagaatatttgaaggggcatgccgaccgtttaaagttcgagttgagcaagttctgcagtcacaaccaagtctgatagtttcttacaaacttagttttatcttccnctttgtccctcgncttctcctttcttctttcttccctctttgccccccctccctttttttcacttgccttttttt

SEQ ID NO: 32194 - DNA, 845 bp, Triticum aestivum
  Clone ID: PAT_TA_32194
gacaaaattaatccaaggtacatcccactactaaaggagacattcacatttcctcaaagcttgggcattttaggtggaaaacctggagcatcaacttacattgctggggtgcaggatgacagggcactctacctagatccccatgaggttcagatggcagttaacagtgcagccctttgcttgggggcggcccccccctcctacctcggccgcgccgtccgcgtttcccctcgcccccccagtgtcccttccctggcaaccgcctggtactgccgtgtccgtgacgactgtgttgtgttctgttctcgggcctcggagttggcagagcaggcgaacggagcaccgctcttcactgtcgtgcagtcagttcagccgtcgaaacggatgtacaaccaggatgatgggtccggctgttcaggctacggcgtctccgacaacatcgacgcggaggaccttgatggctcgggcgaaacaggagaagacgagtggcagattctctgaatgaaagggaagtttaacttcagtgttcggttaaaccttcacatgaccactcattgggttaatgtccccctgtgtgaagtaaagacttcaaaaacctcgtgtgaaatccagggtttccagttctacggaacaagcgggtgtgctgcttgttccgcgtagctgggaggccggaaaaggtaggagccgttacgctgatcatcggatcggcacaagttggttcgatgggaaattcctctgtaccataccgtacgcgctgttgtgggtgactgcaaaatgtacctattgcctcgcggccccttcgcctattggctgtatacactcactggcgtcgtttacacgtcgtg

SEQ ID NO: 32195 - DNA, 1109 bp, Triticum aestivum
  Clone ID: PAT_TA_32195
gggaagatgagacccaaatgccaccccgcacgcaccgcccccaagaggcgccagaaaacacgagcccttcctggcgccggcgggaggacgaaggaggcggagggatggggcgcgggaagatcgagatcaagaggatcgagaaccagagcaaccgccaggtgaccttctccaagcgcaagaacgggatcctcaagaaggccaaggagatcagcgtgctctgcgacgccgaggtcggcgtcgtcgtcttctccagcgccggcaagctctacgacttctgctcccccaggacctcgctatcaagaatcttggagaagtaccaaaaccaatccggggcaagatactgtggggtgagaaacacaagcctctcagtgcggagttttataaaaatcaaggaaagtgaaagctaacataccgatcgaagctcattgcaacttggagatgtcgactcatctcgaactacgctgcagcccataaaggagctagatcatgatattgagggaagcacttgataatgggctgacaagtctgcatgaaaaacagatggagcactatgacaggctcgtgaaacatggtaagatgctggaagatgagaacaagctgctggcctttaaagtgcaccagcatgatatcgccttgagcgggagcatgagggatcttgagcttgggtaccatccagacagggactttgcagcccagatgccgatcaccttccgtgtgcagcctagccaccccaatctgcaggaggacagctaggccgccgactctccacgccactccatcaaatgtatcccccactggcttgtatgtccatcatgcatcttgccagttgtatccttcgtttgttatctgtttggacgaacaattgaacatgttatacgtagtagcttgatgatgtgtcgatacagtcgggctctaaaagctgtgcagccgccgcctgccgcctgctgatctgccatactgtaagtttgcacgaccattggagctgaaatatcagtggactggtattgtatctgcatgttgtttccctgatcaccacaattgctggacggtgaatagtttgtaatgacaacagaaacattgtggaaaatcttgatttgatgtgaactttt

SEQ ID NO: 32196 - DNA, 1434 bp, Triticum aestivum
  unsure (1)..(1434): unsure at all n locations
  Clone ID: PAT_TA_32196
gcacgagggcctcccctcccctcgcgctgcttctagaagcctccagcgatggacgcccgccgcgacgacgaggaggaggcggcggcgccgctcctggccgcgcccgctccgaggagccacgccgccgacgtgcacgtcctctccgccgcgttcgtgtgcttgttctccgcctacagcgccgcccagaacctccagagcaccgtcaacacggacggcaatttgggttcgatatcgctgggcttgctgtacacgtcgttcacggcgttctcggtcgtgggttcgccggtggtgcgagcgatggggtccaggcgggcgctcgtgctcggcacctccggctacctcctcttcatcgccgccaacctcgccccctcctggtacacaatggtaccagcttcactgtacctgggttttaccgcatcaatcatttgggttgggcagggcacatatcttacttctgctgccctcagtcatgcaagagacaacaatttgcccgacggtccaactttaggaagctttaatggagaattctggggtgtgttcgctagcacacaggtcattgggaatttgatctcacttgctctactgagaaatggaaaggatggaggaagtgtaacaggaaaaaatctgctgtttgttgtgttccttggatgcatgattatcggcattgtattgatgtgtttactgtccaaaagggatgagaaacgagataatgcttcgacacactcctcatttggatctatgttgaagtatattgttgcccctctcaagaccgtaggatgattcttctgatccctcctatcgcatattcaggtttacagcaggcatttgtatgggctgtacccacttagagtattgtgacacctgtgcttggcatatctggagtcggtggcgccatggcaatttatggcgcatctgatgtagtttgttcattggttgctggacgttttacctctgggcttcattcagctacatttatagtgtcagttggagctattgttcaggctgtggtcttgttctggttgcttcttttttacagtccaatggagggactacttggttcagcgattccactatttataggtgccttatggggtgttggtgacggagtcttgaacacacagttaagcgcattacttgggttgttgttcgangatgtcaangaagcagcttttgcacaagttgaaaggtttggcaatcangtgccatcgcagtcantcttccgtcttgaagnccaagcatcacactacaagcaatgcttaacttgaatggccacgtcactcgtcatctcccttgggcttgttcctgtnacttaccccntggtnntcgagaaaccatcangcatcanagcgtgacgganatcctaattcggtgtgcaanacagtgtcntcgtaacacnaggntantgnccaacancatttcaaccanactggggtt

SEQ ID NO: 32197 - DNA, 1061 bp, Triticum aestivum
  unsure (1)..(1061): unsure at all n locations
  Clone ID: PAT_TA_32197
cnnnnnnnnnnnnnnnnnnnnnnnnnnnnnnnnnnnnnnnnnnnnnnnaccgccaccgcgagcgaggagaccgaccgagctatctagggttcgcgcctccccgccggtcgccgcccgcccgccgatcctctccccgccgccgcccacgcccgctccggccgctcgccgctccggatccgcgcccctcgacctcgggccccgccgccgggccgccggaagatgataaacctttttaagatcaaggggcagaagaaggaagaggcggccaactcaaatggggggcctcctgttaagaagcaaagtccaggggaattacgtctccataaagatattgctgagcttaacctaccaaagacaactaaaatttccttcccaaacggaaaggatgatctcatgaactttgaagctactctacgacctgacgaaggatactatctaggtgggtcattcactttcaccttccaagtttctccttcctaccctcatgaggcaccgaaggtcaagtgcaagactaaggtttaccatcccaatattgacctagaaggaaatgtctgcctgaacattctgcgtgaagactggaagcccgtcttgaatatcaacaccataatatatggtttaaaccttcttttctcgcaacccaatgacgaggacccattgaatcatgaagccgcggccgtcctccgagacaacccgcagaagttccagagaaacgtccaaatggcgatgtcgggaggctatgtcgataacacccatttcccaaggtgcaagtaaggcgggcgggtgggcgggcctgctacgtgctttgcttctggcttgcgccccctaccctagccccgaatgccaaccattgcacaatctgaagaaatgcgggcggcatacccaggaaatgtatctatcatacttgtttgtgtcaagaagatgtgactgttattgtgcttgtttggtggatgttctggaattgtcgtgtaacatgaagaaacgtggtgacattatgcagcgaagcgaaactcgcctgtatcgagctgaanagtnnaaaanaaaaaaannnnnnnnnnnnnngg

SEQ ID NO: 32198 - DNA, 1256 bp, Triticum aestivum
  unsure (1)..(1256): unsure at all n locations
  Clone ID: PAT_TA_32198
gttttccccacctcgacccgaaccgaggagaccgacctagggttcgcgcatccccgccgctccccgcccctctatctcgcctccgccgcggcgaccggacatcgggcggcggcggcggcagggggggcccccgtgtagcgccgttccgcgtcccgatccgcacggatccgcccccccataagggccccgtgcacaagggacaaacatcataaaccttctcaagggcaaggggcagaaaaacgaagaggcggcaaactggaaaggggggcctcctgtcgagaagcaaagtcctggggaattacgtctccaaaaattttattgagcaacttccagtagaaaagacaactaaaattttcaaatggaaggaaaaaggatgatctcaaaatttgaggggccactctacgccctgatgagatatatgttgaagtgggacatttaatttcacccattccaagtttctccttcctacctgagtgagggacgatagtataaagtttcaatcaactttactatctccataatgatattacaaggctcggaaggtcaagtgctgaatcctaaggtttaccatcctgtatattgacctagaagaaaatgactgcaatgaaaagttttaatctcccattctagcctgtcttgaacaatgaacacctgaatatatggcttaaaccctcttttctcacaacccaatgacgaagaccccttgaatcatgaagccgcggccgtctcttccgagacaacccactgacgtaccagaaaaaatttcaaccggcgaggtcgtcaggctctggtgataggacccatttcccaaggttcaagtaaggtcttctgtgtgcagctccggttccgcctcattgcccagttgcccttgaatgcgacgttgcgcagtctgaaggatgtggcatgtacccaggaaatgtatcccatttgtgttagacgtgactgttattatgcttgtttggtggatgtaccggagtcatgcatgttgaagaaacatgctaagcagaaacaaaaacctgcgcctgttattcagctgaaaagttggcggaagtgttccaagcgcagcagtgttataagcatataacataatgagacgttatgtagcgaaactcgcctgtattgagctgaaaattaagtcacgggtgttgatctgtcaacgaacaaaaagcccacaatcctaaaaaaacacaaaacaaccacccccggcgcnctgcnggaaaccngactaccanctaaccctgcananacccntcnaa

SEQ ID NO: 32199 - DNA, 897 bp, Triticum aestivum
  Clone ID: PAT_TA_32199
ttttttttttcagcaacaccgaccctttttattgtagccatcaatgaacacatctgagggtgtctgaaacctccacaccagcccactactttcacactgaataacagatgagtttacaacttcccgtatgtataacagacgcacacgtgaaaaatggtatgcgacgggcgagcaggctagagcacctgcaacttactgagatgctccaggagagaggtcgccttgcgcttggctctgtccgagccggtcttggacagctccgttaatggtatttgagcacccagcctccctatgcaagcgagattctgggcatccttcttgcagagtgcaagtaaaatggcagcggcattctccttgttgcgggcctggcttgatcttaacaaatcgatcaagaaggggatggtgtgagccttggctatcgccgttttgcactcgtggtgactcacgagaaccgacaggattgtgagcgcctcgtcggtggctccggcgctagatgaatcttgcagcatctgaaccagtggcgacaatattcctgcccggaccgcgcggaccttgtttgcctggtatatgcatagattgaacagtgctgttgctgcatcttttctacctcttgaactgccactcttcagcagctcaaccaatgcttcaatcgccccgggcgtgcttcctatcattatcttgttatcatcgattagtgacaagctgaaaatagctgcagctgcattttctcttgcctccatgctacccgtcctaagcacctgtatgattgggacaatggcaccaccaaccactatcagttccttgttttgatcatatatggagagattcaaaagagatgtaactgcgtgttcctgggtttttgggtcttttgaggacaaaagtttcactagagcagga

SEQ ID NO: 32200 - DNA, 629 bp, Triticum aestivum
  unsure (1)..(629): unsure at all n locations
  Clone ID: PAT_TA_32200
gccatctcctctagctcgcctcacctcttctcccttgtgctgcttgacccggccggcatgtcgcggctctcgatggcgacgctgctcctgctctcccttgcgctggcgacggccccgcgcctcgccgtcgtggaggcggtcgtcgtggaaggcctgagggtggggttctacaacaggacgtgcccggacgccgagcaggtggtccgcgacgtggtgatgaacgactacgccatggaccacaccatcgccccgggcctcatccgcatcttcttccacgactgcttcatcacggggtgcgacgcgtccatcctgctggacgagtccccgtcgggcgacatcccggagaaggagtcgtcggcgaacgggttcaccctgcacggcctgcagacgatcgacgtggccaaggcgagcatcgaggccatgtgcccgcgcacggtgtcgtgctccgacatcctgtcgttcgcggcgcgcgacgcggcggtggcggcggggctgccgagctacgaggtggccggcgggcggcgcgacggcacgcactcccggatggacgacctgccgggcaactncccggtgccggggcacacggtgcccggggctgangaagctgttcgcgagccggggcctgtcgc

SEQ ID NO: 32201 - DNA, 1643 bp, Triticum aestivum
  Clone ID: PAT_TA_32201
tccgcggacgcgtggggaatggtgcattggagtttctgaatgagcaaaaccgtggcccacgtgctgcaaaaccaaagaaacaagacagagacaattctttagtagatgacaaaagcgagaaaaccactcaacttattgacagtgaactgtacaattgtcctgattttgccacggagtacaaggatgcgattttttttgtaattaaatcatacacggaggaccatgtacataggagcattaagtacaatgtttgggccagcacagctagtggcaatagaaagctggattcagcttatcgtgcggccaaacagaaagaagaccattgccgtgttttcttgttcttctcggttaatggcagtggtcagttctgtggtgttgctgagatgattggacctgttgactttgacagaagtgttgattattggcagcaagacaagtggagtggccagtttcctgtgaagtggcacattattaaggatgtcccaaacaccctactccggcacatcacacttgagaataatgacaacaaacctgtaacaaatagcagggacacccaggaggtcaagctagagtatggtctccagatgctaagcatattcaagaatcatgaggccgagacaagcattgtggaggacttctacttctatgagcaacgggagaaagccttgaaggaaaatagacgtcagcagcagcctggcagcgcagagtccctgaagccaacagacgctaaggctgtagggaattctgttactcatatcgcggactcattttctcggagtgtccagctgaaagaaattgagaaaagtgataacaaactgacagctgatggtgccatctcagtgaatgatgcacagacagctaccgtcaaggccgaagaaagcaacgcaaacaaaactaaaggtcctgtggaggagagcagttgatttatctcctgccatttactagtttggagcagctatgatttgatgctcgtcaggagttgagaacggaaaaagatgccgattcgagttcaggcgtgggctgctgctgcttcagttgtgaacatcatagtccttatttcgcctccacttaggttatagtttcaatatcatagttccaaaattcttgttcgtggatccttgcttccgtgttctttcttgttttcttctctttatttttttacttgtgttgtgtcgtgaatgctgttaagttttagtggccttctcaactccttttggtttaccctctatcataaatgctgtcgagttttagtggtacctgcatcgtgttgtgaatgatgttcccttctactagtgttttagccgtaagaagggacggatttatgcatcaataacattccataatctacagctttgtgatagtttcaaaaaaaaaaccgcggccgccttggtcttctccacgccgcccttcttgccgccgccgccggcgttgccgccgccgcgcgcccgcggctcgggtcggcgcccgtgtcccactggtccgcccacgacgtcccgaacgagttgctccgctgcatgccggcgacgaagaggacgagcgtcgatcgatcaacacggacaaaaactccgctgacttaggaaccgagggccggatggatgctttgtgtgcgtgcgtgcgtagggacaaagtcttcttcttggatc

SEQ ID NO: 32202 - DNA, 1086 bp, Triticum aestivum
  unsure (1)..(1086): unsure at all n locations
  Clone ID: PAT_TA_32202
gtctgaaacagtgatnnaatatgaagaaaaaaaagtacaaagtcaaatccttcatttctgtacatgagaaggctataaaacagagcaaagctaagcagtccgcaggcacatcactaaaataacgggatgtacgtctgccgggactgttttatgtgtagggacttttcggctctttgtgacagacttcttggtcaagcgggaggtacatattagggcctaaacgaggcaccagggacttagggacgttgattcttatggtgggtctttttcggttctttttcaacaatgcatctccatgtattcaatggcccgccatcccatggtgttgtttgattgttatttttttatatactagaagcaacatggtcatttaataatctctagaaagggactaaggactttttaatctctgaaaacaaataggaaggaactttttaagcactagagactttttagttgggattagaaaaagttctaaaacttataaactataagaacatcatcggtccatgacgattccatacatatccaaacgtctcagatgaccggtcagtacccggcggccacctcggagccgccgccctgcttgccgctcttgccggcgctcttcttctggtacttgtccttgatccactggaacccctgcgcggtgccggccttgaccttcttcagcccggtggccgcggccgccttggtcttctccacgccgcccttcttgccgtcgccgccaccgttgccgccgccgcgcgcccgcgggctcgggtcggcgccggtgtcccactggtccgcccacgacgtcccgaacgagctgctccgctgcatgccggcgacgacgaaaggaacgaccgtcgatgaacaaaccctgctgacttaggaaccgaggaacggatggatgctttgtgtgcgtgcgtgcgtagggacaaagtcttgcctcgtgccggtcacgagccagatccccaccccttattcggcggcccgcgcttccgtgctctcccgtgttcccctcgctttttctttcacgtctgttctgtcgggctcccggcctcggtccccctgtttnttgntgccaangtaattaggctcnnc

SEQ ID NO: 32203 - DNA, 441 bp, Triticum aestivum
  Clone ID: PAT_TA_32203
cccacgcgtccgcgcccactacggcctgctcatcgtgcctctctgcgtcttcttcggcatcggcgtccgcgcactggtcgacccttgattccatccatgatccatgccgagcgagcatgaccgctacctatatatgctatggagtcagatcgtagtagtatatcactaatgttagatggatgtgcatgatgcatggtggagatcagatcgatcgatgtatgcacccttctagctacctagtgactggattactggaaagacccttctatattactactatgtgtttctgtgagctgtgacactgttatatatagctgatgtgatgtgtttgtggctcttttttgttcttctttatttttgtgagatttgcaaagagtagatcgacaaatgtgcaatgctgctgaaatgttctaatttattaatgtgtttgttctaattgct

SEQ ID NO: 32204 - DNA, 1093 bp, Triticum aestivum
  Clone ID: PAT_TA_32204
ccatctcattctcctctcacagtccactccacaaacacaggccacaaagcagctgatttccttctcgtgcgcggcgtcggcgatggaggctggtggtgctgccggtggccgtcaacccgtcgttgttattgttgttgccggagcaggtgcggcgacggtgcagatccgtgcggtggcgtgtgtgcagctcgtcctcggcttggcagcggcgacattcgccctctgcgtcaccaccctccacccccagctgaagcagcagggggctgcctgcgctaccaccgaggacgaggagaacgcggtggccatgcgcacccacgggctgctgctgctgctctccgccggcacccaggcagcagcggccacggtagctgccttggcgccggtctcctggaggccttcgcccaggattttcgcggccttcgcccacgccgtcagcatcctcacctacttccacttcattaacgccttcgtcgccggcgccttcggcacctaccctgtgcgcgtgcaagccgacagtgccgagttcatcgcccactacggcctgctcatcgtgcctctctgcgtcttcttcggcatccgcgtccgcgcactcgtcgagccttgattccatccatgatccatgccgagcgagcatgaccgctacctatatatgctatggagtcaggtactctagtcttgccatctaaatatctattggctagtggttgattagtgtggcactaattatggttaataagtgtgccgctgtgatggaatgaacagatcgtagtagtatatcactaatgttagatggatgtgcatgatgcatggtggagatcagatcgatgtatgcacccttctagctacctagtggctgaattactggaaagaccctcctatattactactatgtgtttctgtgagctgtgacagactgttatatatagctgatgtgatgtatttgtggctcttttttgttcttctttatttttgtgagatttgcaaagagtagatcgacaaatgtgcaatgctgctgaaatgttctaatttattcatgtgtttgttctaattgctccagataaatctctcactgccagagaatgtagagggaagc

SEQ ID NO: 32205 - DNA, 989 bp, Triticum aestivum
  Clone ID: PAT_TA_32205
gaattcggctcgtgtttttttaataaaagtgcattcgggatttcattaaagcaagtggtaattacacaaatatattagctggagcttgtaggtgctaccagcttacaatatgacaccaatcaggagagaaaatccaagcaactaaacaggacacacgaatcctagtaaccctctaacatcttatacatcacaagtttggactggaatcttgagctgctgcacaacctcctaaatcctggtatgctccagagtgcgcaagaaagcattccattgctgcagtaagtagatcattttgtagagatcacaacggtgagataaccatagacaggcaaacaagggaagccggctgcgacacgatctctggaaagactacctaacacaaccgtctcaagtgtcaacatgaggacatgtcaaagggatcagcctcagaaaaaccatggtatttgaagctcttctttgtatcccattttagttcaatctgtgcatctcgagaactctattctccacttgcaaccgtttacgttgaaaacgcatccatttgctgttgcagcggttgacaactccaatttccatttccataagcacttttgcattcaaaacaaagaattgggcaatgtgattaacttgtgtccggttgccatcgtaattcttcaatcccactttttttagatggacttctaggcattcaattgaacccagtgggtcatactttgcgcacattattcatatcctcctgtgggtgcgaaatgacgtatagcctctctaagaaagtgaagcacttgagtaggccaacaattgcatccagattgggaccaatagagtcaacaaccaaaatcttcactttatgcattatggttgtcaagctgacatcaattgttttctggagaactgtggttccaggcttgagtgtagatatgccatgagacaacaaccccaatagctccagtttaggtgccccggttatccggatggtcgccggaccaatgtgt

SEQ ID NO: 32206 - DNA, 401 bp, Triticum aestivum
  Clone ID: PAT_TA_32206
gaatttgaatttaattcaaaatttactgacaagatgaggagaattaagatacctctgcctccagttgatgagaaaaagaaggtagttgaagatgttgacaaggatcgaagatacgcaattgatgcatccattgttcgtattatgaagagccggaaagtcttgggtcaccagacactagtaatggagtgtgtggagcaacttggtcgcatgttcaagcccgacttcaaagcaataaagaagcgcattgaggatcttataaccagggattacctggagagggacaaggagaacccgaacgtctaccgatacttggcttgatcatctgttctccatgctgggttcggtaacagtgtatgactaccaagctactgctatttaaggatgctatattttgtgccatg

SEQ ID NO: 32207 - DNA, 1846 bp, Triticum aestivum
  Clone ID: PAT_TA_32207
cgtccgcggacgcgtgggggagaattaagatacctctgcctccagttgatgagaaaaagaaggtagttgaagatgttgacaaggatcgaagatacgcaattgatgcatccattgttcgtattatgaagagccggaaagtcttaggtcaccagacactagtaatggagtgtgtggagcaacttggtcgcatgttcaagcccgacttcaaagcaattaagaagcgcattgaggatcttataaccagggattacctggagagggacaaggagaacccgaacgtctaccgatacttggcttgatcatcggttctccatgctgggtcgagatcatgaaggaggatgacagccaatggccggtagtcagactgagcgatggcggcggcggcggcgcggcaacctctccgccccctacgaagagagagaaaaccatggcggcggtcggcggcgcgggccatggagccggcgagaaggctccggcgccagaaagatagagaaaaccatggcggcggctcgacggcgcgggcaacggagcaggcgaggaggcaggtggggccgagttctacctgcggtactacgtggggcacaagggcaagttcgggcacgagttcctcgagttcgagttccgccccgacggcaagctccgctacgccaacaactccaactacaagaatgacaccatgatccgcaaggaggtcttcgtctccccctccgtgctccgcgaggccaggaggatcatccaggactcggagataatgaaggaggacgacagcaactggccggagcccgaccgcgtcggcaggcaggagctcgagattgtcatgggcaacgagcacatctccttcaccacctccaagatcggctccctcgttgacgtccatgaccagcaatggacccggatgggtcctaccgcaatcttctactacctcgtccacggaccttaaatgtttcgtgttttcacttatcaacctccactttaagatcaagcctattcaactttgagctatgttgggttttcccggttgtgttatggtactgcgagtgttagagaattctgtacttatgtaatatgccatgagttgcttctgatgcggttgggtgtgcgtggaacactgtgggtgatcccttttggcatcacctgaggttattggattgtgcaaatcttgccagtgcacaccgcattttcttgtccagtatggataaccttggtggcggcatccgacatctggtcatttgtacatgaaggtcgtcagatccagttctttggccctacctgtatgatagaactgctctggtaaaagagaaggtggttcgtcggggcaggccttggtaaatgttgtacactcctactggttgttgtgttcagttttttcgattgtattatcaatatagttttcctgtaatatatccttgcgacacaaagataattcaaagggatgtatctcttgctggaccaccttcggctgtgtaatttctgtagcagcggcaagagactgtattgtgacttcacaaggatttcatataaagagatgatgatagatgtcaaaaaaaaaaaaaaaaaaaaaaaaaaaaacagagaaaccaacaacagaaaaaaaaaaaaaagaaaacaaaagagcaaaaagaaaaaaaaaaaaaaaaaactcccacaaaaaaaaaaagggggggcccttttaagggaaccaagtttactacccggggcttgcaaaggaataatttttttatgggggccaaaaaaaaaaattacggggccggggttttaaaaggggggggggggaaaaacccgggggtacccaaaataaaaggctttggaaaaaaaccccttttgcgcaggtggggaaaaaagaaaa

SEQ ID NO: 32208 - DNA, 545 bp, Triticum aestivum
  Clone ID: PAT_TA_32208
ccctcgaggtcctgtccccccccccgggctagttcgtccgcgtcgaccccgtccccggctccttcctcgtcaacatcggcgacgtcggcacggcgtggagcaacgggaggctgcacaccgtgaagcaccgggtgcagtgcgtggcggcggtcccgcgcatctcgatcgccatgttcctgctcgcgcccaaggacgacagggtgtgcgcgccggaggcgttcgtcgacccgcagcacccgcgccggttcaaggcgttcaactacgatgactacaggaagctccggctgtccaccggcgagcgtgccggcgaggcgctcgctcgaatggcggcctgagacgcgtgacgtagctatttggcggggcctctgcctgcctgttggctcgagagtgtaactctgagcttttcagagagagctaagcttcagtcgattattgacgtcgagagtgtaactctgagcttttcagagagagctaagcttcagtcgattattgacgtcgagagtgtaactctgagcttttcagagagagctaagcttcagtcgatt

SEQ ID NO: 32209 - DNA, 1397 bp, Triticum aestivum
  Clone ID: PAT_TA_32209
gccgccagttcgggtaagcttgtcccgacaagcggcggcgcgactcgccgccctgccccctgcgtccctctcacggccggcctccaaatactactcctacatctccacggccggccccctgcagtagatagatctccgcaggcaagccagcgagatcggcgcgtcgcgtgactccgcccagctagtaaagcagcgccgatggtggagatcccggtggtcgacctgcggctcgccggcgcgcagccggaggagtcggcgcggctgcgggacgcgtgcgagcgcctgggctgcttccgcgtgtacggccacggcgtgcccgcggcgctccaggcggagatgaaggccgccgtgcgcgcgctcttcgacctccccgacgaagccaagcgccgcaacgccgacatcatcgccggcagcggctacgtcgcgcccagccccgccaacccgctctacgaggccttcggcctcctggacgccgccgcccccgtcgacgtcgacgccttctgcgcgcgcctcgacgcgccgccccgcgccagggagaccgtcaagagctacgccgaggcgatgcacgagctgatcgtggacgtcgccggcaaggtggccgcgagcctggggctggagggccacccgttccaggactggccgtgccagttccgcatcaacaggtacaactacacgcaggacaccgtggggtcctcgggcgtgcagatccacacggactccggcttcctcaccgtgctccaggaggacgactgcgtcggcggcctcgaggtgctggaccccgccaccggcgagttcgtccgcgtcgaccccgtccccggctcgttcctcgtcaacatcggcgacgtcggcacggcgtggagcaacgggaggctgcacaccgtgaagcaccgggtgcagtgcgtggcggcggtgccccgcatctcgatcgccatgttcctgctcgcgcccaaggacgacagggtgtgcgcgccggaggcgttcgtcgacgcgcagcacccgcgccggttcaaggcgttcaactacgatgactacagaaagctccggctgtccaccggcgagcgcgctggcgaggcgctcgctcgaatggctgcgtgacgtagctatctggcggggcttgtttaggttcgagactgtaaactctgagctgttcagagagagctaagcttcagtcgattattgacggttgaaccaagtgaggctgtgaattgtcgctgttttcatctatcaataaaatcttgtacgtactctaaaaaaaaagctggtacgaattgcaaaagtgaaaaccgcaaaaggtgcaaacacgacagcaatctttttttatttttattttttttcaaaaaaaaaaaaaaaaaaaaaaaaaaaagcggcagctcaaaaagatcaaaacttaaaataga

SEQ ID NO: 32210 - DNA, 668 bp, Triticum aestivum
  Clone ID: PAT_TA_32210
cggatccgtgggccttggacgaaaattatctcagggaggatccgcagctctttgccttgaatgaggcgttgctaacactactgcaggatgctgctaacgtgacactacgaccagcggcctttcggcgaaactgtgtgcgatgcactaatcacaaacggtggtgtaaaaaaccgtcaaaaaaggtgcaaaacgtttgcgatgatggatgcatcaaacacggttcagattttggttgtgtgtgcgatgcagggcatacggttcatttcaattaactgtttgcgatgaggaggaacaaaagaaacgggctgccatatgaaggcgtgtgcgatgtagagcatacggttcactcgaatgaactatttgtgatgaggcggaacaacagaaacgggcagccagataaaggtgtgtgcgatatacggcatacagttcactcggatgaactgtttgcgttgagccaagagaacagaaacggttcaacttaacaagatgtgtgtgatacgcggcagacaggtctgtaatcggaaatgtgtgggaagaccgataacaacatagacgattcctgttaacaagccgtgtgtgttgtgagcaaacgattgctggtatacaattgtcagtgattgatgaaatcatcaccaacgggttccattgtttagtctgtgtgcgatgtg

SEQ ID NO: 32211 - DNA, 652 bp, Triticum aestivum
  Clone ID: PAT_TA_32211
cccggtccccaaatccacacgacccctcaaaagaaaaccacagcgatcggggacgagcagcgccgtacgcacggaatcgccgccgcgtcgcatggccaaccacggcgacctctccccgccggccgacggcggctcccaggagctgattccagtcatctaccagtcaccatacagcatgacaccacagggtcctccatgttcatggcttttttactataggccagttcctctcggaggttttcggaggcccgtgtacgaagatgggacgacaagggtgctatgcttgagccaaatgttttctccagaccagctagaagacgacgagtactaccaaaagttttgccggaggatgacggcggaaggacagagatccggcggtaaactcaggaggaccgtcgtcccacggccggaccccagcggcgctccggtcgccggagttggcaaggtgtttctggaatacgccgatatcgacagcgcagcatattccaagacgatgttgcattggatgtggtttgaggggaggcaggtgtttgctgtgttctatcccgaggacaagtttgctgctggggactatgatggataaaatggaaatcttacttatctttattgtaagaattatgtgtctcaaagcatacttacgcataatatgttt

SEQ ID NO: 32212 - DNA, 748 bp, Triticum aestivum
  unsure (1)..(748): unsure at all n locations
  Clone ID: PAT_TA_32212
gntgacctcaactttcagctacaaaatgagacttanaaaaagaggcaaggctgcttgtagggaggagattgagttacagcgtgaagaaggacggcacatcaaataaccacaatgaggaagagcagtacatcaccctagtccgtacatcaccagactatcctgatggcagagcaaccgcactgctaaactggaaactactcgcaatggagttcttacccaaagaggatgcagtctttgtgctcctcttatgcatggcaatcacacggacaatgacggagatcagaagggaagatgtggccgggcttctggtgcgacgaagaatacgtgagccgcaggtagggcagagagactggggctccgtgatgctgccacactcgccttcccttgaccctcatttgcagccgtggtaccggaatgcagcgcgtgttttgagctctgcagagacggtgctgcctaacagagcgatgcccattgggaactcgcctaccgatggcaaggatgagctgtacaggcaagctcttataccttgaagccctgatggatatagtttttgtgaaggaatgtacagggcaaacaatgatgatgatctttaccacagattttttattatattatggttaacatgtcatctgaaaatggcttgatttgttgttgggtatggtttgcctgtcgatagatcgaaatctttgtattgcttcgagtgtattgtgattcagaataatacggaagatatcccagaacatgtttg

SEQ ID NO: 32213 - DNA, 765 bp, Triticum aestivum
  Clone ID: PAT_TA_32213
atttcacaaagcatcctttaacctctccatattcaagtcgcaacgaacttccaaaactattctcaacacttgtgcacacgcaaagattccatgggagcgaagctttcctgcttttccaaccacggaggcagcctctcgcagcagccacaccagccggcgcctgtcagggtcgttgccgcggacggctcgctgaaggagctcccggccagcccacgcgtcaccgtctccgacgtcctcggcgggagcgccgcgtccttcttcgtgtgcaactccgacgcgctctacttcgagcagagccctccggcgctggcatccggggaggtactccggccggggcagatatacttcgtgctcccggcggcgttgctcgggcggccgctatccagcgccgagatggcctcgcttgcggtgcgcgcgagctcggcgatcgcggccaagaagccgcagcggaggcgcgggcgccgcagcggcgggaggaagaaggtgcgcgtcatgccggtgcgcgaggaggtggaagacggcgaggacgttctgctgaacgagaagcttaacgagcggacgctcggggagttcgcggtgtcgccgatgagcccagagaagatcggcgtggtggcggcacggtcgcggctgaagatgaagctgaagcgcgctctgagtatcattcaagaggttgctgagtgaagcatttctctaaaagataaatactagtggtgtttttttttagtttttggcctcggtttgaatccataattaggtttaagccca

SEQ ID NO: 32214 - DNA, 956 bp, Triticum aestivum
  Clone ID: PAT_TA_32214
ctcaggccggccggccgggattctcacatccaacatccaaagctccaacgaactcgacagaaaaatctcacacttccacgcacagcatacctgcaaagattccatgggcgccaagatttcctgctcttccatccaccgaggaaccctctcgcagcagccacaccatccggcgccggtcagggtcatcgccgccgacggctcgctgaaggagctcccggccagcccccgagtcgccgtctccgacgttcttgccggcgaggccgcctccttcttcgtgtgcaactccgacgcgctctacttcaacgagcccccacctgcgctagcctccgacgagctgctccggccgggacaaatatacttcctgctcccggccgcggagctggggcggccgctctcgagcgccgacatggccgcgctcgccgtgcgggcgagcgcagcgatcgcggccaagagccccgagcagcgcggcggcaagaagaacctgcgcgtcgtgccggtgcgcgaggaggtggaagactgcgaggacgtcatgttcaacgagaagcttaacgagcggacgctcggggagttcgccgtgtcgctgagtccggcgaagaagagcaacgggaagctcgcagcgcggtcgcggctgaggctgaagcgagctctgagcatcatacaggaggctgctgactgactcgagcatttctgcaagagaatagtgttggtcatttttttttttttttgcttcaattttggaaccattcttaattcatgaggccaaacggcctaggagtattaaattgatttttgttagtagatttaggcgggaaagaacaaaaaattgggaaagagactgtaaatatctcccagtatttatagtacaatactggatgcaaaactaccgggaatgccaaaaattaattcttgcccgggcggagttgttatctacttctaatctgtatggtgttttgtat

SEQ ID NO: 32215 - DNA, 1053 bp, Triticum aestivum
  Clone ID: PAT_TA_32215
cgcaccacgagccgcgtccgactgccgagagagagacagagagctcggagaagccaacgcccaatcgcccacgcttccacctccccctccacgaggcaaggtaggaaaccctaggcaacgaccatggcgctgctcccgcgcacggcccggctggccctcctctccgcgtcgccgcggacgtactccgccgccgccgcggcgggcgcctcgccgaccccaccggcgccctacgcgggcgtgcctccgccggcggcggggtccaaggcggccgagttcgtggtctccaaggtggacgacctcatgaactgggcgcgccggggctcgatctggccaatgaccttcgggctcgcctgctgcgccgtcgagatgatgcacgccggcgcggcccgctacgacttcgaccgattcggcgtcatcttccgcccgtccccacgccagtccgactgcatgatagtcgccggcacgctcaccaacaagatggcgcccgccctccgcaaggtttatgaccagatgcccgagcctcgatgggtcatatcgatgggcagctgtgccaacggtggtggatactaccactactcctactctgttgtgcgtggatgcgaccgcattgttccggtggatatctacgtccctggatgccccccaaccgctgaggccctactatacggtgttctccagctccagaagaagatcaacaggcgcaaggatttccttcactggtggaccaagtgaagcgccgtttgttactgttctggcttgttatatttgtttttgattctacactgaaataaggacgttgtgctcggacgtgcaaaatttgctgttgtttgtgcctggttggatgtatgcccgggctgtgctgatgagcatggactcgtgtacttggtgttgctgtaactgcttttgctctacatattgtaatacacctttatgacttcgttcttgtatgatgcaaatttgctacagtgtacttggtgttgctgtaactgcttttgctctacatattgtaatacacctttatgacttcaaaaaaaaaaaaaaaaaaggccccta

SEQ ID NO: 32216 - DNA, 1787 bp, Triticum aestivum
  unsure (1)..(1787): unsure at all n locations
  Clone ID: PAT_TA_32216
ggtccagccacgtgcccgggatggcacgaacccccggcccaccgcccatgctcctacttccccccccacaggggaagaagggaacccctggccaccgccagtgcgctgcccccggcgacggccccgccggccctccccctcccgtccccgcggacccacttcgcccccgcccccccgcgggcctcgccccgcccaccggcgcggtctgcgagggtgtctccgcggcgggcggggggcatgggggcgggggcggtctggtcccatgcaggatggccggctgcactcggacgggcggggagacgaggtcccgctcgggctccagttccgtccggctccgcccgtctgggatgggcgcacgccggcgccgccgtggacgacctcgaccgagtcggcgacaccttcgacccgtcccccgcgccagcccccactgcatcaatgccccaaggcacgctcacgaagcaaggctggcgcccgacccccgcaaggtttatcaccagatgcccgagcctcgatggttcatatccatgggcgagctgtgccgaagggcaggggatactactgctactgctactctgtagtacttctattcgtcttctgtgttccggtgggagctctaggtctctgggctgccccccaactcctgtggtccccctatacgtgtttcacgggctccaatgaaggcgctcaccgtggcgccaggaatatcctcgacttggaaatgcgattcgaaccgtcgttggtcactgttctgagatgtgtttttttcttttgattcttgaacttatttataggagtttatgcacggacgttcagaactttgtggtcttaattgcagcatttgtttatgggctgggtgtgctaagctgtatgaactacctcacttggtgattctggaaaaggtttggctatgaaaatggaaatactttttctcaacttattctattgaagtttttgacatcatccaaggaaggtagtaacaaaggcagcactattcaagacaagtaattggaggggaaattactttgaacaactgcccatcagttctagaggagaagtgctccaaaaatgaacatgatgccgccccacttggtgtattatctggcatcagcaaggatcatgaatacagcaataaagggccacagaacctgagaataccagtagactcagcttcatctgatgatctggcctttgcaaatgggaaagcggataattcagattttgctgatgaggatgaaccttcagaagagatcacagtgtccgcaaccgaaccaactactggagcacttgaaggcagggatgagcatgatgaagatactgatgacgaagatgaagaggaagaggaagaagagaaaagttcgtcagcgaagaagttgtggcgttttctcatcacatgagtagcagcttccccggtagtatagacatacagagctgactgtaggctgacagttacctggctcttatgaagttgctttgctcttagctccatttgtgtctccacctttcgggttgaaaggttgggtgcttgttggttttgtgtgcctgtgagcagcggaggttttggaagccgctgtgatgaatcacgccatgcatgtgttctttattttcacatcctgaaggcttcaacgtgtaaagtggttgatagcttgtagtttgtgtacaaattgatcgggggtgtaggaacagcccatatgatgagtattagtgctgccgttatgggtggtgtgacagtcgcctgttcagtgctcgttcaagtaggtgatttttattcncttgatgtgtgactcgta

SEQ ID NO: 32217 - DNA, 1296 bp, Triticum aestivum
  unsure (1)..(1296): unsure at all n locations
  Clone ID: PAT_TA_32217
gtcttgtactgtgagaattagccgcccagcatttctcttggatagctaaatgtttagcacttagcactgtgatataaaggaccaaatactcaacttataacaatgtttcaacaccaaactgctggggaatatcgtatcatgatgggcactgatgttcgtatacaacgagatcctttggcaatgaggatgcgtgaagaccagattaaacagatttggggtggtgatcctgtttacccaactgtgaactatgttcaggatcctgatgaagtgattgactacaggagtccggaatttcatgagcctacccctgaagtagtaccttatttgatggagcatgggataatgatcacgaaggaagaactggatgcacgtttgatggaagaggaagaagacatcaatcaagacattacgtacattcctgaagtcaaagatcccatgtctactgctgttgatattggagagcattctttcaatgaagatagtgatgatgatgaggaggttgacaaagctgtcacactgcccgagtcactagaggatgaggaagagggcggcgatgaggctgcggaagttgaagggaaagtgagtcagaactggagtgttctaaagactactgggcaggacgaaaaaccaaaggaaaagttaaagaaagaccagatgtcacttaaagacgctattaatgagtctgagaaccttactgatttccttatggactttgaagaagatgagtaatattgtgggtgtttactttccgttttgcggaggatataagccatctgtaacattggattgttcgaggacggaatcatgacggtctataactgatagaggcaatgatggcccttccttgcccacaatactaggcctggtccccccgtcctgatatgctcgagggagttaaaaaagtcatccagatcttcatcatagtcaggaaagtgtccctcatcccgtgctagatttatcatgatggtgttgacatagctttgataattcacggttagggcttctggcggtccatagccgctaggggcgatgaagacgattggatgcccacaaaactccacctgttcaaccgggccagtcatgttggcgaacgatatggtggtatgggagatcatacgatggaagatagccgaagctgccttcagtccaaacactttgaagatcacttctgcggcgacatgtgtgaataccacctccagtgagctcttcttcctgtccacaaccttcttcccncttgcgaacgtagtcgagcgggtcgctgtgcatgccgatgaagaacggagggatgatgaaccc

SEQ ID NO: 32218 - DNA, 493 bp, Triticum aestivum
  unsure (1)..(493): unsure at all n locations
  Clone ID: PAT_TA_32218
aaggagagagacgcatagaacctgagttcagatgagagggcagagcgaggaggagatgttgcatccactgcatagaagggataatcacgctgtatatgctatgtgtagaacatacatatactatgataactgatgcggcgttatataccggcggtcgatcggaggaaatatttatctgatgccatgaagaataatttttaatatctaggcaagtagctgctttgctaaactccctgatctcgccttattgttgtcttccttgattatctagtaatattatcgcaccttgatccttgttgatccttgttgatccttgttgatcctgtgttgatccttgagagagggatgtgttttcctcataatccatttgttgacggagctccccgccggaagtgccgcaangngcacttcacggggccgtcctccgtccgccgcgttgctcaagttcgcgggcctctcctccgagctcaaggcacaaattcaatgttcgctc

SEQ ID NO: 32219 - DNA, 1059 bp, Triticum aestivum
  unsure (1)..(1059): unsure at all n locations
  Clone ID: PAT_TA_32219
gnagtggcaggcaaggggatcctgggagctctcgcttctttcttagtcttgaggataacatcttccgaatcttcggaggtgaccggatacagggtctgatgcaagctttcagagttgaagatcttcctattgaatcaaagatgctaacaagggccctagatgaagctcaacggaaagttgagaactacttttttgatatcaggaagcagctattcgagtatgatgaggtattaaatagccagcgggatagggtatatgcagaaagaagacgtgccctagcatctggtagcctggagtcacttattgtggagtatgctgaattaacaatggaagacatattagaggcaaacataggtcctggtaccccaagggaaagttgggatcttggcaagctgatagctaaagttcaacagtattgttacctattaaatgacttgacacccgaactgttggagagtaaatgctcaagctacgaggatttacaagagtaccttcgaacccgagggcgtgaagcatacttccaaaaagctgaaattgtggagaagcaagctccaggcttgatgaaggaagccgagcgattcctaatcctaagcaatattgataagctctggaaagaacacttgcaagctttaaagtttgtgcaacaagctgttgggttaaggggctatgctcaacgagacccccttatcgaatataaacttgagggatataatcttttcttggatatgatggctcaaatccggaggaatgttatttattctgtatatcagttcaaaccagtgatgaagaagcaagaggaggaaagttctgaaaagaaagatccaaaaaagaatctgcagaagggtgccaagaaacttggtgcagcccaagctgcgtcttgagtttgatgtgatctttttttgtaggtacggtttttgctgattttgagaatcgaggtgtatatgttctcttacagtttacgatggcttacagtgtgggaggacacaagtacaaatgatgcggtggctttttgtatgatgtaattacttaaatcttgataagttcttcctttagatcact

SEQ ID NO: 32220 - DNA, 1100 bp, Triticum aestivum
  unsure (1)..(1100): unsure at all n locations
  Clone ID: PAT_TA_32220
cccgggttctacccacgccgtccggngggaatnaagtgtttaaggatttacctgtggagttctctcagaagattgtacatgctttgcaaatgaagtcccgcacaccaagcaacttcacaagagtgcttgctgatgcactcgccgcaatcggagataatatggtagttattggttcacccaagggcccagtaatctgtcgaaacttaaatgcttatatgattagcaaagaggatttgcatgatgttccaaagataatggctcttctgtgttctgaagaacgaagttctgtacaagagactctgttgcctgaaaaatctgatggtgataagtctggcaatgttatttctggaaacattcctaaggctgtacaagataatgagatggagcataggagtaagatagatattgttgagatactctttgagaagcttgagattttaaaagccgacaaggatggcctgaaagatccaaggcgtgttattgaataccttataagtgcccttccatggctggaaggtggccgtctagcagcgattgataaacgattgctggaagacgtcaggcgcatctgcagtgagttcgaaaatggttccgacagggcgcagagaaatgcttgtcttgctgtggagaagctgtggaagggtgagaagaaactgccgatgatcttccgcatggtgactgatgcaaggctatgcaagattgaaaatcaagcgacattccaacgcatggatgacaggagcaacgacgctgcaatggctgctgtagagacgcacgctgacgccgacggttgctcagatgacgatgataaacctgacacgggagaagctgcggcctcgacttccaaaaagggggcgcagaagcagaagagcaagaagaaatccaagaagtccaagggccggggcaagaagtgagctgctgtagctgtggcccgtaggcgctgcggtttccctgtaacgaaacatttacctgcattggagaaaaacctgtatatccgagtagggcgttttggtgcccaggctcatctgcacccggttagaaaaaaattcataaaaaattcaaaacaaattcaaaaaattccaaatagaatttgtgggtagaca

SEQ ID NO: 32221 - DNA, 759 bp, Triticum aestivum
  Clone ID: PAT_TA_32221
tctttttctgttgaagggcgttcttcacgcggtgacctcctcggcgtgagcgcaccaggcagcgccaccagctgtgcgcgatcccaactgatcgcgccatggtaacggcggtggcagccgtgctggagcctccgtcacggtcgccgctgcggcggcggcaccggctggcgaacggggcgggtgctaccaccggcgacttctagctccggcactggcgcccggccaagaagagtagctcgtccgggatgaaggggcggtgggtgccgccggagatcgagatccccagcggcgaggaggggggatacaccagcctccgcgacatcatctcgtcgcccgagtacgccgcggccaagcaggctcactcccccgcggacggggccggaggcggcggggacgtgcacatgatacgccacccgctcgtgaagcacgcggcgtacgcgtacctgcagctcacgccatccgcgcgggaggaccccggcaggttgcgccggcggaggcgcggccccctctgccgccttgtcctcggctgtctcggctttgtcggggcgttcttcacgcggtgacctcggcgtgagccttacggttcttggtcaacttttttttgcctctcttgcttgtcgtttccagtcctttttctcgctcttttctccgtgtccgtgtatttagaacagaagaagcaatcgacttgttcgagttttgatcatggttgcaattcatgtaaatattttggtaggattataagaccaaaaaatgattatc

SEQ ID NO: 32222 - DNA, 1412 bp, Triticum aestivum
  Clone ID: PAT_TA_32222
cgcgcccccgtcgttcttctaccgggcgccatggccgccgcattagcagcgcctacaggcctcctcaagctccctccttcttacgcgccgccttcttccccctcttcccctctctccggcacctcctacgggcggcgctcgcggagacggcctcgcctttgccgccgcggagccccgctgctggcggtggcggccggggaggtgtcgtacactgagccggaggaggcgctgctggaggccctcgtcggcgtacagggccgtggccgtgcagtcgcgccgcgccagctccaggaggtggaaagcgcagtgcagactctggaggcgctggaaggtgtgcccgatccgacctcttcaagtttaattgaaggtagctggaagctcatattcacgacaagaccagggacggcatcccccattcagaggacattcgttggagttgactctttcagcgtctttcaggaagtttaccttagaacagatgatccaagggtggtcaacgttgtcaagttttcagaaacagttggtgaactggcagtacaggcagaagcaactataaacgatgggaagcgcattctcttccgttttgaccgagcagcattcgctttcaagttcttgccatttaaggttccgtatccggtgccattcaggcttcttggggatgaagcaaagggttggcttgacactacatacttatctcgtagtgggaacatacgcatttcaaggggaaacaagggaaccacatttgttctccagaaaagtgcagacccaaggcaaatgttgttgtcagctatatctgcaggaaccggagtaaaagaggctatagatgatcttacttcaagcaaaaaaggggttgtggttgatatgaacaccctagcgggagaatggcaactgttgtgggcttcacagagtgagagtggaggtggaagctggtcatctgttgcatctgccggtctcaaggatttccagaccataaaggaagatgggcaactgaagaatttggtgaacccctttccaggtgtcagcctcagtgcaagaggcaacatatgcaaaacagggaacaacaatgataccttcagcgtgtccatgaatgaaggcgttattcaagttggtggcatacagtttcccttggaaactggaggagaatatgtcatggagatcttgtacattgacaataagataagaatatctaggctcaaccagtacaagcttgttcatttacgcattgtaaataaaacataaatacccaattggaggatcggctgtggccaaattgtttgagcttattgctgtagaaattgttgtataccaggagtccaggacaacacttaggttgatgaaatcatgcatttgcgcatattcaccaccatgcagatttcgagttatttattattgagaaactgtatattttttta

SEQ ID NO: 32223 - DNA, 970 bp, Triticum aestivum
  Clone ID: PAT_TA_32223
cggccgcgtgggcgccgcccaatgctcgtcaaggcccgctgctccttcttcctccttttcctcaaattcaagggcaatcagcagcacacgccatcctcaaggcgcatggttcttctcttctctgatggatggatggatgggtggatgggttggtcgtggaggaggagaacgaccagaagaatagagtcccgtctcttctcttctcttcatcaatgccggccaggaacaacgacccagccacccctcaagggaaggtgtctttgtttactagtacttgagagggaattggaagtagtttgtcaactgaagcttggtgctgctcgacaccaaggagaggcgcaagggggtgcctagcaccggtgccgaagaatgccggtgctcctcttcgtctttgacctgctctgctccttcaaggtgatagccgaatggtatacgcgtgagattcttcttccactcaaacgcctcacgccctgcccctccagtagctgattcttcttcgactctgtcacatgtgacactccttgagtatgatgctgccatgttgagtctgtaatgtcataggcacacttgtcttgctgcagtacagattcgccgtatcaacagccctggctagtgttgctggatttatattgttctccttgggctggaactcgacttcatcccttatttttttgaaacgggacatgtctttaatttttgaaaaaaaaatggcaatgctgacttggcatttgacgggtggttttgagaattagcattatggaatttatgttataggttagcttgattaatctttactacgggatttccttttaaggagctagtgttgttgggttttcttccaaggagctagtcgggttttctatagtcaagcatgttagtcatagtggtataaatttgtatgagaaatgtcttggacatcctgtgtcaggaccccgattccaagtcacatcaatctagccggtaacccctc

SEQ ID NO: 32224 - DNA, 721 bp, Triticum aestivum
  Clone ID: PAT_TA_32224
gtctaccctatcctcatccccttccgtctgcggcgacagccgccgccaggcccttccccctctgcgcttagccggcgtgaccccaagccagattaggcccgccagccgccgccatgctccttcctcgcccctctgcgcgcagggtagacggcgagtggcgggaagggaagttgccgccgcgacctcgggccgatccaatccagatcggcctgacgtaggacgagctggcggcgccgagccgcgacggacggtagacctcgatgccagaagaacgggaggcgccaggagccggtgaataggtccgagtcaaacagatctggcgccgctgacaaaagctgaaggataggtctgatttcgccagatccggctttacctttctttgtctgacatctttatctgggaaaagaaagagatgacgagcagctgcgatagggaccactaattggagacggcggatccacagacccctcccctaaacgctgccgttgagggctgcgtcgatagtttcggtcttcttatatttttaagatgtcatctttaaagaagatgtgctgtgcgggtattaccgcatgatctttaggtcgttttctttgtttctttttttttgtttagtgtttgaatcagtaacaacaaaatatgtaaatacgttaacttgtggtaagagattaacattgttggttctttaaataatatatattttttgtcttctaaaaaaaaaaaa

SEQ ID NO: 32225 - DNA, 842 bp, Triticum aestivum
  Clone ID: PAT_TA_32225
agccccaactgacggagtgtgggcgcccgcgtgggctaaagagaatgccgcctctgatgcagcttcagtggttctattagggaacaggctttcgcaggttgtagatgccctatccctgtctaaagcaaccatggcaaaagtgcaccagaacttggcctgggcggtggcatacaacatagtggccatccccgtcgcggctggagcgctactgcctcaattcgatttcgccatgacaccctctctttcaggaggactgatggccctgagctccatctttgtcgtcagcaattctttgctcctgcagctgcatggatcgtttcagaaggcggaaagacccggaccggatgacctgaagtctagaccgaactctcagatattatagggtagacacgattatttgccgagacacacgtttgtacaggatcacagagcgtgcctcaactgaactgctcctagttttgtaccaccgacccagcacatacgagccgattcttgcaacggacgttgtacagcccagcaattctttgctcctgcagctgcatggatcgttgcagaaggcagaaagacccggaccggatcacctgaagtctagaccaaagtcccagatattatagggtagatacgattatttgtctgagacacgcgtttgtacaggatcatagagcgcgcctctgactgaactgctactagttttccaccactgtcccgacacatacgggtcgattcttgcaacggatgttgtacagcccgacacatgtgtccctgatatgaaaactctgttggcaacacgtaacaaaagatcatcgtccatatattgcgtcgtcaaaaaaaaaaaaaaaaaa

SEQ ID NO: 32226 - DNA, 885 bp, Triticum aestivum
  unsure (1)..(885): unsure at all n locations
  Clone ID: PAT_TA_32226
atcttctttcccggcctagnaatactagctccgtgcctctagtattgcacagcatatgtatacttcgtagctaggcttggtacgttgctagctaggtatacatggagacggagctgtctctggccttgggtcgccctgaaaccggcgacagcggggcggccggccggggtgcgggcaacggcgggaaggccgacgatgaggtccagccgctgttcccgtgcctcttctgcgacaggaagttcctcaagtcgcaggccctcgggggccaccagaacgcgcacaaggaggagcgcgcggccggctggaacccctacatctacggccgctaccccgttgccaatcccacctcgtctcgcgccgccgccagcaaaaagtcgatccctatggccacgcacggtggtggcggagccgccgccgcaccgcccctccatgtcgttcgtgaggctggcacgctggctccgtccgtccacggcgtgcgagcgggagccggcccgttctacggcgtccacgacgatgtgggggacatgctaagctcggaaaggtcaccggccgctgagccggagagcaacaccggcgtagggatcgacctggagctgcgactctagcttatttagctaccgacgacatgcatcttgcaggattatcttccagtctcttggttatttgcctttatcaatctatcttctgaaggtttgtgttgcccttcagtttttgttttgttttgcttgtgaagtgcctttatttcttcagactgatggttcgttgccttagtcaagctgtcaagctcaagcatgactcacttgccatactattgagtaattccaaatattattgcatcgcctcgtcaaattgctatatttgtgattggtacataaataattctcc

SEQ ID NO: 32227 - DNA, 716 bp, Triticum aestivum
  Clone ID: PAT_TA_32227
ggaacacctactgcaaagcctctccaactagccacagctgaccacacatagtacatgcgtataacttgagccagccagccaaagcaacgattatggcgtccatggcgagagctgcccgcctcctgctggtcgcgctgctggtcatctccgcggcggtcaccggctgccatggctacagcatcggtggaccggggttaatccccgaaccacggagcgggcatggaagaccctttgatcctttatacccacgtccatgccgcggactgagatgccggacgctgccgccacgcggccgcggtggcgcaccctacccctatggcggtcctcctccccctccccctcccccggacaacggaggacagccttgatgcttggcatgcatgcaagaaagctacgacctctcaccgaactgatactaatacatggaataagactaaagtttggtgttttccctaatacgtgtcatgtatacatggaacaagaaagctattacatggaataagacttgagagtggtttttctaacggtacggttcctaccgggtattcacacaccccacaatcgtggtccgagattatggtcaacatagtgatagtgcattatacgtatttcgatgggcagtacataatctcaacccatgtgtacatctgtacatgtacgaaacatagtaataccatgtggggctcatgtgtgagccatgcttcaaaaaaaaaaaa

SEQ ID NO: 32228 - DNA, 570 bp, Triticum aestivum
  Clone ID: PAT_TA_32228
cgccggccaggccacgccgccacgccgcgtagctcaacgccgccacgccgccgcgtcgcgccgctccacgctgtcgcgccatgcagctcccccgagcctcctcccggtgctctcccccgtgcagctcccctgttctttcctccggacctaaaaatcacttatttccatatcgatctgtagggcatggggacgagggcggcgacgagcgcgcctgttgccacggtgagctcaatactcttcggcagatcccttccccaaactctgctcctgacgacagctcattgctggggcttccccccatggatgaggaggaggacgacgagtgctgcctggcggagttcttccggctgcttcctggagcggtccagggagatgggaagctctcctaattgctggtgcggcagttctgcccgatggacttcatccagccgtcctgggctgcattagctggtggtggcatggcttcatcgagcggagctacaagtacagagagcagtacagattgttgtggaagaatttgcaatgcgtgtatacaacagtaattcatcattttgcaagcacagatagatc

SEQ ID NO: 32229 - DNA, 407 bp, Triticum aestivum
  Clone ID: PAT_TA_32229
gtcgacgggttcatcataccgccggtcgtgtcggcaaaatacgcatcaccaccaccaccccagttccaaggatattaagcatggcatcatcgaaacatcgacgaggagcgaccaattaaggtttaacacaacatcgcgtgcacatgcacagatgtacctcattaatttggaacgtgcatgcatgcatgcatgcgtcgagacttattattaattatgtgtatgtctgtgcgtatgtgcgactgcaaagtgtatgaagggaaatagatgttatctatgatgcctttttttttgtttttggaagtgggcaattttattaaagcatcaagcaacttttttttttttggaaaagtgatccataatgccgtatgttgtgattttccctttaggacaaatgtaattctttcctt

SEQ ID NO: 32230 - DNA, 1914 bp, Triticum aestivum
  unsure (1)..(1914): unsure at all n locations
  Clone ID: PAT_TA_32230
aggaattcggcacgagggagctctcaccccctccggtgaagtctcctcccccgccggcaccggtccactctccaccaccaccagtgaaatctcccccaccaccggcaccggtgagcccgcccccgcctccggtcaagtctcctcccccacccgcgccggtctactctccaccacccccggtgaaatctcctcccccgcctgctccagtgagctctccaccacctcctgtgaaatctcctccaccacctgcaccagtgagctctccaccacctgcaccgaagaagcctccgccgacagaaacaccggtgatcccacctaaagaaaagtcaatgccaccaccaactccggcgaagtcgtctccccctccgaccgagaagtatgaaccaccagcaaaacctgttgaatcatcgccaccaccggtgaagtcatatccgccaaaagaacctacgcctgagaagtcatcaccaccaccggtgaagtcatatccgccaaaagaacctacgcctgagaagtcatcaccacctccggtgaagtccacaccaccgccaacaccagtcagctcaccgccaccggtaccagtgaagcccccaccggctcaagtgagctcaccaccaccagcgccagttaaggtacttccaccacccacacctgagaaggcgcttccaccaccggtgctagcaaagcctccacctgctccagtgagctcaccaccaccagcacctgtgaaggtacttccaccacctgcaccagagaaggtgcttccaccaccggtgccggtgaagcctccaccggctccagtgagctcaccaccaccagcaccagttaaggtacttccaccacccgcaccagaaaaggtgcttccaccaccggtttccgtgaagcctccatcggctccagtgagctcaccaccaccagcgccagttaaggtgcttccaccacccgcaccagagaaggtgcttccaccacctgtgccggtgaagcctccaccagttccagtgagctcaccacctccagcgcctgcgaaggctcctccaccacccgctccagtgaagctcgccgccacctccggcaccggtctcctcctccacccgctccggtgagctcaccacctcccccggtgaaatctccaccaccccccgccccagttagctcgccgccgcctccggtcaagtctcctcctccaccggcaccagttagttccccaccaccagcaccggtgaagcctccacccgcaccggtgagctcaccacctcctccggtgaaatcgccaccacctccagccccagttagctcaccgccgcctctagtcaagtcttctccaccaccggcaccggtcaactcaccgccaccagcaccagtgttgttgcctcctccagcaaaatccaccccagcaccggtgaaagaagagccacagtcacctccagcggaatcacttacacccccaaagttcgacgagttcatcatgccgccggtcgtgtcggcaaaatacgcgtcaccaccaccaccccagttccaaggatattaagcatggcaccatngaaacatcgacgaggagcgaccaattatggtttaacacaacatcacgtgcacatgcacacatgtacctcattaatttggatcgtgcatgcatgcatgcatgcgtcgtgacttattattaattatgtgcatgtgtgcgtatgcatgtgcaaactaagtgagacggcaaagtgtatgaaatgggaaatagatgtgatctatgatgccttttttgtttgtttttggaagtgggtaattttattaaagcatcaagcaacttttttttttgggagatgtgatccataatgccttatgttctgcttttccctttaggaccaatgtatttctttcttttatgagcaaacagtgtatgagnatnaaggaacaaatacacagtta

SEQ ID NO: 32231 - DNA, 616 bp, Triticum aestivum
  Clone ID: PAT_TA_32231
acctgcaacacctaacagctactagctctcaagcagtagtcttctgatcctgaacaaccgatcaaccgatcacgatgagttcgtcggaggagaagacgtcgtggccggaggtggtggggctgcccgtcgaggaggccaaggcgatcatcctccgcgacaagcctggcgctgacatcctcgtccttcccgtcggctccagcagcgacacgcaattcatcgccaaccgcgtccgcatcttcgtcaacggcaccaccgtcgccgagactcccattgttggctagctctagttcataactagccttgcttgtcgttgatggatcgatgcaagtatgcatatgttaccggctcgacaagtccaataaataaccatgggaattatcatgtgtgcgtttgttatgtatgtgtctacaatttcggtatctacgtgtatatgtactgtgtacactggtaccttattctgtttaccaataatgaattaattatgtgtattttttttgcgggggggaattaatgatgcgtatttggcgtcaagttattgttttcacattatgcagtgctaactgttctgtatatgagactctttcataagtcagaatagaagatatagtttacatgg

SEQ ID NO: 32232 - DNA, 656 bp, Triticum aestivum
  unsure (1)..(656): unsure at all n locations
  Clone ID: PAT_TA_32232
tcgcggccgctcagagccggccgggccgggcaccaagcaacacctaacagctactagctctcaagcagtagtcttctgatcctgaacaaccgatcaaccgatcacgatgagttcgtcggaggagaagacgtcgtggccggaggtggtggggctgcccgtcgaggaggccaaggcgatcatcctccgcgacaagcctggcgctgacatcctcgtccttcccgtcggctccagcagcgacacgcaattcatcgccaaccgcgtccgcatcttcgtcaacggcaccaccgtcgccgagactcccattgttggctagctctagttcataactagccttgcttgtcgttgatggatcgatgcaagtatgcatatgttaccggctcgacaagtccaataaataaccatgggaattatcatgtgtgcgtttgttatgtatgtgtctacaatttcggtatctacgtgtatatgtactgtgtacactggtaccttattctgtttaccaataatgaattaattatgtgtatttaaaaaaaaaaaaaaaaaaaaaaaaaaaaaaaaaaaaaaaaaaaaatgaaaaaaaaaaaaaaaaaaaaannnnnnnnnnnnnnnnnnnnnnnnnnnnnnnnnnnnnnnnnnnnnnnnnnnnnnnnnnnnnnnnn

SEQ ID NO: 32233 - DNA, 1122 bp, Triticum aestivum
  Clone ID: PAT_TA_32233
tatggtttttggcgcccggcccgtcgcaaagatgatttcagttccaatggtcatgtcttatcacacacatcttccagcgtacttaccagggtacaatttaaattggttacttggacccacatggggccttataagatgtctccacaggtctgcagatcttactctagttccttcagtagctattgccgaggactttgaaactgctaaagtagtaccagcaaacagagtacggctttggaacaagggtgttgattctgaaagcttccatcctaaatttcggaggcatgaaatgcggatcaagttgagcggtggtgaaccagaaaaaccattgataattcacgtgggccgttttgggcgtgaaaagaatttggattttctaaagagagttatggaaaagctccccggagtaagaattgcttttgttggagatggaccatacagggctgagctggaaaaaatgttcacaggtatgcctgtagttttcaccggaatgctccaaggcgaggagctctctcaggcgtacgccagtggggacgtatttgcaatgccttcagagtctgagaccctcggacaagtagtgctggagtccatggcttctggagtcccggttgtcgctgctcgcgccggaggcatacctgatataatacccaaggacaaggagggcaagaccagcttcctcttcacacccggggatctcgacgagtgcgtgaggaagatcgaacagctcctctcgtcgaaggacctcagggagtcggtcggaagggctgccagggaggagatggagaactgcgactggagaacggcctcgaagacgatacgcaacgagcactacagcaccgcgacgttgtactggcagaagaagacgggcagaacggggtaggcggcgtttatccagccaggcattccgtttgctgccctgtctactgttatacataaccgaaggatttgtacattgtacccagcagcagcttgcgagcttgtgtggcttgctgcactcatatgtccacagttacggatgattgaccggccgcttgtatgcagttcctgtacattacaaagttctttgaaattggccatttccgtccaaaagctagtctgtttctactaattactacctctgtt

SEQ ID NO: 32234 - DNA, 1034 bp, Triticum aestivum
  Clone ID: PAT_TA_32234
ggcgctggcaaccatcaagagtgccgtgaccgccgccgtgaggagtgagccccgcatgggagcgtcgctgctccggctgcatttccacgactgctttgtccaaggctgcgatgcgtccgtgctgctgagcgacacggccaccttcaccggcgagcagggggcagctcccaacgcccgctccattcgaggcatgaacgtcatcgacaacatcaaggcgcaggtcgaggccgtgtgcaggcagactgtctcctgcgccgacatcctcgccgtcgccgcccgtgactccgtcgtcgccctgggagggccttcgtggaccgttcctctggggaggagggactccacgacggcgagcctttcgctggcgaacagcgacctgcctgcaccgtccttcgacgtcgccaacctcaccgccaacttcgccgccaaggggctcagcgtgaccgacatggtcgccctctctggcggccacacgatcggacaatcgcagtgccggtttttcaggagcaggctctacaacgagaccaacatcgacgcggccttcgcgacatctctcaaggccaactgcccccggacgaccagctccggcaacagcagcctggcgccgctggacacgacgacgcccaacgggttcgacaacgcgtactacagcaacctgatgtcccagaaggggctcctgcactccgaccaggtgctgatcaacgacggacgcaccgccggcctggtccggacgtactcgtcggcgtcggcacagttcaacagggacttcgcggcggccatggtgaggatggggaacatcagcccgctcaccggggcgcaggggcagatcaggctcagctgctccagggtgaactaagccaccaatctagaatcaatgggcgatcaaaggcgacataataaggctgtggagttattgtgcttgtgttctgccatttctcggatcatcatcaagtgtgggagagtagatggggtgtgatgtgatgtatatcatctcttaagtatttccctttgcttaattattatatgcccaagtgcac

SEQ ID NO: 32235 - DNA, 2019 bp, Triticum aestivum
  Clone ID: PAT_TA_32235
ggaaccccaaacagtgcgtacttgcctgagcaacgtaaacgcatggctgtacccatggagagttctcatccggttggctatcgcctctgccaggccggcgcgattgctcccgagcctaccaccggctgcctcgacccctcgtgcgccagcccactggctctacgccagatcggggccggcggcggtggccaccatcaaaggggccgtcaccgacgccccgcggagtcggctgcgcttcggcggcgccgtttgccccggctgccgccgcgccccacctggctgcgcccagacccccaacgtcggccggccgatgacagagccgccccaccacgccggccagaggaggggcgtcctcgacgtcgagaccattctgggcttgaccgtggtcgcacagccggagtcgctcctggacgtcgtctgcagggaggcgctcgcctgcgccagcgtcctcgacggcggtccctgttgctgatgcgtcgccttgggccgctcactgtggacgatggcgctggtgacgctgggctgcagcgacgggtgaacttagccagtcgcctagcaacctgcccgctcagacgtcggacgtcaaaaaggttagggggttgttgcacttcatgcggttctacccatcgatcagcggaaacgctttggctcggctatcaacaacaacaatcgtagaaacatgtagtgtcaggtaaggtcttcgacaaattccacaaggccgccgcgctccgggcatcgcggcaggtgtactgcacccttgcaccaatcgtccccaatagcaccttcgcgctccagtacccgtacaaccccaacttgatttgacagcgtggactccagcaatctgatgacctacaagggactcacggacgcacaccgggtctggttcgacggtactcgtcccggtcgcctcagccgaacggggacttcggggtgggcatggtccaaaaggggcaccgcagcggccacgctgaggcgcgggaacaggacaggccccaccgcggcgcaggggccgatcatgcccgcctgctacacggtgagctcagaggccgacgtagtatggatgtggagtcattgtagatgtaataagcctgtggagttactttgctcgtgttctgccatcgtcaggatgatcgggaagattgggtgtgttgttgtggagcgaagtgttgcaaagcgcctcttaggtatttaccattggcttacaactataagcgcctttgtggaccgttcctctggggaggagggactcgacgacggcgagcttgtcgctggccaacagcgacctgccgccgccgtccttcgacgtggccaacctcactgccaactttgccgccaaggggctcagcgtgacggacatggtcgccctctctggcgcgcacaccatcgggcaggcgcagtgccagaacttccgggacaggctctacaacgagaccaacatcgatacggccttcgcaacatctctcagggccaactgcccacggccgaccgggtccggcgacagcagcctggcaccgctggacacgacgacgcccaacgcgttcgacaacgcatactaccgcaacctgatgtcacagaaggggctcctgcactccgaccaggttctgatcaacgacggacgcaccgcgggacttgtccggacatactcgtcggcgtcggcgcagttcaacagggacttcagggcggccatggtgagcatggggaacatcagcccgctcaccgggacgcaggggcaggtcaggctcagctgctccagggtgaactaagctaccggtctaaattccggggcgatcaaaggcggacataataaggctgtggagttattgtacctgtactgatcatgtacaagaacgttgtgccatttctcggatcatcatcaagtctgggaagatggagtgtcatgtgatgtatctgagtatctcaaggggccgtcgtgcaaatggatgagttgcatacgtatttttcctttgcttaatcatgctcagttgcacataatcaattttgtttctaacgaactctaaa

SEQ ID NO: 32236 - DNA, 855 bp, Triticum aestivum
  Clone ID: PAT_TA_32236
gaagaagagggatcagccatggacatcatctcgcagctgcaggagcagctcaacgagatggccatggtggccgtcaacaccttcggcacgctgcagcgcgacgcgccgcccgtccgcctctccaacagctaccccgacccgctcaacccgaaccctaaccccgaaggccccgcctcccagccccaggccccgcccgcgcccggtgcgccggcggcggcacctctgccgccgcagccgccgcaagcgcggccccagccggctctcgaccttgccgagcaacccaaggccatgagccacgcgctcgtcctcgccgcaaagaagtttgatgctcttgttgctgcattaccactgtcatctgaagaggatcagttgaaaagaattcaagaacttcaggcagagaacgaagttgttggattggagcttcagaaacaacttgaagctgctgaactggaattggaacgggttgaagtgttgtttaatgaagctacagataactgtataaatttgaagaagccagattagtaatattatgcatgtagccgcacctgtgttggtggagacatgaatttccagcattctggtgtttactttcttgtacaagtctctaaaatgtcttgtgcaagcctctaaaatgtcttatatttgtttacagagggagtagttcctaatgtcttacagcttccaagctagatttgtcgacagtaatgttgtcttgttttaacttgcgtgcattgatattccatgagcacttgctggatgagttattaaagttcagtgttgtaacacctataccctgaaatcgtaaaaaaagaatcttgcgtggattggtctggtaaaagttcaccagggtaactg

SEQ ID NO: 32237 - DNA, 440 bp, Triticum aestivum
  Clone ID: PAT_TA_32237
gcaaataatcgcagcagcagcccacatcgtcgtcttcatcatcttctttttcctctgttgccgcctctgccttcggcagcaaacacgggcagcgcgcggcggacggcgggacgggacgacgctagctccggggtccctcatgaccacgctgctcccgaagagcacggagttggtgacgccctgcacgttgttgttcaagtagatgttgatgcagcggcagcagcggacgctgttaccgccgctcgccggcgccaccgacatcgtcgcccccgtgctcctgcacctcgacgccgacgccgacgaaccacctccaacacccatcctcactcagtccccttgtattcacaatcacaggccccagtttcgtttatgtgtaagctactagtacagggaaggaaatgaaggaggcgcgcgttgttgttctttgctccaacgccaag

SEQ ID NO: 32238 - DNA, 848 bp, Triticum aestivum
  Clone ID: PAT_TA_32238
tgcctgggcctccttccacccgtcgctgccgaggccgagcaggtgctaccgctgccgctcgtcgtcatcgccgccaccgccgccgccgccgccgcagaagcagcgaggcgcggagagcaagcggcggcctatccgtaacccatcgtcgccacctctactcatccgctcgttcttgccgcgccgactaactcctcgcgtgccgcgcgcaacagtgcaggcggagcgcggctgctgctgacccggagggcgctggcgacggtcgcggtggcggtggcgggccgcgctagagcggcggagaaggacggcgacggcggggatggtggcgagggggtggtgggcgcgttcaagtcgctgttcgacccgaacgaggagaccaaggccgggaaggtgctgcccaaggcgtacctgaaggcggcgcgggaggtggtgcggacgctccgggagtcgctgggggagggggacgccgccggcgactcggccagcttccgcaggggcgccgactccgccaagacgtccatccgggagttcatcggcggctggagaggccagcccgccgtcgccaaagaggagtcgtatgtggcgctggagaaggccatcaaatcgctggcggagttctactccaaggcagggcccttcgcctcgctaccgggagatgtcaagaacaagatcctggacgaccttaacgccgcagaagcttacctctagatctccttgcctagcggcattgtatttcgggcgtaaatttcgttatacttgtggacgtgtccttttgatgcgacgtcatgagtaaataaatatttgcattttattcaaaaaaaaaaaaaaactcgtgccgaattcggcacgag

SEQ ID NO: 32239 - DNA, 1412 bp, Triticum aestivum
  unsure (1)..(1412): unsure at all n locations
  Clone ID: PAT_TA_32239
gccgctcgaggtgccgcacgccggtggagctcctcgccgcataggcagcgtggatctgccaggaggcgagcgggctttccttctcctggtctccgggcgtggccgctagccgccgcactcgatcctcggccagctgccttgccgccagcctcgcttgcctcccggctccaccgcggggctcgcgggatcctggggttctcgcttcccgcgctggagtccctccacgtccgcaagtatcccattggtaaattgagggtacaaccagtcggcattatcatcttcgcagctgttatggctactttaggattccaagtattttttcaagcagttgaaaagctggtagtgaacgtgactccagataaattgtccccaccacaactcatgtggctatattcaatcatgatctttgcaacagtagtcaagctagccctgtggttctactgccggacctctggtaacaacatagtccgcgcctatgctaaggatcattattttgatgtggtcacgaatgtcgttggtttggctgctgctgttctcggtgacatgttttactggtggattgacccagttggtgcaatcgtccttgcagtctatacaattacaaactggtctggaacagtgtgggaaaatgcagtatcactagtaggtgaatcagctcccccggaaatgctgcagaagttgacatacctagctatcagacatgaccctcaaattaagcgtgttgatacagttcgggcatacacctttggggtgctttactttgttgaggtcgatattgagctcccggaggacttgccactcaaggaggcgcatgccattggagaatcgctccagataaagatcgaggaacttccagaagttgagcgggcattcgttcaccttgatttcgagtgtgaccacaagccagagcactcgatcctcagcaagcttcctagcagccagccttgattaccatctgaattcactgtggaaaacgcaagatgttggctattttgcttgccgtgcaggattcgctacagtacatggtgtcttgcgctatatggaagggctgaagttgagctaggcattgttggccatctaaatgagataagaaccagcgttggagactgtatagacttgttttgcggagccctctaagtgtcatgtttcgagtaaaagtaggttacttttgcttcttgaagctgtcattgtttgtctgccacgagggctgcaatgtggaaatgtttgccacaaaaagaaagcaagcgatttttgtgtgctaacagtctgggaagttatatgccgcttgagaaacctgttggctanggcnttangagcaactagccacccggntcnatcccnaatggacgtgggcttaaanattcgcaanaaacatganccanggtantcnaagattgttnannaaaaaaaaa

SEQ ID NO: 32240 - DNA, 452 bp, Triticum aestivum
  Clone ID: PAT_TA_32240
ttcgccgggccacgggctacagccgccgttgaaacgaggcgagcatcgagggaaccatggagaacgtcggggaagcgatgtcgcgccatctggcctcctcttgcggtgggagaacgaatactcctgtggctctggctggctctgcaccctcatgaacggcacaccatactcgatcgattcgttatcctctgggtgcttgaccttcgacctgtacgccccccacctccgcctgactatcgcctcgggtgaatctgtctgctccatcgcccataggagatactcgatgaactcggaggactgcaacgtgactgccgccgaggagtacatgtacatcacccgtcctcatcgccgccatctcgctctttcgcatacattgccacatggcccgcaccgtcctcgaaatctcccactcattgtcaaaccaactaaggatctccttcaacctagctaac

SEQ ID NO: 32241 - DNA, 709 bp, Triticum aestivum
  unsure (1)..(709): unsure at all n locations
  Clone ID: PAT_TA_32241
gcaggacgacgagcaggcgagctacgacgacaatgacggggaagaagcaccgagtggccagacgnagaaggaggcgcatgtaggcgatcagagtggtcagaacaagcaggaagacggagacaacgcagagcatcatgccggcgctgagaacagtgctggctctgctggagcgacgagatgcgtggagctttttctcggagaagaaggggatgtcaggaggattgcgctgcttccacaggatggcggtctggctcagttgatggacatagctcggagcaagttccccgacctcaaggaattgtctgttaatttcaaggacgaccggggtgacttggtaacggtcgactcgactacggaccagagcgcatggttcgatgaagcgaattcccggtcccaagggccacttcggttgtacgtgaccgaaggtaatcgcgaacgggtgtcgtgccccgatcagccgattcgggaacaccactctgttgatccgtgcttgtcgcacgatcagtagcaggcacatactatatatgtcgtacgtttggtcatattgagtgatgaaatgtatttacggttcggtggtcggtggtctaactcccaaaatgtatgtttgactcactgaaatgagtaaggagatccattgtaatccaaatacagataaagctattcggttcgataaaaaaaaaannaaaaaaaaaaaaaaaaaagcggccgc

SEQ ID NO: 32242 - DNA, 367 bp, Triticum aestivum
  unsure (1)..(367): unsure at all n locations
  Clone ID: PAT_TA_32242
cggacgcgtgggcgggctccgtggtgccctcgctcccctcgcgcccgcaagtcgcgtcgccggcgatccacacctctgccacgccccgccgccggcgaccttcaccgccggacctccggccactccgccgcctcgcccctctgccttctcctccttcctctcgatctcctctcacatctctccctctttctcgctgaacagggacctccacgagggccatggcgccgccggccctcaatctcgccggatccggccgcctccacgccaaatccgccgaaaatggatccaccccggccagatccgcccggatccgaccgggcctnctgccgtacgacgcctcatngaggagtacaacagcttgcccatg

SEQ ID NO: 32243 - DNA, 713 bp, Triticum aestivum
  Clone ID: PAT_TA_32243
tggctttggtgccctctctcgctctggtgaggccgtgcatgcttgccatgttgtggctacggaaatctcagactgagtcgcttcggtcgggcactattcaggggaatatttgttcagaatcttcaatcttgtaattttctccttgatgacaatgaccatgctgtgctgggggatttgggattccatccttgctgtttggacttccgctgccaaatccagatcttatccaaagacgtgggactccaaattacatgccccagaacattggcgaccagacatcagaggcccaattagttacgagactgactcattggggtttcgcttggagcattcttgagatgttcagtggcgttcagacttggtgtgccaaatcaccagatgagatttatcagtcagttgtcctgaagaaagagaaaccgatgttcctatacaatttacctatggaggtcgctaatgtcctctctggctgctatgagtatgaatttcgggatcactccttgatgttagatatcttacagtcatttgaaaggtttctctacattagctttgtgtatccaaattttttgttcctgacaagaagtgcattgcacatgcacacttatatgaacaagccttacatgatttgctcttttactgatggactgaggaggtcagagatgtatatgaaggaaatatgccctagaggcaataataaagttattatttatttcctt

SEQ ID NO: 32244 - DNA, 1862 bp, Triticum aestivum
  Clone ID: PAT_TA_32244
cgcatcaccgttctcaacaactagccgccgctcgcagctccctcctgcgcgagctcctctcgcgcccgcaagacgcctcgccggcgaccccacacctccgccacgccccgccgccggcgaccttccccgctggatctccgacctccatggtgtcgttggccttcaatctcgctggatccggccgcctccatgccaaatccaccggaaatggatccaccccggccagatctgcccggatccaaccgggccccgccgtcgtcgccaccggagcgccgccccgaaattttggttcaggactgctcttcaatccttgctgatttgtggttttgagacccacccaagcagggctgcgctcaggagaggaacctgctgttcctggagggctgacagacagccgattccgctattatcacaagtccgctttgtgacgagctggtcaacacgcgggaggagacatatatgattctacttgtgcaaactctgcctgtactactgttcatattgcccccttgctatacaatttatctgctgcctcaatagttcactcatacaagtgatgacgttgtagttttatatgtcctacgcctacaagccggacttcaatcacaaggtcgtactgttttgtcatatatgtagcttcgttgtatcgtcattctcgtgaaaggatgacatatgacccaaatattccattgatctgtgtaaaactgagacattttgtcccataataggacattttgcctctgaccgaatttgcttatttaacaatcttttcagattgtggcaaccttgggcgatcggtacattggattcttgaaacccatgccttttctgaaggtaagtctggcatgcaaggtaccctcacggtttattttcaagagatggcgctggggtctcggggacgtgccggacggcgtcacgttcctgcaccttggggatggctttcggttgaattcccctccttgcaatcttgtgctcctttgggtgtttcttatgtttctgccgtttagcgtaaaaagagatatattctcccatctctattggctgtctaattagcgatgcaatccatccctatgtcggcacaatcagcagaacaaagcagctaccatgatttgcccattgatctcttggagtgattcaaacctgcaagcaccagggctgattgagtgactcctgcatatgatgaactgaagaatttttcatcaattttccaatctgaattagcctaccaggaagttgggaaaaggaggagtccaggctctgatgaacacaccgtctttcccagaaaccacttcaactagcccaggactgtgtctattagtcctcctgtatttgtttagatgagataacacattgtatggcaggtaacaagcaactgaagcaagaagattttttaaatttcttggaaagtataacccccttaacccaggatgcaagatgaaggatccaatatgtcaggaccaacgagggaattgcagtatgtcagaaccaatgagagaattgtagagcttcatattaagtttattttagctgcttgcccgcttcaagtgtctagattacaggaaatatgtttctttaagtgacaaacctggataccaatttattcaaactattatatttcttatagaagtaatgcaatatattctctctcttttgcccagtcatttgaaatgtaacatgataaaaatctgtgtctgcttttcccattcgcacttacataattcgtgtaacgcgccatggatgggtgattttaccatatttcattttcatatttgcttatattatattggacaaaatactaagcatttttgaagtttgtcacatgaaagcatgggaaaaaaaaaaaaaaaaaaaaaaaaaaaaaa

SEQ ID NO: 32245 - DNA, 1542 bp, Triticum aestivum
  Clone ID: PAT_TA_32245
cccccatcttctgcgaccaccacgccgtcgacgtcgtcctgaagcacgctgctcctctccctagccaagccgccctggatcttgcgatggaggtggccgcctcgtggctatggagggctcgccagccgcctccggagtcccacattcctaagatcgactggattgcagccgcctggccgaggtcgttggccctcgacgggctggcactaccttgcctgtgcttgctcccgtccacgccgccgtcctgctcgggccacggcatgatctgctcgccgcgcccgcccaaaccccaggccacacttcctattccactccgcgtactcctggttgcagccccagcttgccacgggcagggatcggcggctccgccggcgtggcgcgtggcaggggagagaaggggggcaagatcggcaaggcagagttcttccggaaggacggcgtggtgggcgacatggacggatacctcaactacctgtccctcgagtatgacttcgtctcggacaccaatcctacttgggtatcttcaaggtctatgctccaaatataaataagatttggtccgccgagcccttcattggcgtcctcctgggacacctccatgtagcaccaaggggaatatttgttcagaatcttcagtcttgtaattttctccttgatgacaatgaccatgttgtgctgggggatttgggattccatccttgccgtttggacttccgctgccaaatccagatcttatccaaagacatgggactccaaattacatgccccagaacattggcgaccaaacatcagaggcccaattagttactatactgactcattggggttccgcgtacagctttcttgagatgttcagtggtgttcagacttggtgtgccaaatcaccagatgagatttatcagtcagttgtcctacagaaagagaaaccgatgttcctgtacaatttacctatggaggtcgctaatgtcctctctggctgctatgagtatgactttcgggatcactccttgatgttagatatcttacaatcatttgaaaggttggaggtgacacatgaacgctggcaatgcaaaatagcagatataaaataactgcagctcaagccatgtagttctacaacaaccaaggaagaagtctgtttttaagccgacctcggccaagcatttaagcttatatgggtgctctctatttttcagagttgcgtgtactgagaacgcccatgatttagggccaaaaatttagacaaagtggcaaaactgaaatacgagacttacttgaagccagtgatagcccattgaaggatgccgattgtggctatccaactacaacaatgtgcttgcaactcatgagtggcaaagtataacatgcctcctttattaaagaagccccttcagtttatgtatgcagaatgctgtgaaggactcgtgacaaagctagatctgtatgcatgtcttaatgtattttcatactagcttgagtaatgtactcttgccccccgcccggccccccctttgtagtgtatttttggtcgcttgttgcccc

SEQ ID NO: 32246 - DNA, 567 bp, Triticum aestivum
  Clone ID: PAT_TA_32246
aaaacacaagtttttcagcgaaaatagagtcttcactcttgagaactaaatcatacatgttcagtggaaagattatccatacgacgcctcggtcccaaatggaaacatagcttaattctcgagcgggcaaagcccgaatcaatattacatctctatcttgaagagcattcagcagaaataatccacattccaggatgcccaaacagaaagattatgtcttgataattgcgaaaagtaaacaatgggaattgaatgtagtaattagcaaccagaccactatcgccatctttctgaatgtgaccatcaccctgcttcagcttcttattttcaggccttccttcagtatgccactccaagtctccaagtaacccagccaagcgcacatcatcctcttgcagttggtgatgaggatcgttcccctcggaagatgagcatcttaattctcatcagtgccaccatcttccttgctctttttctcgtcaccacaaatgtcttcactgtcctcttcaagacactggtattcatcacaaatagtaactgcgggatggtttggatgggcacctgctt

SEQ ID NO: 32247 - DNA, 945 bp, Triticum aestivum
  unsure (1)..(945): unsure at all n locations
  Clone ID: PAT_TA_32247
cccgggttctgtacccacgcgtccttanaaaatgtttcagaaggtacgtgatgtgggaaatgactattagaaccgaacaccgttctatggctgaatcgggtggtcaagttggagataatggtttcctatatgtgtatggagaggaaggtggaaaacaaaatgcagtcatagaaatcaaagatgtccaaaaatccctggggaacatggggggtcacaaaggcacaattaaacaggggtcagtcgaggttggaaagaaaatcgacgctgcagttgatggaaaactgaggcagggagccaaggctcatcatactgctacacatctactacagtccgctcttaaaagtgtcattggttcagagacatcacaggccggatcccttgtggcttttgaccgtcttcgatttgacttcagtttccatcggccccttacagaaaaagagttactggaaattgaatcattggtgaaccaatggattagcgacgcaacacatctcgagacaaatgtgatggcatttgcaagatgcgaaaaatgctggtgccactgcaatgttcggagaaaaatatggtgaacaggttagagttgtcgaggtccctggggtgtcgatggaactgtgcggtgggaactcatgtcagtaatactgcggagatccgtgggattcaagataatctcaagaacanggaatacttctgggagtcagaagatccangcagttcangtgatgcgtttgttgagtagtttggtcacgggacaactacatcgacacttancnctcccctaaagncaaagcaaaagattcacagcaaagtagaacaattctgaagaactaagacaacgagaaatgacacactcnnaaanaaaatnaatgctaaananacctgnaataacgtccntganccaaagcagtcantanantgggactgtcnatcctaaaccaccacacttgn

SEQ ID NO: 32248 - DNA, 601 bp, Triticum aestivum
  unsure (1)..(601): unsure at all n locations
  Clone ID: PAT_TA_32248
cccantgagcgcgcgtantacgacttcacttttagggcgaattgggtaccgggcccccccntcgtgccgaacgtccgcatctagcttcggcacacaaacacaacgcacagagaaccaaagaatcaggaaggagcaagaagaagatcgagaggcgatggagtacgagcaccagtacatcagcagcggcagcttcgccaaggagaagaggcctccggcgaagaggggccaggtcatgatgcagatggcgaggacgctgagcaacctcgtctcgccgagcgccagcggcgccgccgccgccgatggctcgaagaaggtgagccgcgacagcttcacgagggaagcaagctagctactgaacatgcctgcaactaaacgaaatattagatgggtatggtgtctgggactggattatgttactactactactactagttagctgtttttcttttggggagtttagcaggatggcctttcagtagtactggcgcctgtgtgatccaccagaatgtaacttttcttgcgtggaaaatgctccccgttatgtgtgcattatgggtggtatttttacaaaaaaagttccacgttatgggnnaaaactttt

SEQ ID NO: 32249 - DNA, 663 bp, Triticum aestivum
  Clone ID: PAT_TA_32249
ggtcgtcccagcgtcctttcgcacagcctggtgcttcatcgcatcatccatggcgctgctcgccggcgacagagctgcaacgcatcagcgatggtgcttcaacacagcatccatggcgctgctcgccggcgacgaagcttcaacgcagcatccatggtgctcggccgaagttgcaatcgagcttcgatagagcaccggtgctgcgttggagctcggtcggagttgcaagcaacgaagcttcgccggaaccgttggagctttattggggctgcaatggagctaggccggagttgcaatggagttcgccggagcgtcattgctgcgctggagcttcatccggttgcaatggagctcaccggaggccgttagtgctgagttggagcttcccgctggggctgcaatggcgctgcgttgaagctgtcactcttgctgctgcctgttgtaatccaacgcttcccagcatactgatccgacggctgatttgtagcatcgcccaaaaattatggaaatcagataatagtggtaggaaagagtagattttgtgcagatccaccttggtttctgggtaacatggactcttatatggaattttctttacttcaagggcagtttaatcaaataacagcatctctagccaaattctttggtggcggttgtgctagt

SEQ ID NO: 32250 - DNA, 1109 bp, Triticum aestivum
  unsure (1)..(1109): unsure at all n locations
  Clone ID: PAT_TA_32250
tcgagcggccgcccgggcaggtacttcatcagtcttgttcttgaaaatcttgccttgtcnactgacgacaacgaagacatcttatattgcttaaagggatggaatcgagccatggacatggttaagcaaaaggatgaccaatgggccctctacgctaaagcatttcttgacagaaccagacttgcccttgcgagcaagggcgaacaatactacaatatgatgcagccctcggctgaatatcttggctcattactcaacgttgaggaatgggcagttgacatcttcacagaagaagtaattcgtggtggatcagctaccactttatctgctcttctgaaccgatttgaccctgttctcagaaatgtcgcacaccttggaagttggcaggttattagcccagttgaagtaacaggttatattgtagtggttgataagttgctttctgttcaaaacaaaacttatgataaaccaacaatccttgtggcaaagagtgtcaagggagaggaagaaataccagatggtgttgttggcgtgataacacctgatatgccagatgttctgtctcatgtgtcagttcgagcaaggaattgcaaggtgttgtttgcgacatgctttgacctgaacatcctgtctgaacttcaaggacatgaagggaaggtgttttccttcaaaactacttctgcagatgtcacctacagggaggtatcggacagtgaactttcaatttcttcagatgcacaaggtggtgaagcaataccatctttatcattagtcaagaaaaagttcctcggaaaatatgcaatatcagcggaagagttctctgatgaaatggttggagcaaagtcccgcaacatagcatacctgaaaggaaaagtaccttcatgggttggtatcccaacatcagttgccataccatttgggacctttgagaagatattgtctgatgagaccaataaggaagtagcacaaaacatacagatgctgaagggcagacttgctcaagaagattttagtgctctaggagaaatccggaaaactgttcttaatctaactgctccaactcaactggttaaggagctgaaggagaagatgctaagctccggaatgcc

SEQ ID NO: 32251 - DNA, 845 bp, Triticum aestivum
  Clone ID: PAT_TA_32251
tgcaggatactcgatttcagtcccgtggttgtggcaatggcatgcatctccatgtgaatttatctgtgtgctgcgagtgcatgaaagtggtaaaggttcctaattgacttggtcgtaagtattagaccaagcggccttgattgtcgccaacaatgccacaaggcccgagaagcctgaggatatcatggttgaacgacaggggtgagctgcgtgtaccctatgagcctgtctttggtggtgggtttggccgagctgcctgtccttgtgggctgcgtctcgtatttcaccttccgacacggatgctgctgggtgcgccgcgacggcgtctctgatttgagcttcgcgctgggcatcttcttcgccatcctcgcatggttattggcgttgtgggcggcacgactatatctcgtcgatgtggcggcgatctggccggggaggcgtggtaaacccccggagtgttacacctctcttatgacggatcaccgtggccttgtggaggccggggaggcgtggtaaacccccggagtgttacgcctctcttaagacggatcaccatcgccttatggagaaagcattcagacccttcatctttgacatcctctttgcaatcggctcctccaagaaactttccccccctcctcctgtagaaacccagctagctagctagctagcgtgcgtacgtctccggccccaacattcattccatgtgagcacattatattatattggaggctcctttttttcttggtttgattatttttgttaactcacattcacatatcacgattggatcgagtcggatttctaaaaaacaagcatgcaagtcacattcagcacacaaatga

SEQ ID NO: 32252 - DNA, 1468 bp, Triticum aestivum
  Clone ID: PAT_TA_32252
cccgggcccggcgtccgcgccgcggctccgcgtgggcttccgcgtcccgtccgaggcgtcgtccgccttcgtgctcgacgaggtcgcgagggcggccgggggcgtgcggaggagggcggccacgcgcgcggccagctgggattccgagaagtccccgtacgagacgctcgagctggaaagggatgccgacgaggagaccataaaggtcgcgtacaggagattggccaagttctatcaccctgatgtttatgatggtaagggaacccttgaggaaggagagaccgctgaagcccgtttcatcaaaatccaagcagcatatgagctgttgatcgatgacgaaaggagaaagacatacgataaagagcattttgtgaatccaatgaaggcttctcaggcatggatggagtgggtgatgaaaaagcgaaaagcttttgataaacgtggcgacatggcggtagctgcttgggccgagcaacagcaacgagaattgacgcttcgggcgcgacgtctctctaggtcgaaggttgacccagaggaggaaaggagattactcgccaaggaaaggaaggcatcgatggagttctacagcacaactctaaaaagacataccctcgtattacggaagagggacatcatgcgcaagagagaagaggaagacaagatgagtgagatcagtagacttctagctgccgaggggcttgagttagatacagacgaagatgatgatgacacaactttcttgaagtaattctatccagtatttacccgccaattatatccaaccctcgtcccagaagccctggaaggtttcgctgaagttacttccatcgcactgcagtatataaggcaagagaaattcggccttgttgagcatgatgagttgtatattgataactgttggatcggaaaatcctatctgcgctgatgtaggggagaagattgtcccatggagcagaaagaggaggaatgtgaagtgattcttcagtgctgattgatgcaggcctgcagtgtaatcggcgaaggctggattcaagacttgcaagagctgcgcctttcagctgtgtatacttgggacttgcatgatgtttctatgctgatttccgcagctccgcagtgtactcggtgaaggtttggctgcaagactgtgcaacagctacgactatcagatgtgtagaccttgttacatgcaagatgtaattatgttaaggtggtatccaggcgctgttaccagctgcgtgtaaccgtggccctgtgttactactgtagaaggcagatgaagcagccaggtttgtgtttcagcctagattcttcccgtggccgggcactgtttcattacctgttatactactacaatgcatgattcgcttgtcgtccttgttaaaatctgaaggcttctgaatgatgatgaatactaccaagtgattgctagtaacgtgaatatacacattgtcgcaaaaaaaaaaaaaaa

SEQ ID NO: 32253 - DNA, 1342 bp, Triticum aestivum
  Clone ID: PAT_TA_32253
agttcctgcacacaactgggaagagagtgctccgacatccgcaccggcagcctcagtggccggataacgcacgcgcccttgcgcgacgccgtcatccagcgatacctacgagggccagacccggcactggcggacgaggtcgcgtcggagtgtgccgccaagccctgggacgggattgtcgccagactatggccgcgggcacggtgtgccctcaccattgtcaccggctcgatggcgcagtacattccgattctccggagctactgcggtggccggttgccgatcgtctcaccctgttatgcgtctactgagtgcgccgccggagtcaatctaaggcctctcgacccacccggccgtgcgtcgtatgcattgcttcccaacatcgcctacttcgaatttgctgagatccagcctcgtgatgaagaaactcctactgttgatggagatggcgatccgggtgagatgaagcttgtggatcttgtggatgtcgaaattggtcggtcctatgagctggttgtcaccacctttgcaggctttaacaggtaccgagttggtgaccttctcaccgtgactggcttctacaacgcaacgccattgttcctcttctcgggacgacatgatgtcatcttaagcatagaccatgagaagataagcgaggaggaactactcagggcaatttcacaggctattgagctccatcttggccctcttgggtacatgctcagtggaagcaccgcctttgcagacatatccaagttgccaggccactacgtcctgttctgggagctaaccaacgcaaggagtaatggcctggttggcgacatccctgatcaaactgtcatggagaattgttgctcgacagttgaagaatgcttcgaccaaatgtactgcaaaatcaggcagcgcgcgaacatcaccgcgctcgagataagggtgcttgagcagggcgcgtacgacgctctgatggacttcttcgtgtctagaggcgcatcggcgggccagtataagactccaacggctattcggtcaaaagaagcgatgatggtgttggaagagagggtggtggcaaggttctttagcaaagaaattccccgtggttctctatatgatgattacatgaagaaatgattgatgccctgatgggttgattaggagactagtgttctacttgtgtgtaccgatacacatagtagtgtgtgccagtccaaatcatgatctccaccaacttggatttggttctctagcaaaaatcgcttgatgcagagatgagaacatgtaatcctgaaaataccgaaactaaataatgaaaagaatgtcacgtcttttatcttctatttaaaaa

SEQ ID NO: 32254 - DNA, 656 bp, Triticum aestivum
  Clone ID: PAT_TA_32254
aaggcagattgagattgctgtaatgcagtatcgtgaatctctcgaggagaaggggttgcatagcatggaggagattgagaggaaggttgccagccaccgtaggcgccttcaatcagattatggtttgtcttcaatagatggtgcaaacaacaggcggtcttctgagagactatcattggaacggaaagaaagggcggatgatgcacgtgattcttccaggaagcggcctcgcagccggagcaggagccgtagtccttcaaggaagtcatcactggatagagaccgagagcacaatcgcagcagaggcagattgcatggcaatgatgccgggagagacaggacacgtgaaaaaggctcaggccgagggaaggatgatcaccacgataggagcagcagagaccgggaaaaggacaggagaacgggaaggtgatcggaacctgctgtgcacgcgtccgtggccggaacctgctgtgcactcatatgagctgggctgcctaaacgcgccatgcatgggctcctcgaacctgtttgtaatggggtcagctgaggaactgttttttgtagtttcaggaacagaagtagtgttatcaaacatctaatgttgactttgcaatgcattgaaatgctgacccattgtcgtcatgcactgcggctta

SEQ ID NO: 32255 - DNA, 667 bp, Triticum aestivum
  Clone ID: PAT_TA_32255
gacaccaccaatggctgcatgtcaactggcccacacttcaaccccgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgatcttggcaagggtggacatgagctgagcaagagcactggaaacgctggtgcacgtgttgcttgcggaatcatcgggctccagggctaagatgtcatcttcgccgaccaacgtcgcacagatatgggaaccttttcagaatgcagatttgcaatctctattctaaataagcacatgatctttgatcacttgttagtgtgcaccagtcgtgtcaattcctatgtgttactctgaactttatcgctgtcatttggctatcgagatgtgtgactggaacagttctgtcaagtgcttgtggatctgttgttcgctactagctctggacgtgtttacagaaaacgagagaggtttcagatttcatcatatatcttgtagagctacattcatcttgcaacgccacatccgtgcatctggatacgctccatgtgtctggtgattcttttttgtc

SEQ ID NO: 32256 - DNA, 1128 bp, Triticum aestivum
  Clone ID: PAT_TA_32256
cccccatcctcccccccccccccacataaacccacctcggcctcccctccttcctcccccccaaccccgcctctctcctccccgccccacccacccctctcctgacctcagagcatcatcccatcccccaagtcataaacccaagtcggactcgccttcctcctcccccaactactcctcctcgcctccgcgcatcgcaccgcaccgggggtcacctgagacatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactgccatatcccccttactggaccaaattcaattgttggccgtgctgttgtcgtccatggtgacgctgatgatcttggcaagggtggacatgagctgagcaagagcactggaaacgctggtgcgcgtgttgcttgcggaatcatcgggctccagggctaagatgtcatcttcgccgaccaacgtcgtacagatctgggaaccttttcagaatgcagatttgcaatctctattctaaataagcacatgatctttgatcacttgttagtgtgcaccattcgtgtcaattcctatgtgctactctgaactttatcactgtcatttggctatgagttgcgtgactggaacagttgtcaagtgcttgtggatctgctgttgttctttaagccgctaccagctctggacatatttacagaaaacgagagagatttcagatttcatcataaaacatgaaaagcaacaaaaatgctacattcacagtccaaaaaatagcgcatgcaaaaaaaaaaaaaagctgcataaaaaaaaaaaaaaaaaaaaaaaaaaaaaaaatacaaaaacgcccctgtgtaaaaaaaggaagatcaaaaccaaagg

SEQ ID NO: 32257 - DNA, 807 bp, Triticum aestivum
  Clone ID: PAT_TA_32257
ggccgcccggctacacaacagagctcctctccgcaccgagtcctggtaccgagttctcacagaccaacagcacaacagagcatcgaccgaattccacacgcgaggtgatccagataagcagcgaatccatgggagtgggcatgaagcgcgcgagggaggaggagccagttgtgtcgctggcgctgtcgctcagcacagactcctcggcgacgtccaccacgacgtcggacagctcgaccggtgcgccggcgatggtccccaggaagagggcgcggcgggggagagctgtggccacgtccggggagggagagttcgtgtgcaagacttgcggccgggcgttcgagacattccaggcgctcggcgggcaccggaccagtcacctgcgcggccgccatgggctagagctcggcgtcggcgtcgccagggtcatcaaggagcggaaaaggcaagaggataagcagcggcacgactgtcacatctgcgggctgggcttcgagacgggccaggcgctgggcggccacatgcggcggcaccgcgaggagatggcactcagcggctccgtcgaccggtgggtcgctctgtcggatcaggaggcgggacaccaggccgccgtcgactcgccgcccgtcttgcggcagcttttcgtctagcctgctagctggatctctcagtttcttaatccaggacttgttcatctctttagaatgagataggttaattgttcaaccttgtaattacgaacttacataccatagagtacttttcatttgggtagttttgttaaccgataatcggataatccactcg

SEQ ID NO: 32258 - DNA, 978 bp, Triticum aestivum
  Clone ID: PAT_TA_32258
catggtgcacctggccactatcccgatcaccggcaccggcatcaacccggcaaggagcttgggggctgctgtgatctacaacaacgagaaggcctgggacgaccacgtatgtaccgcctttgccccccatgcatctctctgctaattattaatattgttctcacagttactatttcagtaagcagtggccacaatcacctcgaagactattacataaaaataaaagaaaacaaagagaacttgtgtggtgttcctcatccataagaacagatagaatatactgcatatcttatcgaacggcacaagatagctaggatatataactttattaaacccatgctgcactatgtcatcccaaatgactggttcgcgatcacttgcagactcaaagcttaaaagaactagacataaaacttttgtggtattcctcgtccataagttcaaaagtagcaatcagaacgctgagcaggtcgattattttggccaaggacccgggataaggatcacttaataaactcaagcgatgtcacaccccactgattagccttgaagtttctttttgtatagtcttgtagcttatgtatgatatatctgcaaaaaatactatatttggagcaatacacgctgcctactctcgtcccactcccacctgctccaccatccaactaccctagaaactcttatatagctctaatgtgcctaactacttagtgccatcttgtatgcccattttgtagagaatgcaattaggaggaaattaattcaaattcctctgagacatcttatgcttacatttgtggccattgttgttgcagtggattttctgggtggggccattcatcggcgccgccatcgccgccttgtaccaccagtacgtgctgagggccagcgccaccaagttcggctcgtccgccttcttcggcagccgctagatcggccggccgccgtctcggtgatggtcggaggcactgaactgta

SEQ ID NO: 32259 - DNA, 781 bp, Triticum aestivum
  Clone ID: PAT_TA_32259
ccacgcgtccggttaaagaagaaccaggaacaaaaagctccactaagtcttgtcacaacaaaccaagtcttcaatgtcttcaatatttttaggggtcgacaccctttagttaaaccaatatcctctaggactatgcacctatttataaccaataaacacattagtcccttaattgtttgtcactaatcattaaaacccactagggggcactagatgctctttcacccgatgccagccatgtcagttaacctatatccatctgatcttgcataattgtagaaagaaaggaatttggttggtatggtgggagaatgtggtagggtaaacaatggttcaagagccacccaatgatcccgccatattaaagtgttgcatgatagtcgactctacaatcgatcgcgaggagaagttgttgcagctctttcaacatgaacgatgagaggtagtatggttattctgcggaggaatatataactgatgagtggagcaaccatattttccatggcaggctagtgagtagaggaatttaagtgcaaaaattgacaattttttggcagatgtgcaagttttaatactcggaccacctgattctcttggaaatagacattgtcccaaggtgactaggtattgagctccagagtatgcactcatctctagtccaaaagaaagaatgcatgatcttgtcaaattgttatatgactagatgagaactaggctgtagcctagtggcaagggagcgcagtggcgtctccagcaaccagggttcgagccacgtcgggga

SEQ ID NO: 32260 - DNA, 577 bp, Triticum aestivum
  Clone ID: PAT_TA_32260
ttcatcggctcctaccagcaccacgccaggcaagaagaaagccacgacacctcctctactgttccttatccgtgtcccgtagctagccagcaatctgcgcagcaagaaaagaagggaggtacttggatcgcttcttctgtggagatggtggcgcccatggtgatcgcgtccgcggggctcgggatgctggcgggcgtggcgatggcgaaccggacgaccagggacgggctgccggcggcgtccagatgggacgcgcggccactgttgctccacgtgcagcggcaccggccgggatggagtgcctctgcagccgttggtccgacggctgacgtcggctgcaggacgtgctccggctccggccgcaagctggtgccgcagctgcggaggctctggcaccggccggcagctcccggttcgactcatcgcccagcagcagaagctgccgaccgcgcccgggcgacgcggatactaaaactgattgatactccgtcggtttcccggagtaaatcagaggtgcagttaggcagaacacaacacatgagcatgagtgtataggcaaacaagcatgttcattcct

SEQ ID NO: 32261 - DNA, 670 bp, Triticum aestivum
  unsure (1)..(670): unsure at all n locations
  Clone ID: PAT_TA_32261
ttttttttttttgaacccaaatcagagcatgtatgcatattcctcacaagatattaattaagcaaataaacattggctcaaataacagcatttttcatcatcatcatcgtggtattttacaatgggggattcccacggaaaggccaaccagataggccatggttgttgcagcaaacactgacacgcctaactagtaccatgtaggcagctgctaatttgggccccagcagctgaggtacatgacgctcatggccaccatccacgacgccttcgccggaccagcctcgtgccgaattcggcacgaggtcatctacaacaaagacaaggcctgggatgaccaatggatcttctgggtggggccactgatncggcgccgccatccgccgccgcctaccaccagtacgtgctgagggccagcgccgccaactcgggtcctacangacaactaatcaccgtcgctccggccggactgaatgtanatattgcgaaagaagaagncgcctccaaacgaagccctacggttgctcgntccacacctttgccctgttcaatggactccaatctttgcatcatcaactgctaccgttcctccgcttgtgcacatgtcatgtgacgtcatcctagcgtgtccgganntcncatgtttgctgctgcngttctcaatgtgcta

SEQ ID NO: 32262 - DNA, 660 bp, Triticum aestivum
  unsure (1)..(660): unsure at all n locations
  Clone ID: PAT_TA_32262
tcggcggcgtctgcctcgtcaaggcgttccagagcgcctacttcgacaggtacggcggcggcgccaactcgctcgcctccggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcgctgccatcgcggccttctaccaccagtacatcctccgggctggcgccatcaaggccctcggctccttcaggagcaacgcgtgatgagcggggcttggctgtggagcaatggcgggcgacctacgggcggggggcgttagcgaggagaatgccatcattcatcgatcgacttgggtgccggtggttggttcgggtccccttttttntgtntaacaactgctgcgttgcgcgcgtgcgtgaatttggtttggtcgttcccctgcatgtatcattcgtgacctcaaggatatccctc

SEQ ID NO: 32263 - DNA, 634 bp, Triticum aestivum
  Clone ID: PAT_TA_32263
gcgacgcgtgggcgccacacacacccatccaaatctcttcttccactccttaccagcaacaggcaagtgcatacggcaaggaagcaacaggtacaacagctccggagattcttggattggttcttctgtgaagatggtggcgcccatggtgatcgcgtcggcggggctccggatgctggcgggcgttgcgatggcgaaccggggagacgggctgccggcggcgtccaggtgggcgcgcggccccgttgctccacgtgcagcggcaccggccgggaggagtgcctctgcagccgttggtccgacggcgacgtcggctgcgggacgtgctctgggtctggccgcaagcggtgccgcggctgcggaggctctggcaccggtcggccgctcccggcgcgactcatcgtccaggagcagaagctgccaaccccgcccggggcgacgcggagactacaactgatattcgtcggcaggtttcccagaggaaatcagttgtgcaattaggcataactgaactaacgcacgagtgtatatgcaacatgttcactccttctcacaaaaggttatagaacttgcattttattccatacttgcatatgcaactctaatttatacattaatttggcaattgaggacg

SEQ ID NO: 32264 - DNA, 816 bp, Triticum aestivum
  Clone ID: PAT_TA_32264
tgtgcggcgctcgagccggccgggttcgggacaccactgacacacccatccaattctcttcttccactccttaccagcaccaggcaagtgcacacggcaaggaagcaacaagcaccggcaatttgggcaccaagaaaagggagattcttggattgttttttcggcgaagatggtttcgcccatggtgatcgcgtcggcggggctcgggatgctggcgggcgtggcgatggcgaaccggacgacgggcgacgggctgccggcggcgtccaggtggaacgcgcggccccgttgctccacgtgcagcggcaccggccgggaggagtgcctctgcagccgttggtccgacggcgacgtcggctgcgggacgtgctccggctccggtcgcaagcggtgccgcagctgtggaggctctggcaccggccggccgctcccggcgcgactcgtcgtccaggagcagaagctgccgaccccgcctgggcgacgcggagactacaactaatattcgtcggtttcccagaggaaatcagttgtgcaattaggcggagctgaactaacgcacgagtgtatatgcaacatgttcactcttgtggatgtgatacgtgcctccttcaagacgtactaagtagttatgcataaaacatttttagaagctcctttgattcaaaggaattttatagcaatttttagaggatttaaattcttagggatctttcctgcgttggcaatttgattcatatggttgcaatcctttggatttttcctttgaatccatttccattctattttcgggggaaaaaaaaaaaaaaaaaaaaaaaa

SEQ ID NO: 32265 - DNA, 665 bp, Triticum aestivum
  Clone ID: PAT_TA_32265
ctcgtgccgaattcggcacgaggcaaaaacaacagattggcacaacctctcgtccacacacccatccaaatctcttcttcttccactcctaacagcaccagcaaagccaagaagtacagctcctccttccactcctacttcgccgtttccgggagattcttggattggtttttcggcaaagatggtttcgcccgtcgtgatcgcgtcggcggggctcgggatgctggcgggcgtggcgatggcgagccggggatcgggcgacgggctgccggcggcgtccaggtgggacgcgcggccccgttgctccacgtgcagcggcaccggccgggaggagtgcctctgcagccgttggtccgacggcgacgtcggctgcgggacgtgctctgggtccggccgcaagcgctgccgcagctgcggaggctctggcaccggccggccgctcccggcccgactcatcgtccaggagcagaagctaccgaccggcgccagggcgacgccggagactacaactgatattcatcggtttccccgaggaaatcgtaagtgtaattaagcagaacatagcacaccaagtatatgcaacgtgtccattcctgtgtatgttatacgctgtatccctgcacgtactactagttaagtactcctctgtaaagaaatatgagact

SEQ ID NO: 32266 - DNA, 591 bp, Triticum aestivum
  unsure (1)..(591): unsure at all n locations
  Clone ID: PAT_TA_32266
cggatgtggtccttctaccgggcgctcatcgccgagttcgtcgccacgctgctcttcctctacatcaccgtcgccaccgtcatcggcggcggcgtaccaccagtacatcctccgggcggcggccatcaaggcgctcggctccttccggagcagccggagcaactgagccgcccgcccggccggccaataatttaatgcaacggtcacccaccgcgctagctagcgtgttggcagtactgctcctcgtgtccatccggccttctcgttccagtgtcctctctgtgcatgcatgcgagtgagagaaagaccaccatgttttcactcttcaattattactccttgtcaccgttactgttgtcgaattacattaagttactactgttattaagtgttggtgttggatggatgatgaacctgtaatgtaaaaccgctgtgagtggagaattgctgcaatttgggaacgttaatttatttatttatggtgtgatgcatgcgtgtttgctgggagtgctgctagcttatcctgctgggtatccttgtcagtgtatattaaggcctgtcctatatttgtcaangggtaaaaaaaaaaaa

SEQ ID NO: 32267 - DNA, 1828 bp, Triticum aestivum
  Clone ID: PAT_TA_32267
cacgaaatccatttattccccgtctatcggaggcaaacccgcggcctcctttcccgagccggctggatggagagggacttcctgggcgccataagccacgagcagctgctgcagcagcagcagcgccagcgcgccccgccgccgaggacgacccaccagaaaggagtcagcttactttgggggaggaggagtgccacccatggattggtccttcgctggcagggccggggccgcgccggctgtcatgtccttcaggtcggctgcgagggaggagcagcagggcgagctcgcgtaccccaagcagcaggcctcccgcgtcctgacgccacagagatcgtttggtgctgagacccatggcagcgtgcagtacgccgccgccgcgcgtgcggcttacggtgtgcagccttcgcagcagcagcatgctcctaatggtgctagggtgattccaatgtcgtcgccgttcaatcccaacaatcccatgttcagggttcggagttcgcctaacctcccgaatggcggtgctgctggtagcccgtttaaacaaccgccttttgccatgaacaatgcggtggctgcttctaccgttggtgtctataaatcaagggacatgccgaagccaaagacagcgcagttaactatcttctacgctggttctgtcaatgtattcaacaacgtctcagcagaaaaggctcaggagcttatgttcttggccagcagaggatctcttccaactgcacccactactgttactcgcagcccagatgcaacctttttcactccggctaagcttgcggcacctgaggcttcacctgcaaagcagatgctagctcagataccacagcgtgtttcacctcctttgccggccatttccaagccgatgtccatcatgtctcaagctgcatgtctccccaagagcacatctagctccaacactgattccgcagtgccaaaatcttcaggccagttggttgtacctcccactagtcagccctcgtcgtcgactcatactgcgacactatcgtccaccactgctgcaagtattatgccaagagctgttcctcaagctcgtaaggcatcccttgcccgattcttggagaaaaggaaagcgaaaatgcttcacacacgacagtgtttggacgataactgcacgatcgagggatccagcggccgctgctgggctgtgctcgacattcttcggctggatttaaccgtcgtgcacaagtcgtccaaactttatcgtccccatagcactgctcaaaggaaagaaagagtgacgactacggcgccatatccatcagccaagagcccgatggagagcaccgacacggtcggaagcgccaacgacaacaatagcaagtcctcatcatgcacagagatcgccttctcaagcaaccatgaagagtcgctgcgtctaggccggcccaggaacatcagctttagcggggagtccccaagtacaaaactacacatctgatccgatatgatcttccggttgtccatagattcaatcatgatggctgatgcaaagccgtaataagattttgcatccaggcaggcagggaggagggaagggatattgggaaaggcaggcagcatgatatatgttattgatgatgctcttattcttgtttatgatgtggtttttgttttggttagttcgcaacctgtaatgctggtctagctggtgcaacaccccacctaactaacaagggagctgtcgcttgcagactcttgattgttattttttgttttgcccctgcgcccattgtattgcagaaagaaacatgttaatttagcagtataaattataggcttacaaatttccacc

SEQ ID NO: 32268 - DNA, 617 bp, Triticum aestivum
  unsure (1)..(617): unsure at all n locations
  Clone ID: PAT_TA_32268
ggtacggcggcggcgccaacgagctcagcgcaggctactccaagggcaccgggctcgcggccgagatcatcggcaccttcgtgctcgtctacaccgtcttctccgccaccgaccccaagcgcaacgcccgtgactcccacatcccggtgctggctcctctcccaatcggattcgccgtgttcatggtccacctgggccaccatccccatcaccggcaccggcatcaacccggcgagaagcttgggagctgctgtcatctacaacaaagacaaggcctggggatgaccaatggatcttctgggttgggggccactgattcggcgcccgccatccgccgccgcctaccaccaattacgtgctgagggccagcgcccgccaagctccgggtcctacaggagcaactaagtcacccgtcgctcccggccggactgaagtgtagatatgtgcgaaagaagaaggccgcctccaagcgaatgcgctacggttgctccattccacactttgtcctgttcaatgacccatccttgcatcatcaactgctacgttctcggttgtgaaatgtgatgtaacgtcattgacgtgagtgtccggagtccatgttgtngtgtgttttcaaa

SEQ ID NO: 32269 - DNA, 1261 bp, Triticum aestivum
  Clone ID: PAT_TA_32269
gagcttcagcgcattagcatcttgagcagagacactcaccctagcttgtcgatcagtcgaggcagagaggatggccaaggacatcgaggcggcgccccccggcggggagtacggggccaaggactactccgacccaccgccggcgccgctcttcgacgccgaggagctgaccaagtggtccctgtaccgcgcggtcatcgccgagttcgtggccacgctgctcttcctctacatcaccgtggccaccgtcatcgggtacaagcaccaggcggaccccgccggccccaatgctgccgacgcggcctgcagcggcgtcggcatcctcggcatcgcctgggcgttcggcggcatgatcttcgtgctcgtctactgcaccgccggcgtctcgggtggccacatcaacccggcgggtgacgttcgggctgttcctggcgcgtaaggtgtcgctggtgcgcgcgctgctctacatcatcgcgcagtgcctgggcgccatctgcggagtggggctcgtcaaggggttccagagcgccttctacgtgcgctatggcggcggcgccaacgagctcagctccggctactccaagggcaccggcctcgccgccgagatcatcggcaccttcgtactcgtctacaccgtcttctccgccaccgaccccaagcgcagcgcccgtgactcccacgtcccggtgctggctcctctgccgatcggcttcgcggtgttcatggtgcacttggccactatcccgatcaccggcaccggcatcaacccagcaaggagctttggagctgccgtgatctacaacaacgagaaggcctgggatgaccactggatcttctgggtggggccattcatcggggccgccatcgcagccgcctaccaccagtacgtcctgagggccagcgccaccaagctcggcccgtctgcctccttcggcaggagctagatcggtcggccgatgtatggatgatcggaagcacagacagtaaatatatcagtgtgatactgttcggatcatgtattgtgcacgcgtctgtcttttcttagacgcatttgggtgtcttcaaaatttccctacaattgcactaaattcgaaggactcgtcgccttgtttttttcttgaacaaacaaagggtacagaaggacccaaaagctgcattaactagaagtggatcacatcatcttgtaacaggactctcgaagaaacagacataacaaactggtcccaagactattacaaagaggacctccaaaaaaaaaaaa

SEQ ID NO: 32270 - DNA, 461 bp, Triticum aestivum
  Clone ID: PAT_TA_32270
ggcaccggccggccgctcccggcgcgactcatcgtccaggagcagaagctgccgaccgcgccagggcgacgcggagactacaactgatattcatcggtttccccgaggaaatcgtaagtgtaattaagcacaacatagcacaccagtatatgcaacgtgtccattcctgtgtatgttatacgctgtctcctttcaatactccctccgtaaactaatataaaaacgtttagatcattactttaatgatttaaatgcttttatattagtttacagagggaatacgtactagttaagtagctatggcaagtccttgagaccgtagacttggatgtaataatggcaaaatcatgcatcaaacagtttcgtggttcctttgattcaaaggaattttacagaacttttggagtaaaaaaaaaaaaaaaaacctgcccgggcggccgctcgaaatcactagtgaattc

SEQ ID NO: 32271 - DNA, 1177 bp, Triticum aestivum
  Clone ID: PAT_TA_32271
ggctcctctcccaatcgggatgtgggagtcagcaccgggatgtgggagtcacgggcgttgctggctcctctcccaatcggattcgccgtgttcatggtccacctggccaccatccccatcaccggcaccggcatcaacccagcgagaagcttgggagctgctgtcatctacaacactgacaaggcctgggatgaccaatggatcttctgggtggggccactgatcggcgccgccatcgccgccgcctaccaccagtacgtgctgagggccagcgccgccaagcttgggtcctacaggagcaactaagtcaccggtcgctccggccggactgaagtgtagatatgtgcgaagaagaaggctgcctccagcaaatgcgctatggttgctcgaaccaacacctttgtcctgttcagtgtctccggtctttgcatcatcagctgctaccgttcctcggcttgtgcatatgtcgatgtgaccgtccattcgtacgtcgacgtgttccggagttcgccatgtttgcttgctgctgtttgttccaagtgtgctatccttttactcgctctatgtactcatgcagagaactaggctgtagcctagtggcaagggagcgcagtggcgtctccagcaaccagggttcgagccacgtcggggacgaatttctggtttctcacaagggatgctttctcctatatcaataaaccatgggtgctagtgcccatgagtttcatctttttaagaacaaccactaccaacgataactacgaacctaagaaagcacgcaccattgactcacattagctcaacacaaagcacttcaactagtctgcccgccggtcggcatcaccggcctgcggcgccacggaggagacggcatcgtcgggaacgccgacggggacgtcggagaatgccgccagcacgcggcggacgctcatgctccgcatcggccggaagctgagcgacctcgccgcgctggccgtggagaagacgtctgaggacttgcgcaggatgaggtagaccagcccctgcacgaacgcgaacacggccaccttggccagcgcgtccccgagctccggcgagatcgcggccgccgcctccaccacgttgcccattccccaacaactaaaccagctcaactggccgccgacgatgacagtcgacgagactacgatccgacacg

SEQ ID NO: 32272 - DNA, 822 bp, Triticum aestivum
  Clone ID: PAT_TA_32272
tccacacacacccatcgaaacctcttcttcttccaactcctaccagcaccagcaaagccaagaagtacagctcctcctcccctcccctgtagctgcttcgccgtttccgggaggttcttggattggtttttcggcagagatggtttcgcccgtcgtgatcgcgtcggcggggctcgggatgctggcgggcgtggcgttggcgagccgggggacgggcgacgggctgccggcgtcgtccagatgggacgcgcggccccgttgctccacgtgcagcggcaccggccgggaggagtgcctctgcagccgctggtccgacggcgacgtcggctgcgggacgtgctctgggtccggccgcaagcggtgccgcagctgcggaggctctggcaccggccggccgctcccggcgcgactcatcgtccaggagcagaagctgccgaccgcgccagggcgacgcggagactacaactgatattcatcggtttccccgaggaaatcgtaagtgtaattaagcacaacatagcacaccagtatatgcaacgtgtccattcctgtgtatgttatacgctgtctccttccaatactccctccgtaaactaatataaaaatatttagatcattactttaatgatttaaacgtttttatattagtttacagagggagtacgtactagttaagtagctatggcaagtccttgagaccgtagacttggatgtaataatggcaaaatcatgcatcaaacagtttcgtggttcctttgattcaaaggaattttacagaacttttggggttaaaaaaaaaaaaaaaaaaaaaaaaaaaaaaaa

SEQ ID NO: 32273 - DNA, 1095 bp, Triticum aestivum
  Clone ID: PAT_TA_32273
gaattcggcacgagcttcagcgcattagcatcttagcacacacaccgaccctagcttgtcgattagtcgaggcagcgacgatggccaaggacatcgaggcggcgccccccggtggggagtacggggccaaggactactccgacccgccgccggcgccgctcttcgacgccgaggagctgactaaatggtccctgtaccgcgcggtcatcgccgagttcgtggccacgctgctcttcctctacatcaccgtggccaccgtcatcgggtacaagcaccaggcagaccccgccggccccagtgctgccgacgcggcctgcagcggcgtcggcatcctcggcatcgcctgggcgttcggcggcatgatcttcgtcctcgtgtactgcaccgccggggtttccggtggccacatcaacccggcggtgacgttcgggctattcctggcgcgcaaggtgtcgctggtgcgtgccgctgctctacatcatcgcgcagtgcctgggcgccatctgcggcgtggggctcgtcaaggggttccagagcgccttctacgtgcgctatggcggtggcgccaacgagctcagctcaggctactccaagggcaccggcctcgcggccgagatcatcggcaccttcgtgctcgtctacaccgtcttctccgccacagaccccaagcgcagcgctcgtgactcccacgtcccggtgctggctcctctgccaatcggcttcgcggtgttcatggtgcacttggccactattccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggagctagatcagcaagccgccgtatggatgatcggaagcacggacagtagatatatcagtgtgatactgttcagatcatgtattgtgcacgcgtctgtattttcttagacgcatttgggtgtgttcaaaatttccctacaattgcact

SEQ ID NO: 32274 - DNA, 1215 bp, Triticum aestivum
  unsure (1)..(1215): unsure at all n locations
  Clone ID: PAT_TA_32274
cccccccttcaagctagctacagggcactagctagacagagctagcaatggcgaaggacattgaggcggccccccaggggggcgagttctccaccaaggactactcggacccgcccccggcgcccatcgtggacttcgaggagctgaccaagtggtcgctctaccgcgcggtgatcgccgagttcgtcgccacgctcctcttcctctacatcaccgtggccaccgtcatcgggtacaagcaccagtccgaccccaccgtcaacaccaccgacgcggcctgcagcggcgtcggcatcctcgggatcgcctgggccttcggcggcatgatcttcgtcctcgtctactgcaccgccggcgtctcaggtgggcacatcaacccggcggtgacgttcgggctgttcctggcgaggaaggtgtcgctcatccgggcgctgctctacatcatcgcgcagtgcctcggcgccatctgcggcgtcgggctggtcaagggcttccagagctcctactacgtgcggtacggcggcggcgccaacgagctcagcgcaggctactccaagggcaccgggctcgcagccgagatcatcggcaccttcgtgctcgtctacaccgtcttctccgccaccgaccccaagcgcaacgcccgtgactcccacatcccggtgctggctcctctcccaattgggattcgccgtgttcatggtccacctggccaccatccccatcaccggcacccggcatcaacccgggcgagaagcttgggagctgctgtcatctacaacaaagacaaggcctgggatgaccaatggatcttctgggtggggccactgatcggcgccgccatcgccgccgcctacaacaattacttgctgaaggcaacgcccgccaagctcgggtcctacaggacaactaatcacccgtcctccggccggactgaagttgttagatatgtgcgaagaagaaggcgctcccagccgaatgcgctacggttgctccattccaaaacctttccctgttcnattgactcccatcctttgcatcatcaagttgtacntccctccgtttgtgcacatgtccatgttaccgtccattcctatgcgtntcccggnttctccantttgcttgctgctnttccttccaatgttctacccttttacccatncaagtcccatntagtagtagcatttccaaatttttgaaccnaattngatttttttt

SEQ ID NO: 32275 - DNA, 1282 bp, Triticum aestivum
  unsure (1)..(1282): unsure at all n locations
  Clone ID: PAT_TA_32275
cggcacgagggagcaaacaccattcaagctacagcgacactagctagacagagctagcaatggcgaaggacattgaggcggcaccccaggggggcgagttctccaccaaggactactcggacccgcccccggcgccgatcgtggacttcgaggagctgaccaagtggtcgctgtaccgcgcggtgatcgccgagttcgtcgccacgctcctcttcctctacatcaccgtggccaccgtcatcggctacaagcaccagtccgaccccaccgtaaacaccaccgacgcggcctgcagcggcgtcggcatcctcgggatcgcctgggccttcggcggcatgatcttcgtcctcgtctactgcaccgccggcgtctcaggtggacacatcaacccggcggtgagcgttcgggctgttcctggcgaggaaggtgtcgctcatccgggcgctgctctacatcattgcgcagtgcctcggcgccatctgcggcgtcgggcttgtcaagggcttccagagctcctactacgtgccggtacggcggtggcgccaacgagctcagcgcaggctactccaagggcaccgggctcgcggccgagatcatcggcaccttcgtgctcgtctacaccgtcttctccgccaccgaccccaagcgcaacgcccgtgactcccacatcccggtgctggctcctctcccaatcggattcgccgtgttcatggtccacctggccaccatccccatcaccggcaccggcatcaacccaagcgagaagcttgggagctgctgtcatctacaacactgacaaggcctgggatgaccaatggatcttctgggtggggccactgatcggcgccgccatcgccgccgcctaccaccagtacgtgctgagggccagcgccgccaagcttgggtcctacaggagcaactaagtcaccggtcgctccggccggactgaagtgtagatatgtgcgaagaagaaggctgcctccagcaaatgcgctatggttgctcgaaccaacacctttgtcctgttcagtgtctccggtctttgcatcatcagctgctaccgttcctcggcttgtgcatatgtcgaagtgaccgtcatcgtacgtcgactgttccggagttcgcatgtttgctgctgctgtttgttcaagtgtgctanccttactcgctcatgtaccatgtnagaacagctgtaccaatggaaggaaccattgngttcacaacaaggttcagccactcgggacaatttcggttccaaggaggttcccaacataacaaggtg

SEQ ID NO: 32276 - DNA, 1919 bp, Triticum aestivum
  Clone ID: PAT_TA_32276
caaggctgggaaagatgcaccgtcgtcgtcgccgtcatcgttcgttcgttcgttcgttccagaggagtggcggtgttggcagtgagagagggtgagaggagggaggaaggaaggttcaggggaggggagtgagagacgaaatccatttattcccccgtctatcggaggcaaacccgcggcctcctttcccgagccggctggatggagagggacttcctgggcaccataggccacgagcagctgcagcagcagcagcagcagcagcagcgccagcgcgccgccgccgaggacgccgccgccagaaaggagtcagcttactttgggggaggaggagtgccgcccatggattggtccttcgctggcagggccggggccgcgccggcggtcatgtccttcaggtcggcgccgagggaggagcagcggggcgagctcgcctaccccaagcagcaggcctcccgcgtcctgacgccacagagatcgtttggtgctgagagccacggcagcgtgcagtacgccgccgccgcgcgtgcggcttacggcgggcagcctccgcagcagcaccagcatgctcctaatggtgctagagtgattccaatgtcgtcgccgttcaatcccaacaatcccatgttcagggttcagagttcgcctaacctcccgaacggtgttgctgctggtagcccgttcaaacaaccgcctttcgtgatgaacaatgcggtggctgcttcgactgttggcgtctataaatcaagggacacgccgaagccaaagacagcgcaattaactatcttctatgctggttctgtcaatgtattcaacaacgtctcagcagaaaaggctcaggagcttatgttcttggctagcagaggatctcttccaaccgcacccactactgttactcgcagcccagatgcaacctttttcactccggctaaactcgccgcccctgaggcttcacctgcaaagcagatgctagctcagataccacagcgtgtttcacctcctttgccagccatttccaaaccgatgtccatcatgtctcaagctgcatgtctccccaagagcacatctagctccaacaccgattccgcagtgccaaaatcttcaggccagttggttgtgcctcccacaagtcagccctcgtcgtcgacactagcgtccaccactgcagcaagtattatgccaagagctgttcctcaagctcggaaggcatcccttgcccgattcttggagaaaaggaaagaaagggtgacgactacggcgccatatccatcagccaagagcccgatggagagcagcgacacggtcggaagcgccaacgacaacaacagcaagtcctcatcgtgcacagagatcgccttctcaagcaaccatgaagagtcgctgcgcctaggccggcccaggaacatcagctttagcggggagtccccgagtacaaaattacacatctgatccgatatgatcttccggttgtccatagattcaaccacgatggctgatgcaaaaccgcaataagaagattttgcatccaggcaggcaggcaggcaggcaggcaggaggagggaagggatattgggaaaaggcaggcagcatgatatatgttattgatgatgttgttattcttgtttatgatgtgttttgttttggttagctcgcaacctgtaatgctggcctagctggtgcaacaccccacctaactaacaagggagctgtcgcttgcagactcttgattgttattttttgctttgcccctgcgcccattgtattgcagaagaaagaaacatgttgatttagcagtatgaaaattataggcttacaaatttccaccatgggtcgcagagctgtgtgctgttcttgttcttcttctgtttttaccaacttctacaggccgcgggatacaatacaagagctattaaacattt

SEQ ID NO: 32277 - DNA, 1271 bp, Triticum aestivum
  Clone ID: PAT_TA_32277
gcaccattcaagctagctacagggcactagctagacagagctagcaatggcgaaggacattgaggcggcaccccagggcggcgagttctccaccaaggactactcggacccgccgccggcgccgatcgtggacttcgaggagctgaccaagtggtcgctctaccgcgcggtgatcgccgagttcgtcgccacgctcctcttcctctacatcaccgtggccaccgtcatcgggtacaagcaccagtccgaccccaccgtcaacaccaccgacgcggcctgcagcggcgtcggcatcctcgggatcgcctgggccttcggcggcatgatcttcgtcctcgtctactgcaccgccggcgtctcaggtgggcacatcaaccctgcggtgacgttcgggctgttcctggcgaggaaggtgtcgctcatccgggcgctgctctacatcatcgcgcagtgcctcggcgccatctgcggcgtcgggctggtcaagggcttccagagctcctactacgtgcggtacggcggcggcgccaacgagctcagcgcaggctactccaagggcaccgggcttgcggccgagatcatcggcaccttcgtgctcgttacccgtcttctccgccaccgaccccaagcgcaacgcccgtgactcccacatcccggtgctggctcctctcccaatcggattcgccgtgttcatggtccacctgccaccatccccatcaccggcaccggcatcaacccggcgagaagcttgggagctgctgtcatctacaacaaagacaaggcctgggatgaccaatggatcttctgggtggggccgctgatcggcgccgccatcgccgccgcctaccaccagtacgtgctgagggccagcgccgccaagctcgggtcctacaggagcaactaagccggccgtcgctccggccggactgaagtgtagatatgtgcgaagaagaaggccgcctccagcaaatgcgctatggttgctcgatcccacacctttgtcctgttcagtggctccagtctttgcatcatcagctgctaccgttcctcggcttgtgcatatgtcgatgtgaccgtccattcgtacgtcgacgtgttccggagttcgccatgtttgcttgctgctgtttcttccaagtgtgctatccatttactcgctctatgtatgtatgtatgcatgtggagaatttgtgaatcaaagaattggtatcgtttgtgaaattttattttacttgcaaagaaagagcttccacagcttcaaaaaaaaaaaa

SEQ ID NO: 32278 - DNA, 1395 bp, Triticum aestivum
  Clone ID: PAT_TA_32278
gaaactgttaatcgcaaagggagcgccctgcgccggcctttcgccgagagccagtagccgccccgcgcctcgccgccataaataccacgcccgtgtcctcgtcgtctcacaccaccacacagagcttcggcgcactcgcaccttgggcaccaccacacacacccaccctagcttgtcgatcggctgaggagcgcgacgatggccaaggacatcgaggcggcgccacccggtggggagtacgcggccaaggactactccgacccgccgccggcgccgctcttcgacgccgaggagctgaccaagtggtccctgtaccgcgcggtgatcgccgagttcgtggccacgctcctcttcctctacatcaccgtggccaccgtcatcgggtacaagcaccaggcggaccccgccggccccaacgccgccgacgcggcctgcagcggcgtgggaatcctcggcatcgcctgggcgttcggcggcatgatcttcgtgctcgtctactgcaccgccggtgtgtcggggtggccacataaacccggcggtgaccttcgggctgttccctggccgcgcaaggtgtcgctggtgcgcgcgctgctctacatcatcgcgcagtgcctcggcgcaatctgcggcgtcgggctcgtcaaggggttccagagcgccttctacgtgcgctacggcggcggcgccaacgagctcagctccggcttctccaagggcaccggcctcgccgcggaaatcatcggcaccttcgttctcgtctacaccgtcttctccgccaccgaccccaagcgcagcgcccgtgactcccacgtcccagtgctggctcctctgccaatcggcttcgcggtgttcatggtgcacctggccactatcccgatcaccggcaccggcatcaacccggcaaggagcttgggggctgctgtgatctacaacaacgagaaggcctgggacgaccactggatcttctgggtggggccattcatcggcgccgccatcgccgccttataccaccagtacgtgctgagggccagcgccaccaagttcggctcgtccgcctccttcggcagccgctagatcgacggccggccgccgttctccgatggtcggaggcactgaactgtagatatatcaagaggacagaggggcctccagtgtgtgctgctgttcgggtcctggattctgctggtctttgcacgcgtctctcttttcctcagctcgcccgcccgcgtttggctgcttgttttctctaccggtcgagtgtgtcttcgttagtgtttgcttccattgcatgtactatctgtgaacgatgaggatgatgtactgtcaatctgtcatgtatgcgtccaggtaatttggggggaaatttgaaatgcaatgtgtactaaaaaaaaaaaa

SEQ ID NO: 32279 - DNA, 2286 bp, Triticum aestivum
  Clone ID: PAT_TA_32279
taacctccacgggccgaaaataaacaagcgattttgtcggcaccacacgcgcacgcacgcacaccgcccagaggctaggcttggccaggagtactggagcagtatacattcgagagagagaggggaaaggcagacggtcaaggctgggagagagggagagggagagcatcgtcgtcgtcatcattcgctcgttcacagaggagtgagagagtcagaggaggaaggaaggttcaggggagtgagaaacgaaatccatttattccccgtctatcggaggcaaatccgcggcctcctttcccgagccggctggatggagagggacttcctgggcgccataggccacgagcagctgcagcagcagcagcagcagcagcagcgccagcgcgccgccgccgaggacgacgccaccagaaaggagtcagcttactttgggggaggaggagtgccgcccatggattggtccttcgctggcagggccggggccgcgccggcggtcatgtccttcaggtcggcgccgagggaggagcagcagggcgagctcgcgtaccccaagcagcaggcctcccgcgtcctgacgtcacagagatcgtttggtgctgagagccatggcagcgtgcagtacgccgccgccgcgcgtgcggcttacggcgggcagcctccgcagcagcagcatgctcctaatggtgctagagtgattccaatgtcgtcgccgttcaatcccaacaatcccatgttcagggttcagagttcgcctaacctcccgaatggcgttgctgctggtagcccgtttaaacaaccaccttttgcgatgaacaacgcggtggctgcttctactgttggtgtctataaatcaagggacatgccaaagcccaagacagcgcagttaactatcttctacgctggttctgtcaatgtattcaacaacgtctcggcagaaaaggctcaggagcttatgttcttggctagcagaggatctcttccaactgcacccactactgttactcgcagcccagatgcaacctttttcactcccgctaaactcgcagcacctgaggcttcacctgcaaagcagatgctagctcacataccacagcgtgtttcacctcctttgccggccatttccaaaccgatgtccatcatgtctcaagctgcatgtctccccaagagcacatctagctccaacaccgattccgcagtgccaaaatcttcaggccagttggttgtgcctcccacaagtcagacctcgtcgtcgactcatcctgtgacactatcgtccaccactgctgcaagtattatgccaagagctgttcctcaagcacgtaaggcatcccttgcccgattcttggagaaaaggaaagaaagagtgacgactacggcgccatatccatcagccaagagcccgatggagagcagcgacacggtcggaagcgccaacgacaacaacagcaagtcctcgtcgtgcacggagatcgccttctcaagcaaccatgaagagtcgctgcgcctaggccggcccaggaacatcagctttagtggggagtccccgagtacaaaactacacatctgatccgatatgatcttccggtgtccatagattcaaccatgatggctgatgcaaaaccgtaataagaagattttgcatccaggcaggcaggaggagggaagggatattgggaaaggcaggcagcatgatatatgttatggatgatgctcttattcttgtttatgatgtgttctattttggttagctcgcaacctgtaatgctggtctagctggtgcaacaccccacctaactaacaagggagctgtcgcttgcagactcttgattgttattttttgttttgcccctgcgcccattgtattgcagaagaaagaaacatgttaatttaaaaaaaaaaaaaaaaaactcgagactagctcgtgccgaattcggcacgaggtacgtgctgagggccagcgccaccaagttcggctcgtccgcctccttcggcagccgctagatcggccggccgccgtctcggtgatggtcggaggcactgaactgtagatatatcagaggacagagggcctccagtgtgtgctgctgttcgggtcctggattctgctggtctttgcacgcgtctctgttttccgcagctcgccgccgcgtttgctgcttgttttctctaccgatcgagtgtgtcttcgttagtgtttgcttccattccatgtactatctgtgaacgatgaggatgatgtactgtcatgtatgcatccaaggtaatttggggggaaatttgaaatgc

SEQ ID NO: 32280 - DNA, 774 bp, Triticum aestivum
  Clone ID: PAT_TA_32280
cgccaacgagctcagcgcaggctactccaagggcaccgggctcgcagccgagatcatcggcaccttcgtgctcgtctacaccgtcttctccgccaccgaccccaagcgcaacgcccgtgactcccacatcccggtgctgggctcctctcccaattggattcgccgtgttcatggtccacctggccaccatccccatcaccggcaccggcatcaacccggcgagaagcttgggagctgctgtcatctacaacaaagacaaggcctgggatgaccaatggatcttctgggtggggccactgatcggcgccgccatcgccgccgcctaccaccagtacgtgctgagggccagcgccgccaagctcgggtcctacaggagcaactaagtcacccgtcgctccggccggactgaagtgtagatatgtgcgaagaagaaggccgcctccagcgaatgcgctacggttgctccgatcccacacctttgccctgttcagtgactccagtctttgcatcatcaactgctaccgttcctccggcttgtgcacatgtcgatgtgaccgtccattccgtatgcgtgttccggagttctccatgtttgcttgctgctgtttcttccaagtgtgctacccttttactcgatctatgtactcatgtatgtatgttatgcatgtccgagaatttgtgaatcaaagaattggtattttttttagaaaaggaggatgaccccggctctgcatctgggagagcatgcggcatttattgattaaaaaaaaaaaa

SEQ ID NO: 32281 - DNA, 1329 bp, Triticum aestivum
  Clone ID: PAT_TA_32281
gcacgaggcagagcttcagcgcactcgcacctcgggcaccaccacacacacccaccctagcttgtcgatcggctgaggaggcggcgatggccaaggacatcgaggcggctccacccggcggggggtacgcggccaaggactactccgacccgccgccggcgccgctcttcgacgccgaggagctgaccaagtggtcactctaccgcgcggtcatcgccgagttcgtggccacgctgctcttcctctacatcaccgtggccaccgtcatcgggtacaagcaccaggcggaccccgccggccccaacgccgccgacgcggcctgcagcggcgtcggcatcctgggcatcgcctgggcgttcggcggcatgatcttcgtgctcgtctactgcaccgccggtgtctcgggcggacacatcaacccggcggtgaccttcgggctgttcctggcgcgcaaggtgtccctggtgcgcgcgctgctctacatcatcgcgcagtgcctgggcgccatctgcggcgtggggctcgtcaaggggttccagagcgccttctacgtgcgctacggcggcggcgccaacgagctcagctccggcttctccaagggcaccggccctcgccgcggagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatccccatcaccggcaccggcatcaacccggcaaggagcttgggagctgctgtgatctacaacaacgagaaggcctgggatgaccactggatcttctgggtggggccattcatcggcgccggcatcgccgccttgtaccaccagtacgtgctgagggccagcgccaccaagttcggctcgtcggcctccttcggcagtcgctagatcgacggccggccgccgtctcggtgatggtcggaggcactgaactgtagatatatcagaggacagaggggcctccagtgtgtgctgctgttcgggtcctggattctgctggtctttgcacgcgtctctgttttcctcagctcgccgccgcgtttgctgcttgtttttctctaccgatcgagtgtgcgtctgtcttcgttagtgtttgcttccattccatgtactatctgtgaacgatgaggatgatgtactgtcaatctgtcatgtatgcatccaggtaatttggggggaaatttgaaatgcaatgtgtacgtacgattcgggttgtgagctgcttgcatgtttcgtcgaaatcactaattagggagt

SEQ ID NO: 32282 - DNA, 1391 bp, Triticum aestivum
  Clone ID: PAT_TA_32282
cacaccgcaagccccacctccattttttccagtcaggtttgcagcgagaaggaacagcaaggaaggctagctacacgccgatggccaaggacgaggtgatggagaccggcggcggcggcgacttcgcggccaaggactacacggacccgccgccggccccgctgatcgacgcggcggagctggcctcctggtcgctgtaccgcgccgtcatcgcggagttcatcgccacgctgctcttcctctacatcaccgtggccaccgtcatcgggtacaagcaccagacggaccccgcggtgaacgccgccgccgacgcggcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtctccctggtccgcgcgctgctctacatgattgcgcagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcgcgcgactctcacgtcccggtgctggcgcccctccccatcggcttcgccgtgttcatggtccacctggccaccatccccatcaccggcaccggcatcaacccggccaggagcctgggcgccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccacgtcagctccatgcaagattgaagcaatggcgacctgtgttgtgcccatccagagagaaatgcgcttttgcaacttctcaacagttcagttggcccgcaatggtcgtgttatttatgtgtcggcagcagcatatgcgtagtgcgagtacgtggttggcctccatgtgcccggtcctgcgtgccgtgtcttgtaattcggtccatgggatcgctttgtcttaattagcccgcattgcttttcctactgtatttaaatttggcgaccatatgatcgatccaacgtcgccacctttctgtctaagtcatgaatccaccaagcaagtgatcatcccaaataagtgctctattgtcttgtttgtgacgagtggtggtactcttgctttctaatcttgttgctgctttgccggatgtgagtcctcaagcc

SEQ ID NO: 32283 - DNA, 1682 bp, Triticum aestivum
  unsure (1)..(1682): unsure at all n locations
  Clone ID: PAT_TA_32283
cacactccaccacccccatccatccatccatcagagaagagagagagagaggagagcgtccacactccgcagcagccatggccaaggaggtgagcgaggagccggagcacgccgcgccggcgcacaaggactactccgacccgccgccggcgccgctcttcgacatgggggagctccggatgtggtccttctaccgggcgctcatcgccgagttcgtcgccacgctgctcttcctctacatcaccgtcgccaccgtcacggccctcggggcggagatcgtcggcaccttcgtgctcgtctacaccgtcttctccgccaccgaccccaagcgcagcgcccgcgactcccacgtccccgtgctcgccccgctccccatcggcttcgccgtcttcatggtgcacctcgccaccatccccatcaccggcaccggcatcaaccccgccaggagcctcggcgccgccgtcatctacaacaagaaggccgcatgggacaaccactggatcttctgggtcggcccgttcgtgggagcgctggcggcggcggcgtaccaccagtacatcctcggggcggcggccatcaaggcgctcggctccttccggagcagccggagcaactgagccggccggccaataatttaatgcaacggtcacccaccgcgctagccagccacacaagctagcgtgtccatccggcctcgtcgttcagtgtctgtgcatgcatgtgagtgagaggaaggccagcatgcgtgattcgtggcgcgttttcacccttcaattattactccatcaacaccaacactaacggtaactaatataattcgacaacattaacggtgctcccgtccacacacccatcgaaatctcttcttcttccactcctaccagcaccagcaaagcatacacggcaggaaagccaagaagtacagctcctcctcccctcccctgtagttgcttcgccgtttccgggagattcttggattggttttccggcaaagatggtttcgcccgtcgtgatcgcgtcggcggggctcgggatgctggcgggcgtggccatggcaaaccggacgacgggcgacgggctgccggcgtcatccagatgggacgcgcggccccgttgctcgacttgcagcggcaccggccgggaggagtgcctctgcagccgttggtccgacggcgacgtcggctgcgggacgtgctctggctccggccgcaagcggtgccgcagctgcggaggctctggcaccggccggccgctcccggcgcgactcatcgtccaggagcagaagctgccgaccgcgccagcgcgacgcggagactacaactgatattcatcggtttccccgaggaaatcgtaagtgtaattaagcacaacatagcacaccagtatatgcaacgtgtccattcctgtgtatgttatacgctgcatcctgcacgtactactagttaagtactcccgctgtaaagaaatacgagacttttttttagaccattactccttgagaccgtaggcttgacagtaataaggacaaaatcatgcatcaaacagtttcaggagatcctttgattcaaagcaattttgcaagattttttggaggatttaaatacttangaacccttttgtgttattagtttgattcacatgattgaaatccttcagaatttcaaaaaaaaaaaaaaaaaaaa

SEQ ID NO: 32284 - DNA, 1155 bp, Triticum aestivum
  Clone ID: PAT_TA_32284
tcggcacgaggagagagctaagcgcattcgcatcttgagcacagacacccaccctagcttgtcgatcagtcgaggcagcgacgatggccaaggacatcgaggcggcgccccccggaggggagtacggagccaaggactactctgacccgccgcgcggcgccgctcttcgacgccgaggagctgactaaatggtccctgtaccgcgcggtcatcgccgagttcgtggccacgctgctcttcctctacatcaccgtggccactgtcatcgggtacaagcaccaggcggaccccgccggccccaatgctgccgacgcggcctgcagcggcgtcggcatcctcggcatcgcctgggcgttcggcggcatgatcttcgtgctcgtctactgcactgccggggtttccggtggccacatcaacccggcggtgacgttcgggctgttcctggcgcggaaggtgtcgctggtgcgcgcgctgctctacatcatcgcgcagtgcctgggcgccatctgcggcgtcgggctcgtcaaggggttccagagcgccttctacgtgcgctacggcggcggcgccaacgagctcagctccggcttctccaagggcaccggcctcgccgccgagatcatcggcaccttcgtgctcgtctacaccgtcttctccgccaccgaccccaagcgcagcgcccgtgactcccacgtcccggtgctggctcctctgccaatcggcttcgcggtgttcatggtgcacctggccactatcccgatcaccggcaccggcatcaacccggcaaggagctttggagctgccgtgatctacaacaacgagaaggcctgggatgaccactggatcttctgggtggggccattcatcggggccgccatcgccgccgcctaccaccagtacgtcctgagggccagcgccaccaagctcggctcgtctgcctccttcggcaggaactagatcggccgactgcagtatggatgatcggaagcacggacagtagatatatcagtgtgatactgttcgggtgatgtattgtgcacgcgtgctgtattttcttagacgcgtttgggtgtcttcaaaatttctctacaattgcactaaattcgaaggactcgtcaccatgtgttttttttgaacaaaaaaaaaaaaaaaaaa

SEQ ID NO: 32285 - DNA, 1365 bp, Triticum aestivum
  Clone ID: PAT_TA_32285
gcccgtactcccccaccacacaccccaccccaagcccccacctccattttttccagtcaggttcacagcgagaagcaacagcaaggcaagctagctacacgccgatggccaaggacgaggtgatggagaccggcggcggcggcgacttcgcggccaaggactacacggacccgccgccggccccgctgatcgacgcggcggagctggcctcctggtcgctctaccgcgccgtcatcgccgagttcatcgccacgctgctcttcctctacatcaccgtggccaccgtcatcgggtacaagcaccaagacgggacccggccgtgaacaccgccgccgaacgccgcgttgcggcggcgtttggcgtgctcggcatcgccctggggccttcggcggcatgatcttcgtcctcgtctactgcaccgccggcatctccgggggccacatcaacccggccgtcaccttcggcctcttcctggcgcgcaaggtctccctggtccgcgcgctgctctacatggtggcccagtgcctcggcgccatgtgcggggtcggcctcgtcaaggccttccagagcgcctacttcgtcaggtacggcggcggcgccaacacgctcgccgccggctactccaagggcaccggcctcgccgcggagatcatcggcaccttcgtgctcgtctacaccgtcttctccgccaccgaccccaagcgcagcgcacgcgactctcacgtcccggtgctggcgcccctcccgattggcttcgccgtgttcatggtccacctggccaccatccccatcaccggcaccggcatcaacccggcccggagcctcggggccgccgtcatctacaacaaggacaaggcctgggatgatcagtggatcttctgggtcggccccatgatcggcgcggcgatcgcggccttctaccaccagtacatcctcagggccggcgcccatcaaggccctcggctccttcaggagcaacgcgtaacaagttatcatccatgtgatctgcatgcaagattgaagcaatggcgacccgtgttgtgtccatccatccagagagaaatgcgcttttgcaacttctcgacagttcagttcggccgccgcaatggtcgtgttatttatgtgtcggcagctgcatatgcgtagtacgagtacgtggttggcctccatgtgcccggtcctgcgtgccgtgtcttgtaattcggtcccatgggatcgcctcgcttgtcttaattagcccgcattgcttttcctattgtatttaaatttagcgaccatatgtatgatcgatccaacgtcgccgcctttctgtctaattcatcaatccaccaagcaagtgatcatcccaaaataagaaaaaaaaaa

SEQ ID NO: 32286 - DNA, 1296 bp, Triticum aestivum
  Clone ID: PAT_TA_32286
cgtccgctccaccactcccaacccatccatccatcacagaagagagagagagagagagagacagaggagagccatggccaaggaggtgagtgaggagccggagcacgccgcgccggcgcacaaggactactccgacccgccgccggcgccgctgttcgacatgggggagctccggatgtggtccttctaccgggccctcatcgccgagttcgtcgccacgctgctcttcctctacatcaccgtcgccaccgtcatcggctacaaggtgcagtcggcggccgacccgtgcggcggcgtcggcgtgctcggcatcgcctgggccttcggcggcatgatcttcgtcctcgtctactgcaccgccggcatctcggggggccacatcaaccctgccgtcaccttcgggctgctgctggcgcggaaggtgtcgctgctgcgcgcggtgatgtacatcgtggcgcagtgcgcgggcggcatcgtgggggccggcatcgtcaagggcatcatgaaggacgcgtaccaggccaacggcggcggcgccaacatggtcgcctcggggttctcccgcggcacggccctaggggcggagatcgtcggcaccttcgtgctggtgtacaccgtcttctcagccaccgaccccaagcgcagcgcccgcgactcccacgtccccgtgctggccccgctccccatcgggttcgccgtcttcatggtgcacctcgccaccatccccatcaccggcaccggcatcaaccccgccaggagcctcggcgccgcagtcatctacaacaagaaggccgcatgggacaaccactggatcttctgggtcggcccgttggtgggagcgctggcggcggcggcgtaccaccagtacatcctccgggcggcggccatcaaggcgctcggctccttccggagcagccggagcaactgagccggccggccaataatttaatgcaacggtcacccaccgcgctagctagcgtgttggcagtagtgcatgctcctcctcgtgtcgttcagtgtcctctctgtgcatgcatgtgagtgagagaaagaccaccatggatcgctgttttcacttgctcttcaattattactccttgtcaccgttaatgttgtccaattatattagttactgttagtgttggtgttggatggatgatcgaacctgtgtaaaaccgctgtgagtgagttggaacatggattaatttattgtgtgatgcatgcgtgtttgattgagtggtgctatccttgtcagtgtatagcttgtctttgtctgcaatgcaatcatgtttatct

SEQ ID NO: 32287 - DNA, 1313 bp, Triticum aestivum
  Clone ID: PAT_TA_32287
accacacaccccaagcccccacctccattttttccagccaggtttgcagcgagaaggaacagcaaggctagctacacaagccgatggccaaggacgaggtgatggagaccggcggcggcggcgacttcgcggccaaggactacacggacccgccgccggccccgctgatcgacgcggccgagctggcctcctggtcgctctaccgcgccgtcatcgccgagttcatcgccacgctgctcttcctctacatcaccgtggccaccgtcatcgggtacaagcaccagacggacccggcggtgaacagcgccgccgacgcagcgtgcggcggcgtgggcgtgctcggcatcgcctgggccttcggcggcatgatcttcgtcctcgtctactgcaccgccggcatctccgggggccacatcaacccggccgtcaccttcggcctcttcctggcgcgcaaggtgtccctggtccgcgcgctgctctacatgattgcgcagtgcctcggcgccatgtgcggggtcggcctcgtcaaggccttcagagcgcctacttcgtcaggtacggcggcggcgccaacacgctcgccgccggctactccaagggcaccggcctcgctgcggagatcatcgggcaccttcgtgctcgtctacaccgtcttctccgccaccgaccccaagcgcagcgcacgcgactctcacgtcccggtgctggcgcccctcccgatcggcttcgccgtgttcatggtccacctggccaccatccccatcaccggcaccggcatcaacccggcccggagcctgggggccgccgtcatctacaacaaggacaaggcctgggatgatcagtggatcttctgggtcggccccatgatcggcgcggcgatcgcggccttctaccaccagtacatcctcagggccggcgccatcaaggccctcggctccttcaggagcaacgcgtaacaagttatcatccatgtcatctgtatgcaagactgaagcaatggcgacccgtgttgtgtccatccatccagagagaaatgcgcttttgcaacttctcgacagttcagttcggccgccgcaatggtcgtgttattatgtgtcggcagctgcatatgcgtagtacgtggtccggtcatgcgtgccgtgtcttgtaattcggtccatgggatcgcttgtcttaattagcccgcattgcttttcctacttgtatttaaatttagcgaccatatgtatgatcgatccaacgtcgccacctttctatctaagtcatcaatccaccaagcaagtgatcatcccaaaaaaaaaaaaaaaaaaaaa

SEQ ID NO: 32288 - DNA, 1258 bp, Triticum aestivum
  Clone ID: PAT_TA_32288
tcacactccacctccaccacccccatccatccatccatcagagaagagagagagagacagagagagaggagccatggccaaggaggtgagcgaggagccggagcacgccgcgccggcgcacaaggactactccgacccgccgccggcgccgctcttcgacatgggggagctccggatgtggtccttctaccgggccatcatcgccgagttcgtcgccacgctgctcttcctctacatcaccgtcgccaccgtcatcggctacaaggtgcagtcggcggccgacccgtgcggcggcgtcggcgtgctcggcatcgcctgggccttcggcggcatgatcttcgtcctcgtctactgcaccgccggcatctcgggcggccacatcaacccggccgtcaccttcgggctcctcctggcgcgcaaggtgtcgctgctacgcgcggtgatgtacatcgtggcgcagtgcgcgggcggcatcgtgggcgccggcatcgtcaagggcatcatgaaggacgcgtaccaggccaacggcggcggcgccaacatggtggcctccggcttctcccgcggcaccgcgctgggggcggagatcgtcggcaccttcgtgctcgtctacaccgtcttctccgccaccgaccccaagcgcagcgcccgcgactcgcacgtccccgtgctggcgccgctccccatcgggttcgcggtcttcatggtgcacctcgccaccatccccatcaccggcaccggcatcaaccccgccaggagcctcggcgccgccgtcatctacaacaagaaggccgcatgggacaaccactggatcttctgggtcggcccgttcgtgggagcgctggcggcggcggcgtaccaccagtacatcctccgggcggcggccatcaaggcgctcggctccttccggagcagccggagcaactgagccggccggccaataatttaatgcaacggtcacccaccgcgctagccagccacacaagctagcgtgtccatccggcctcgtcgttcagtgtctgtgcatgcatgtgagtgagaggaaggccagcatgcgtgattcgtggcgcgttttcacccttcaattattactccctgtcaccgttaatgttgtcgaattatattagttaccgttagtgttggtgttgatggatgatgaacctgtaatgtaaaaccgctgtgagtgacaactgctgcaatttggaacatggattaatttattgtgtgatgcatgcgtgtttgattgaaaaaaaaaaaa

SEQ ID NO: 32289 - DNA, 1329 bp, Triticum aestivum
  Clone ID: PAT_TA_32289
actccccaccacagagcttcagcgcactcgcaccttgggcaccaccacacacacacacaccctagcttgtcgatcggctgaggaggcgacgatggccaaggacatcgaggcggcgccacccggcggggggtacgcggccaaggactactccgacccaccgccggcgccgctcttcgacgccgaggagctgaccaagtggtccctgtaccgcgcggtcatcgccgagttcgtggccacgctgctcttcctctacatcaccgtggccaccgtcatcgggtacaagcaccaggcagaccccgccggccccaacgccgccgacgcggcctgcagcggcgtgggaatcctcggcatcgcctgggcgttcggcggcatgatcttcgtgctcgtctactgcaccgccggtgtgtccgggggacacatcaacccggcggtgaccttcgggctgttcctggcgcgcaaggtgtccctggtgcgcgcgctgctctacatcatcgcgcagtgcctgggcgccatctgcggcgtggggctcgtcaaggggttccagagcgccttctacgtgcgctacggcggcggcgccaacgagctcagctccggctactccacgggcaccggcctcgccgccgagatcatcggcaccttcgtgcttgtctacaccgtcttctccgccaccgaccccaagcgcagcgcccgtggactcccacgtcccagtgctggctcctctgccaatcggcttcgcggtgttcatggtgcacctggccactatcccgatcaccggcaccggcatcaacccggcaaggagcttgggagctgctgtgatctacaacaacgagaaggcctgggatgaccactgggattttctgggtggggccattcatcggcgccggcaatcgccgccttgtaccaccaagtacgtgctgagggccagcgccaccaagttcggctcgtccgcctccttccggcagccgctagatcggccggccgccgtctcggtgatggtcggaggcactgaactgtagatatatcaagaggacagagggcctccagtgtgtgctgctgttcgggtcctggattctgctggtctttgcacgcgtctctgttttccgcagctcgccgccgcgtttgctgcttgttttctctaccgatcgagtgtgtcttcgttagtgtttgcttccattccatgtactatctgtgaacgatgaggatgatgtactgtcatgtatgcatccaaggtaatttggggggaaatttgaaatgcaatgtgtacgtacgattcgggttaaaaaaaaaaaaaaaaaaaaaaaaaaaaaaaaacgcgagactagttctctc

SEQ ID NO: 32290 - DNA, 1642 bp, Triticum aestivum
  Clone ID: PAT_TA_32290
cgccggctcgcgcccgtccgtcaagaaacggacatttgacatactagatcaagccaagcttcccgtgacaccaccaaagggcatgacggtggagaagttcaaaaacatcatggctgtcgacaagaaggtcgcggccgcattgcccacgtccacccgctcatccgtcactccgctccgcgcctcccccgcgggggctcaccggagccgcgtcgtcgccagcaccgctcccgcgatgtacccgaccggggtgtccatggtctcgacggtggtccacgtcggcatcggcgaacggagctatacgatatccatccggagcggactcgtcgacatgcccgacctgcttcagaggtatatgatctggaagagagtattgggggtgaccaaaaggacctggacccaacgcgccggattagaaatccaatgggagctctcgtgccccactaattgtgagtcgtgttcgcccgttttgcctaacagaataccctccgcgccatatacgaaaacagatcgttgtcaagctggagctccagcatttctgtatactaagtaggctgtaacatccgttccgcgagggggcgggggcattggggacgtgtgcgggtttgctgctgctgctttcctccgttgcgcctattgctgacaaatacccgcctcccgggtggcccgggtggggtctcctggtgcggggctgcccggccttttccatcctctggggggcaacttaattggcgcagtcgaccagccgtccggcgtactcattgacacagagacattgaatacattgcctgacagagagctagcttcaggtgtcgctgaggtggtgaagtatgggctcataagagacgcacccttctttgagtggcaagagaagaatatggcagcaatattagcgagagaaccaagtgccctgacctacgctataaagagatcatgtgaaaacaaagctgaagttgttgctcaggatgagaaggaaagtggtcttcgagcaacactaaacctgggtcatacatttggtcatgctatagaaacagggcttggctatggagaatggctccatggggaagctgttgctgctggaacggttatggcagctgacatgtcttaccgcctgggctggatagacgagtccatcaagaaacggacatttgacatactagatcaagccaagcttcccgtgacaccaccaaagggcatgacggtggagaagttcaaaaacatcatggcggtcgacaagaaggtcgcggacggattgttgaggctcatccttctgaaaggacctctgggaggctgcgttttcaccggcgagtacgacaggaaagccctggacgaaaccctccgcgcgttctgcgacaactgatccttgtcaagctggagatccagcacttctgtatactagtaggctgtaatatcatatcacacagagagagtgagtgcgttgtgtgctacctttatttgttcatttcgttttggtgagaataatggaatgtcgtaaggggttggttccaggtcgtagtagcaattctttgtagggcatcatacctcagtaattgtgaattgtggtcagtcattttgaaaaacagaattcacacttcaaaaaaaaaaaacgaaaaaagaaaaagacgcaaaaaaaaaggaggaagag

SEQ ID NO: 32291 - DNA, 695 bp, Triticum aestivum
  Clone ID: PAT_TA_32291
tgaatctggattggaactctcggtctggactctgttgactgatcactcagactggatcgaaacctccaagtacaatgttgataaaatctgggcaaacgtcaactatcagtctactgttttgagacagcttattccgtctcttcctgtcctgagcatccatgaagacggggttgtctacttggtcgtgaatgatgaaagcatcgtggaccatcgactagatcataaaggccagtatttgcttcgtgttgacatgaagagtaacgagatccagatctctccacagcctacaaggcgtatttgttaccaactctttgccagcgagttcagtgcgtaccgacagcatttacaggattgaccgaagagagatagaagcaagagagttcggtgcgagtggaaagacgttgaagatttgagatgttggcaacataacatgtggaactggtacttaaagtccactggagacatttactgttgtcattatctgatgttagtagttataaactgaatggtgggtagtatgtgttttcactcatggctttatgtctactgagtggcttgttttggatttgtaactggtaatggcttgtttatttttgtgactgctgattctggctacatgcatcattgtgattttcctgcatgaatcctgcggttgctataagtcggtgattaaaagcaattttagatgtttggga

SEQ ID NO: 32292 - DNA, 420 bp, Triticum aestivum
  Clone ID: PAT_TA_32292
gggtcgaccgggaagttgtccctagtcccggctgaagaatgtatttagtcatttagtgtcgatgcaaggcagtaaccatttcttgtcttcatcctcgtattgtatagcatatagaggtacaagggagagagagagagagagagagagagagttacactgtaacaacatacatttgggatcctatctatcagggcgcgggcacgtagtcatactgcatggatagggacgtgcgtttagcatccaggagaagttgttttcagcataaaaatattcagtctaacaccgatgaccacgacaacaatgtccttctcttcttcccctacttctcttgggcgtcatcatcggcggctggcgagcacggctgagtgatatatggtcacgggctcacggcctagttgttgaacttgaggcatgggcggg

SEQ ID NO: 32293 - DNA, 1227 bp, Triticum aestivum
  Clone ID: PAT_TA_32293
caccaacccgcgaaccttctagaacacgccgtcggttgagcgagacgaaaccctaggcgagcgtcggagcttggaggggacggacgatgcgcgcccggtgaccctctcgggcggcggcggagggtttgcggggggatggcagtggcggctgaaggtgggagcgtggaggagggcgtgggggagagctcttctcctccgcgtgaggcgccgcccgcgcccgcagtgtcgggcgggagcggcggaagcgggggagccccccgcgacatctgcacccaggtgttcgagcggctcgtcgccgacggcaacgaggaggtggcaggccccgacttccgcgtccagctcgaggcccatttcgcgcggcttccattcagctatcaacttgatatcaatgtcgacaaatcagcagatgtcttggtccatcagaaggtcttggcggaagcaaaggatcctctgaggcgccctgctttccgtgtccgttttttgagggttgaagacatggattcagcatatggctctgatgcatctgatgaaggggctgatgatggtgatgatctctctgtaaggcaggacacaccgtacacacacattcatgagatagttttctccacaattgacaagccaaagctccttagtcagctgtctgccttgctatcagacattggactgaacatcagggaagcacatgttttctctacggtagatggctattctcttgatgtttttgttgttgatggttggcccattgaggacactgatggtttacataaggcgcttgaagcatctgttttaaggaatgagggttcatggtctggttcatctcactcctcagctgcggaaagaacactgccattccaggtaaaaggtggggaatgggaaattgacaagcggcttctgaagatgggagagatgattgcttctggttcttgtggagacttgttccatgggacttactttggcgaggatgttgctgttaaagttctaaaagccgagcatttgaataataatgtttggaacgagtttacacaagaagtatatattctaagggaagttcatcataccaatgttgtgcgattcattggtgcatgcacaaaaccaccaaaattttgcataattacagaatacatgtctggaggaagtctgtatgattatgtgcacaagcagcgtaatgtcgttgatctcccaactctgctgaagtttgcatgtgatatatgccgaaggatgtgttac

SEQ ID NO: 32294 - DNA, 910 bp, Triticum aestivum
  unsure (1)..(910): unsure at all n locations
  Clone ID: PAT_TA_32294
tcctgagaganaggtgctggtgaagagttgatggagattgccctctcccgatgagaggagcgttggtgatgatgatggtgatgatttccccctcccgaagggaagtatccccggcagaacagctctgccggagctctagattggttccgccaaggttccgcctcgtggcggcggagtctcgtcctgaaaagttccttcctatttttttctcatcgaaagacttcatataggagaagatggacgtccgagagccaccagggggcccacgaggtagggggcgcgccccccaccctcgtgagcagggtgtgggccctttggccttcatctttggcgaggatttttttatttattttcagatgttctgtaacaccccggatatgatttacccaatatgtaatccaactcttgccgtttccggtgttaagttattttattttctcaagttcgggtctttgccttcgtgtgttgttgtcgttgtcatgcatctcatatcatgtcatcatgtgcattgcatttgcatacgtgttcatctcatgcattcgagcattttccccgttgtccgttttgcattccggcgctccgttctcctccggtggtcatttctacctttctttcatgtgtgaggattaaacatttccggattggaccgagactttccaagcggccttggtttactaccggtagaccgcctgtcaagttccttaccatttggacttcgtttggtgctccaacggttaaccgagggaccgaaaaggcctcgtgtgtgttgcagcccaaaacccctccaagttggcccaaaacccaccaaaaccctctccatcatctagatcatttgatcacgatcgcgtggccgaaaaccgcgcctcatttggactctcctagctcctcctatgtagttnctagatcgcga

SEQ ID NO: 32295 - DNA, 737 bp, Triticum aestivum
  unsure (1)..(737): unsure at all n locations
  Clone ID: PAT_TA_32295
gaattcactagtgattagcgtggtcgcggccgaggtgcgacctagagagttggatctatccaacactaatcaatgagcatcatccaaaaagtcccttgtgtatgggttcaagaatagcaatagcagttgacatagctgctgctttggtttacctccataaccaatgcatgcctcctatggtccactgtgatctgaagcctagcaatgtccttctggatgatgtcatgggcgcatgtgttggtgacttcgggttggctaagttcctacatggttattattcttcttctggaattgatggttctacttctacaagcttagtggggccaagaggatcagttggatacattgcaccaagaatatggatatgggagtaaaatctcgacggagggtgatgtttacagctatggagtcatcatcttagagatgctcacagggaagccgtccaactgacgagatgttcaaagatggcctgagcctttacaaatttgtgggagattcatttccagaaaagattggggacattctaagatcctacgatcgttcccccccccggtgtgggagacgcgggaagtttggtaggccggcagttcctcccaccggcgggaactctgcgctgcgccgtcgggctcattgggcttggcctgtcgtgtgctgcggaggcacccaaagatcgcccagtaatccaagacgtttacagtgaagtcaccgcaattagagaagtattttctgcacttcnn

SEQ ID NO: 32296 - DNA, 564 bp, Triticum aestivum
  Clone ID: PAT_TA_32296
gcatggaccaccgctctagacgccatggtagccacaagaaggaatgttagcttcagttttagcgccgccgctgcaggtgcaaggcttgcccgcggggcatgccgatgctgcgactaacctgtcgcatccggcgaggcgaccatgcgggctgcgctgcggggcatcccgatgttgcggccaacccgtcgtatccggcgacggcgaccacgcgagttgcgatgcagcgggggcaaattgctgcatcctagtatggcagtgctggaaccggcgtccagttttgctacaaccggcaaagagaatactgcggccgtggcgtgctgcgtccggcagcaccagatgctgggaccggctatgaggaatgctacatccatggtttggagatgctggaaccgacgactcacggtgattcaatcagccgaccgacggcggaggcggcggtaattttgctggaaccatggttttttttgctggaactagccccttttttgctaccaccgtctggttgtttttactgtaaataatgcccagcttggagctacataaagaccaccgtccttttttgct

SEQ ID NO: 32297 - DNA, 524 bp, Triticum aestivum
  Clone ID: PAT_TA_32297
caccggatttgggaacagtttggttgagtgaaagttggctgcacgtaaactattgtgatcaagttggaaaaaaatgtttccattcttaactgcttctgttggagactggggtcagtagtcactgaaatttgcacacgcatggaggaatgaatgatgattctcaagtaacgaagttgtagccttcacgacaagataaatggatgattttgcagctcaagtgttgctacatgttacagataactatggcattccattttaatgaatctgcatattgctgttgagcaccggaagcgagggagggcatggctgcactggaggttgtcccaaggcgagggcagggcagagacatgcaacaatgagggttgcaaccgtaatcaatatctcaacatcgaatcatttcctatagccttccagcaagttcattcttattttctgattgggtcatgttaggccagcaaagtaaacctagaaaaactgattaggcaatgatgtttttgtttaattttagtgtttggttttgtttc

SEQ ID NO: 32298 - DNA, 539 bp, Triticum aestivum
  Clone ID: PAT_TA_32298
cgcatgaggagtattagccacgggggagggaggagactgacatgaggaaaacatattctggatcgatttggttctcatggtttggtactaatttctcaaaaaaaatcatgcttttgcagcaccgtcctgttgagccatgagatctaaaccaaggaatccagataacatcgactatgtttatagatcactacatgttccgttggaacattgtgaggtcctttttccagtttgctactaaattctcaaaaaagaaacgttcttatgcatcaccatcatgtggaaccacgatacctgaaccaatgaactcagtgaacatatattatatttattatggatcattacatgttctgctggaacaaggtcagtttggagtagtctattttggctacttgaaagatggaaccccagttgcagtcaaaacacgcttagaatcatcatctcatggggttaatgagttcttggcagaggctctacatctaataagagttcatcacaggaacttggtcaatctggttagccactacaaggatggacaccac

SEQ ID NO: 32299 - DNA, 846 bp, Triticum aestivum
  Clone ID: PAT_TA_32299
gctcgtggctcccctcgccgcctccgccgcctccccgtctcgcgagctgcccgcggcccagccgcacctccccgtgtcgcgagaacccctcgtcccatcctctcctcaccctgcctcgcctcccctctccccctccaactccgccgcggcgcccgcaaccctcgtcccatccgctcctccctccgccctcccgccgaggccgtccccccccgccacgtcggggagccgcccgcgccacgccctccaccccgtctgggacgcctgcctcgaccgcgccatccgccgcctcgcccactcctgtctcgcagccgccctcggggggacccatcctcctcggtagcccaataacccgctgggcatcagttgcccttggcagctggtgtggggataggggctgcgttcactgaatgctcatacatattcaatggttctcctccaaagtggtcggccaaagcttcgactgttcctgctcattctgaaggaggagacaattaaaacactgtcgggcgggatgagtagcccaatcttggcggagttttggagtgtttgttgattgaacctagctgttccgtgtctgatgatatcgccacttgtcatagtatgtcctgaaagttagcatgtgcccctctcgtgaattttcttcacacattacgcggaaaccattcctgactgcggtctgatgatgacccaatggctgcgtaagctcggtccggtccgtcctgaggttttatgtctggcaataaatttttggtcatgtgaacttgctgtgtaatgctctggcgctttactatatgctatacttgtgatcttgttggttagatggaaatgattggtaaaaaaaaaaaa

SEQ ID NO: 32300 - DNA, 689 bp, Triticum aestivum
  Clone ID: PAT_TA_32300
cggacgcgtgggcggacacacggccggggaggccatggatcaggaactccaagaagccgacgtcctctggccacagaacaactccgaccaccgccgcgacggcggccacgacgacagcgtcatcaacgtcgacggagacatggcaaagctatcctcgccggagctgtctgccccggtcctcgtgcctcaccggaagcggcggtcacgctcctggaccacgtcggacgggagcggcagcggcaacgacgactgcagcgatggcgacgttcgatgcaccaacgacgcaaagaggaacgtgccgccgcacgtcctggctgagcgacgccggaggctcgccggaaggtcgacggcggcctactccatgtgcagcgggaaagggaggacgctcaaagggcgggacctccgcaacatcaggaacctcgtcctcaggatgaccggattcatcgagaaatgagatgggttcaacaccgtggatgtggacatattgcttcattgcttgggaacgtccatggacgtgtgtgaaagtttgtggcaacctaattagagttttcagtgagcgcagagaggtgaagaaagacaagagatgtagtaataactctctgtttaattaattaaatttgtttgtttaatcgaatttagcatgtgtggtatgcgagcagcttgctcaagaataaatgtacattcataag

SEQ ID NO: 32301 - DNA, 669 bp, Triticum aestivum
  Clone ID: PAT_TA_32301
cggacgcgtgggcggacacacggccggggaggccatggatcatcaggagctccaagaagccgacgtcctctggccacaacacaactccgaccaccgccgtgacggcgccgacggcgacgacggcagcaacgtcgacggagacatggcaaagctatcctcgccggagctgtctgccccggtcctcgtgcctcgccggaagcggcggtctcgctcctggtcgacgtccgacgggagcggcagcggcaacgacgactgcagcgacggcgatgtccgatgcaccgacgacgcaaagaggaacgtgccgccgcacgtcctggctgaacggcggcggaggctcgccggaaggtcgacggcggcctactccatgtgcaccggcaaagggaggacgctcaaagggcgggaccttcgcaacatcaggaacctcgtcctcaggatgaccggattcatcgagaaatgaaatggactcaacaccgtgggatgtggatacattgcttcgtcgtccatggacgtgtgtgaaagtttgtggcaacctaattaaagttttcagtgagcgcagaggtgaagaaagataagagatgtagtaataactctctgtttaattaattaaatttgtctgtttattaattaaatttgtgtgtataaaaaaaaaagcttgctcaagaataaatg

SEQ ID NO: 32302 - DNA, 1194 bp, Triticum aestivum
  Clone ID: PAT_TA_32302
aaccaagcgaacctgcagttgcagccgagcaatcacagcagcgtcgtcgaccaccatcgagccgtactccatggctgccgtgaccaccgcctccctctgccccggcctcggcaagccccgccaaggccacgcgaagccgccgagaacgacggtctgccattgcctccctgctcggagggcggaggagggggtgaatcggcgggacgccctgctcggcgtcctcctctccgccaccgccgcgttgtcggcgccgctgctcgtccccgccgaggccttcgccgagaccgccgaggcgcaggaggggttcaccgcgtacgaggacgaggccaacaagttcaccctcgtgattccacaaggctggcaggtcggtgcaggtgaacgcagcggcttcaagaacgtgacggcgttcttccccgagcaaaaccccaactccagcgtcagcgtcgtgatcaccgggatcgggccggacttcaccagcctcaagtccttcggtagcgtcgacgagttcgccgagaacttggtgaccggcctggacaggagctggcagaggccggcggggctcgccgcgaagctcatcgactccaaggcatcaaacggcctgtactacatcgagtacacgctgcagaaccccggcgagaagcgccgccacatcgtctccgccatcgggatggcattcaacggctggtacaatcggctgtacacggtgacagggcagtacatcgacgacgacgaggagtcagccatatacaagcctgagatagagaagtctgtcaagtcgttcaagttcacatgaaatgcctccaaaaaggaagttcaggtgagaacaagtatagagtgacagagaagagagagtatacaaagctagtagctcctgatgttaagttcaattagtgagtatgtatatgtttgtcgaatttaccggaaagaaaagatgaacaccagatgttcgaagacttcgatggcgtagcttggctgagaacagcattggcagcatgagtgtgagatagagcatgagagtgtcgttggttctaagaaaattgctagaactcggttataaggaaactaaaattgctctgatgtaaacttcctagcacctatttttgggcccacatgtcagattttttttttcatccgatagctgaattcaaagcccgccgctattttccatagcccactatttaaaacattgctcat

SEQ ID NO: 32303 - DNA, 971 bp, Triticum aestivum
  Clone ID: PAT_TA_32303
gtcgacagtaacgacccatccaccggaaggcgtcgatcggctgcgcgacagactcgtcccatggcgacccgggctctgcactcgccgaggctcaccagcccgccgctcacgggccggcatgcggcggcgaggtgcaagtgctccgccgcgccgctcttcgcgaagcgactaccgctcgtcgtcgccttccctcgctccgttgcctcctgctgcgccgtgcaggagtcatcccccggcaccaccgccgccgccgcaaccactgttagcgagacgaaggatgcagacggtgacaagaaggaagccgccgccgcggaggcgaagccggcagccaagccagcagcggccaagccgaagaaggccccgccgaagccactgccggagatgatggaggaagagatcatccctcctctgaagaccgcgctggaggccgaggaggacgtgtcccaagtcgtgctgacgttccagaacaacacgttggaaggctccttcgtgaaggaagacataccctactacttctgggccttcttcccacagggagacctctcaggacccaagggctttgcgatgacgtcctactccatggaggtgagcaccatcgagccgttcctgatcgacgagaagaggatcactccgcagtacgtggtgttctgggtgtacaagaggctggccggccagggggtcctccctgtctggagggcagaggacctgagtcctgctcctgcagagtagtaagtagtagtaacccatgcaagatacacaacatacagggtgatcatacgggcacaagttactctgtgtataagatgtccatgtctaattgtgaattgagtaaagatgctgcaaaaggttcatctgatcttttttctacaaaaaaaaaaaaaaaaaaaaaaaaaaaaaaaaaaaaaaaaaaaggcaatgcaatgcaatgctggtttacttgcaaaaaaaaaaaaaaaaaaaaaaaaaaaaaa

SEQ ID NO: 32304 - DNA, 653 bp, Triticum aestivum
  unsure (1)..(653): unsure at all n locations
  Clone ID: PAT_TA_32304
gtcaggtcagcctccctctccggatcccccacctgctccgccgccggccaacgcatcgctccccttggcagccaggatgacagaagcaccatttctgccacgtgagaggctcttcaagctgcaacatcatttccagaacatgaccaagcacacctacctgaaagggcgctacgatgtgatcacctccgttgccatccctcttgcacttgctgcctccagcatgttcatgattgggcgtggagtttacaacatgtctcatggaattgggaaaaaggagtgatctaccacgggttaactagtttttctacttggcatggaagtaccatccagactatgaagtcttctttgcttgctaaataatactgtcaaagaacaagtcgactacatttttgcatcatatttctgtttgtatttgtggatatgaaatgccatcaacttgaagatcagcattgttacacgtttgggataattacccatccttccgtctgtgtgtcccttcctataagaactggccggtccaaacaaacacgtttagtccccggcaggtcacctgggtcccgcggaccctagagaaacccttccaacnggtanacaaagccccgttnctcaanttgcaccgatgcaanggacccgtcggataccgnggntggtan

SEQ ID NO: 32305 - DNA, 628 bp, Triticum aestivum
  Clone ID: PAT_TA_32305
gcgaatagttccttgcctataaaacaaagatattgagaatagccaacagagaagctggacacgatcacacgaggatggagcgttcttcttccttgctcgcccgcagcagcgtcgccctcctgctgctgctggctctcctactctgttccttggcgtgctcggcagcggtccaagtttctctggacggaaaccgcgaggggcaacgacctccggcgccctgggcatcaggcgcgaggtcgaagtactgcccaggctgcagcgacgacggcgtccctccgccgccaccgccgccgcctgcaactacgtcggcacttgcgcctcaccgcaagaccctgggggttgctgcgaggatcccttccacgagaaccacctatactagatgatatatattgttttgttgatgatgatcagacggttaagagtcaaagcagagaaatctgagctaagcctttacgacccagacatgttgcatgttcgctctccaaattaattctaagcggaagttctaccatgaccgacacccatcttgtggtactagagcaactccgagtcatcgtattggctcgatggtcattataatcattaatatgacggttttgagcaaaaataacgctttaagagagtcgcc

SEQ ID NO: 32306 - DNA, 515 bp, Triticum aestivum
  Clone ID: PAT_TA_32306
tccgcggcagatgagatgcacgagttggagaggaagctttgtctcgttgggctatgctgcatccagatgaagtctcacgatcggccgacgatgagcgaggccatacagacgctcgaaggtggcgttgaaggcctgcatgtgccttccaggccattcttctgtgacgatgagcacgcccctgtagctgctggttctcaccacgtcttctctgagctgactgctctgtcggaggatgatgagtttgatgatgcttctacgcaagacaacagcgctggtcttagaaatgcagagtagtcagtagagtgggttcacggttcagtgagatttactggtttttactcttttgtagcagtgccgtgctacggtgtgtactatgattgaaatcttgctgctgtacgtggatgcgcctgacaaatatatgtcagataatctggaattttggtgaccacctgatggtcgcggattaggaagaaatgtactcaattgttattaaaaaatggaaacaatgttggaga

SEQ ID NO: 32307 - DNA, 1334 bp, Triticum aestivum
  Clone ID: PAT_TA_32307
gtcgcgcgccgcttgtggcgcttcaagagaggctgaagaactggcaaatacagcagagcaagaacggactcaacatatgggtggaataaacttggaagatcgtttatctgatgatgacgtcgtgggtgctgctgctgcagcggggaggcggcgagtaggtgctgcggggaggggtgcaacaactatgcaaaccagcagatgaagagagctccgatgaggagaccgatgatgttgaagaagagccattagttagacgtcgttctaggcgcatccctgctggagacacagagtcaacggaacctgttctcccaggtgatagtcctccctcaagttcgcagcctcaaaaccatgatcgccagtataacagaactgatttcccatcagagtggggtggcattccttcggacggaacatgatgaagctgttatgcttgaggctgcaatgtttggtggaattcctgaagccccaacatatccattatctcatgcgagctcgagtcattatccccaagtagtgcactctccaccaccaagaattgactgaacaacggttattacgagagcagcaggatgatgagtaccttgcatcgctccaagctgatcatcaagaagaggtgaagactctacaagaagctgagctcagactgctggaagaaactgctgcaagagaagctgctcttgaagaaacaaaggcaagaggaggaggaacagcgtaaaatgcaacttgagaaagaagagcttgtgtcctatcgtgccgccaaagaagcatcagcttgccattggaagccaccttcagacaagggtgatgttatatcaagtgtgcttccctggccgtacgcgagaggggcgtcgcgttttaaaatctgataaattcaagtccctttttgatttcttagactttggcaggacttgcaagccagaaacctacagactggtaaggacataccccaggcgtgcttttaccactgctgacggcgaccaatcgtttactgatctcgggttaacaagcaagcaggaagccttatttatagagcagattactgattaggggaaaaagattgagcctcacctagggataccaccatctgagactgagttggggttttacatgtctatacttgcatatggcttttactagggaatctaaaattggtctgtgtagaagacttccaactgtgttcttttgtgatgtggaacggttctcatcactttagtcttatgtagggggtataaaacagtgatccgcaacggatccagtatatttggttatgaatgcgcgcgcgcgcagcgtcattcacttgttcgtttcagagagagaaagattcctggtttcat

SEQ ID NO: 32308 - DNA, 850 bp, Triticum aestivum
  unsure (1)..(850): unsure at all n locations
  Clone ID: PAT_TA_32308
cccagcgtcagttcagttcgacaacagtctgaaacagcatcacgactttcttagactggaccatgtcgaggggtatcatgaactctccgctgctactagacttcttctccacgtccgtgggcatttgggatgctgactttttatgtcaaggtcgatgatgatgtgcatgtgaacttaggaatgcttgccactacccttgcgaggcataaagcgaaaccaagaacttatattggctgcatgaagtcaggcccagttctggctgacaagaatctgaagtaccatgaacctgaggcctggaaatttggggaggatggaaacaagtattttcgccatgctactggacagatatatgccatctcaaaagatcttgcgacctatatctcaataaatcaacctatcttacacaagtatgcgaacgaagatgtatcacttgggtcatggtttattgggttagaggttaatcatattgatgaaaggaacatgtgctgtggaactccaccagattgtgagtggaaagggcaagctggcaatatctgtgtggcatcctttgattggagctgcagtggcatatgcaagtccgtcgagaggctcaaggatgtacctccgccgcgcccccgcggcgattctctgtttggagtgatctaatctagctaatactctcctggcgtaaatatgtacattcagtaaacctgacatcgtgcctcagtgntacaactgaaatgactgaaatnacaacagtcccagatgnctanattctggagtcggctgagcacanatgtatgtaatgaactgtcatcgcnagagatccagtaatggaattcttgtgcacacgggactcatangtanaaaa

SEQ ID NO: 32309 - DNA, 677 bp, Triticum aestivum
  unsure (1)..(677): unsure at all n locations
  Clone ID: PAT_TA_32309
cggccgctcgggccggccgggccgggatatcctacccattcccttcatcttcatagcagcaaagcctcttttcctcatcctcccctactgttcttgatcgcttcaggaagacacaccagtaatcccatcatgagctaccagcagcagggcgccagcgccacggcctaccctccgccgggccagcagcagcagcaggcctacgtagcgccgccgccggccggctacccgcagcgggaccagcagtatcctgacgccggcggcgccgacaccaccacgagccgcggcggccatgggcaccaccacggcggcggcttctggagaggctgctgcgcggcgctgtgctgctgctgcctcctcgacgcctgcttctgatcaagccaattttatccgccgcgctcagttacgatacgtggtctgacgagtgctcctgctgttcatcacggttcatgtggagtccggacgtcatgtactagttgtttgttttcctttttcgcttggttggttacacttttgtgagtaatactatttgttggttgcgcagcaccatttctgtgtagtgtatcatggtgatgttgctcgatctcttgtacattgattatgtctatatataaacatggttcgtagtagtaaaaaaannaaaaaannnnaaagaanaaaaaaaaaaaaaaaggccccta

SEQ ID NO: 32310 - DNA, 677 bp, Triticum aestivum
  Clone ID: PAT_TA_32310
gccggccggccgggggcggaaactacccactcccttcatctcctttgcagcaaagcctctttaactcgtcctcctctactgttctcgatcgcttcaggaagacacaccagtaatcccatcatgagctaccagcagggctacccgcagcagggcgccagcgccacggcctaccctcagcagcagcaggcctacgtagcgccgccgccggccggctacccgcagcgggaccagcagtatcctgacgccggcgccgccgacaccaccacgagccgcggcggacacggacaccaccacggcggcggcttctggagaggctgctgcgccgcgctgtgctgctgctgcctcctcgacgcctgcttctgatcaagtcgattttatccgccgtgctcagttacgacacgtggtctgacgagtgctgctgctgttcatcacggttgatgtggagtccggacgtcatgtacagtagttgtttgttttcctttttcgcttggttggttacacgtttgtgagtagtactatttgttggttgcgcagcaccatttctgtgtagtactccatatcatggtgatgttgctcgatctcttgtacattgattatgtctatatataaacatggttcgtagtaaaaaaaaaaaaaaaaaaggcccctaaaaaaaaaaaaaagtcgacgcggcgcga

SEQ ID NO: 32311 - DNA, 2093 bp, Triticum aestivum
  Clone ID: PAT_TA_32311
ccgcccgcgcgggggagtcctagtcccttccacttgatgtcccatgacgcttttgtgttcctaccgggttgcgggatcccctgtctgcggctccgcggaccgcggtcttctccccgtgccggtcactgtctgcccacccacatattgccgcggtccctgcccgctcttcgcttgtggcaccttctgcccctggccgtctgtgttggcgctctccgcctgctaatcgcccgggaggtgcagccggggacctcgcgccgccccgggccctgggccggggagatttggaagatcactgtcatgattcaagtatgacatgttgtttaacaaataacaggagggcaataaatgatttttccactgctccggcaggaaaacagaagataattgtatatccagactctcaaaagaaaatgtgcgatggtggcaatgttgtcgaacccatttttgatgtaaatacgatgccagttacttgctctatctcatcaatccacaaacaagataatcagaacagagccatcaaccttaacaatgcagagagcctgatggatgtagatcatgcaaataatattgaactgaactcagatacagtggatcttgtttcacatgcatcacgtagtgcacaaaaaagaaatgtggatatggcaaactggactgacggagccaatggatcagtagacaagaaaattaaattggataatgtatcgtccactgtggagtctagtttaagtgggaaggtcagagatggaaggttatcatccaaggtacaccctctagcagctttacctgttcatgattgcactgacaataagaccatggcaggaatctcgaagagtaatggaaagtgcacatttccactagatctaaacgtggtggatgatgcagatatagacatggtggatgatgcagcgactggaaatagcataaccggtctgtctgaagatttacctgaacagaacacacaagatcttaagccagcaccgggggacaacatatcttctagaaagcccatggttgaagaaaagttgaataaaggagatacacagcctactgatatgtcaggcgcgctctccctctccctcgcatttccagcatcaaaggatcaataggctggtaaaatgcaaccggaatcgcaaagaagcctgagatgagcagtaggaataaaccgtcttcgattatccagtgatgatggctccttgcgtttgcattcctgatgtcttgcgtgatgcatctttgtagcatcaacccactgcacaaggagtctgccaaagagtccaccaaaaactcatctggtcgatgagcaaacagaaagcatctttacaactgcataatgacgacttttcatgctcctggcgccacccccatcctaagtaatgaactcaccacggactactactcccgctcctccctagctgttgtacttcttttttataacgaaggctcgagacagagcccggctttgaattagcaaagccatcaaccagccaggaaattacaactaaagagcagaaaataaaactggggataccaggtacagatacaagcacagaggtgggcagctgaggaatcaagtgttgtactaaatcagtgacacttaatatggaacggagggagtagcatgtatatactcgatggacctgaacttcacaagctccagaaccaggtaacccagtcacacatacggtcgatgaatacacagatcactctagtggtaccttctggccttagatggctgtgaaggtgctgtcttccttgaaaatcccacagaagatgcagccagggaccttgggcgacgctggatccatggccggggctacgcgccgtgtccggaacgcctggccgcctcgctcggtgccatcgttgcgcctgcgctgcgccccgacggacccaacgctgcgggagtgccgtagctccctgaactctggttcccccgaggtccactggctatgctcatccgacatgagcctctcgccccagaccatgcctgatgatcctgacctcctgaatgtccgtgaagacctctgcagcccagccatggatgtaatattccctgcccttcccccgggcttgtatctaggtgggttttatggatgtgc

SEQ ID NO: 32312 - DNA, 492 bp, Triticum aestivum
  unsure (1)..(492): unsure at all n locations
  Clone ID: PAT_TA_32312
gaactagtctcgagtttttttttttttttttttttttttgacgaattgtcctagggaatcatactccctgtggttcctcaatatattgttttaaagaagtaattttttttgaccactaattcatgtatactggttctactaattcgtgcaagcatgaatagctagatgtntgantaatacanattcgttgcaccggtgggatggtggtgccnacggacatgancagcttgctcaatcacgcgttcaagtccgagatcttgaangagtcggcgacgactttgagcttgttgcncancctgntccaccgccgctcgttanccgtcacnatcagcgtgtagtaccccccgttcccganggcgaccgtcgcaaacgccgncacgccnttgcccggcgcctccanatngtanccaaattcaagttagttcctgccatccatcgtaggctcntgaattcatanatcgtgggaatcnggttcngggcaantaactcggt

SEQ ID NO: 32313 - DNA, 573 bp, Triticum aestivum
  Clone ID: PAT_TA_32313
ttttttttttttttttttttttttttttaaatttaaatggaggaaaacatattatatattgaatcatcttagccaaatcatcttttaaatagacaactaatatttatagataactaaaggaccacatgcattgtcttgggattccaactatctttccatcacaaaagtatggccttcatgcaccaccaggtttggaccgggactcgtcaggtttgggttgggactgttgggttgcttgagcccttaagagaagaccaattaggttatatgtctcctttcgcttcttcttgatgctccctgtgcatttcttcaaattctctatcttgtgcttcaagtcttgcacctaactcctcttgatgcctctctatgattttgttccactatctcttctacaacacggatctgtgctgatgaagtagagctcccagacctccagtatcttgatgcataccccatgctggaaaggaaggtgcttgatccaattctcgtgagtactattaggtggcttgttggataacacttcctcagcagtataaccattgaagtaatccttctttagttgcagcattattg

SEQ ID NO: 32314 - DNA, 728 bp, Triticum aestivum
  unsure (1)..(728): unsure at all n locations
  Clone ID: PAT_TA_32314
gcaaatggggtatatgcacaattctacttgcagttactcgacttttacacacaccgtcgtaggttgtgggaatagccaggggccactgtctattgtacacttgttttacatctggaatttgtatcctatgggtgatttacagatcggcatcagccaattttacaacatgatttacagatactgctaacacgtcgaatccagggcgggagagcaaatgctatgcagctctcctcaaataattagactatacatggagggttaactaacgcttcataaaaccacacattcgatgtgtaacgaccgtgttctcttctcactcctggttggacgctgcctctggaagtttgaatgtaggaggcctgtctgcacctttcctcgagtattctcgccacctccttgccgccgcagccgctcgcttcactctctcctttgtgtcctcttcgttcttttggtatcttgttggtgacccccatatatcactccatgaactgcccttgttagcatcatcttggctcatccgcatcctcaccttattcaagacttgtgcttgtcttttctcccagcgcgtacttgccatccggaacacatcaaatgaactccccatcccagaaagcatcaatgcaacattcactctctcgactctgcgcatttcatcctcgaggagtgtaacttgtgctgctgaagtccagtggatgcagtcaaccggacaactgtcaatggcttcttna

SEQ ID NO: 32315 - DNA, 699 bp, Triticum aestivum
  Clone ID: PAT_TA_32315
agatcacgcgaacggcaacggcacgctgctggatgtcccaacgggtcccatgattgtccaggtcgcataagtactggtaagcttgcattatcttgtcccagctaacccgaagactcttcatttaagaagggcgagatatctttgattattttgaccaagatgattttgtaacagctggtgtgatttagttaggtgtcgtgtctgattcagagattgattgctcatgtgtggagataaatcttaatacgttaagactacactatgttgtctaggatagcattttgtcagccacgagggttgcaccaatcaattaatcatttcagctttgttttcatccaattgttctccagggctgcctcagcaaactggcatgcgtgcaagacagcgaacgaggtgttagcctgaagccaccaaattctgtctatcatatcggggcataactgtgccaaggaagattcaggaagagaattccccgtgtcaagagtcccatccaaaaggaatcgcttgattagttgttgccagaaaagcatgcaattgtaccagatattttctttattttctcgaatcgtacgtagtgctagctatttttattgcttcttgtatattgtctaggttgttcgtcgtgcaataagcctagctcatatgcgtctagccatatgtatacatcggcatcagtgggttgttacagttacgcagatc

SEQ ID NO: 32316 - DNA, 1235 bp, Triticum aestivum
  Clone ID: PAT_TA_32316
gctggagctctctagggcctgcagtttcatcatgctcctcgcctacgtcgcctacctcttcttccagctcaagacgcatcgccaggctcttcgagccgcaggagatcgagggcggagacgaggaggaggaggaggcggtcctcggcttcgggagcgcgctcttctggctcatcctcatgaccatcatcatcgccgtgctctccgagtacgttgtcggcaccatcgagccgacctcgcagtcgtggggtctctcggtgagcttcatcagcatcatcctgctccccatcgttggtaacgcggcggagcacgccggagccgtgatcttcgccctgaagaacaagctggacatcaccctcggtgtcgccttggggtcggctacccagatctccatgttcgtggtgccattgagtgtccttgtcgcttggatcatggggattcagatggatctcgacttcaagctgctagagactggctctctcttcatctcggtgctagtgacggccttcaccctccaggatggaacgtcacattacctcaagggagtcctcctcctcctatgctacattgttatcggcgcctgcttctttgtcacgagacaaccagcacctcacgcgaacaacaacggcacgctgctggatgtcccaacgggtcccatgattgtccaggtcgcataagtactgattgattaagagggctgcctcgggaaactgacatgcgtgcaagacagcgaccgaagtgtttgagcctgaagccaccaaattctgtctatcatatctgggcataactgtgccaaggaagattcatgaggagaattccctgtgtcagagtcgccatccaaaaggaatcggttgattagttgttgccagaaaaagcatgcaactgtaccagatattttctttattttcttgaattgtacgtagcgctagctatttttattgcttcttgtatattgtctaggctgttcgccgtgcaataagcctagctcatatgcgtctagccaaatgtatacatcggcatcagtgggttgttacagttatgcggatcagtacgatatatgtaatgatgcagatgttgtttccccccccgggtgatccatgtgttattagacccgacttaaaacctgttcatcagcgtgtccctccaaatatctcatgtggccttctgtatgcatgtccgtggagcaatgaagttgtcagggcaacgcggaccctttaatctccacaaacaacacccac

SEQ ID NO: 32317 - DNA, 2092 bp, Triticum aestivum
  Clone ID: PAT_TA_32317
gctcgcggcagcgtcggcgctcggcgcggcgccgcactccccccgcaggtagtgcccgtgtccccacccttcgctccctcccgcccatggatggcctccccccccgctcggccgtccgcccacgctacagcacgaggttcgtaagcgcgccgaataggctcgtcgtggcgccgcactagcagcacaggtagagtcagagtccagatcgatcgatctaacctggccatggatagccagtccgcggtgacgatggaggccggcgcgcccacgaggaaggagtctgggcggcttccctcgcggcacggcggccacgcgcacggccacagcggcctcgcccggacggcgcacggcatgtcctcctcgtcgctgcggaagaagtcggacgccacgctggtgcgcaaggtccccgtggcctcgctgcgccccgtgctcgccaacctccaggaggtcctcctcggcaccaagctcgccgtcctcttcatcgcggtgccgctcgccgtcgccgcgcagtgcttccgcttcggccaggtatgggtgttcgcgcttagtctaatcggcctcattcctctggctgagcgagtcagcttcctgacagagcagattgcgctctacactggccccactattggcgggctcctgaacgcgacgtgcggcaacgcaacggagctcatcatcgccgtgttcgcgctggtgcaagggaagatcgaggtggtgaaatgctcgctgctcggctccgtgctctccaacctgcttctcgtccttggcacctcgctcttctgtggcggcatcaagaacctcggggccgaccagccctacgaccggaaacaagcggacgtgagcactgggtctgctcaccctgggcgtgctgtgccagtctctgccgctgctgctgcgttacgccgtcagctccggggagcatgctgtcgccactgacaccacggtgctggagctctcaagggcctgcagtttcatcatgctcctcgcctacgtcgcctacctcttcttccagctcaagacgcatcgccagctcttcgagccgcaggagattgagggcggcgatgatgatgaggaagaggcggtcctcggctttgggagcgcgctcttctggctcatcctcatgaccatcataatcgccgtgctctccgagtacgttgtcggcaccatcgagccgacctcgtcagtcggtggggtctctcggtgagcttcatcagcatcattgatgtcctgctcgctatcattggtaacgcggcggatcacgacttcaagctgctagagcctggatcttcgccctgctagtcatcacctgtgttgcctcctggggtcaaggctacccagatctccatgttccgtggtgccattgagtgtccttgtcgcttggatcatggggattcagatggatctcgacttcaagctgctagagactggctctctcttcatctcggtgctagtgacggccttcaccctccaggatggaacgtcacattacctcaagggagtcctcctcctcctatgctacattgttatcggcgcctgcttctttgtcacgagacaaccagcacctcacgcgaacaacaacggcacgctgctggatgtcccaacgggtcccatgattgtccaggtcgcataagtactgattgattaagagggctgcctcggcaaactggcatgcgtgcaagacagcgaacgaagtgtttgagcctgaagccaccaaattctgtctatcatatctgggcataactgtgccaaggaagattcaggaagagaattccccgtgtcagagtccccatccaaaaggaatcggttgattagttgttgccagaaaagcatgcaattgtaccagatattttctttattttctcgaatcgtacgtactgctagctatttttattgcttcttgtatattgtctaggctgttcgccgtgcaataagcctagctcatatgcgtctagccatatgtatacatcggcaacagtgggttgttacagttatgcggatcagtacgatatatgtaatgatgcagatgttgttttctgtgggggtgatccatgtgttattagacccgaaaaactcgagactagctcgtgccgaattc

SEQ ID NO: 32318 - DNA, 1056 bp, Triticum aestivum
  Clone ID: PAT_TA_32318
cccacgcttccggctttgcgaatctgtctgcgagttgcgtggggctagcgttggtggatccatgtggccggagagcccgcctctccgggacgccggcgctgccgtgctcaccggatgcgtcgccatggcggtgctccgcttctgggaggaggtcggcaaccgcgccctcttggaccaaaaactctgcaggaagctggtgcacatcagtgttgggctggtatatttcctgatgtggcctttgttcagtgcagatgatgtctatgctccatttcttgcttcaattgtcattgcgctcaatatcataaaggtaatcttgattggatctggtgtagttaaagatgacggcgtggttaactcgatgacaagaaatggagactacagagagcttctcaaaggcccactctattacgcgtgtactataaccctcactaccgtaatcttttggaggacgtctcccatttcgattgctgtgatttgcaacttgtgcgcgggggacggtgtggctgacatagccgggaggcggttcgggcatgtgaagctccctcacaaccccgacaaatcctatgccggaagcatcgcaatgttcttcgccggcttcgtcgcatcgatccttttcatgtgctacttccaccttttcggattcgtggagcagagctggaccatggtcgctgcctttggcgtcacgtcgcttgcagcggcgattgtcgagtcactcccggtcagcacgctcttggacgataacctgacgactccaatcgcgtcggcgctcgtcggcagcctggttttctactatgttggtggtggtggcggtgccggaagcggcgacgggaccagcatctcggcgactgctgcgatggtctttgcaggcagtagctattacagtgagggctaaggagaagttgcagtgaattggaaggctttggtggtgtgatgatactgcaatgagttgcagtagttgagatggtttttgcaggctgttactgggtgttggttaatccggtctgtgtctctgttaaatttggtttgacagtgtcattgtgtgagcagcattgttcg

SEQ ID NO: 32319 - DNA, 771 bp, Triticum aestivum
  Clone ID: PAT_TA_32319
cccccccccccccgccgtcgcccccgcggccacctgccccatggcctcgtgagccgccgcggggcttccccgcccgccgtgcgcggcgccaaatgatcgaagttcagctcatgtgtgatccccacctgaccatggtcaggtcaggttatagagctttattgtttgctggacattgtagtgtgaaccgcgtagtgtgaatgtgtcttgtgtgacatgtcaaagctgaagcggaggtgtcaactcagtgtcgtagaggaccacccggtattcagatactgttcttcacattctgttcgtactgtggttctggcaaggctccagcagaatttgcaaatatttataaagaggatggacttgttggtggacatgtaataatgcttggcggagaccctgcaagccgttctgctgccctggaagcactacatgcatatcctggtggtttgcaagttggaggtggaataaatttggagaatgcaatgtcataccttaatgaaggagcaagtcacgtgattgtaacttcttatgtgtttagtgatggcaaaatgaacattgaaaggctgacgcaacttgtcgagcttgttgggaaagaaaggcttattttggacctgagttgtcgaaaaaaggatggcagatatgccattgtgactgacagatggcagaagttcaatgatgtctttgtggatgggccaacattaaaacgtcttgctgcatatgcagatgagtttttggtcatggagttgatgtggagggcaaaaggttaggaattgatga

SEQ ID NO: 32320 - DNA, 755 bp, Triticum aestivum
  Clone ID: PAT_TA_32320
atcccactgcataaatagtaagcttcaaaatgcagtcatttccctgttggccactgttatcttactgacagctctttctgtcttctatttttcttaccaaaatctttctggttatgatggcagatatgccattgtgactgacagatggcagaagttcagtgatgtctttgtggatgggccaacattagaacgtcttgctgcatatgcagatgagtttttggttcatggggttgatgtggagggcaaaaggttaggaattgatgaggaactcgtggagctactgggaagtcattcacctatcccgacaacatacgccgggggcgtgtcaacgatggacgacctggagaggatcaagaaagcaggcaagagccgagtcgatgtcactgtcgggagcgccctagacatattcgggggagatttgccgtacgacactgttgtccattggcacaaggagcaaaacctggttagccaacggtgaagaaatcagatgatccttttatccaatacggtcaaattatcgggcttcattgctggacaccacctcgctgacagtctgtgtcttgtgttttttcgtttgctggacattgggtggcgaccacggtgtgtgtccggaccaccaggtattaacagactctgctttacattctgtttgtattgtaatgccaataaagagaggctggactgcataaatatccactaaaaacgggagaacaggtcttcatgaataacagaggttgaactgccagaaaaaaaaa

SEQ ID NO: 32321 - DNA, 1514 bp, Triticum aestivum
  unsure (1)..(1514): unsure at all n locations
  Clone ID: PAT_TA_32321
cttcctaatctcccatgcttgctcacagtccaaanacagtggaaaaaaggaaattattagggagtggaacatttggccaggtttaccttggatttaacagtgaatcgggcagttttgcgcgattaaggaagtacaagtaatttccgatgatccacattcgaaagaacgactcaagcaactgaatcaggaaatagacatgcttaagaaatcatcgcacccgaacgttgtgcaatactatgatagtgatatgactgatgataccctttcaatttatcttgagtatgtttctgggggctcaattcataagtttccttggaagtacggcccttttaagggacctctaattcggagctaagcgtcttttgtggaccttcagcatgaaaaatgcaccgataacatggtagatgctcagagttgttctgtctgcagcctcttgtaggctcgtgttgcgacattaaactggcttactgtggaatcgaaaagggtttatgatgttttgctgtgtttcactctgtcctgtatatttctcagtcgatatctcctcgcggtaaaacaataagtacccttaacactttagggttttaaactcggcagtttgcgcaagacaataattgttattacaaggggaagtcgactttcgtatcagttagtgggagtagccccaatgtttatgcttggaaagatcaagcgactatcgtgaaagatattggaaatttctctggctaatgttcatgttttgaaactaggcttaaaacgtaatccagcatctcgcgccaccgcaagtcagttgatggaccatccttttgttcaggaccatccagcagtaagagcagcaaaagacagtgcattgagaaatgcattttctgctccagcagatgtgaagcatacaatgtctaacagggagttgccatcacgaagaagtattactcccctaagggatataggtgtgagtgcgcgagattttaccggattttctacaactgtcccttcaccccgtacctcgagccctattcctgtgagaacaaacatgtctctaccggtgtccccctgctcaagcccactgaggcaatttaagcagtccaactggagctgcttgccgtctccgccccacccaatgctctcgtctggtgctgcggcttacaattcatcaagctacgcgctgaatcaggcacgacggatgccggatccctggcaggatggctccttgaaactccaaagtccttacggttctccaaaaaggttctaagggtcttttgtggagcttcagcatgaaaaatgcacccataacatggtagatgctcagagttgttctgtctgcagcctcttgtagctttgtgttgcggcaccggtctgatttactgtacagtcgaaaagggttctcgaggaaagaggatgtatcatgaagatctgtatatatataggccgttatatcatgatgtaaatcaatacaaacccttatagcaatagggttgtaaactcgccagtttgcgcaagctcacagttgttgttaaaaa

SEQ ID NO: 32322 - DNA, 385 bp, Triticum aestivum
  unsure (1)..(385): unsure at all n locations
  Clone ID: PAT_TA_32322
ccgggtcgtcccagcgtcctctgtcgttgtccttgtgtgaactaggctgtgctgcgtcctctgcggggcgcgtgtaagattgatgattgactcgggatcgatagcgcttgtttgtacgtactgcggtagagtgggatttggttcgcttttgaaaattactgtattaggtagtgtaacaaattatggccggtgcagggctgaacctcgatgtgcagagaacagaactggtctcagcatccttcagtgtcggtgtgcttctcgtgcacaagcaggaagactgtctcgaaactttcagacttcttctggtgcagcgttgcgtctctttggaactccaaatgtacatgtattagccgaacctatgaaatggagaaagaaacanngaana

SEQ ID NO: 32323 - DNA, 438 bp, Triticum aestivum
  Clone ID: PAT_TA_32323
ccacgggaggtgtttcatcttctaatggaggttccagaaacttctagagccttccacaaccctccagaggttttctagggttgtcctaaactttttggatctccgctttttctcggtttccttcataacattttcttttcttccaaaacttttctggtgcaattcacataagctcttgcacttctagtactcaacaaatcgatgatccttaagcgtgtgtcctggcaggttcggtaaatgtagacaagacccggaacaccttccggtcaatggccaatagcagaactgtggacatccatattgtcccccctacacttacacgaattattatcgagtgaacctattgttctgacacacaattccctttatttcacaatataacataatcaaaggtgatacttattggtatccatgtgaagcaactcatgatcaccatac

SEQ ID NO: 32324 - DNA, 272 bp, Triticum aestivum
  Clone ID: PAT_TA_32324
tccggattactatggtggtgagggatataatgactatgaagatgaggaatataatgagtatggcaatgataatgatgattggccataaaagtctagtgatcttcaagtcatgccaaaatcaagttatgttagatgtttgaaatactttatcttatggaccaatttgtcttagtggaaaatttatcttcgcaaaatgtgaaatatctcagttattattttgttttgaattcgacatttgatacttatggttaatgccattcggatgcaactca

SEQ ID NO: 32325 - DNA, 2100 bp, Triticum aestivum
  Clone ID: PAT_TA_32325
gcccccgccgcgccggatcccggccaacccgctccgccccggcgcgccgcccgcggccccctccgtcggcctcgacgacatcaagcgcagcctcgagtccttccgcgccggctcgccccgcttatccggccccggcgtcggcggcggtggcggcggaggcgccagcccgtcgttccaggacttgctcaagaacagcgccgccgccccggcgggtcgcccccagggaggaggagcccccaacgccggcggcggcaagccgttcagcttgagcttcgagtccatccgcgagagcatccgcaagatcgacccgcagcaggagaggcagcggcagccgcctttgcggttcctgaacaacaccccggacaacatcttcgggagggagatgcggcagagggccgggaagccgcagcctggggaggggaaggaagacgaggacgccggcgtttttctcgcgaaagaatacactcccgaacagcttgggcagatgctcagggagctccggccggcggacgcagggaaggacgggaaggagtggttctctctccaggagctgcaggggcggatcgccaagatcgcggagcaggagaggggccaggctgacccgcggtatggcggcgagtttggtttgctccggcagaccttaacgagcctccataaagatcagaaagggcagaagaagcatgttacaagtgtccagcatatgtcactatttgcaaacatcggtggaaagccgctgccggagtacatgctgagcaatcttccgccgcaggaggagttgctagagaggtatttccatcctgatcacatgtcaggcgaagagaagatgaaattggagcttcagaaggtcagggatgagttcaagatgtccgagaatgactgtggttccgcacgagttcaaatagcccaactgacactaaaaatcaagcacttgtcatccgttctacacaaaaaggataagcactctcgaaaggggctccaggacatggtccagaggaggaagaagtacctcaagtacctgcgcaggaccgactgggactcatactgcctcgtcctgtcaaagttggggctccgcgacacgcccgagtacaaggcggccgactacaagaagacccagccgacgaaggcgcagtcgaagaagagcaagagcaagaggaagagaaagatgaaggcgtagagctccgcggcgcgggacagatgataatttcccacactcttctccttctctttggcattgagaactccgttggcggtagaatccgtcgggtcgacgggcactgaggctcaagatgtctctgccctgccaggtctttgcagtgttgtaatttttttgatccacttcttctgtaataaccagtcgcttgacatagctgcatgtttttcttgttctgtagcaacagaatgtttgttgatcctggggctcggctcccccctgcccgggtatcacgccggtgccgcacgagaccaacgggccgaactgacactgtacgtccacgagatgacatccgaagtgcacaaaaaggataagcactctcgaaaggggctccaggacatggtccagaggaggaagaagtacctcaagtacctgcgcaggaccgactgggattcgtactgcctcgtcctgtcgaagctggggctccgcgacacgccggagtacaaggcgcccgactacaagaagacccagccgacgaaggcgcagtcggaagaagagcaagagcaagaggaagagaagagatgaaggcggtagagctccgctgcccgggacagatgatgattttccacactcttcgccttctctttggccttgagaactccgttggcggtagaatccatcgggtcgacaggcaccgatgctcaagatgtctccgcccggccaggtctttgcagtgttgtaattttttgatccacttcttctgtaataaccagtcgcttgacatagctgcatgtttttcttgttctgtagcaacagaatgtttgttgatcctaggtctcagctctcccctgccctgttatcaggccaatgggattggaggaacaaacgggatgatgattacttgtttcctcatttaaatcatatacgggggtttgggaacccaggggggg

SEQ ID NO: 32326 - DNA, 586 bp, Triticum aestivum
  unsure (1)..(586): unsure at all n locations
  Clone ID: PAT_TA_32326
atccgaannaaagangcagcctctatacaatgtctatatgttcctcgattttattagatgcatatatgtggacatctccttttttgccagattgctatttgaagtttacaaccttatagattgctctatatatggcagtaaatagtttgtattttagcgccttagttgtgaatttgttatagaagtattctaactgatattctaacgtcatcatgtagaatggacatgatctcgcccattgggaattgcatgctgcagtaaagcaatttggtcaaccatattcagcgttcggcggagtccttggtcatttctttgaggagcagctccttctcaggtgttctcttcaagagatgcttgcacaccttgtttgggtggcgaggttggagtctcatggcgagtctgaggattttattcctatccgagtagtcgtaggtatttatagttgtatcagaaaacacctaccaagtacttctaggcgttgcaagttttttgtagcaatgcgacaatgatcttattcataaacagtggtgttgatgatcaagtcttgggtgacttacattaactaatttatagaaccaagtacttt

SEQ ID NO: 32327 - DNA, 1202 bp, Triticum aestivum
  unsure (1)..(1202): unsure at all n locations
  Clone ID: PAT_TA_32327
gtgcgcgcggtccgctggacgcccttccgtgtgcctatctgctcagtggcggtcttcctgaacgcgttccctctggcccccgtcctgctccgggtgctgctccccgtcttcggccggcgctcgcgcgcctgcgttagattcgcgttgcctgccccggcccgcggcctcgcagtccggcctgtgcgctggcctgatctctggggcgtggggtgggcggtgatcttcctcaattgcgtgcatgatcttgttggagcaatcttttatggtgtttacgtttcacgggaccagtttgagccggctcagggggctcaggcctcagtgttcacacagtgtgcccgcggtcagtgggtcctacctccgggtcaccagctgccgactggcttccctcctgaactgcttccctcgccctcccattgttctcggcatgcgaacttccttcgccggccgcaagctcccgcgtccaccgatggcggacctgtcgcacgggcagcatcgtctgttccgctcaaccatctcaccaaaatgatgtatattcctggtgatcaagagcacaggtaacccacccttttccctgggagtccgccttcccgcgctggggcaccagcgacctgccacgttcactggtgaattacttcactggccctacgaaagatcaggtcaagtgaacatccatagccagatgcaagctcccatgtccatggatggcggaggtgtcatgcaggcatcaacctttgttcagcacaacctcctgccacaattattcgctcctacgcaagtccaagaaagcatgcatgccatccattactctgagaatccacctaaccatgccgttggaccatcgacatggcacgatgatatttatccctgcaccggagcctagtgccaatctatttcccggaccggattatgggaacttctagcaagcgagcactttccacaatgcagtttaaggccgtgtaccatcatggntcgtgtgttgtgtgtcaccacaacttaggtgtcaggttgtgatatacgatagtacgtgttactttcagtctcaggcattgttaaactgtatgtttggacacaaaaattgcttgcccccattccttcccagttagatgttttcaacaattgtacaatgatgtcccgtgggggctttgggtgggggggttcgtggccttaacgctttgttgtctgcgcgccctcgcccnccccan

SEQ ID NO: 32328 - DNA, 1361 bp, Triticum aestivum
  Clone ID: PAT_TA_32328
gccggccgtgctcgctagcaagtcactaagtaaacccacaactatcagcagcaccagctcggctatctccaaagtccgaacaagcagttaatataattatctgctaaatgggctccactgccgtggagaaggtcgctgtcgccactggcgacgaggaggcgtgcatgtacgcggtgaagcttgcagcggcatctatccttccaatgaccctcaagaacgccatcgagctgggcatgctcgagatcctcgtgggtgccggcgggaagatgttgtcaccttcagaggtggcagcgcagcttccgtcgaaggccaacccggaggcaccggttatggtggaccgcatgctgcggctgctggcatcgaacaacgtcgtgtcatgcgaggtggaggaaggtaaggacggcctcctcgcccgtcgatacggccccgcgcccgtgtgtaagtggctcacacccaacgaggacggcgcatccatggctgggctgctcctcatgacccacgacaaggtcactatggagagctggtattatttgaaggacgtggcccttgaaggcggccaaccattccacagggcgcacgggatgacggcgtacgagtacaacagcacagacccacgcgctaactgcttgttcaacgaggccatgcttaaccactccaccatcatcaccaagaagctcctcgagttctacaggggcttcgacaacgtcgagaccacggttcctgtcgccggtggcgttggtgccacagcccacgccatcacctcaaagtacccgcacatcaagggggtaaacttcgatctcccgcatgtcatatccgaggcgccgccctaccctggcgtgcagcacatcgccggtgacatgttcaagaaggtgccctccggcgatgctatcctcctgaagtggatcctccacaattggaccgacgattactgtatgactcttctgaggaactgctacgatgcgttgcccatgaatggcaaggtggtcatcgtggagggcatcctgccggtgaaaccagatgcaatgcccagcacgcagacgatgttccaggtcgacatgatgatgctgctgcacaccgcaggcggcaaggagagggaactgagcgaatttgaagagctagcgaagggcgctgggttcagcacagtcaagaccagctacatctacagcaccgcatgggtcattgagttcgtcaaatagatcactctaatattttcttgcttctgctcctagtatcggaatatgtacttttgagcttccttttcctgctgtccttagcatctcatgtaatgtatcactattatactatatgatacatacataataaatgattcacgataaagatcgactgatcgatccccagtt

SEQ ID NO: 32329 - DNA, 516 bp, Triticum aestivum
  unsure (1)..(516): unsure at all n locations
  Clone ID: PAT_TA_32329
ngctcttcccaatcnccaacggatcccacgccttcttctctgggatcccccctccgccccaccggggacaagcaacaagatgctaaagccgcgccgcttggacttgaccaaggttacgtttgccgggttctgggccatgtcggtgacaaccatcagcactggttcccccaaccactggttccttatatttgcagcgacagctattgcttctggtctcttttggaggctcctcacgcacagcagaaataaggacatggtggaaactgccaatgctgcttccttcttcactcatttatgcattgcagttgctacggtcccattcacggtaatggcatgggaggccgccaataaattgcaagtgaacacgtgttcaagccggcagtgaacgagattcaagtgtcaccctcctactgtatgtcacacaaatttacgtttagcatatgtggtgtgaatgccggagtatcgtattgtatatcaggtgtttatggataataaataaaaagagaagattccaga

SEQ ID NO: 32330 - DNA, 1356 bp, Triticum aestivum
  Clone ID: PAT_TA_32330
ccgaattcgcggccgcgtcgacccgacgtctgcgacctcgccggcggcagcggcggcgtgcgcatccacggctccacccacacggtgctcgtcccgcccaccatcgagtccggcggcagcaaccccaacccgcaggagtggcgcgtgctgccctactcccggaagcacatgtccggcatcaaggagatcaccgtgcgcgagctgccctcggccgccgacgcgccccgctgcgccgtcacctcgcaggtccccgcgctcgtcttcgccatgggcggcctcacgggcaactactggcacgacttcagcgacgtcatgatcccgctctacctccaggcctcccgcttcgacggcgaggtgcagctcgtggtcaccaacatccagccctggtacgccggcaagtaccgccacatcatcgcccggctctcccggtacgacgtcgtggacatggacaaggacgaccaggtgcgctgcttccccagcgccgtcgtcggcatccgcatgcacaaggagttcagcatcgaccccaccaaggagcccacgggccactccatgcccgtccgcccacgcgtccgcccccgcgtccgcgcgctcccgcgcgccgcgcccatgcgggtcaccgccagacttataagcgacaagaagccgaggatgatgatcatctcgcggcgccacccgaggaagctggtgaacatcgcggaggtggtggcgctcgccaagcggatcgggttcgaggtggtgattggggacccgccgttcaacgtggacgtgggcgacttcgcgcgcgaggtgaacgccgccgacgtgctcatgggggtgcacggcgccggcctcaccaactcgctcttcctgccgacgggggcggtgttcatccaggtgaaccccttcggcaagatggagcacatcggggaggtggacttcgggacgccggcggtggacatggggctcaagtacatggcctactcgtgcggcatggaggagagcacgctggtggacacgctcgggcgcgaccacccggcggtcaaggacccggagtcgatccaccgcagcgggtggagcaaggtggcggagtactacctcggcaagcaggacgtgaagctcgacctccagcggttcgagccggtgctcctcaaggccatggccatgctcagagagtagccgctccgatcgagcttgcagccccggcgcattggttgattcgcactagcgtagagcagttccatttcttctaatttattcctattaatttacatattttttgggtggatatatattgatcaaaacggttatacagtatatatgtgttacactgatcgatcgacagagcaatacaaaatattgatcaaaaaaaaggggggg

SEQ ID NO: 32331 - DNA, 812 bp, Triticum aestivum
  Clone ID: PAT_TA_32331
aaaaaataagacagcttgaaactgctgagagcacgacagattctcgatgcttccagccaatacacaatgatgaacaacatctccattccattggtccaataaatgttatcagacacgctacagctgccagccatgtttatgtacacactagattacgagataccaaaaggagggccatcctgccaagtgaacagcatgcccctctagcccgtgtgagaagcgaacatcccgtccgtgcaatgctcagctacacctagatctgagaccgagaaatcagtagataattacaaccgatgcgtccctcctattgttatatttgcagatcgtccagcgacagctcctcattcgacatcatcttcagtttcgtaatgaatttgggtggatcatcaaggctagaggagccaaggataatttctctcttcagtttcgatgacagcttgtggacagcacgtaactcggaccgggtagcacccccaactacaaagataaacaagcgccgacccaactttctcatatcacttgacgcgtgcttcagtacagagtcgcttgaatagccatcgtcggagttgcgaggtctagcccatgtgccacctgttcgtctagatctcatggattgagctggttgatgagctgggcttgttcgagccgacatgctgcttgagatcccccggaagctagaactagggtcactcatacaatggtactcatctttcggaagctctcctttactgagtttctcaatcaaatcctccaggatgggataaaacctggacaacgtccatgttgattcttcccttattcgttcttttctg

SEQ ID NO: 32332 - DNA, 1541 bp, Triticum aestivum
  unsure (1)..(1541): unsure at all n locations
  Clone ID: PAT_TA_32332
tacgagccactatagggcgaattgggtaccggggaggcaaaactttactaacacaagatagcaacacaaacaagtctaaaccatatctgttctattggaaatttcaaacggtaatatacagcagttccactaacagcacgctaggtatgaacaaccacgcagggatttacaaaccccgttatcttgcaccggagcgtcgaacctttctcccgataaaagggggagcaggcgcaacagccagtctggtgcccatgacaagggaaatcacagctgggaacaaggggaaaagaagaagaaagaacgaaaacttttcctctagggcagacatgtacagcttgggaggaaaacacatgatggcctaggccggagatcacaagactgtattgatgtgcaatgccttcaacagtgaggtggccatttgtttgaccagcacttgttgaccgccgcgttgcccatccctgcgctcttcgatgaggttttgtagcttttggggaaggtcgttctccactataagctgctttggtcgagggtggtgctcatagacaacctttattagtttcagcagagtcaaacgagcaatagcttctcgatggtcaagtcttgcaataagcaatgtcgtcaaaccattggtggctattgcagtatttatccgagatgatttcgtgattattttgaggaaagcatcgagtatatgaacgaaatattgttcagggcagtcttcgaaaaatttcaccaacttctgaatggcctctttcttcaacaaggcttgctctacttttctgtgatcattgtcatgagccaaacaaacagcaatggaatccaaagctgtacatgcccatgcatcatcctctaacaggtccaggtacacatccaggcctccatgagctctcaactgctccctagagttgcgagaagcatgagccatatcacaaagaagaggcaaagcatactgccttagcggcgagtctgacatgacaaaattcatcaagtgaggaatgatcccattttcagctgcttgttcctgtcttcttttattgatcttacaaaggttgaacagcgcattgaggacctcgctatgtatttgaaaaactagaggtccatcacgaagttcgagaattggtatcaaatgcttgatagcatctgtgcgttgaagtgtctctagacaattaggatcaccagacaaatgattgatgcacctaagaatcttcagaagaataggagattctatcctggtgaacatctggaaaagccgtgcgagaaggctttggcttagacatgagagattttacaacagtgtctgcttgtgcaaactccaaaagaagatctgccactttctcaagatactcgcgtgcaacatcagcactcatagaaaccatttgagctaatagaccagatgatgttgtacttncctggcattcttgcattgagcactcctgatccagataacacgcccgatgctgtttgtgatgctgctccggatgttgatgttccctcattggaagctgttggaccatacttcatacttggaatncctatttgaa

SEQ ID NO: 32333 - DNA, 665 bp, Triticum aestivum
  Clone ID: PAT_TA_32333
ttttttttttatcatcaatttcttttctcttttgattggtatggacatatggttacatgtgcagacgatataaatattgtacattagaatacatacgagataagttaaatccatggaggaaggagacaggtcgatcccgccatagaccacttgctactgaagtattatgaacatgcatgcatctgcatagccttgcatgcgtacgttgacatggacaccatgcacgagacttatctcatgcacatgcacatgcttccagttccatcgatctatgtagtgtgtatcattcattgtccattgccgcctagatcttcaagtgcttcaacctgtcggcctcgtagccggcgttgtggccggggcccgggcacggggaacggtaggcggggaaggccaccttgccggcctcgatgcgggcgatgtcgtggacgagcagctcgtagtagcgtttgacatcgtcggccgacttgccgccaccaacggcacgagcgacgttgtgccagcggtcgggcgtgtcccggtcgtgcactgccagtgcctgctcgaacagcttgttctgctgcggcgtccacccagctctcccggccgcgctcattgacagcgacgccattgctcgatatacctacggttgggcttatgatgttggcccccgtgaactcgttggttgc

SEQ ID NO: 32334 - DNA, 573 bp, Triticum aestivum
  Clone ID: PAT_TA_32334
tctaaggtcattgagcagtctgagatcagtccattcatccgcgaggctgcagtgctcactcagataaaccacagaaatattgtgaagctctttggatgttgtctcgaaagtgaggttccactgctggtgtatgattatgtatccagtggctcactgtctgaagttcttcatgcagatgaaagtgttggtttttctttgtcttggggtgattacttaaggattgccctggaaacagcaggagctctgtcttatctccactcttcagcttcaatatcaatcttccaccgtgacgtgaaatcctcaaatatactattggatgtgaactacacagctaaagtttcagactttggtgcttctagattggttccaattgatcaaacacatattgtcacaaatgtgcaaggtacatttgggtacttagatcaagtgtatttccataccacgcagctgaacacgatgagcgacgtgtacagttttggtgtggtactactcgagctgctccgacaagagaacactgtccaacattgtgaatcaggaggaatcaaagatgtacccagcccagaacacagaaat

SEQ ID NO: 32335 - DNA, 460 bp, Triticum aestivum
  Clone ID: PAT_TA_32335
atcggagacatcttccagtacatggtgggtgaggatgaacttcccgacgaggagccggcgtttttgccggttgatcgacctcaccatgcgcctgcatgcacggctcttcctcgacaggtagtaccacgaggacctgcacctgctcgtgccttgatgaggttgttcaaccagcaaaacggcggcggcggggctcggcggtgcctaaggcggtcggcgtgaggcactcgtcagtgacgaccatgctgttccaagcatatctcctgaagcatcggccagccggcgtcagcgtgcggcggcgaccccatactccgcgaacctccttgccgtttacctctagggcgtggacggagcgcctctccaccctttcgcgtggggcgggtgggtagtggcaggcgacggcgaagaggcttccggagatgatactcatggcgttgactctttctttcttgtctcatttttg

SEQ ID NO: 32336 - DNA, 348 bp, Triticum aestivum
  Clone ID: PAT_TA_32336
tgctgatgccatcatcgactccttccacaatgtcaactagtttatgatttgcgtcgcggccacgataccgcgataagttccttctatagtttgctgggatttttgggtccttccagctcgagtttttggtcgcgatgctgatgacgtgtccggtgattcagaggtatagtaataaataatttggcaaaactcacggatgctaggcgctaggcacttgtaccgttgtacggtccttgcaagcttgtaatgctgattaattatgtatgatggcatctccaattagccttttgagtgctatatctcaaagtttcttttttggtcaaaaaaaagtgaatacgggctggtcgt

SEQ ID NO: 32337 - DNA, 1855 bp, Triticum aestivum
  unsure (1)..(1855): unsure at all n locations
  Clone ID: PAT_TA_32337
tcccccacccccccgcgcccccccccgcgccctgctcaccctcgccccatcctccgcgcgctgcagctctcgccccacgcggatggcctccgccctctccgccccggcggcctccgccgtcgccgccgcccggtgcaaggtgttcggaggaggaaggaacgatgggagggccgggtgccgcgtcggggtcgcgaggaagaatactagccacataacgatggcagttgcagtagatgcttctcgctttgaaggagtgccaatggcccctccagacccgattcttggggtttcggaagcatttaaagcagacacaagtgatctgaagctcaaccttggcgttggtgcctatagaacggaagagctacagcccgctgtcctcaatgttgtcaagaaggctgaaaaacttatgttggagaaaggagataacaaggtgtatctgcctattgaaggcttcgctgcatttaacaaagcaactgcagatctattgcttggagctgacaatcctgtcatcaagcaaggacgggttgctactcttcagtctctctcagggactggatcattacgccttgctgcagcttttattctagagatacttccctgaatgcgaaagtacttatatcatctcccacatggggaaaaccacaaaaacatattcaatgatgcgagggtaccatggtcagaataccggtattatgatcccaggactgttgggctggattttgaaggaatgatagctgacatacaggctgccccaagaggggtcttttgttctgctacatggttgtgctcacaatccaactggaattgacccaactcctgaacagtgggagaaactggccagatgtgattgaagagaaaaaacatatgcctttctttgatgttgcctatcagggttttgccagtggaagccttgatgaagatgcatcttctgtcaggctttttgttaagcgtggtctggaagtgtttgttgcacagtcttacagcaagaaccttggtctatatgcagaaaggatcggtgcgataaatgtcatttgctcagcaccggaagttgcagatagggtgaagagccagctgaagcgattggcgcggcccaatgtactcaaacccacctattcacggtgccaagatcgtcgccaacgttgttggagaccctaccatgttcggtgagtggaaagaagagatggaacaaatggccggtcggatcaagaacgttcggcagaagctttatgatagcttgactgcaaaggaccagtctggcaaggactggtctttcattctgcgccagataggcatgttctcgttcacaggcttgaacagaccccagagcgataacatgaccgataaatggcacatatacatgaccaaggacgggaggatttcgttggcggggttgaacctggcgaagtgcgagtaccttgccgatgccatcatcgactccttccacaatgtcaactagattatgatttgcgtcgcggccacgctaccgcgattagttccttccatagtttgctgggatttttgggtccttccagctcgagtttttagtcgcgatgttgacgacgtgtccggtaattcagaggtacagtaataaataattcggcaaaactcacgaatgctagcgctatgcacttgtacggtcttacaagtttgtaatactgattaattatatatgatggcatctccaattagccttttgagtgttcgcaaaaaaatatactaaggcctactatctcaaaggtttcttttttggtcaagaggtattnattactcccggggcggggcccggtcccctacctcgcccccggcagcggctccctgtgacccgncgccccaccngggccttcgtttttanaac

SEQ ID NO: 32338 - DNA, 740 bp, Triticum aestivum
  Clone ID: PAT_TA_32338
caccggtagcgagggggtggaggacgccggcgttggcttctcgccgccgaagaagacgaggaggactgcctcctcctccatcaacgaccccgtcacttctcctgcaacgcatccggtcctccttgagctggaggtgatgcccatagcggagaagctggcggtggtgagcatgaggcatgacaacgcgcaacacgtcatggcgaagatgtacaaggcgctcgatccgctccgtctcaaggtcatcacctcaagtgtcaccttcgtggacggccgcacagtccacacaatgttcatcgagatggaagaaacggatagtgttgagacgatcaaggagatggtacaggctgcactcagccatctcgaattcttgatgtgagaagaagcccaaaaaagtccatgagtcactgatgaagattaagtgtctcaaagaatgcgtaatgggcaccccaactactgatgctccatcatgatcaatatcatggaggagagcgcgtggtttggtccaatctggtactacaacattctaataaaagtgactacaactgcaatcacttgtatggcccaaaaaatagtaattgtgcctagaatttatgtaagctcgtagtattagtactccctcccttgggatttgtgaggacatctccatacataattatagaacttcagttcagtttacaactttgtgcaccccaactactggtatgaaatccgcactttaactttaccaaaaaaaaaaaaaa

SEQ ID NO: 32339 - DNA, 768 bp, Triticum aestivum
  unsure (1)..(768): unsure at all n locations
  Clone ID: PAT_TA_32339
cggggccaacggggcaatgcaaaaccataatggcacctcccaaggggcaataacaaaaaggttcaacctggcataacctaagcaacatgcagcctgcccaacaaatggctacggacaatttgggtggccacaaccttcatactgctgccatgctctccgctgctggacggggtggacctggactcgttcctagttcattgctgccttttgatgtttccgtcgtgcttcggggcccatactggatacgcattatatatcgcaagaagttttctgttgacatgcgttgcttcgccggggatcaggtttggctacagcccgcaacccctcctaagggtgggccttcagttggcgggtcattaccatgtccacaatttagacctttcataatgggagcatgttgctcaaaggtcctaaatgctcttgaacctgctttcnatgaatgctacacagcctgggcccacactttaaatactagtgctggggctccacatcctgctccctgtcgccaaaccgtttaaatgccacccctgggtgttgctatgtccaggccaacttccagtgtcgccaaccatgtagcagctagttggagccgaccaggaagccccttgctcccttcgcctgctcttgcttcgggggtccccgggccccctgcgcgaccggctccgggaactggccggcctgttcatccgaatgggctgcggatctctgcccgcgtggggctcgggggtgctggtggcttaatgggatctatacgtgncgctgctgttn

SEQ ID NO: 32340 - DNA, 554 bp, Triticum aestivum
  Clone ID: PAT_TA_32340
cacatgcagcagcttagaggcagctgttttagcatcggcgcttctaagatgaacaatgagtgcacatctttcaggaacagctgtggagaagaaaatgctgaaggttgcaggagaactttccagaaagtgaagagggagcacgctatccttaggcagaagctggagtcctatttccagctgctgcgacaggccggtcctgccaggaccgcgaccaggcctggaagcatgtaaagcgctggccgctggcgctttacagggagatgaaccagtatatatctctatatgggatcgttgcagagaaagaagacccaggaacaggagacatgcctggtactgccatgggtgctagctagttcattgatgcctgaaagataccatataatgatcataaaaaaaagtactctatcatactataatcataaggacgccatgttggtgtcctgtgtctgatatagtcgtatcatgtcatgtccgcggttatgtacgataaataaaaccccccgagcttgcaagtgtctgttgttaattaattatttaccaccagcttgtggatg

SEQ ID NO: 32341 - DNA, 1294 bp, Triticum aestivum
  Clone ID: PAT_TA_32341
gtagcaatctgcttgactggccagaacccattgtaccagtgcaaactctttccaactctggtatgagctccttgccacaacagtacgtcaagcctccatctgagcgtcctagtggtgttacaaatgaccctaatctcagtatcccagttatcgatcttgctagcttctctaatgcccctgaacatcaccaagaaatgctaaaagcaatagcctctgcatgcaagaactggggtttcttccagttagtgaaccatgatgtggacacggaggctgtgaggaggatgagaagtgcatggagggagttctttgacctccccatggaagagaagaaggcacatgccaacttaccggtaacatatgagggctatgggagccgccttggagttgagaaaggggcaatcttggattggagtgactattacttccttaatctcttcccaagtgatatcagaaaccttgacaagtggccaaagattcctactgacctgagggaagccactgagaagtatgcatgccaactaataagtctctgtcaagtcttgctcaaaggctatgtccagtagcttaagggctgggagggagggactacctccaataatgcctttgggggcaagtgagggcatctcggctaccatgcgtgtgaactactatccaagatgcccacagcctgagctcactcttggtctctcatctcactctgaccccggtggcatcaccttgctcctcactgatgataacgtcgaggggacacaggtacgcaagggagacgcatgggtcaccgtgcaaccagtcccaggttccttcctcgtaaacgttggtgatcagattcagatcctgagcaacgggcgttacaggagcgtggagcaccgcgcgctggtcaactcggacaaggagcgcttcaccatcgccttcttctgcaaccctcgaggcgacctccctgtcgctccggcgagcgagctcgtcggcccggggtcgccggcgctgtaccaggagcccgtcaccttcagcgactaccgcaagtacatacgcaccaagggccccagcggcaagacgcaggtgcagtccatcagcagcaccatgcagccagggcctgcagcttgatccaccatcccttcggacgcgtgggggataaatcataataaatgtatcagcacggacagcgtttgaacctgttgttataggttgccagcagttgggagatatgggcgtcgtgcgtgcacgtaatttgtttgtacaatttggatccttggtattgtatctcaatcagtgtgccttccattttatacgaatgctc

SEQ ID NO: 32342 - DNA, 1784 bp, Triticum aestivum
  unsure (1)..(1784): unsure at all n locations
  Clone ID: PAT_TA_32342
gcccggcggcaaaaggggccgtcgcagacggaccccccaggcaacgtcccgggcaacagccaccggaacctcgatttccaaagcgaatgggtccaggctctcccagatgcccaacaaccgccctcgccccagcccggcaaccctcaacaaaaccgtcgctgcaaggaagaatggtcgtcgcaggcagaatctaaaagtctactcgcaacgaagccgctgctagcaacgcaagcgtagacaggcgtagcaagctgcccaatgaccttctgctcaacattctggagagggtggacacactcgatgccataaggacctgcattctctccaagcaactgctgaagcttcctaccatgctctcacgcttctacctaactttcagccgcaaggaagtgttcagaaccaaccgtgctgtggctcatgtagcggataacatcttgagcacaaggagcccgaaggttaccatcagcgaactcaaaatcagatttgtcttattgcctgatgtctccctaaccattggaagatttgttgcccgtgccatggcaacccagaaggttggcacagctgagtttgagattgtaacgaaaaagcgtcatgacctctgctcttctgatgacctcctcaagtgtccgcagcagcgtcctgatttatttggtgcttgtccgcgtgcatttgctggccttacgagtctgtggctgcaaaatatgaggtttggtgaactagacattcccaacatcctcagcacttgcaagcgcttggagtatttgcgtttaacccgttgtgactcagggttccattctgtgctgcaagtagaacacgatcaacttgttgagatcgaggtcgaccaagggaagtttgagagagttgagctgatatgtctaccaaaactccaacggttgacctatgataattggttctcttctgaggatccgttgtatttcggtttcgtaccacagctttcaaagctgagccttgttaaaactggcatccggtcggacaagactctcgagttaagtcagctccttgctaatgttccttccataagcgatctgcatctggattttggaagtgaaaagatttgggttctaccagaatgcccaaaactgctcaagcctgtgctcagcaaactacagcatgtgaatctggaccatcttcctgaaggatgtgatttagcttggacaatgtttattcttgaagctgcaccctccctaaaagagctatgcatcacagtatgggatcattggtgcataatggtgaaagacgaagagtttcggaagaaaaatggttactgcgaaaaggcagatgtgaagtggaagccatatgcccctgatttcaagcacaagaatctggctaagctcaccatctatggcttccaacccgatgacaattttatgcgatacgtcaggtgtgtcgtggaacatgccattaatataacagagatatccctgtccgacaggaaggggtgtaggcggtgtggtgacttggatccatcaagatatccacggactgccggggagaggaaacagacagctgacgagttgggtttggcttcgggtgttgtggttcatttccggtcgtgattgaaaaaattatgagtagtttgtaagtcatctgttctatcatctttgtagctggaaggagtttgtaagtcatatgtcatatcatgtttgtagctggaagtagttattgtaccttttgctttgctttcagttgaagcttgttgtgaagtattctgagatttacatctttggaaataataattgtgaactantgacaaaaaaaaaaaa

SEQ ID NO: 32343 - DNA, 596 bp, Triticum aestivum
  unsure (1)..(596): unsure at all n locations
  Clone ID: PAT_TA_32343
acttagaagaaccgtgccgttggcctcctgtgtgnccggcantccttgcgaatcaacgatgctcacacttcccaagaggcnntgttggaagcgaaaaggtnttngntccctgtccgtacgggaacntntcttaccgtattcactgagaataccagncctagagaaagaacaaagcaagatgaagatggtcaggttagctantagatgaaacatggcggtgtggcgacatctgccttggagctctgcatccagttagttggccaagcaacaatgcggtgaatcgatcggtacattcctcagcgatcaatgttgcatgcataacatgaagttctggggaaggaagggagaagaacactgcagccaaccgagatggagaccaaatgtttgcatgtatattattattctagaacatgtgcatttgaagacagaacaacatgtatatatatactcgttgtcggtcccgaattcgggaaacatgtatgttattctgtaagcgtatatattcgaacaatatggtttggaatgcaaaactgagaaaatgcgacgctgtttctaaactttagaaaaaaaaaaaaaanncaaaaanaaaaaaaaaa

SEQ ID NO: 32344 - DNA, 510 bp, Triticum aestivum
  Clone ID: PAT_TA_32344
acgccccccgcggggtccctttcgtcccttgcccggcttgcgccgtcggccgccaggtctgcgacgggcgcgtggtccgcgccctccggtgcggcgtctgcgtcgcctgcggcatgctgccctgcccctcctgcgccgcccggtccgtttgctgctcctgggtgggagtgggcggattcgtcttcgccccctgctccgggaggcgccgccccggggtcgcggtcgtcgtggtttatgtgcccgggctcaatcgatcaatcaatccgatcgtttggggatcggattgttagctgctcatgggcggaagagaacgaattgttcttggctcctttgctgcgggaatcgccgcccggtggtggcgattgatgatgaataagagccggtgcttgtatatgtgtgtaaaatttggtgctgatattagcctgatggattaatgtataacaaagaactgatgtaaatacttgagctctgggagtgattcaatcttcctcgtgccgaattcggcacgag

SEQ ID NO: 32345 - DNA, 561 bp, Triticum aestivum
  Clone ID: PAT_TA_32345
cctcgcgtccgcctctcccccgccgtcttccttctccacctccgaccgcaacacacgacgccacaacctccagcaacgacttgctcttgaatcaggctgaaaaatgatgggttcacgaggtaccagtgctgtgctctcgagggctgcacggatgaggcaaaagctgcagtcttctttggtaggcgagtgcactagacatcgaagatgtttcttaccaacatgctgggcatgcggctgtcaaggacaatgcaaatgagacgcattttaacatcaaggtaatttcgccgaagtttgaagggcagagccttgtggaagcgtcataggatggtgtatgatctcttgaccgatgagttgaactcgggtcttcatgctatctccattgttgcgaaaactccaacagagtcgggatcatgaatgtaatttcttacaactcgattaatgtttgttccagaataagttgattgcagcagcagcatgtagccatgaatcggatggttaaacaatgttatggcatgcatatttcttcatgataaagacattgttgccttggttcaaaaaaaa

SEQ ID NO: 32346 - DNA, 1040 bp, Triticum aestivum
  Clone ID: PAT_TA_32346
gtcatggtgtaggtttgctcgttccagatcctcacgcacccaatgtcccactactctcacagaaaattcaaatataagcatgatcagggctcagaacatactactgccattaacagaacgaagggtgggcttgcccagaagtggccgacgccgcccacgaactctagctgcaaatgtgctatgactagtaccaaatacgaaacgatcggttctcctccgtggctcatattccggtgaaatcttgatccattgccacggacaacggtgaagataattcttccttccccaccccccaacgggttttgagtcccgcccccctccgccgcgcaccatgggccccgacgagctccccaaggccgccgccgccggtgccgaggaggccgccccgttctccttcagcatctggccgccgacgcagcggacgcgggacgccgtggtgcggcgcctggtggacacgctggccggcgacaccctcctctgcaagcgctacggcgccgtgccggccgccgacgccgagcccgccgcgcgggccatcgaggccgaggccttcgacgccgccgccgtcaccggcggggccgccgcctccgtcgaggagggcatcgaggcgctgcagctctactccaaggaggtcagccgccgcctcctcgacttcgtcaagtcccgctccgccgccgccaaggccgagccgtcgggccgaggagccgctcgccgtcgagcaggagacctcccaggcccgacccccggacgagaaccgttcggttcgattatgcttcgagataaaattcatttgcatctagagttcctgtgcggcgttggcctctgccccccatgccttcggcgtcggttccccgctctccttccgcttctgccccccgacgcagcgcacgcgcgtcgccggggcgcggcccccggtggactccccggccggcgactccctcctctgcaagccccgcgccgccgtgccggccgccgacgccgagcccgccgcgcgcgccatcgaggccgaggccttcgacgccgccgccgtcaccggcggggcc

SEQ ID NO: 32347 - DNA, 1484 bp, Triticum aestivum
  unsure (1)..(1484): unsure at all n locations
  Clone ID: PAT_TA_32347
ccaacggcctaaccccccccggcccttccctgccggccctggccctccgcccggcggccccccccgccccccccggccgccgttcggacccccgttggggncccggacccggcggggcccggccggnccgtccggcgacggcttcctcgagggcgagggcggcggcgagggcgaggacggcgactactaccccgaagctccgctgctacaacggggagtactactacgacgacggcctggaggggagcgaggaggacgcggtgggcgcggatctggagcgccggatctgcctcctcgagcacggccaggatggggatgtactaggtcaaccgtccctggaggaagaggaagagggagaggagggcgcccacctgtatgcagaggaggcattgctggagccggctgggcaggaaacaaccggattttctgccgacgaggtgttacatgaggagactgtgcaacaaaggagccatctctgtgatgatgatgagttgccagattctcccgttgctggatatggcgtcgaagaagggggaagtgacgacgatggttctggcagcggcagcgacagggtctacatgatcgacaaggtgcatcagggtgcggcagctcctaccgccagggtcctggagaagtacgaggatgaggcgctcgagccagacattaagacactatacatgaggctggaagtgctggaggctgaccgggaatcgatgcgccaggctctgctgggaatgcgcactgagaaagctcagcttatgcttcttcgggagatagcacaacagctagccaaagacgccgctccagttggcactggggctgggtctgttccagttgtccaccatttgcccagaaagcaagctgtgggggtcgcagatacaacggtcagggaagacaagaagacagcacccgccgggacattctccaagcccttgttgtttaagtgggccatcgcattattttgctctcgaaaaaagaagccatcacaaagcaggtatacatttggattatcaagtaacaatgtgggtttgctcatactcttggacaagtgccctcggattcagaaaactctcatgagaagaaagtaaagcctgtctgaagaagctgctgctgcctaatgtaaataacatagccgttggttgggaagtctgcatcaaatcacattttcttattcaagggttgggaggagatggtgttgttttaattctttagttgttgatgatttctctttggccccaggaggggatggggatccttgtgccatgatccagaaattgtcaatgtgggttttggggggttgcttttgcttatattttctcaccagcaaaggctatatgcttgtatagtgcgcgtgtggacgtgcggtgactgctggttgtttttgcttgctttcagattgatgactgatgagttgatgtcaaggaaattagctgcacattcgtgcaaactgtatactgatgtgtcttttttgtcagtacagaatc

SEQ ID NO: 32348 - DNA, 753 bp, Triticum aestivum
  Clone ID: PAT_TA_32348
cgggtcgaccgattctacgacccaatgctgtcgttcatcgacgtggccgtcaacgaaggcttcatcacccaggaggcgaggcagatcatcatctcggccccaacagccaaggagctagtgatgaagctggaggagtacgtccccgagtatgaggtcggcctggtctgggatgaccagaaccagatgccaagcaacagcctggtcccagagccgctggagacacccgcgatcacttcatcctaatcgatgtgcctcgcctacatctcagttagggttctaacaacagtgtcgagatagcggcgccacatatatttattctctcctagataagtcctagccaactgaagggcgacgagggggcacattatagcctgtgtgcttgttttgctagcgtcggtcgatcgatctcttgtgtcaccgctgatgattgttttgggtggcatgattatattaagttaactagtgagtagtagcttccaacttgtatggattgttgaatggttcatggctggatgggcatagcatgcagctaagcctctgaatcgatcctgctgtgatcctgaacaagggttgactacatataaatagcagcacatatagtttatcgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaggaaaaaaaaaaaaaaaaaaaaaaaaaaaaaaagggggccccccaaaag

SEQ ID NO: 32349 - DNA, 662 bp, Triticum aestivum
  Clone ID: PAT_TA_32349
ttcggcacgaggcctcaaccgattatggaccgccgcgacggggcgggcaatcggggccggcgcgacgcgcgcggcaacgcccgcggccgaggatggcggggccggtgtgaagaccgcggccgcccctccacacaacctcctccctccaccgcccccgccgccgcggtcatccccagcgacgccccgccgatcgtgggcacctgtcccgacatgtgcccggctacggagagagcgcagagggagcggctccgggatctggccgtgtttgagcgtgtgtgcagcgaccccatgcgcacgtcccattccctcgccgtcaagaagttttgcagaactatctcctctaccggcacacaggcatcagatatacgccctcttccagtcttacgagaaacgatggattatcttttgcatttactaaattcttcagagtacccatttgagatcgttcatgatttcatatttgatagaacaaggtctgtgagacaagatcttagtatacagaatttggtgaatgatcaagctattcgcatatatgaggacgtgataaagtttcatattctgtcccatcaaagacttgcgaggtcttgccaggattctgatgcatcttccttgtgttacctgaacacggaacaaatgatgaaatgccttctttctctgtttga

SEQ ID NO: 32350 - DNA, 818 bp, Triticum aestivum
  unsure (1)..(818): unsure at all n locations
  Clone ID: PAT_TA_32350
ctcgccgcgtcaacccccctccgccaccgggccaactccgtctccgccagcggccagccgccgcgcccgtcgcggccgccggcgtcaaggccgccgcccccctcaaccccctcactcccccccccccgctcccccccccgcccccgcgcccctcgcgcgccccgcgcccgccgcgccaccgtcgccggcgcggcgggggaccagggcgccgcgagggcggggcggcgtggccggacggctcctcgggcggctgccggccacgggcggcgcccccggcggcaggcccgtcgtccggccctaccgccaggccatcgtcactgaacagcgaagcgaacctgcacaggaagctgtaaatcgtattcgaagagctaggaaggcgaagaccgagcaagaagcccggcaaatattaggtatcagtgaaaagaggagttgggaagagattgtcaagaagtatgatacgatgtttgagaagaatgccaatagcggaagcttctatctccagtcgaaagtacaccgggccaaagaatgtctggagtccatataccatgataagcccgacataatgaactgaactgagatgggcagcgtttcgtctaatcgatcgattttgtcagtcgatgttctgtctgagctatgctgggctgctgcatcaggtcaaatttggttgtaacaggatgtttgttccgcttgactcgaataatatattcaacaaaaggaacaccgtttgatttattttttcaacaaaaggaacaccgtcacccgttgatttgttttaattgaggcgatgcctcgtttccatgcaaaattcagatgttgan

SEQ ID NO: 32351 - DNA, 1104 bp, Triticum aestivum
  Clone ID: PAT_TA_32351
attttcccaggattgttgttgtctcaagttcctcgaattcccgtacatgcccgagtgcgatttgtgctcgtcgtcgccttcctgctatagtgacacctactgatctgcagggcaaacagagggtccgcgttgatttttttgctcttgttgaacaacttagggggcaacaccaaaccagcaagcccgaggcgccactggcatggataggggtggtcgtaataacatacggataatatgcacatggaaggtgttcctgaaaatgattcaaatgtatagccccatgatgtcgcgcctagtgcggtggtaagagccacttctttatgatcacgaggatatctgttagcctggcctccctagctatactcatacagtctcagttgccttggtctgggcagagcctttccatacaactgtgcctcggcaatcagttggagatagacgggaatctccagtgttcacctgttgcctttccattgggccgaaatactgcccaggggggcacaggactgtcactacgcggcggggccaaccccctttctgccggccttgttgtcgtctcctgttgctcgtatctcctcccctgcccgactgcgatctaggctcgtcgtcgccttcctgccatagctacatccacagatctgcaggttccaggcatcttcgttattctctaatgatcggctacaccgccgtagtgtttcatatgcatcatgtcggaggaagtcaaatggattattgaaatgattcgggtgactacggctacctaactttggaatgactttctacattgtgatagcgaggaggattgtgagcctgttatttggatctgtgctcaactggccgtcctatcacattccagctgggtctcggcgaagccttcatggacatggctggtcgttttaatgaaacttggatatgacaaagaacatattagatctggtctaatatctgcaagtgatagatcaagatgtttagtcctgagtccttaccacgccactatcaacctacctcgtgatgtgtacctttgtttgtttctcttcacaagcattaagacttgatttttgtaaatcgtgttaccatttctgtgacatcaacatttggaaggcc

SEQ ID NO: 32352 - DNA, 328 bp, Triticum aestivum
  Clone ID: PAT_TA_32352
cggacgcgtggggtccatttgccaaaagcttagagttaaagcacggtgggggaaaaaccggattaacctgtggcaggctccgcggcgccggcgacgagatcctggggcggcggggatggcgccggggaggcgggggcggaggccgtgctgctgctgctagtgggaaagcgtggagggtagtaggtgggtgagagggaccgacggaccgacggacatgaaggccctgcggcgatccagcacctcgacctctccgtcctcctcctcctcgcccacggccgcctcgtccccgccctcctcctcctggatccacatccgctcgctcctcgtc

SEQ ID NO: 32353 - DNA, 1808 bp, Triticum aestivum
  Clone ID: PAT_TA_32353
cgcccccccgtccggacaactccccggccaaggctcctcggaaaaaaataaattgaaacagcctcggtcgtccgtccccacccccccggtccctcaaccaagaccggaaatcctccccgcggcgtcgtcgggggcagcgccgcccagatcctccggccatggacgggctcctgtccaagctccggagcctggacgcgtaccccaaggtgaacgaggacttctacagccgcaccctctccggcggcgccatcacgctcgcctcctccttcatcatgctcctcctcttcgtctccgagctccgattgtatcttcatgcagttacagagacaacactaagggttgatacctcaagaggagaaaaacttcgcataaattttgatatcacctttccagcccttcagtgttctataattagtgttgatgtgatggacatcagtggacaagagcaccttgatgtgaaacatgatgtattcaagcagcgaatcgatgcacacggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaaaaaaggttggggcgtatcaaatccagattcgatcgatcagtgcaaaagcgagggcttccttcaaacaataaaggatgaagaaggtgaaggatgcaacatttatggcattctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgatggggcgcaatggatccagcattcatcatatggaatggctcaatactttgttaaggttgttcccactgtatactctcacctaaatgagcaaattattctctccaatcagttttctgtgacagaacattacagaagtggcgatagtggtcgggtacaagctcttcctggcgtgtttttcttttatgacctttcaccaattaaggtcacgttcacggagcgccatgtgtcattcttacacttcttaactaatgtatgcgctattgttggaggtgtgttcactgtttctggaatcatagattcgtttgtctaccatggccagagggcaatcaccaagaagagggaactcggcaaattcacctgagttttcaatcaagccttcctattgccgcagaacctccttttgagtgactctagtctgtagctgcagtagaaagcgagtcttctccaaagtcctaaaagtgtacaactgaaccaacaggcaggtctctttgtcacagcttgtgctctggaactcctggtgcgctgcctgcttacttccggctgaagctgccagcatacaaaatggctcatctggcgtactgtgatgttggtatatcgctcaggcaaatgggacatttcagaggtgctcaatttttgtacactcaagtccacaaggacaaaggttttgtcgttctaaactgcaagtttttgtatctttgtaaatccgtgtaagcgggctgtagactgtacaatactcatgacaggttttatttttcttagacattttgtagctcttacaggcgaggtcaaaaaaacataaagaccatttgaacgaaactaagctcaatttgtcagggtgtttttcgtaact

SEQ ID NO: 32354 - DNA, 654 bp, Triticum aestivum
  unsure (1)..(654): unsure at all n locations
  Clone ID: PAT_TA_32354
tgcggccaaggcagccatggagttcctcgactccctctgcatcgctggcgcgtccagaaatgggatccagctgctcaaaccgaaatccaagaagaaacatgtgcaggtcaagctcctgtacaggccgccgtcgtccaatggccgggcgatcgagggggcagaggatgctgttggtggtgatgtcactcccaggccgcatcgtcggcgcagggagagcgacgagggggtcgctcgcaagctgcaccgcgtgatgaacagctcgccccggatttccttcaccggacccaagagaccccacagtatcgccgatgggaaagatggggggttccatagtgatgggggtggggntgatgcttgcaatggttccttgacgcacacgccaactgaggttagtttcgttaacggaggaagctctgtagggaaatccggcgagagagctattcactcctccaagactagggctccggacgacgacggtgaacagtatccttggaacactgcaaagggcagcaggcacattgttaataatggagatgggattggaaacctaagcgctggtcggaaagtgaagatcaagaggaagcagctgtttttgaaccaacattctaacggtgaacagagagaagagcataatcaagaaacaggcaatcagag

SEQ ID NO: 32355 - DNA, 970 bp, Triticum aestivum
  Clone ID: PAT_TA_32355
ccgtcccctgtctgcctctctcgcctgtcggcggctgccgggctggggccctcccgggcgggggccgcgcccgcgccgcacggccacggccccggcgacggccggcagcccatgctggagaagggcccgccgagccaccgggagcggcacttcacggccggggaggtggtgcgcgacttcatcatgggcgtgtccgacggcctcaccgtgcccttcgccctcgccgcgggcctctccggcgccagcgcgccctcatcgctcgtcctcaccgccggcctcgccgaggtcgccgccggggcgatctccatgggcctcggagggtacctggctgcccagagcgaggcagatcactacaagcgggagatgaagagggagcaggacgagatcattgccgtcccagacaccgaggctgctgagattggggatatcatggcagagtacgggctcgaaccgcatgagtatggccccgttgtggagggcctccggaggaacccgcaggcttggctcgagttcatgatgaggttcgagctcggattggagaagccggatcctagaagagccttgcagagtgctttaacaatagcgctatcttatatcatcggcggattggtccctctcctgccctacatgttcatctccacggtccaggacgccatgctcacatcagttggagtcacgctgctcgcgctccttttctttggctacatcaagggtcggtttactgggaaccgcccgttccttagcgctgtccagactactattattggtgctgttgcttctgctgcggcatacgggatggcgaaggctgtgcaagctagataatcttatggggtgcacttgtatccaaacttttcactagcctgcaatgaattcagaacagatgtgaatttgcttctttgaacaatgcattatattacattgcaatcagttgtagatgaagctagcctgttcctcctttatcgaaaaaaaa

SEQ ID NO: 32356 - DNA, 615 bp, Triticum aestivum
  unsure (1)..(615): unsure at all n locations
  Clone ID: PAT_TA_32356
gcgttcgcggncgcgtgggtttgtcgcatgggagtttttttttttttttggcctagattccctggagtttgtaccgagagttttctctacctatcgtaccattatgtctaatcatgaatgtgcatttgcaataagcagtttcatctagatatggatatagtttgatgtctattatgtggctcgaatatatgggctattccttagttttatggtgtgtctcaggctcatgtagatgtgacggaactatgtcacatgtaagggcctctttgggacggctccactcctcaaaaatcagcttaactccatcaactccactttggagcaattccaggagttgcagctccaccttggagcagcggtttattttgtttggcttacagccagcttcaaattcaagaatgagaatatttggtgggaaaagtctgttgtgcccctattttttgttcaattgttgatgttttgatagcccaacatttgtgccccttgagcaattgttcttatttttcattttttgcactctaaaaaaatacaatattacacatggactcgtgtacttccggtttgagtgttgtatgcatgaacatgtcgttggattaaaaatatactgtatgtacc

SEQ ID NO: 32357 - DNA, 573 bp, Triticum aestivum
  unsure (1)..(573): unsure at all n locations
  Clone ID: PAT_TA_32357
gcgttcgcggccgcgtgggggcctcctcttgtcctccctttttctctcctgctcatctctctcttctctcatacatacccgacgtcatgccgctcccgccatggccctcctggaggtccctgttcagcaagaaagagagccagaggtgagaagagatcaagaggaaggagggaaggggcgaggcggcggggcgcggcggaggtgtggggtcgccggcgaggcggcttgcgggggcgaggggagctcgggcaggatggagcagcgggaggcagagcggtctggtttgggctgggttttcagggttatttttgtaaaagtgaaacattatccactaaaacagggactgcgggttgaattcgaataaactgaaggactttgatgcaaaatcgctagcgacgacggacgaccagaagcactccgtgctttattagtagggaaagatgtacacatgcatttcaccttgaggtatgtagttgttgagaaatatgatgagtatgcacatacctacnnnaaaaaaaaaaaaaaaaaaaaaaaaaaaaaaaaaaaaaaaaaaaaaaaaaaaaaggggcggcc

SEQ ID NO: 32358 - DNA, 821 bp, Triticum aestivum
  Clone ID: PAT_TA_32358
accataatgaattgataatgatgcaagcacccaatgtgctgttacacaacagcaatccaggttacaattcccaaatcctgacccctgtcaaaccagcaacggtaatacgggcttttgtcccttggtttgttcgcgggggtcaccacctacaaagctaacaacatatgatcagcctatacattgctacatcactatccagtgatccaatctatactaacgaatatatacactacaaggtaggatacaacagtgtacgtgtagccaacacatgaggttcagttccgggtatcagtgagaaagcatctacgaagcggaacccttcgattgctgaatctccaacgcctgctccgccaccataatgcacgagtccatctccaaacttgcggcctcgttgttcccggtgagcgaaggcgctctcggtaacgatagcgcgtcagcggtgcattgtatgtccggttggatcccgacatggtcgatttcgtgcagtgccggagagagatactttgcaaccgtgatgaatagagcagagccatcgtccagctctgtcacgctctgtattcttcctttaccgaaggttttgtggcctaccagaatagcacggccattgtcatgcaatgccccagccaaaatttcgcttgcactggcactttcttcgttgacaagcaccacaagaggatcatgtgttaaagattggcctccgcccgggcggccgccttgcacattgccctcacggtcaacggtgttcactagagtttcatctccatctaaccaaatttgagccacgtcaagaccagctgttactaaaccacctggattattcc

SEQ ID NO: 32359 - DNA, 860 bp, Triticum aestivum
  Clone ID: PAT_TA_32359
tgtgttttcttctctcccccccctgtcccgggtgcacgccttctgtattagcaggtttagtttttctctgcggtgattccggtgtactaaaagactgaagtactgacatggaaacgtaatcacaaagctgaatattgtcttcctttgattgatgcacaactgcaatgttatggcctcatactcttgtgcaactgaaacagccaggatcgatggtattttctctctgagtttttgggttacagctacacgtactggcattacacctgctgcaggtccactgatttgaatcttgacgacgaaaccgtcaatctgaacaagctcaaggcttccacctccggtgccggaaaggtacggcctgatctcatctagcagcttctcgacattctctgtgttgagctcaagcccggtctcggtgtcgtggatctgctcgacctcaaggatctcggggatcttgtcacggaggcgggactcgattcccatcttgagcgtcatggtggagctggggcaggagccgcaggcgccctggagcatgagcacgacgacgaggccgtcgatctcgtgcagggccacgttgcctccatcccgcatcaggctcggccgcacctcatccagcaccctctccacgttctcctccgtcaggggaagcacccgcaccgcccaccctgctctcttggtgcggtggttcggtgtctgcagtgacgcgtggccgaagctgagacggccatgaataagggagctcgaagaactcttgccgagagctgctgcaaagggggcgttggtgacgccagacccggcgccggggcctgcggcggcttgccggagattcggcgagtagagcctcatctgaagccgattttgcc

SEQ ID NO: 32360 - DNA, 691 bp, Triticum aestivum
  unsure (1)..(691): unsure at all n locations
  Clone ID: PAT_TA_32360
aatactgcaaacagttcccatgattacgactggttattacagtgacatgaaacagtaccgatcacgaatgctgctgcagatggcctgataacgaaagactctggacgcatacactgataacacacgaggcgaccggatacaatccagaagccatcacggttaaaactcacacatagacatatggtcgatcgacttaatggcagacacaccttgatgttaataacagtgatgcggcacgtgtgggatactgtatgctttattgttagtggcgggcgacgaagctcttgatggcgtcgataagctcctgggctcgctccccggtggtagggtccatgtcgacggcgaacttgttnaggtagaaggaatggctcatgccgcggttgatgagcacctccacctccttgccggcngcgcgcagcgcgtcgcantactcgaggttagtgtcgcggatgaggtccttctccgcgacggccaccaacatcggcggcagagggacggactccaagcggcggcctgtccgggccatcgggaactntacggttngccttggtgggcgccatcggnagcgccatgggcaaggacttgtcaacaagtccagcgtgaaaganaccaatccgggttcctgcaacttcnactnctcccnntggcgcgaacaacccngtggttnggatcccccgcacccnaagggggc

SEQ ID NO: 32361 - DNA, 887 bp, Triticum aestivum
  unsure (1)..(887): unsure at all n locations
  Clone ID: PAT_TA_32361
acaagnctcgcggntcaaancgnctgcacaatccagttcgtcgcagcaatacaaacgacacatgtagcaatcactagataacaacccggccatagttttacaaatgatcaagaaaataaaataaaggcaaggggcattcacatcaaaatccatgcaaggcagcacaggaaaaacagcactggtttggcccccaatcatatgcagcagagcatatactacaggcatgagcatcgcccaacagagagatcccagtccaacctgcgtcctctgttgctgcgtgccgtctcagcgacgaaacaaagcgaaaagggaagaacctgatggacctcggagaaccagggatcacccatcacagctgcgttatttttgcctaactcgcgcatggatagaatgaacaggcccccatggcagtttaaaaccctcagctcccacgtgttgacctcacgtgagtcaccataggatggtgccgccgtggggctctccctcgaacagcagcaactcgctgccccctttgagtgttaactggaccttgccggatatcagaagaatcaactgatatgcccaggtggttacgcctaggcctctccctgtgccttctgtaagccctgctgtgtgagtctccacttgcgatccgcctgccacggccaaataaggatgccaggaagtcgatgctctcatccaaactaccttctgaagattcatagaagtcgatcctctcgttcagggtgcgatccatggaagtgaagaagttgagtctctcctccaagtcaaattcatctccatcagcgaacatactgttgttgctgccaccgttcaattcaagtacataatcccccataatcacagctccgggttcgaagcccnaagtaccctcgtgccgaattcct

SEQ ID NO: 32362 - DNA, 584 bp, Triticum aestivum
  Clone ID: PAT_TA_32362
aggaaggcgtagacccagtagaggaagacggcggagaagggctgggcgagggtcggtggattgttatcataaaagcagcggcatacaagcagagctggtcaagagaaaaattcggcagagtctcccctcaaaaaccaaggtttcttactgtgaaatcggacagagtttctcctgaccaagcgagaattctcggggaaaatatttgagcagggtgttgcccttgattgcaaggttttccgacaggaaatttcggcagagtgacgccctgaacaagggggtttctgactggaaatttcagcagagtatcgccctgaacagctaggtttcgtcgcaaggattccaacagagtagtactaagctagatggtagatcttgtatgatcagactttcacacagaatctccaaggcacagggaactaaaggtggtagatgccaagcaaagagggttcaaacttgaaaggcgggagcagggtggttgtggtcaacaggaagtaagagcagcagcgtggcgttgctgctgcgaggaaagaaagaatccaagtccttccagagacgggagaagagagagagagagagggaaaagg

SEQ ID NO: 32363 - DNA, 881 bp, Triticum aestivum
  Clone ID: PAT_TA_32363
ggccggccgggggctcgatcaaacatctcacaccatgcccatcgcaatgccttccatgccggccccggcactagccctggcactgctcggtgctttcggcctcgccatcgccccggttgttcattcggcccccaccatcgaggccatccaatctacatgcgccaagacaatacagccagactcttgcaaacacgtccttgctcgccaacatggccgccggctcaccggaggtgaacagcgtccccctaatgtccctgcaagtcgcggcaaagctcgccaagatggccaacgagattcgccaatgccaggctcaccacggacccgcaccccgccaaatgcctcgcaaactgcatcgacgacattcatagggtggccaaggcattggaggggctcccagtggaggcggttaagcctggcgacgaggcgggggtgctgtccttcagctcggagttcaggccgacatgcggggaagactgcccgaagccaatccccgagaggaccgaggacggacgggccacgcgcgacaagtttgtgggtgtcatgagagcgatcggcgtcatgcaggaccttttcataaccaagacttggtaacaacgtacggagtacctcgcctaatttttattttgtttcttcttcattggtggatttccatcgtgtctatgagcacaggcttctggattttgatatattctgcattaccatgatgtacttatttgtactttgacactttttctctgtttaatgagtggttgtgtgcatcgcttgatgcagaggcagggtccgttcataaaaataaagatgttctaattctttgaatccgggtaatcccctttttcagaaaagaactcccctccctcacaaaaaaaaaaaaaaagggccct

SEQ ID NO: 32364 - DNA, 880 bp, Triticum aestivum
  unsure (1)..(880): unsure at all n locations
  Clone ID: PAT_TA_32364
gttcggaaaagcgtcctcccccttctccccctctccccggccacccgtcccccctccccccttttcgtccccggcgacgccaacggggagcggctcccgcgccgccgcgagaaggagcccgcggccgccgccgatggcgcagctggacgacttcccgttccacgggatcgaaacccgtcaataggcccttccgtccccatcggtgccttggtcactcgcgggtgtcctgagggctggccgggttcagcttccgctgacggggattctcggggttgggctcagtatgctgatgagggcccgtggggttgctccaaggcgttacggttgctcctaaatggtcggcagagcagtagtactatggtgaccaaatcaagctgatcaagaaagggtctagcccaatgaacttgactggatagtggttgtggcagtacggaatggcatatcttatgtacttaagtttcacctggggctctgctgttcgatcgcctcccggtcctggggattaactattgtcattcacgcttggcatgtggtttctaactagaagtaattttggctcaatctccaggcttaagaataaatatttttcttcgtaaaacaaaccgaataaccaaaccatgagcctaccccgccgctaaaaaaaaaaaaataaaggcccctacngggaaacctgggttaccaaantnatcccttgaanaanccccttnccaattggggtaatacaaaaagcccacgntgccttccaaaatnccaaaccnaatgcaatggaacccccttacgggnataacccggggntttgngtaccaactacgtaacttncagcctacgccnncctttccttttcctccttnccatcncgtttcctnagntancggccctn

SEQ ID NO: 32365 - DNA, 2575 bp, Triticum aestivum
  Clone ID: PAT_TA_32365
ccacgcgtccgcttcctccacttccgtgcgagcccacgccttaggatgtccatggcgacgaagcaagcgaccctgcccaggtcgggagctttctcaaagggctacaacttcgcgtacgcgtgggagaagaacgcgccggtcacagaggagcagaatgccgcgatctccgcgctctcgcacgctgtggcagagcggccgttcccggtcaatctggaagatggaggtacggccgtgccagaaaaagaatctgctttggaggaggcgggtgcaatggatgcggtcttggtgaatacacatcagttttacaaatggtttgctgaactggaatcagctatgaaatctgagactgaggaaaagtatcgcctctacgagagtacattagaggaacgtgttaacacatgtgatggcatccttcaacaagtggatggcacacagaacttatttgaagaactacaatccttgcactcgagtgttgccataaagacacaaactttgcatgatgcttgcgaccaacttttggtggagaaacaaaggctcattgggttcgctgaagcactccgaagtaggttaaactactttgatgaattggaaaatgcctctactagcttttattctcagactatgaacatcggaaatgaacagtttctcccactgttgaaaagactagatgattgtatcttatatgttgaaaataatccactgtatgctgaatctgctgtttacttggtcaagtttcgccaacttcagtctcgggcattaggtatgatcaggtcacatgtcttgtcgacactgaaagccgcttcatcccaggttcaagccgcaattcgaggcagtggttctggcaaaaatgctgttacagagggtgtggaagcatctcttatctatgttcgtttcaaggcagcagctggggagctaaaaccggttttcaatgagattgaaagtagatcctctaagaaagagtatgcgcagactctttcagaatgtcacagtttgttttgtgagcagaggctgtacttgatacgaggtacggtgcagcaacgcatttctgagtttgctaaaaaagagaccttaccttcttttacaaggtctggttgtgcctatttgatggaggcatgccagtttgagcaccagctttttgctcacttcttcccagcatccgcaccagatgtttcaactatggctcctttaatggatccattgtgcacacacttatatgatactctgaggcctagactgatatatgaaggcaacattgattctctctgtgaactcgttgacattctgaaggtcgaagtgttgggagaacaactgagtagacgtggtaaatcagcagctggactccgtccaatattgcagaggatacttgcagatgttcttgagcgtctggcattttgtgctcggactcatattcgtgaggggattgcaaattttcgcccttctgacgaagatctggattatcctggaaaacttgagagatctacaatttcaagtgctaatgttagtgacaactcagacatgtatgcgacatggtacagaccactggagaaaacagtttcgtgcctgtcaaagctatatcactgcttggaatcttcggtttttactggattagcccttgaagccgtagaagtttgcacagcatcccttcagagtgcaagcaaggtcattgcaaaaagagcaaccccaatggatggacagcttttcctaattaagcaccttctcattttaagggaacagattgcaccatttgagattgagttctcagtcacacacaaggaactggatttctcccatttgctggatcacttaagaaggattctcaggggccaggtctcattatttgactggtcaaggtcaacatcacttgctaggaccttttctccccgcattttggagaatcaaattgacgccagaaaagaactggagaaaggcctcaaatctacttgtgaagagtttataatgtccatcactaaactagtagtggacccaatgctttcttttgttactaaggtaactgctgtcaaagttgcactgtcctcaggtagccagggccagaatttggattctgttctagcaaaaccccttaagacacaagcatttgcttcacccgataaagttgcagagctggttcaaaaggttgggactgctattcaacaagatctgcccaaagcaatgaccaagttgatgttgtatttgcaaaatccatcgacaagattaattatattcaaacccatcaagtcgaatatagttgaggctcatatacagctacagtcccttctgaactcagaatactcggctgaagaaattcagtctattggtatgctgtctatatctgatctgcaatctcagctcgacagtcttctgtagcccatactttttcatatgttttgttatggtgtgtcctcttgagtctgagtgagaagtgcactcgattgttcaactagagtgatgttatttttaatcctgtaatcaaatttaaacacactttgatatgacatcaatcatggtggatggctagtacaagattgttgctaatgtgttagcatatcggattgattaaaaaaaccttcccaacaat

SEQ ID NO: 32366 - DNA, 792 bp, Triticum aestivum
  Clone ID: PAT_TA_32366
cccgagccgccgccgcccccggcctcccccccgcccccaccgcggccggcccgccactcgtctttgtgttgcgtgccccgccaaacccccgcaactctttccccgatccggcggcgaccacgacctcctcgccggccccagcgccaccgccgcgccatggacccggaggcggtgcggaggaccctcgagcccaccgcttccgccgcggacatctcgggctccaccccttacgactccttcgtcatcagcggcgtccgcctcgaggccgccgagcacggccgcgtcctctgctccttcgtcgtcaccccccgtatcgccagtccccaagggtaccttctcagcggcgtcacggcaacgctcgccgaccagttgggctcggccgtgttcttctccagcggggtgggcacgagcggggtctccctcgagatcagcgtgtcctacgtcgacaccgccgccgtcggggaagaaatagaggttgaggcgaagctattgcgtgctggaaaatcagtgggtgttgtctctgttgatttcaggaagaaaaggagcggcaaattgatggctcaggcgcgtcatacaaagtaccttgctgtatctagcagattgtgaggattcccttcagttgtaagataaaaacatggttctgtcgagctcttcgctgccctttatcaatagacaacatcagcacaacgtagtgctacattgtttaagaaaggctggttatatctatatgaaattctgtaacgcataaaccgctctgcccatttcatgttcgcttttcaacctttgtcagat

SEQ ID NO: 32367 - DNA, 711 bp, Triticum aestivum
  Clone ID: PAT_TA_32367
ttccggatgttgaaggagaccgcaaattccaaatatcaactttggcgacaaagcttggtgtcagaaatattgccttccttggctctggtttattgttggcaaattatgttgttgctattgtagtaccttttcttattcctcaggctttcaggagctttgtaatggtgccttttcatgctgctcttgcagttgctttaatttttcagacatgggttctggagcaagcaaagtacagtaaggatgctatttcacagtactaccggttcatctggaacctcttctatgccgaatacatcttcttcccgttaatatagagatatggcgtttgacatcggctacacgatcggagcacgcaccgaagcacgaattcgttggggcaacagaagagaaaccctttgtggtctataaagcgtgagcaatttttgtacatactgtttgactggtaggggaatagagcggcgatgcgacgaggatcttgacgatgctgtgggaggatccagtagaaaatgactgagttttcgtggttgtttctgccaaacaaagaggaaaagaaatgaaagtgaaaaggtatcgggccttgttttggagggattggacgtatttgaagcagagtcctcctttaatgccttatcagggcttgggtttttttcagtaatttcagtgtgacatatggttcaaacagaatccgattcttcgttgacaagtttgagc

SEQ ID NO: 32368 - DNA, 447 bp, Triticum aestivum
  Clone ID: PAT_TA_32368
attcgcgggtcgacttgggtaggaagcttccttagacaggtcagtctgccgggggaggagggaggcgggctgcccgccggcgacatcactctagccaccggttggtcagccatggtggcgagcatgcgtgtcgagcacgaggtcctccatggctgagggcgaacggcgagaggaagaaagagagacagaggagaagaaaacatgctgagtaaggaagatatcggtgttgacattttatgccacgtcagctccaacgactgggccatccttgtcataatcacgatcgattttaaagcactcggtcatttgggggttttgaacagccgaccctaaagttggtagttatcagcaaaaaaataaaattagtagttttttgaaaccctagcccgaactgtagtagttttatgttatttactcgagttcaccggaataatacgttgggtttcc

SEQ ID NO: 32369 - DNA, 806 bp, Triticum aestivum
  Clone ID: PAT_TA_32369
gaaaaaatgttggagtgctgctgctgcttggttgattacagagagcttggtaggccattaaggcctcacatttgacattagcatccgtaacatttcctagcactactcctagcagtagacaagatcacaagaatctccatttgctagccctactcctagcactactcctagcatctgacattaagttttcacggagaagagacagtaagaggaagatagagcaatactcaaggagtcatcatccatggacgcacagccgggccaccatgtccatcctctcgccacctgacgcagcagctgctcctcaaggagtcgctcatggaggccgcgcgcaaggaggaggacggcggcagccgcggcgacgacaagctgccgcaggtggtgttcgaccgcatccttcggcgtcagatggtgtacgacgcgctcaagcgcgggggcggggcggaggtgccgtcgtgggtccagctgctcaccatcctcctttccttcggcacgtcggcgctcggcatcgcctactgctcctcgtcacagccgcacagatgcagcaactccccacagccgcacagatccggcagctccccacagccgcacagatccggcagctcctcaccgccacagtttctcttcccgcagctcctcctactcgagcagctcctccggcggtaaaaatcgaatcttgggacgacgaagcagggacgacgcgagagaaagagggcagcggcgacgcggttaagggagatgcagcgacgcaggcgagggagatgcggctgctacgcaggcgagggagatacgcggcgacgcgggcg

SEQ ID NO: 32370 - DNA, 673 bp, Triticum aestivum
  unsure (1)..(673): unsure at all n locations
  Clone ID: PAT_TA_32370
tcgcgatctagactagtgaggaagcgggccaggggggcggaggcgatggatgccaccgcggcggacaggcacgaggcttcaccagtggcaagagacggcgagtccacgacgtccgtgccggaggtgccgcgagcgccattgtccgacttgcctgtcgccggcggcagcggcacgcccgaggagagcggcggcggcgaggacgagcaggtggagaggttctacgcgctgctcgccaacatccgggcactgagggacgtgtacggcgccggcgggtcgtcgaggaagcgggccaggggggcggaggcgccgttgtggaagccaaagttcaggatggaggatttccgggaggcggacgacgtggtgcccgcgaagaaggggaggagcgatcgcgtcgagcggcagcggctggagaacagcgacgcggcggaggccgacggggaggacggcgaggtcgtggaagagaatgatcgggtctccgcgtcgcagaccacgtgtgtgctgactgccgagcagccagcctagctagccagtattctgaatccaacaaattgtctggacgatattacttctaatgtgtacaccgacgcagtcgtttaattagatttgccatctgccatgtatctttccttnntgatanccatttacacntactgacatagaattttaagttcaa

SEQ ID NO: 32371 - DNA, 759 bp, Triticum aestivum
  unsure (1)..(759): unsure at all n locations
  Clone ID: PAT_TA_32371
ctcattattattttgaccccatgtattatttccttgtgtattcntgtaggagtttttgnacatgtgtctttagtttcccttttatcatcttggcccaggaggaaagttcttctaattctatgaatctttctagatccttttctccttgaatatccagttaagaggtttcggattgcctggtattcccaccaattcttaatcccaaagttccagacatttgttaaatgaggaagagacccccccaaggcaaaagtacgagaattcactagtgattagcgtggtcgcggccgaggttttttttcatttttgatctgtaaatggagttgttaatgaatatgcttcattcgctgactctattccattccctgactctatatgatgatatttctatttcatgatatttctatttctttgaagcaaaaactctataggtttgataccctgtatctattcttcttttttgtatattagttattagtggaatttcagtgcattgggttctttcttagatctagatggaatgaaatagtgaaatagaataaaaaaaaagccctttcggatgaaaaaggaagaatagtatgcgatatatctcacttggataaaaaaaaattaaaagcaaatttctcttatcctcgtttgttccttcctttagataaatacttaaaaatccccttacaataacaaatccaatttagaagggaccttccccccccccccctggggaaagactttcccttcctccctcctactcctttcctt

SEQ ID NO: 32372 - DNA, 519 bp, Triticum aestivum
  Clone ID: PAT_TA_32372
caacaatgccaagggtgctacagtgggtgatgctgttaagaagattggcatgctgggccttttcaccagaggacttccccttcgcatcgtcatgatcggtactcttaccggtgctcagtggggaatctatgacgccttcaaggtcatggtcggactcccgaccaccggcggtgctccaccagttgctccggtagaggaagcagcgaaagccatcgcttgattgatttttcctgctacgacgatgacgatgtattcccggatgatggggtattggtggatggggactctatcaattacttgagtttagcaaccgaaatcttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgaggaattcccatatactactgtttacctccaattctc

SEQ ID NO: 32373 - DNA, 590 bp, Triticum aestivum
  Clone ID: PAT_TA_32373
cggacgcgtccgcgaacctcgccacgccaagggagaggagagctcggaaagcaccgccagcgccgcagccccccgcgaatccgcgcccggatctcccggcccggcggcgatggcgctctccgacctctcccgcgactcgctcctccccagcttcctctactcctcgcgctccttcgccgccgccgccccgcgcttcccctcctccccgtcgccctaccaggcgcccgcctcgcccgccgcggccccggctgctggcctcgtcggcgctggcggggtcgggggcagcaggcccttctcgatccgcgcgcccaacgagaagatcgacatgtactctccggccttctacgccgcctgcaccgccggggggatcgccagctgcgggctcacccacatggccgtcaccccgctcgacctcgtcaagtgcaacatgcagattgacccggccaaatacaagagcatcacatctggatttggtgttctgtttaaggagcaaggagctaggggattcttcaggggatgggtgcctacgttgcttggttacagtgctcagggggcttgcaagtttgggttctacgagttctttaagaaga

SEQ ID NO: 32374 - DNA, 949 bp, Triticum aestivum
  Clone ID: PAT_TA_32374
cgtccgcccacgcgtccgcccacgcgtccgcaagaccctgatttaccttgcaggttcagcttctgctgaggtaattgctgatattgctctgtgcccctttgaagctgtcaaggtccgtgtgcagacacagcctggatttgctcgtgggttgagtgacgggcttcccaagttcatcaaagccgagggtgctgctgggctctacaagggcatcgttccactctggggtcgccagattccttacaccatgatgaagtttgcctcctttgagaccattgttgagcttatctacaagcacgctgttcctgttcccaaggccgagtgcagcaagtcttcccagttgggtatcagctttgctggtggctacattgccggtgtcttctgtgctattgtttctcaccctgctgacaacctggtctctttcctcaacaatgccaagggtgctacagtgggtgatgctgttaacaagattggcatgttgggccttttcacaagagggctaccccttcgtatcgtcatgattggtactcttaccggtgctcagtggggaatctatgacgcgttcaaggtcatggttggactcccgaccaccggcggtgctccaccagttgctccggtggaggaagcagcgaaagccagcgcttgattgatttttcctactacgacgatgacgatgtattccgggatgatgtggtattggtggatggggactgtatcaattacttgagtttagcaaccgaaatcatttgttattgtagcagatggttattgtgtcatcattttgatgagaggaactcattaagcaggcgatatcgtggcatgttgtgtgttagtttctggatggttagaacgttttattgttttactagtagtagttatcttcagacagcaaggctggtaaagcgcaggttttgccaataactgtactggggaaatgccctatacctactgg

SEQ ID NO: 32375 - DNA, 1951 bp, Triticum aestivum
  unsure (1)..(1951): unsure at all n locations
  Clone ID: PAT_TA_32375
ccgcggacgcgtgggcggaccggtcgcgcgccacgccaagggagagccgcgcccggagagcaccgcgcgcggaaagcaccgccagcgccgcagccccccgcgaatccgcgcccggatctcccggcccggcggccatggcgccctcccacctctcccgagagtccggaaagccccgccagcgctgcaccccgccgccaatccgcgcccccaccccccgcccccgcgccgccggggctccccgaccgcccccgcgactcgcccctccggcgctggctgtactccccgcgctcgttcgccgccgccgcgtccccccgcttcccctcctccccggcgccctcccacgcgccagcccggcccgccccgcgccgggcttctgcccccgccggccctgccggggtcgccgggccgccggcccttctcgatccgcgcgcccaacgatgaagatcgagatgtacactaccgccttctacccggcctgcaccgccgggatggaatcgccaggctgcggggtcatcttcatggagcgtcgccccgctcgagcttcgtttagtgcaacatgcagattgacccggtgtaggacaagagggatctcatctggatttggtgttctgttaaaggagcaaggagctaggggattcttcaggggatgggtgcctaccttgcttggttacagtgctcagggggcttgcaagtttgggttctacgagttctttaagaagacctactcaggctctggctgggcctgagaatgctgtgaagtacaagaccctgatttaccttgcagggtcagcttctgctgaggtaattgctgatatcgctctgtgcccctttgaagctgtcaaagtccgtgtgcagacactacgcctggatttgctccattggtatgagatgatggacttcccaagttttatcgaagctgagggtgctgctgggctctacacgggcattgttccgcactggggtttgccggatgccttacacgcatgatgaagtttgtgctcttgtgtgaccattgttgtgcttaccgtgctatcattcctcaccctgttcccaacggccgactgctgcaagtattcccagttgggtatcagcttggctggtggtgacattgctgttgtcatgtgggctattgtttctcaaccggctgacaccctgtatcttcattcctggaacaatgccaagtgttgctagagtgggtgatgacgcgttaaaaagcttggcatggtgggccttttacccgaggaggacttccccttggcatcggcaagatgggtactcgattaccgggctctttgggtgatttattcaagcacgtcaaattccatggtatgacgggcgaatgagctgcggggggcccaccagttgctcctttagaggtaagcaagcgaaagcctttgttgcttgtagcaattttgttacttatttattgattatggatgagagtgaatccaggaagcgatggggtattaggtcggtatggggactgtgataaattacttgagtttagcacccggaatatcatttgttattgtagcagatggttattgtgtcatcattttgatgtagaggaatctcattaagcaggcgtaaataggcctttttttgtccccgggaagtttgatgcttgacataataagttttaggacagcaaggctgttagagcgcaggttttgccatcacctgtactgaggaattcccatattatactcctgtttacctccaaaaaaaaaaaaaaacctcggccgcgaccacgctacgccctagtggatcctattaccgcctcacggcgtcctttanacgtcctgacgggaaacctggcntaccaactaacccctncaanaaccccttcgcaactgggtatacaanagccnacgntccctccaaaatnccaccnaaggnnaagggaccccntacgncataaccgngtttgtgtacccactacgcaacttca

SEQ ID NO: 32376 - DNA, 291 bp, Triticum aestivum
  Clone ID: PAT_TA_32376
ggtcctaagattgaggaggtcgactaaatgatagatttagattcggcctactattctgcttgaataatgtgtctttcattgtacggtggattctagtatcgttctgcagtttttcgttcgggcatatatacattgccccatcttatgtttaagttgatattgaaacacgattatttagtactagactagaagacagtatacttggttatctgcagttatttcacatttatttatctttgattgaaagtctggttgcccaactataacctgtcatgaatctctagttgctac

SEQ ID NO: 32377 - DNA, 670 bp, Triticum aestivum
  Clone ID: PAT_TA_32377
ggcaaccagaaggtgcaggacctgctcctgctcgacgtgacgccgctctcgctcgggttggagacggccggaggcgtgatgacgaccctgatcccgaggaacaccaccatccccaccaagaaggagcaggtcttctcaacctactcggacaacccgcccggcgtgctgatccaggtgtacgagggccgtccggcgaggaccaaggacaacaacctgctcggcaagttcgagctctccgggatcccaccggcgcccaggggtgtcccccagatcaccgtgtgctttgacattgatgccaatggtatcctgaacgtctctgcggaggacaagaccaccgggcagaagaacaagatcacaattaccaacgacaaggggcggctgagcaaggaggacatcgagaagatggtgcaggaggccgagaagtacaaggctgaggacgaggagcacaagaagaaggtggactccaagaacgccctggagaactacgcttacaacatgcgcaacaccatcaaggacgataagatcgccttcaagctcccagacgccgacaagaagaagatcgaggactctattgaatacgccatcaagtggctcgacgaccaccagcttgccgaggctgacgagtttgatgacaaaagaaggagctggagagcatttgcaacccatcatc

SEQ ID NO: 32378 - DNA, 1446 bp, Triticum aestivum
  unsure (1)..(1446): unsure at all n locations
  Clone ID: PAT_TA_32378
gccggccgggtccggacacctattctccccctacccgcgtgctccgctccaagatccaaccaatcccgcaattcccttcgaggttgtttctccgctcgacttgtcgacgagatcatggccggaaaaggagacgggccggcgatcggcatcgatctcggcaccacctactcctgcgtcggcgtctggcagcatgaccgggtggagatcatcgccaacgaccagggcaaccgcaccacgccgtcctatgtcgccttcaccgacaccgagcggctcatcggcgacgccgcgaagaaccaggtcgccatgaacccgatcaacaccgtcttcgatgcgaagcggctcatcggtcggcgtttctcggacgcgtcggtgcagagcgacgccaagctgtggccgttcaaggtgatcccaggccccgctgacaagccgatgatcggggtacagcacagaggcgaggacaagcagctctcggccgaggagatctcctccatggtgctcaacaagatgaaggagacggccgagggctacctcggcacaaccatcaagaacgcagtcgtcaccgtccccgcctacttcaacgactcccagcgccaggccaccaaggatgcaggcgtcatctctggcctcaacgtcatgcggatcatcaacgagccagctccgccgccatctgctacggtctcgacaggtgctcccagcgttcagctcttccattccatctttgatctcgagtcgactccttcgatgtctcgctcatcctcattgaggaggcatgttatgtactcancaaggctagtcaaaccttctttggtaaatgctcagacaaagcctcagaggttctctttcctgatggaaaaaattcaagtaaattgtcctccattttgcctttctttaaaagtgcaatcagatcatccaaactattttccttcagatattccttgaagaactcagtaatgaatgaaagcactatccctttggcaacaagattgtccttaagcaatggctgaaagacagtttcaggtggcagacctgataatttctgagaaaatgcaagtgccgtgaaaatggcaagtttttgtctctcattttcttcaaagaactccaaagactggagaaattttcgcataacattttcaagactctttattaagaaaggcctcctgcgcagtgttttctgaataaagaggacataaggtaatattgcttcacgttgtgctgcacagtcaatgagagaataggggtggcgctctccctcttcttcgggtttaatcgtaccaggctgagtacgcacaccaatgaaaacaacctcaaagaaagtgtcaccgtaacgtgagaagttgagatctgatgactctatacttttggcaacaagttcctgcaagacatcacctttattcatattaactgctcagggtagaaaaataaaatagaaggcaaaggcgtgttcca

SEQ ID NO: 32379 - DNA, 848 bp, Triticum aestivum
  Clone ID: PAT_TA_32379
ctcagagagcaaaccagagcatatccacatccaccgagcgaacagaaagaacaactcgatcagtcacagacagagtctcgaatcttgcgttcgatttgatcggagaagatggcgagcaagggaggcaacaagggggagggccctgcgatcggcatcgacctcggcaccacctactcctgcgtcggcgtatggcagcacgaccgggtggagatcgtcgccaacgaccaaggcaaccgcaccacgccgtcctacgtcgccttcaccgacaccgagcggctcatcggcgacgccgccaagaaccaggtcgccatgaaccccaccaacaccgtttttgatgccaagcggctcatcgggcggcgcttctcggacgcatccgtgcagtcggacatgaagatgtggccgttcaaggtggtccccggcgccggcgacaagccgatgatcgtggtcaactacaagggggaggagaagaccttctcggccgaggagatatcctccatggtgctcaccaagatgagggagatcgccgaggccttcctcagcacgaccatcaacaacgccgtcgtcaccgtcccggcctacttcaacgactcccagcgccaggccaccaaggacgccggcgtgatcgctggcctcaacgtcatgcgcatcatcaacgagcctaccgcggcggccatcgcctatggtctcgacaagaagtccaccagcgtcggcgagaagaacgtgctcatctttgatctcggcggcggtaccttcgatgtctccctcctcaccattgaggagggtatcttcgaggtcaaggccactgccggagacacccacctgggaggcgaggacttcgacaaccggat

SEQ ID NO: 32380 - DNA, 820 bp, Triticum aestivum
  Clone ID: PAT_TA_32380
taggggccttttttttttttttttttctttttttttttttttttttttttttttttttttttttttttttttttttttttttttttttttttttttgggttaaaaatgtgcactctgcataaatatccatgtaacaactaatacacggcacaaagtaggtaacgttccttccaaatcctggtacaagaatgtcgaaaatgatagcagatgacagcaatgctcacatctgaatataaaatgtttgttcagtaataagcagcaaaaggatgaccaccgtctccgcaaacatggggtataaggaaatactcattttaaagcaacaaccgtgcctctttattcttcctcctcggcctcctcgagccatttgacgaaaggctccagagctttcacgaaagattgccttcctttttggtttgaacccttgcggaaccaaagaagtatggtatcttcagctaggacatcttgatcatacagtgatcttataatttcagggaacagcttcatcaacttagcatcctcataacattgtgtctggaccttgtatatgagttccagttctagctttccacttgtgcaaaatgcattcataagaccagcccaagcattcacctgcctaagtgctgaattagaattttgctgctggttctttccagaccactgaacagcctccatcagcacatcccacagcatgcgaacaacctctatatcaggaaatttagcatctttaacctgttgcttgacaacctcagttacttcagatatttcagcttcttcattgatcatagtggtcagagttgactttatctccttgagcttaact

SEQ ID NO: 32381 - DNA, 3834 bp, Triticum aestivum
  Clone ID: PAT_TA_32381
gtttacgctaccggtaccggtttcccggtccgaccccctccgcgcgtgctccgctccaagatccaaccaatcccgcaattcccttcgaggttgtttgtacgctcgacttgtcgacgagatcatggccggaaaaggagacgggccggcgatcggcatcgatctcggcaccacctactcctgcgtcggcgtctggcagcatgaccgggtggagatcatcgccaacgaccagggcaaccgcaccacgccgtcctatgtcgccttcaccgacaccgagcggctcatcggcgacgccgcgaagaaccaggtcgccatgaacccgatcaacaccgtcttcgatgcgaagcggctcatcggccggcgtttctcggactcgtcggtccagagcgacgccaagctgtggccgttcaaggtgatccccggtcccgccgacaaccggatggtatcgggcaacagtacaagaggaagaagtccgaggacatcagcggcaacccaagggcgctccggcggctgaggacggcgtgcgagagggccaagaggaccctctcttccaccgcccagaccaccattgagatcgactcgctgtacgaggggatcgacttctacgcgaccatcacccgtgccaggttcgaggagctcaacatggacctcttccgcaagtgcatggagcccgtggagaagtgcctccgggacgccaagatggacaagacccacatccacgacatcgtgctcgtcggaggctccacccggatccccaaggtgcagcagctcctccaggacttcttcaacgggaaggagctctgcaagagcatcaaccccgacgaggccgtcgcgtacggcgccgccgttcaggccgccatcctcagcggcgagggcaacgagaaggtgcaggacttgctcctgcttgacgtcacgccgctctcgctcggcctggagacggccggaggtgtcatgaccatgctgatcccaaggaacacgacaatccccaccaagaaggagcaggtcttctcaacctactctgacaaccagcccggcgtgctgatccaggtgtacgagggcgagaggacgaggaccaaggacaacaacctgctgggcaagttcgagctgtccggcatcccgccggcgcccaggggcgtcccccagatcacggtgaccttcgacatcgacgcgaacggcatcctgaacgtgtccgcggaggacaagacgaccgggcagaagaacaagatcaccatcaccaacgacaaggggcggctgagcaaggaggacatcgagcgcatggtgcaggaggcggagaagtacaagtctgagaaagttgtatttccctcttcatcctccgtttcccgcgtcctacgcatccaaccactcccaatcacgctgttcccaccaatgccttctagacagtatgataggctgaatagatcaccgagcgcagatacgacgaggccgaaagcggcagcaatccttacacgccgttctacaccatttgtggcttaagaatctggcaaaggatcgcggatgcccccacagccaagggctagaggaaaagaccgacttcaagccaaaaacccgaacaccatgctcgacctctccggcatcgcgcccgatcaaaagaggctcacactcaacaccgttaacgttgcctttttttccttctgtcttctgagtcctgcgggcccagacaagtatgggctccgagaacagcaaggccagattttccagcgattttagggggtcaggcaagaggaacatcaagtaaactggccagtaagactaggtcttcacggtgcagaagaggtcgtataatatcagggcacacgtccagaacgcaatcatcacctaagcccacaacatgacaacgactatctgcggagtcataattgtcttcgcactcttatagaacgacaacaagaagaccgcccccatcatccaccgccccacagcctgactacaccactacgatctcggtcaatttcacgactttgatcattcgcttaaacagctagaggacatttgcgaccataccatcttcttcaggtaactcatcgtcgtcagtcggtggcttgatcgccttgatgcttatgctccaaacagtttccttggtagtgtaactcgcccaaggctagtgcaaaccgtcgttgggtgaaatgttcaagtacaacgcctccgaaggttctcttaccatgatcgtaaaaaattcaagtaaattgtccatcgtattttgcctttctttaaaagtgcaatcagatcatcccaaactattttccttcagatattccttgaagaactcagtaatgaatgaaagcactatccctttggcaacaagattgtccttaagcaatggctgaaagacagtttcaggtggcagacctgataatttctgagaaaatgcaagtgccgtgaaaatggcaagtttctgtctctcattttcttcaaagaactccaaagactggagaaattttcgcataacattttcaagactctttattaagaaaggcctcctgcgcaatgttttctgaataaagaggacataaggtaatattgcttcacgttgtgctgcacagtcaatgagagaataggggtggcgctctccctcttcttcgggtttaatcgtaccaggctgagtacgcacaccaatgaaaacaacctcaaagaaagtgtcaccgtaacgtgagaagttgagatctgatgactctatacttttggcaacaagttccaggtctccagcattatccagataaatctggacaattgcatcagagaacgacgaagggtccaaaggagctgcgatattccgcttgcgggtcttaatccgctggcctccgagggtgggcttctccttcgagctcataaacaacgatctggcacggagaggagaggtgaaggagatcggggcttcgaggaggtcggttgtgcggccgccgaggcgatgatgaacggtggcagtggataaaaacctaggatccgaggaacatccggcaggtggcgcaggagcaaggagggcatcaggcagatgacgcgggggacaaggaagtacaagactgcggacgagcagcacaggaagaaggtggactccaagaacgccctggagaactacgcttacaacatgcgtaacaccatcaaggatgataagatcgcctccaagctcccagaggccgacaagaagaagatcgaggatactattgatggtgccatcacctggctcgacaacaaccagcttgccgaggctgaagagtttgatgacaagatgaaagagctggagggcatttgcaaccccatcatcgccaagatgtaccagggtgccggcgctggaaatgcctggtggcatggatgaggatgctccggccaagtgccgcaggcggcagcagcggcccagggcccaagattgaggaggtcgactaaatgatagatttagatcgcctactattctgcttgaataatgtgtctctcattgtacggtggattctattatcgttctgcagtttttcgttcgggcatatatacattgccccatcttatgtttaagttgatattgaaacatgattatttagtactaaaaaaaaaaaaaaaaaaacgcgagattggtccccctggccccgacccccctaatcactagtgaattcgcgccaacatgcccgggccgtgcctgagtgagtcgtgacagtttacttggttatctgcagttatttcccacttataatgtagttctcggccgaggagatctcctccatggtgctcaacaagatgaaggagaccggcgggggctaccttgggacaaccattaagaacgcgagcggcacccggcctggctactttaacgacttccaccccccccccagc

SEQ ID NO: 32382 - DNA, 792 bp, Triticum aestivum
  unsure (1)..(792): unsure at all n locations
  Clone ID: PAT_TA_32382
tcgtaatgctccatcagctggnanaatgggaatgaagctacaagnatctccatcatgtctaataacatcaccgagctttctttctcaccaaagtgcaaaaatgtcaccactctgttgatgcagaacaacccaaatttgaacaagatgagctatggatttttcagaactatgtcatccttgaaagttctggatctttctcatactgcaataacatcacttccagaatgtgatgcattggttgcattggagcatctgaatttgtctcacacacacattatgagattacctgagcgcctatggttactgaaagagttgaggcatttggatctgagtgtgactgttgcacttgaagataccatgaacaactgctcaaagttgcacaagttgaaagtgctcaatctcttccgcagccactacggtatccgtgatgttgacaacctgaatctggattctctgaaggaactactgttccttggaatcactatttatgcagaggatgtgctaaagaaattgaacatgcctcgtcctttggcaaagtcaacacatcgcttaaacttgaagtattgtgcagatatgcaatcaatcaaaatctctgacctcagccacatggagcaccttgaggagctgtatgttgaatcatgctatgacctgaacacagtggttgctgatgctgagcttacaacttcacagttgcagttcctgaccctgtcagttcttccctcgttggaaagtgtccttattgcaccaatgtcccataattttcagtacatccgcaaattgatcatttcacac

SEQ ID NO: 32383 - DNA, 602 bp, Triticum aestivum
  unsure (1)..(602): unsure at all n locations
  Clone ID: PAT_TA_32383
gcctaatccacttgaataccctaagaagaagagaaaacacatccctctcctgtcacgggaagctgaaccttcttacgaggaacgcagagcaagagtaaaagctaagtcagcaacatgtagttgagtggctaccttaagtagcacactaagagtttcgcctttggagatcggtgcggctgactagttgagtgtgataatcatcaagcatcaaggggcaatcttctcatcccaacatctctccttgaagcttttgttcttactgtgtgcagttctgggacgggctaaagtgttacgcgacgatggggaattgacaaaagaagttcattgttcagatatccttcaagctttgcgttattcaccaccctttgctacctaccagccttctgacaggccttgataactctgctctgtcttgttgttgctattgccatgcgattaaggtacaagctgcttactggattgtagagtagttgcatctaagcaacagttgtatcgctacaaggcagaattatttgatttcgcaagcggcaatgcttgcttgggccgtgcttggattaggtgtaaaataatacagaggtgttttcttnccaaaagattcataa

SEQ ID NO: 32384 - DNA, 1386 bp, Triticum aestivum
  Clone ID: PAT_TA_32384
ccctccgcccggccccacattacccagtcgaagcgacagcgttccaaacgctccaccaatctcgacagagcctaaaccctagctcgggcggcggcggcggcggtcatggacggcggcggaggcgtcggaggaggcatggggcccgtcggcggcggggtgggaggcatggtgggacccgtcggcgtcggcggcgggggcggcgggagcgacgtggagctcgtcagcaaaacgctgcagttcgagcacaagctcttctacttcgatctgaaggagaacccgcgggggaggtacctcaagatctccgagaagacgtccaccacgcgctccaccatcatcgtgcccatcgccggcgtcgcctggttcctcgacctcttcgactattacatccgcaccgacgagcgcgacgtcttcagcaaggagctacgcctcgacaccaaggtgttctacttcgatattggggagaacaagagaggccgctaccttaaggtttcggaggcatctgtcaatagaaaccgtagcacgataattgttccggctggtagctctggcgaagaaggttgggaagcatttaggaatgtactgttagaaatcaatgacgaagcttcccgactctacgttcttccaaatcatccaagtcagcaacacctggaacctccagagcgccttcctggcctttctgacgatgttggtgctggatttatagctgggcatggcagccaatctgcatctgtacccgaggtagatgttgatgggcctcctattgaagaatttagtggcatggggctgtctaaggtgataagggcagatcagaaaaggtttttctttgacctgggcagcaacaacaggggccattatttgaggatttccgaggtcgctggagctgatcgttcgtcgataatcttgccactttctggtttgaagcagttccatgagatggtgggacactttgtagatataatgaaggacagacttgaaggaatgacgggcgcgaacgtgcgcactgtcgagcccagccagagatgattagctcgaccttgtggcacttactgctgttatgcctcctctaggatttgtgtaagtgatgtggtgtgtggttgcgtagatcacgcagtattaattcatctgatggggataataatgtttgatgtttagttttttctttcttctgaattccgtggcgaggattgatttgcttgggaccttttctgttgaggaataataagcagtataatgttcgtgggtggtatatattggttactgcgtgaggcggagttagttttaggagtaggattgcttgtgttctgtggtaataatcgcaggcctccgcaaattgatatgtttcactttcatccgtttgcgttttgaaaaattctgagttcgatgttg

SEQ ID NO: 32385 - DNA, 557 bp, Triticum aestivum
  Clone ID: PAT_TA_32385
gggcctcccttcgagtttttttatcgtattattaagacgcaatatcagcatattgcagagtataccatatacacgaatgtagttctaacaatgtatacaatctacgccgtcacatatacaaattttaaacaatttaagaggagacctcttatttgtgtgaagactgaagacaaaactaagccacctgcatgccatacaaaagccattgaaattgggtttctgtcagattggaatgaagtacttgctgtccagacatgccacctcctccctattttcccactgcagtttctcccaccattcaactgaaccacatatctgcttcagtttcccatagttatgcgtgcagcttagcgggatgcttctcagatttgggcaatcctccacccgaagggtctcaaggcatgggaattctcttggtttacaaatacttctcagcttcttaagtcccgtcaatacgatcaatctcaactttggaaagtcactctgccctgtgtcattccgtgaagtttctaccatagcatgatcttcttgttcatctgaagcatgatcctgcattt

SEQ ID NO: 32386 - DNA, 2020 bp, Triticum aestivum
  Clone ID: PAT_TA_32386
ttttttctagatatgcatgggcgcaaagccatcacaaattacccaaagcaagcacaatagagcagccatgaatctacctatgatcataacttcataagggggtctcgatacctttgcttccacgtggaacatatatgtacatatctatcttcctcccggtacatatacgcatattcatcgcagtgtttcccatggacaaatctgtactcaccagcggtagagagtagtaagtaggaggatataccattgccgtagctacaacagggcgacgtttttccttttttacagaagaactggccgatgtaccgatcgagctgagcctgcctactcctccctggggatccaccggctccaccagatgctcttgcgctggctcgtaagctcgtccatgctctcgctgatcgtcctcacgatcttcctctgcacccgcagcatcgacgccagcacgttccgctgcgcgctgtccttcttcggcttgatctccctgagctcttggagctgtgcttccgtgaagccaccgcccgccttttttcccgatttcgccatcaggccgatgatccatcgcgccgcctcgctgcgctctcgcgcgggcacgcgggccgggggcagcgtcgggttgcgggcggcggaggggcccaggggctcgatgctgtggatgagcgggtgcgcgagggaggccgtggccctgctcctttggcgtgcggtgcgccgcacgatggatgtcaggagctcccatccgataccaccatctaagtccaggatgtcaaagcccctgcggaggtctggggtggctcgtggttccaccaagttcctccaggcttccaggtcgtagttgcatctcttcagttggcggttgaattgtatcaggctgctgtccgttctcaacgctggaaatgccatctgcaggtatatgaggcccaagctgtatatgtcaaatctgtcaggaaggttcagctgccacaggactggagatagagcagttgcaactggagcagagggagcagatggtgtttgtgtgctcatgatatattgctccggagcagcataccttggatccaaaaggaactccttaggaatatagttgatgcccactcgtaaatcagctgctgctccaagatcaataattttgaaggtacgagattcttctgaaaatatcacattttggggttttatgtccctgtgaacaatccctgtcgaatgaagtccatctagagcaaacaagagttgtcccatcaccgtttggacaatcttattctctctcgctattcccttgggcaaatcttgaacatttccgagaatcttagtctcgacattgtaagggaactccttgctttgcatgagagcagaaagcgtgtcctcgccttcatagcgccaaataagccagtattcctcacccttacctttggttttgctctcacgaaagccgtaaagaaaatccgcgcagctgctagcgcatgccctccttacacgctcattcatccagatctctactgcgccatactctgtcgccttcttcacgaccacatcaccttgcttctccgcggctttggggtcggccagggacgccttgtacacgaccccgaacgcgccctccccgagcttcttcccgggcacgaagtcgtccttgcggaaggtggggcggaagaggcgctcggcgaaggcgaggacgaacatgtcgaagaagcccggggcgacgccgggggtggcccagaggtaggaggcagcggcgagcgcgagcgcgaccccgggggcggtgatggtgaggccgtcgttgtggggcagcgtgctgcggtagatgacgtcgccgcaggccatgacggtgcagggcaggcccacccccaccgcctccaccagctgccgccccacctcggccccgagctccgccgacgccaccaccggccggaacgacgacgccgcggcgggggccgcccggcggcgccggcggaggcgggtgtcgtggccggggaggaaggaggtggagaggccgaggctactggtggcgccggctgttttttttctt

SEQ ID NO: 32387 - DNA, 659 bp, Triticum aestivum
  Clone ID: PAT_TA_32387
catgaaaagccctttcaccattgattgtcagacaacagccgtcttcagctacagttattacaccaacaaatgaagatccaattccctcaacaacaacaaaaaaaatgaagatccaaaactttgtctaatgaacatattatacaaaccctaacagcgggcgcgttttgccgcgaaccggcgaaacttttcagaagcgccccgtttcggttttcaggcgattccgatttctacatctttgacaggaacgacagggaaaaaatgtaatgaatgtaatgtcgatgccacatgatctccggtggaaaggatatcatcgtgtcgccgctatctgcgtgatcctcagttgcaagcagctctcgcttcatgggattccgtcgtggagccaccgccgcccatgttcatcagggtggtgaggtgggggatctccttcggcaccgacgccgtcaacacctcatggccgttctcggtgatgaggacctcgtcctcgatccttattccgatgccccggaacctgtccggggcattctcgttgagtatcgggacctggggaatgtagatccccggttcaatggttattacaacgcctggctccaagggtttgtctaaggtgaggctcgtggagtcatgtatatccattcccaaagaatgacctggatgccagc

SEQ ID NO: 32388 - DNA, 422 bp, Triticum aestivum
  unsure (1)..(422): unsure at all n locations
  Clone ID: PAT_TA_32388
gtaccgggccccccntggggngtttttntttnttttcangcaccnaggnacgtaagttccggtgacttatatttgttagcttaattggcaccatcatgaatcgtacatgcatagacaggaactgaacatatcggagcgacaggggcttcatacatgaggaacgctcgaaacagcctgctgcagggtcttgcggggcggcgcaagcgccgttgtctccaagggcgggggtggcgacgcaatctcggccggagcctccaccgggttctggttcccgggcagtggcgacggcggagtccttggctcacggggtccgtccggaacaacttgggccgccgccgagcatgctaaccaacagcagatgagtgccaggaggacgacaccgcgtgccatggaaaaaaaaaagcgctcgatgatcctttcga

SEQ ID NO: 32389 - DNA, 456 bp, Triticum aestivum
  unsure (1)..(456): unsure at all n locations
  Clone ID: PAT_TA_32389
cggcgccatcagctggctcgacaccaaccagctcgcggnggtggacgagttggaggacaagatgaaggagctggagggcgtctgcaaccccatcatcgccaagatgtaccagggcgctggcgcggacatgggcggcatgggcggtgccgccggcatggatgaggatgcgccggccggcggaagcggtgcgggccccaagattgaggaggtcgattaactggtggcggtggtgattttggcggctgggagagtacgaaagtgtgaactctgaagtgttaagtttgtaaagtgtcgtcgtttttagattttggctgtttcgcaaggcaattcttaggtgtggtgaatcgagagggggaacccaaatcttgatgtgcggggcctaagattgatgtcggtgttgatgtaatcctgaacttggatcgatttatgtagctggcgttgtaccggtggttgctc

SEQ ID NO: 32390 - DNA, 403 bp, Triticum aestivum
  unsure (1)..(403): unsure at all n locations
  Clone ID: PAT_TA_32390
ggctgccggtggnacgtggcgagnataggaggctgccgacggagcgaggcgaggcagggcaggaggcggccggcgaagcacggtgagtcggggcgacgcaagaggcggcttgcggagcgcggcgaggcgggacgggacaggaggcggatggcggagcaggaggcggggcagagcgcggagaggcagaggcgcggctgtttttttctccttcgtaccggttcgggctgacttatcacgaggactgcgggttgaataactacaacagcagggacgtttttgcaaaaacaccgacgacgtacgacagaaccctaatttgctttattattaggtaaagatatatactagtaaaagagcccgtgcgttgtaacaggagagaaaacataacacacactcttaactgaac

SEQ ID NO: 32391 - DNA, 442 bp, Triticum aestivum
  Clone ID: PAT_TA_32391
tcggtgcggcgcggcgcacggccgagcgcggacgggacgacgagggcgggcgtcagcgacagcagcgcaagccatttcgccggtggaggagcgggtgcggcgcggcgcatggccgagcgctctggccggccatgagccagggggcaagccccacgggagcgcgagcggcggtgtcaaggccgcgtccagaggcgtgctgagcgccccggatggcgtctccagcggcgcggcgcggatggtcgggaggcagccgagcggctgggcgcgaggcccgcgcggcgcgggcgcggccggcgctggagcgagggtggcctcggcgagggcgggcaccacggccagcgagttggttggccttctcgctcttggcagagcaaagtgcgtgataacatgttgagagaaaaatgaatcctctatctctttcattagatgattgtaagcattt

SEQ ID NO: 32392 - DNA, 238 bp, Triticum aestivum
  Clone ID: PAT_TA_32392
cggacgcgtgggtcagatttgagagaagatcaagcaagtatgagaaaacttcagctatcaccagcaaagacttgcatgtaacctgttcttggctgtatgaaatggagagcttgtaaagaagaaacgttgtgcttgcgtacgtatatatatcctgttgtagcctaacggctagctcagtgagtaacggctacctgttttgaaagcacacctttcaaaataataatattataatgctctg

SEQ ID NO: 32393 - DNA, 1186 bp, Triticum aestivum
  unsure (1)..(1186): unsure at all n locations
  Clone ID: PAT_TA_32393
nngggattgatttcgagcggccgcccgggcaggtacttagctctaacaatcttgaaggcctcataccacccaacataggaagcctccaacagcttacagttttaaattttagccacaataatctccaaggtgagatacctcagattagcgcccttaaacaactcactactttagatctttcttcaaataaggtcacagggcatattccagattctttgggccaatgttccggcttagtgagtctacaaatggaccaaaactttctgtcaggaaacatcccaacaacttttgggaaactgttgtctctgagtatgctaaatctttcacacaacaacttgtcaggcgccatcccgttagctctaagcaaactagagtacctcggccgcgaccacgctatcatataatgatcttgacggagaattaccaaggaatggagtatttggaaatgctacagctgtttcagttgagggtaattgcgggctttgtggaggtngcgggtgggtccttcacatgcccaatgtggtcgtggttgtttccttggggggccagagggcacaattcccttttgtcagagcactgattccattatttggattcacgtcagttgtaatgctaacttacattatattctttgggaagaagacatcaagaagaacatactcaattttgctttcttttggcaagaaattcctagagttgcttacaatgatctagctcgagctacagggaatttctctgagttaaacgttgttggaagaggaagttatggttccgtgtacagaggaaagttaactcaagctaaaatacaggtggctattaaggtttttgaccttgatatgaaatgtgcagacaaaagttttgtaacggaatgcgaggttctgagtagaattcggcaccggaaccttgtacctatcctcactgcatgtttgacaatagacaataatggtgatgctttcaaagctctaatttacgaattcatgcctaacgggaatttggacacatggctgcataatatatattccggcagttcatcgaaatgtttgagcttagctcaaagagcaagcatagctaccaatatagccgatgcattggcttatttacacaacgattgtgaaaggcagattgtacattgtgatctgaagccaactaatatccttcttgacgatgatatgaatgcttatttggg

SEQ ID NO: 32394 - DNA, 604 bp, Triticum aestivum
  unsure (1)..(604): unsure at all n locations
  Clone ID: PAT_TA_32394
aagaattccacgattctagtggcggtagcggggaggcacnttttgaaggtgtagagatttgcaacttcaatttggacggtgcacactatatgatntatacaccagtcgatccgnttttntttgtcgcggtcaaggacaaggacggtgtgtacgcattgctgaagatgatctgatggacgaccccagcatcgtgagcgccatggacgaagagacggagttcacggcattggtggaggaggaggaggcccttctcgaatcaatactgcacggcgacgatgatgttagctgatgcttactttcatgatgggaatgtgaggatacgtagagtatatgttcgtgagaaggattctctttggagaatgtgttgttagatctcgcgtagagagtacgcattttgcaggtagggatgatacacatatcgttggtgttgttgtatgtgtttgtaaagcgagtgtaggttaagaagaagctgcaggacttgagtttggagggtgtaatggtagatagttttgtttgcttgttatggcagttgcccatggtgaaacaaaacagacattatttgtctatgagttggagagattgatgaatgagtggatttagtagt

SEQ ID NO: 32395 - DNA, 548 bp, Triticum aestivum
  Clone ID: PAT_TA_32395
gcgttcgcggccgcgtggggcgcgtctggtcgccggagctggcgcggctgatcagggagacggcggaacccttcgtgaacgtgatctacgacgcggacccgctgccgcggctgtcgtgggcgggcggcagcgtggcgctggtcggcgacgcggcgcacccgaccaccccgcacgggctgcggagcaccaacatgtccgtccacgacgcccgcgtgctcggggagtgcctcgcgaggtgggggcagacgccgccgccacgcgctctggccgagtacgaggccgcgcggctgccggtcgtggcggcgcaggtgctgcacgcccgcaggctcgggcggctgaagcagggcctgccggtggaggacggtgacaccggggctttcgacgcgtgggcggcaacggcggaggatgctctgcagttgcggcagaggggcatgccgtattttggcggcgcgccgactgttgacggcggtagtttgtgagttacgaattttgatgctggactgccggtgaatggacacaaatctatatcatggtactcagtgtctagt

SEQ ID NO: 32396 - DNA, 660 bp, Triticum aestivum
  Clone ID: PAT_TA_32396
cagcgatgttgtttgctctttggtaggagcacaggtgcttttacaatctgggacattgagtttggatctcaaggaagatctgcacagtgagactgactcacacccatccatggtggagcccggggatgaagaagcaagcgaacatctgaataacacacatggttggcaaaataatgaagccctgaactctaccagcgacgaacaaggaaaaggaaatatgactgtgggtaaactgatggaagcttatgaaacttgcatcgctaaactgcggaagtcccaatctagccgtcgtaaaatatcactaaagaaagtggaggaagcaaacttctcaaaagaggcacggaagctggtccccgaggcaattttgaaacaaattatctcgctgaacagccttgacatggaactttatgaccatgctaagaaaatctttacccaggaacatctgatgctgaaagctcagcaatccatggcggggcagcacagacagttggcggaacaagaggagggctggatcggcacgatgtgcagcgacgggacttgctctccctgggtggtggtcttgctgggtctagggatcaccacgatcctagttttggccacattagctgtaacgacgagaaaaagaacgtctaaacttaaggtttaaccagaactttcatg

SEQ ID NO: 32397 - DNA, 714 bp, Triticum aestivum
  Clone ID: PAT_TA_32397
tcgcacaccaccaccgtccggcgaacacatagcagagaagctgtcgtgcggtgggctccggccgagcaagcttgcagaggtgactgacctaattgatggccacacggcgatccctggaacccagtgcgcttgtgctactagcagtacaattactgctgttctatggagctggtaacgcctattgctctgtggtatctgacaacaccacggatcgactttcattgctcgattttagaaaggcgatcacagatgatccaaatggagccttgcgctcttggaacgacagcatctaccactgtatgtggcggggcgtcaagtgcagcaaaagccacctaggacgtacgtgttacgacagtggatgttagagtaatccaaacaaatacgtgttaggtttgatagcttggttaagtgtaatcatgatcaacctgatcaggtgattaactaggtaagttttcgatgtacatgtaatggctggcttgcacgccgtgtcctagtttgagcagtagtagtataggaaagtttagttccgagtcggtttgaagtttcctactactagtacatgtacgtgtgtcaggtctagccgtccatgttaattaggaatcttttagcaattgtgtccggattgggttagcagtcaacatacgagtaggtttggagtttagtcgtggctgcacttatataagcagcggtagtcttgggtttgtaacaccagag

SEQ ID NO: 32398 - DNA, 533 bp, Triticum aestivum
  Clone ID: PAT_TA_32398
agtaactctaaattctgtattaaaaaagtaaccctaaattctgcaagttactccgtgtactcgtggctgatttcacttcttctcctatttatgcctactctcaatacaagggataaactcaaacatgaaatcatgacccattgtaaaccactctagtgaagcatgacttgctctcacttggttgctctaatgtacgatgttctaattgaatgcaacttattggttgcttctcttatattcatgcgttcccctgggatctgacatgtacaggaaagagcaacttgcatgagtgataacaagcatccatatgtcacattttctgttccaatgttcgcttggatatagcccttgcattccccacgcaagcacacatcaataatatctagtatcttatctggatagttcctctccacaaagttgaccatgttgagttcgttctcaaacatagggtctgttggtcttttgccaatgagcatctcgaggagtactattccaaaactataaacatccccacggattgatgcatggccact

SEQ ID NO: 32399 - DNA, 831 bp, Triticum aestivum
  Clone ID: PAT_TA_32399
ggaagaaatgggatattccattgcaattattaattctgtacatggtaatggtaataaacacaaagagactaactgacaagttagtgatggcatgatatgtacacatttcatgttaggtgttcaagcatcagttgcttatgtcgaagtacttgggatcagcagggaagtcatgctcaacccggagctcgccttcgtctgaatctgagtgcctttgaggaaagacaactctaatatcattgtagagataaaatcgcttctcttcctcggtagcggtactccgattgagtggttctgatgacatgccaggtttggtccgctgcatcgatcttgatgatttcttggaaagggggctcagaaaacgcaggtgcaaagcataacgaagaacgcctccagctgaactatcattcactttggaaggtctgcagcaagacttcttttcactgtctatttgacagcagcaaccattggcattagtccgactttctgagctcccaatgggactcgattcatttgattcgctaatgtcacattccatctcgagcaacatgttctgttggtgtgacctcccttctctgattcatcagtcaagtagcagttctgcccctgttcacagccttggttccagcaggcatgccactcaaatcatagttgcaaaagaaggtgtgcagcggtgtcttctctgggttactgaccaccagctgaatgcgccctttaattgggatgtgtaagcgacttctcgatgatcttgaatcattattgttggagcttcttttaagttttgggcttttgctgttgttagtaggcaacctcccagcaagatcaatcgacgaa

SEQ ID NO: 32400 - DNA, 502 bp, Triticum aestivum
  Clone ID: PAT_TA_32400
tcgttcacgcgtccgcccacgcgtccgcccggaccagagcaagagagagatttcccccgattcgatccgatcagatccgagatctccatccccgatggcgtcccggagctgcaccttcctggagatcctgctcgccatcatcctgccgccgctcggtgtcttcctccactacggctgctgcagcatggagttctgcatctgcctgctgctcaccatcctgggctacatccccggcatcatctacgcggtctacgtgcttgtcgcgctcggctcggaggagcgggatcgggactacgacacccttgcttaataatcctgcagcaactcgtattgtgtgatgaacctctcgcctggtagttgcgaatcgacgtcgtgtgttcccatctggactgtgtagcgtgccttctttctgtcagcctgtaaatgcttaaaccatcctccccttcgctttcgccgtcctggaattctgatacgacccgatatatttcagcagcttcgaaga

SEQ ID NO: 32401 - DNA, 710 bp, Triticum aestivum
  Clone ID: PAT_TA_32401
gcgcgcccggcccacaccaacaaatcccccgggccacagacaaaggacggagttcccccgatgcgaaccggtcggacccgagctagcgagcgcggttgccccccctccgatccgagttccgcgtcaccgatgccgtccccgagctgccccttcctcgagtccctgctcgccatcatcctgccgccgctcggtgtcttcctcccctacgggctgctgcagcatggcgttctgcatctgcctgatgctcaccgtcctggggcatctccccggcatcatcgacgcggtctacgtgctcgttgcgctcggctcagaggagcgttgatgcgggactacgacacccttgcttatgtaatcctgcaggcaactctgtattgtgtgatgaacttcgtgcctggcttgttgtgagttcgacgtcctgtctttccaatcatggactgtgtagcttgccttattttctgtcatgcctgtaaatgcttaaaccatccccccatttcggttttgccgtacctgtaattctgatacaaccgaatcaatttcagcagcttcgaagatttatgccagtggtttacatgagaaggttctgtaacaggagttacgagccgaggtaattcccgccaccccttgttgcgtggggatctttgttcagtcggactgaattttgtgtgctatatatacttcattgctgatagggcccccccataagaaaaaaa

SEQ ID NO: 32402 - DNA, 707 bp, Triticum aestivum
  unsure (1)..(707): unsure at all n locations
  Clone ID: PAT_TA_32402
ttgggnagnatcatagagagagccagccatgtacactaccaagaggtgcattgccacggccatcgtggtggtgctctggctccaggccgccgcggacgcccgccgcctctcccccggcggcgtgatccggcttccgagcgatggcagaggtgattttgttgatcaagtcgggtcgtcaaaggtgatcagcatagaggatccattctatacttgcccggatggcaaggtgctgaaatgcaaagtcattgcgttccaatggtattgcgattgcgtgcgtgaaaaaggtgttggccccactgatcaagccatgtctgcgacgacgagctcgccaaggaaggtcggtgaggagatgctgtcgcgaaagaactccggcgacaaaggtggtcctaccgatcaagtccaagtgacaaaggtgctcaacgatctaggggagccgtggtggccgtgtccggacggcacagtacagaaatgtgaactcgttgcattcaaaatatactgcaagtgcgtgcctaaagacggtgcaggtctcgccgatcgatccatgtcggcgcgggcgcactcggcgaggaagaaggacggcgcacggtaactagctagcgcgtacgcccacgctagcaatatattccctgccgcgtcttaaattacttgtcttacattcgttcagatatgttgagacgaaggtaatatacgtaaagcctgttttagcc

SEQ ID NO: 32403 - DNA, 678 bp, Triticum aestivum
  Clone ID: PAT_TA_32403
ggctccacttaatgtcagcttttcgctgacaattccccgaccaactcgtcatcttgcctggctagagagagcttggcgcttgctccccggtcgtctcttcgctcgctggtgctgctcatgtcgcacgggaagccccagctgagcgcttttttctcctccgccgccaccaccgccgcgcccaaggccgcgaagcctccagcagctccagccggtgatagtccggccaccgaccctccagccgctgcagcttcgtcgtctggatctggctcgactcacagcgcccctctggaatgcccaagcagaagatttagacatgttgaacttgaacctgaacctgagggctcatatcacacacttggacatgaaactgacaagattccgcctggcgccaccaaggatccggagggcccaatatccgagggctcatgcggcacgcctcaacctgtatcggacgatccacagcctggacctcgcaaagacccgaggcacagagttcctgaagacccgtagggcctgtgcgatgccggagaagttgagatttttcttgtgctcatcacatccagatatagcaatagaattatccgttaattgtaattggctcctacacatcatgtattcccaaattgttagcacccgatcccttatgcatcttatttattgatattgatactttagccc

SEQ ID NO: 32404 - DNA, 572 bp, Triticum aestivum
  Clone ID: PAT_TA_32404
ccccgcgtccgggccttcagcgccccgccggacgagcagctccgcaagtcctacgcctgctacctctccacgtccgccggcccggtcatgggggtcatgtacctctccaccgcccgggtcgccttctgcagcgacaccccgctctcctacgaggcccacgccggcgacaacacggaatggagctactacaaggtggcgattcctctgcaccggctgagggcggccatcccgtcggccagcaaggtcaagccggcggagaagttcatccagctcgtgtcggtggagaaccacgagttctggctgatgggcttcgtcaactacagcagcgccgtcgtgcacttgcaagaagctctcagcggcttccacaacctgcaagcgtgacgacgacgacccgcatcgcgcacgcctttggtctgtctgtggtactggtgttttcgccaatcgtcgggcgtgggagtgtttctgcagttcctactgctttcttttttttgggtgttgcagaggagccgagtcattgcagcatgctgtttactaagagcattcacatgatcgtgacattattatttgcgctg

SEQ ID NO: 32405 - DNA, 559 bp, Triticum aestivum
  unsure (1)..(559): unsure at all n locations
  Clone ID: PAT_TA_32405
gcttacgagacacagttatattgagcatatggctgactccgatcacaaggacgcgatggacaaagcgacccatgccaagtccgtccctccacaacagttttataggactttcccgaacaactcagcgggaacttatcctccaccaattgccccgaataaagaaccggttgccggtgcgatgagtactggatcacagccttcactaaagaacgatgagaaccctgcaccttttggcacggagtaagtgtaacaattctataagacgaaggatccacatacacaagtacgtcatgacatgcacatgagaacaagcatccgagcttcaactggcatactatatatctaaaataatatgtattatgtagcaatttgttttgatttgtgcagctatgaggtgcaattagaaaaatggataacaatttgatacatctagtggtttgtagttgcatattggtgttgtgttgaatatgtgagttcatgtgtaagttttgatatatcaagttcacatatatgtatattaagattttgagattcattgatttggngtaaaaaaaaaaaa

SEQ ID NO: 32406 - DNA, 1295 bp, Triticum aestivum
  Clone ID: PAT_TA_32406
gcagcaaatgatgttccttattgcctgcggcgacgatggccaccgtggcggcgaccatggcgacgccgacgcgccaccgccagttccgcgtgcgcgccgcctgggacatgaccgcgggcgccgccaccgtcgccgtgcccaagccgtcaaaggacaaacccaagccagccctggggcagtcgccggcggcggcgaccacccccgcacgcgcaccccctcccacacacgccgacctcttcgcgcgcagcagcgaggaccaagcaaagaagagcacgtacatggggtttgagaagtggtggttgccgcctgcgccagaggtgaagaaaccccgttcactctacaacgcggcatcgctggcatacttgggggactgcatatatgaactctatgctcggagacacttcttctttcctccactgagcatcaatgaatacaataagcgtgtgatggatgttgtgaaatgtgaatcacaggatctgctgctgaacaaactcctgggagaggattttctaactgaagaagaaagggacatacttcgttggggaaggaacatcgttagcagcaaaactcgtacaagaaaacgggcaggaatcgcagtgtacaatcgagcatcttcacttgaaacactgatcggatatctttacctcacgaatttcaagcgcttggagcaaatgatgttccagttaggattcacaagtggtgcttcgtcacagaatattgcagatgagctgctctcaagcttccagaaaacaacctcaacttctgtacaatctcagcaacctgcaaagcgatgagcagtttcagtatgtaatgaactgaaccggagtttctttgatgacagagcgactgatacaagcatgcgcaacttgcggcacacgtgttccaaaagttaaacttaaaaggaaaatgagtgaatgttgtttgtgtgtaggcaagatcgagttagttgaggaacatatatgatcgtgcatactagaggccatcaagaggctgatgattctgatcggaagattgtggcacatcgaggtcatgatgattctgatccgaagattgtggcacattaaggtcatgagcacaattgagacccaagctttatgtggattccgtgtaagatgtgtgatctatggaatgaattgatgttgaatgctgatataatctcagtttattctagggtatatttcccatttttattaaaggtgagtcaaatttatgttgctttgtgtgtgtcctgttggtgtgccccggagtggcttgtagctccggattgcctagtgactactccctccgttccaaaa

SEQ ID NO: 32407 - DNA, 672 bp, Triticum aestivum
  unsure (1)..(672): unsure at all n locations
  Clone ID: PAT_TA_32407
gcggtacgtagtcagcatgtgagccgcgaacgcctcccgtcccaaatcccaatgctggcgtccttcacggcggtggtgagcgggtacaaggagcggtcgctctcgcggtacgcgcgggtggggcgggcgctggtgctgtacgagatcggcgaccgcgacgagtccatcacggagatggaggacgtgtcggtggcgctcaaggggtacccggagatccacgccgcgctggcggcggcgctctacgccgacaagcacgcgccgctgctggccgagttccagttcaacatcgccacgctgctggacccgcactactccgacctcgcctacgtcagggacaccaagcactggccgcccagcctcgtcgcctccctcaagaacttcatcacgctcacctagcctccccctcctcctagtcctaggtaccatcactatagataatttcttgctcatctttcttcagttcctctatcatatactgtataccgatacgtagaactaaattgtaccctccaattcaaaaaaaaaatatactgtaaaagacctatgatgtctgaaatttgtaccatgtactacttcctccgttccataatgtaagacattaagacattttttaacggccnncnttcctcaatnccncnatggatggacccctnggnataacggggttgttcc

SEQ ID NO: 32408 - DNA, 462 bp, Triticum aestivum
  unsure (1)..(462): unsure at all n locations
  Clone ID: PAT_TA_32408
tcccgggtcgcccagcgtccgagaactcaaggaattgacgggggcccgcccaggcggccggagccggagccgaggccaggggcacgaaaatggcgtcgatgcagagctggcgcaaggcgtacggcgccatcaaggacaccaccaccgtcagcctcgccaacatcaactccgacttcaaggatctggatgtggcgatcgtgaaggcgactaaccacgtggagtgcccgcccaaggagagccacctgcgcttcaaggctccggcgacgtccatcgcgaggccacctacagacatcgcctactgcatccacaccctctcccgcgcactctccaagatacgctccttgattgcactgaagacacttgttggtatgtggtcataggcttntattagagtgcgtttcttttttgtttatgagctttttantttttccnctgtgtggtttttttttttctttttaattt

SEQ ID NO: 32409 - DNA, 2531 bp, Triticum aestivum
  Clone ID: PAT_TA_32409
cgcactgtcacacccgcccgcgtcttcgcgaaaccgtcgcgaacaaacacccaaccccgcaccccaccccacccccaaagacgacacagcaagcgagcggcggcgggagccggagccggggaaggggcacgaaaatggcgtcgatgcagagctggcgcaaggcgtacggcgccatcaaggacaccaccaccgtcagcctcgccaacatcaactccgacttcaaggatctggatgtggcgatcgtgaaggcgactaaccacgtggagtgcccgcccaaggagcgccacctgcgcaagattgctgcggcgacgtccattgcgaggccgcggggcagacatcgcctgctgcaccccgccgctctctcgcggttctgtccagcgactggcaattcctgaagaggcttcgtacttcacatataatccttacaaatgagatgtaaagttcctgaacctgctccagacttaagaggaaaggccaccagttgaataacctgttccaggtacagcccagccctgaagttgtttcacctcctaccaaggctcttgtggctgatactggtgatcgcttggtcttacattaccggagccctggtgaatcaagcatgaaaggctagaaatgctcttgatttggtccataggctgacctcttgttgcaagaacgtcaacaactggacaggcactgattggcaagataaaggatttgatccaacaggatgggaactcgcccttgttactgctccaagtaacacaaattcatctgctacagatagtcaattgggtggtggacttgacaagctcatcctggacagcctttatgatgagggggcctacaggcagtcacaacaacagcagttatacggttcatcagctcccaacccattcatgacaagcgatcctttcgcgatgtcgaatcacgtcgccgccccgtcgtcagttcaaatggctgccatgtctcagcagcagcagcagataccaacgatgatacatcagaatcccttcggaccaccagttcagccgcagcatccgggcgctggcgctgccctgcagcagtaaacccattcctggatagtggcttcggcgcgttcccggcggcaaataactcgcaacagcaagccaacccatttggtggaagccttctataggcttgcaataggcgaggagctaatagtataccccgagcaaatgcgattttcgtgtgactgtaatatgcattgcgcctggctctattcatgtatgtcaaaatctgtgtaacgatatgtgtattcgcttcggcacacgggactctgccaagtgacccttgcttgtaaagaaaacgtagcggcctgtgtaacatcagatatatgtcaataaatagtaggacgttggctatatatagaacagaaggcgaggatttcgctcgtgctccaacaggaggggaactcgcccttgttactgctccaagtaacacaaattcatctgctacagatagtcaattgggtggtggacttgacaagctcatcttggacagcctttatgatgagggggcctacaggcagtcacaacaacagcagttatacggttcatcagctcccaacccattcatgacaagcgatcctttcgcgatgtcgaatcacgtcgctgccccgtcgtcagttcaaatggctgccatgtctcagcagcagcagcagataccgacgatgatccatcagaatcccttcggaccaccaattcagccgcagcatccgggcgctggccctgcagcagtaaacccattcctggatagtggcttcggcgcgttcccggcggcaaataactcgcaacagcaagccaacccatttggtggtagccttctataggcctgcaataggcgaggagctaatagtataccccgagcaaatgcgattttcgtgtgactgtaatatgcattgcgcctggctctattcatgtatgtcaaaaatctgtgtaacgatatgtgtattcgcttcggcacacgggactctgccaagtgacccttgcttgtaaagaaacgtacggcctgtgtaacatcgatatatgtcaataaatagtactaggacgtaggcttctacgggagggcgatcctacatttggggaagagctatttaattttacacggagggggaggattctgcagctctcaaacttcaaggatgactccagtccaattgcctgggactgttctgcgtgggttcgcacatatggtcagtttttggaggaaagactggaatgcttcaggatcctgaaatatgatgttgaggctgagcgtttatccaaacaaggccaaggtcctgaaaagggacacagtagaaccagagacctagattcccaggacctgttagagcagttgccagctttgcagcagttactgtatcggcttgttggatgtcggccagaaggagctgcaaataacaactacttggtgcaatatgctctagctttggtgctaaaagagagtttcaaaatttattgtgcgataaatgatggaattattaaccttgtcgataagttttttgagatggcaagacatgaagcact

SEQ ID NO: 32410 - DNA, 172 bp, Triticum aestivum
  Clone ID: PAT_TA_32410
cacgccggtcgtcggagctttcttggccgattcttattggggacgatactcgacaattgcaatcttcctctctgtttacatctttgtaagtgaggcaaccagaatgccatccgatcagtttaatccgcaacgtttctgaatttactgtaaaaaatgctgtgcaacatttctg

SEQ ID NO: 32411 - DNA, 637 bp, Triticum aestivum
  unsure (1)..(637): unsure at all n locations
  Clone ID: PAT_TA_32411
tttcccccgcgtccgcggccgcgtgggcgagnagtaagtggtggctgcacctccacagtagcagtctcctgttcagttctgctcgccgagaagccaagccatggctgtggtggagctcaaggtcgggatgcactgcgacaggtgcatcaagtcgatcaagaaggcgatcaagacgatcgatgacatggagagctaccagctcgagaaagaaacgaacaaggtgaccgtgacggggaacatcaccccggaggaagtggtgaaggctctgcagaagatcgggaagacggtaacttactggggcgagtgaagaacagagcccagaggaagagggaacagacggtaacatagtgctgctggggcgaagactaaagcgcacggaatcagctagctagctagttactgtatttaccatgggatatcaggagctatttgtactgcagatcgggtaattgtggtgagtttctttgaactgctagatgttggttcttccctcgcttgatcatatattgaccgcggcgtcgtcgtgttgggttagctcatctgtactcatggcaaaatcttgtagaggatgaacccaatttttgtacgttttcacggggaatatatgtatgaaaagagtgatatgtttcagactttc

SEQ ID NO: 32412 - DNA, 985 bp, Triticum aestivum
  unsure (1)..(985): unsure at all n locations
  Clone ID: PAT_TA_32412
gtctcacatgcagcaatgcttctgatgttcttaagtgtgcatttgacttgacagaagctgcactcaatcatcagtatgagggttgtacagcaactgtccttcttatttgcttgggtcgctactttgctggccccgccctgtgcgctattcggggtggctcggcggccatgatgtgtgtccccgggaaaccaattgcgatgacagaggatcatcgagtagtcagtaccacagaacgagcgaggatagcgaaattagggaatcccctgaaagatggcgaaagccgtatatgtggactgaatctttgcaggatgcttggagacaagtttctcaaagagcaagatccaaggttcagtaaggaaccatatgtgagcccagtagttcagatctcgaaatcgtgctcagcttttgcgcttatcgctagcgatggcctatgggatgtcattaccgcgaaaaaggcagcacagcttgtcctcgattataaggagaggaacatgggccaagaaatctcagcggacggagtagcagaccatgtgcttagtgaagccaggaatctgcggacgaaggacaacacatcggtgatatttttagacttcgacgccatgaggatgggtcgctgaactgccaattgattcattcagtctagagagaaaccgccccgctcggctgcttcagccccattgttttgttctttttcccttagattgtttttactggtggtatggctcctatccagcacttgagagtctgcgccttgctccagaggccaaatacaaccaacagtttttcttgtctgcaaccaaattacccggggagctgttttgtgcggctgtgcctgtaaaaattgtgaggcgatgttttagaggaatgttgttgaactttgcatcctgggatcatatatacatgctttggaaaaanaaaaacacccgggggggggcgggtaccaatcgcctaaagtgnncgtatacggngccantggcgcgtttaa

SEQ ID NO: 32413 - DNA, 575 bp, Triticum aestivum
  Clone ID: PAT_TA_32413
tcggccgcgtgggccgtgacgctgagggacgacgagaacgtgtacatgacggtggcgaggccggagaaggcctgggccggcggcggcagcggcaagaaggcgccggaggcgctggtggtggacatcacgctggacccctgcgagtacgtcaagttcgacgtgctggttaacgtccccaagggccaggagtacaaggtgggcccgcggaacgccgagttcgccggaagcttcacgcatgtgccgcacgggagaagcttcggcggcggcatggccatgatccaggtgtcgtaccagttcgcgctgcgggagctgctggaggacctcaagtccggcgatgacggccagctggacatcaccatcgtccccgtcaacgctgatgaggtcgtcatcgatgacgcgcgcatcgagctcctctaggactaggagcacatacatagtagccgaggtgcatgcaagttcaacgcacgggggcgtagctagccacgattttggaccaggggattctgaacaagtatattccctccgtttcggattacttgtgacaaaatggatacaaatggatatatgtaaaacaa

SEQ ID NO: 32414 - DNA, 948 bp, Triticum aestivum
  unsure (1)..(948): unsure at all n locations
  Clone ID: PAT_TA_32414
ggcgtgcgcacgacacaaaacactaattactaatactccgtactcacacagaatcaaaattagtaggtaccagttactccatcgacttcaaagatgtcgggctgatttcaggaaaagtccgggggggtggtggacgtgacccaagttaagggcggcgaggccaggaaggtggcgtccgaggacgggacaagccaggcaggaccgtgcggtcgaggcaaaagaccacgacggggacgattccttgggcagcgaggccagcgggaatgacgtcggctgcggccagagcctacagggccgacgcagtagatgggcggagagcacacggggaactgtgtcggggacaagagtgaggctgccgagaagacgggcaccgagccagccgaaaccacccaggagaggcccaccgcggccgcccagcaagtccaggacacccctgcacaactgcaccaaggataccccgatcgcccccaagggaaacgtcttccagcaggccggcgggaatatggtgggtgccgctacggacaccaaggacgctgtcatgaacgcgcccgggatgggaggagacaaacagtgaggcgggtggtgcaaccaagaagaccacaagggataataggacgcgtctgcgcttgcttactctagccctccttctgttccgctattccttcaatataatttaatttccaataccatggcaataacttacacatgctccttggtgtaactttgtatgatgtgtccgaccgaggtatgaatatattttccaccaatcattatttttaacaaagtcatggatgttgcaaaaaacttttatggtgggcgcttattacttgttgtcggccccccttgnttttacaacntncntggactngggnaaaaccttggggttnccccacttaaatnncctttgnagganaatcccccttttnccanntggggnannaacaaaat

SEQ ID NO: 32415 - DNA, 1779 bp, Triticum aestivum
  unsure (1)..(1779): unsure at all n locations
  Clone ID: PAT_TA_32415
acgactccntcgccatcagcgagtcagacggcgaggacgatttccacagcgtgcaagatgatgccttttcacccaacggcttcgagaacgaagcggcattgggtatgagggacgccaatggcgggagcttcaatggagctgaacacccccataggaagccaaggtccagtgagctgccgaaggggcatttggagaacggtgcgaggccctctgctagccatgaggatgggcggcgggtttcaggcggtgctagcccaagtagtggagggatactggacaattgcggtctcctgccaaataactgtttgccatgtatggcctctgctgttggtgtgaatgagaagaagagggcgctttccacaagcccgactcattcgatgaagatgccttcgttgaagctctcgttcaagaagaagtctggggaagccaacccgtcgtccacactgttgtctacaaaggatttccttgaaaggcctatagcaggttctcaagtacagttatgtttgctggaaaagaaagtgctgaatagctggtctcatattgatcctggtacattcagagtccggggatctaactatcttagggataaaaagaaagagcttgctcaaaattgtgcggcgtactatccatttggagttgatgtatacttttcgccgcaaaaactccatcgttcatctcgatttgtcgtcctccccggatatccagacctcccgcaaactcccacctcttttggtggtcaatgtacaggttccactatatcctgcttcactctttcagaatgaaaccgatggggaaggcatgagctttgttttgtattttaggctttccgaaggttactcaaaagagctttcacccttattcatagagaatatcagaaggttggttgatgatgatgtagaaaaaataaaaggatttcctatggaaacaagtatatcatttcgggaacggctgaagatacttggacgggtggctaatctggaggaccttcctttaagtgccgcggagaggaagctaatgcatgcatacaacgagaagcctgtgctttctagacctcagcatcagtttttcctgggtgataactactttgaggttgacattgacatgcatagatttggctacatctcaaggaaaggtttcgagacattcctggacaggctaaaaatatgcatgctagatgttgggctaaccatccagggaaacaaacccgaagaattgcctgagcaggtcttgtgctgtgttaggttgaacgggatagattatgcaaagtatcagccactgatgacaaacggtgcctgaacttggtgacttgcaaggaccagctaaccattgtttgtttgggatctgggaggtggcctgatcatgccaaggcgcggcgaggcccctcgaggtttccggccaggaaaccggaggcgggctcgtcggtcaccgccgtaacaagcgcgagcggctgcatgtaaatctgtatatcattacatgagctctgactgcctctgctgctgttgttgctgcccgtgattctggagctagtaaatatggctagtttgcccgtggaatggtaggtttcgatgcgctgcctcgacaaaaaataggttcggtcgggcgcacctggaacatgaggaggatttgtggtgaacgcgagctgcttgcaatggtgtggaatgtcaacaccggaggcgttgtataagtgtaacccatacctcacatgacctcacatgagacgaaaaataatggagcatgttctgcaagcctggaaaaaaaaaataaaaggggcggccgttt

SEQ ID NO: 32416 - DNA, 967 bp, Triticum aestivum
  Clone ID: PAT_TA_32416
gactcatatgatgcacctcaccaagctcttgtcccctcatttcgccaagaccatctaaggctgtcgagttggggcccaacgctcgtgctttctgccccgggccagcgctggaatggaaggcttcagtggcgatcccagtgccagtcacgacggtggcgggtagggaagttcgcgggtaccgggcacttcagaccttgtttgccactgaggggttgaaggggcgcagaaacacctaagagggagccccggtggcgtgggggtcggggggcacgtactgcgcggccgcacccacataccccaacgtggacacgaagctgggggatcctagcattctccgcgggattatgcggccggtgccggtctcggacgccctgcgcaagttcggcggcgccgctcacatctcccgctccggcgtcctcaagatcgtctgggactacatcaaggccaaggacctccagaacccactgaacaagagggagatcatctgtgacgagaagctcaaaaccatctttcctgggagggacacggttcatatgatggaggtcaccaagctcttgtcccctcatttcgtgaagactatctaaggctgtcgagtggggggccaacgcttgtgctttctgtgcccagggctagcgttggaatggaaggcttcttttgcgatccctgtccaagtcatggttctactaggtagttaagttaatacggagttcagacttcagactttgttcgccatttaagggttgggggttcggtgatgcatgtaagaaggattccctgtgttttgtggttcgttcggtgtttggggaatttgaggatttgccacgcctttaattatactttgaggatttgcccccgtttttcccgtttccgtggactgaccactccctcgctgcggtcgggtggtgttgccctctgtactcggtctggatcatttggcagattatagtataaaaaaaaaaaaaaaaaa

SEQ ID NO: 32417 - DNA, 433 bp, Triticum aestivum
  Clone ID: PAT_TA_32417
cgggcccagctacggccgcaagaagaatgatgacgacgatgacgaggataggcagcggcgatacaagaagcgcgacgacgacgacgatgatgagaggaagccacggcacaagaagcacgacgatgatgacgacgacgatggcgagaggaagccgcggtacaagaaacgtgacgacgacgatgatgatgaggatgacaggaagccgcgttacaagaagcgtgacgacgacgacgacgatgatagaaagccacgttacaagaagcacgacgacgatgacgacgacgacgatgagaggaagcagcgtcgcgggaacaaccgccgccgccatgattacgatgactgatcaaggcatcctgacatgagtttagctgacgctaaataagtatagtcgcggcggctttgcttcgatgaatcaccaattcgtatttttttt

SEQ ID NO: 32418 - DNA, 1152 bp, Triticum aestivum
  Clone ID: PAT_TA_32418
ggaggtcgtcggacggccgcggccgcagctggatcacggcggaggtggtcgtgggatggcacgggacgaggcggaggcggcggcggcttccaccaaccagaagaccgaaagcttcggaggctgttccagctccaacagcgtgaagaaaatttaccccattgacagtccaattaagaaaagaaagtcacatgtatgacctcagtgacacaaggctgtcatcagctgaaatacaagtttcacggaccgaccaacttcacatggaggatgagactgcaagaacagaaagcttaggaggtgatgacattttcgtcaacaagaactgtaatgtggacatggtcaatgcttacaaggggttggactcgtgtgagaatactcaaagccttttaggtggttgcatcgaagtcgactccataaatggaatcgagagccagtctatgagaaaacgggcatctgcatccagcagctcaagcaacaacatttcatcggacacttacagttcttttcatagctatggcaccaaagagactgacagctgggtgaggccacacctggagcatgatggctcaggtttgctgctgcaagcatacgatgatgacattgagaaaatctgcgctgtgatgaatgagctagcaggtggtggtgtcgatggttctgctgatcgtatcatggatgagacgctttactcgaatggcgtcgatgatttcatgattctgccagcaggcaagaatggggagaagaagaagcagctaaccatcgaccaagaattcgagcagtacttctcaaaactcatgctttagcgtgaccgtaacagagaatttgctgccttgaagtgttgaaaaatgttctgcatcctaacctatcatgaatgagcaaatgcaagtcggggctaccattggagtcaattctgtatttcttaacctaagtcttgacactgcaatgtatatatatgtttccttttcaaagccgtaccttgagtgaccatcgactcttggcttcaaatctgccgtgtttgtgtatatcttatgaataatgaaaaatctggaattttaagcagggtgttcctttcatctgctggtgttttgaatggatctgtaaggaagccatattccagaattggatgttgaactatagattatgctattggtgatcccc

SEQ ID NO: 32419 - DNA, 681 bp, Triticum aestivum
  Clone ID: PAT_TA_32419
ggcaagaaccaaaggtaatgtaccattacagtacataacctttatctgataaacggtgcacattcttttgacaactagcaatctatactattaccacagaagttttacaattctagttttacataacttattgcacccatgaatgaagctgcatcacttggttcttcctgcataccaaggctataggtgaacagaaggcaatataatgtacatacgtcactctccaactccctacacaactaaattcgttcatgcatctgggcaaaagttttccacttggcagcccgctgttgtttcatccagcatgcatctgaggtcacgatgactgggagagctgattccaattcatcaacctatgtgactgctgcgggtgcctgtccaaataactcctggaaatgtcagtttcatccgcagcgtagggatctgaatggcctgacgcagccggaggcgaccagacgggtactaccccaccttctctcccagtccagctgcttgatgcctctgaagtggatggtgctatgccgccctgcacacggtgacggtgtagggtatactgctgctgctgctggacgccgttgtatctggcagcagtgtcgtcgctggcaacttcatccctgacttccatccgagtctgaggctggaaatgcacctgtgatggcacctccggcctagtcacttcgc

SEQ ID NO: 32420 - DNA, 659 bp, Triticum aestivum
  Clone ID: PAT_TA_32420
tgttttttttttttttttttgaaactatcaaatttcatggcaaacttcagggtagtatcttatattgtctggcgtacgccacaatctgaaactatcacaatttaacttgacccaaccgaccacaagtttgccggaacttcacgttctcaaactgcaaaaaagtagacaatccctccgcagatcatattaggcgttcgctcatcaggcgctctttgacggcgccgggtacttgacggcgttcttcacgatcttcttcagggccgcgtcaccgaggtcgacgccgcacatgtcggagagacggatcaggtagagcagcacgtcggagagctcctcgccgaggtgctccttctccctctcctcccagccaggcaagcccttctgcacctcgcctttccacatgaacagctccgacagctccccgacctcgccgaccatggcgagcagaaggttccttgggctgtggtgcttctcccagtccctctcctttgcgaagtcttcgagcctcctggacagatccttcaggctcacatcggcggccaccccctccgtcgtctccttccctctcgcctcctccatggccgccttcttctccgcctccgtcgacctcgctcggcaccaaccttaaacaaatacgagtgcctgcctttcctcgtgccgaa

SEQ ID NO: 32421 - DNA, 854 bp, Triticum aestivum
  Clone ID: PAT_TA_32421
acgaggacgagatcgtcggcctcaaggagatgttcaagatgatcgactcggacaacagcgggcagatcacgtacgaggagctcaaggtggggctcaagaaggtgggcgccaacctccaggagtcggagatctacgcgctcatgcaggccgcggacgtggacaagagcgggacgatcgactacggcgagttcatcgcggcgacgctgcacctgaacaaagtggagcgggaggaccacctgttcgcggcgttccagtacttcgacaaggacggcagcggctacatcacccccgacgagctgcagctcgcctgcgaggagttcggcctcggctccgacgacctcagcctcgacaacatgatcagagaagtcgaccaggacaacgacgggcgcatagactacaacgagttcgtggcgatgatgcagaagccggcgctggggctggcgaagaaggccggggccgggctggagagcagcttcagcatcggcttcagggaggcgctgaggatggcttgaaggaggaggaggagctaggtggtagtcatggcgacgctaatttcgttctgctcgtcgaagacgcttgttgtagagacatggtgaggcgattgagttttcatagggtcgaagtggcagcagctcctggcgagtagcggagggtcgggactcgggacaacgtgtgtgtagtagaggcaggcaggcaggcccggtgattttcttctcgctactggattggttcaattgtgtattatactgagtataaactacagaaagcttttcccctccttgtatacagtacggttagaaatgaaacctgcacaagttggattagctttataggaagagtcatatgaatgtggc

SEQ ID NO: 32422 - DNA, 502 bp, Triticum aestivum
  Clone ID: PAT_TA_32422
cacaacactatctcctaccagagactcccagttagcaatatggcgaagtgtctcgccgtcgcgctcctgatgctggtggtgctcgcgtcctgcgaagggagggagctgaatgagaaggttgcagcgacgcgtggcgcaggtgcgggcggtggcgtcggcgagtctaaggcgttggacttgcctgtgctcgggggagtcggtacgggaaccagcaccattaccggcccgctggtggtggttcctgggatccctgctattggcccatgatcatctctagctcatgtgctggcttataagaagctaaagctcgccttgtcgctttagattctatagttagcaccaccgggaagaaaaaagcctgcgtttcgctcatgtccatgttttcggtaatgagcgtctgtatcaactgtcatctgtatctatttccagttcatgttctcgtatttgtcgttccttgatgtgctacatacatgtatcatcaataaataataattactatgtt

SEQ ID NO: 32423 - DNA, 576 bp, Triticum aestivum
  Clone ID: PAT_TA_32423
cgggaaattcaaaaaaaaaaaaaaaaaaagctcactcaaacacagccacacaacactatctcctctgtagtagtactactattaccagagccgcctcccagttagcaattggcaaagtgtctcgccgtcgcgctcctgctgctggtggtgctcgcgtcatgcgaagggagggagctgaatgagaaggttgcagcgacgcgtggcgcaggtgcgggcggtggcgtcggcgagtctaaggcgttggacttgcctttgctcgggggaaccggtacgggaaccagcaccattaccggcccgctggtggtgcttcctgggatccctgctattggcccatgatcatctctggctcatgtgctggcttacaaggagctaaagctcgccttgtcgctttagattctgtaggtagcaccgccgggaaggaaaaagcggacgttttgctcatttccatgttttcggtaatgagcgcctgtatcaactgtcatctgtatctatttccagttcatgttctcgtatttttcgttccttgatgtgctacatacatgtatcatcaataaataataattactatgttagtgt

SEQ ID NO: 32424 - DNA, 812 bp, Triticum aestivum
  unsure (1)..(812): unsure at all n locations
  Clone ID: PAT_TA_32424
ccggcgtcgtcaccaatgggcgctcgtctccatgaaccacgacacacagtcctgcatggnaccccaacgtcatggaggccaaggtcgtggtgagctcctgcggccacgacgggcccttcggcgccaccggggtcaagcggctccaggacatcggcatgatccaggcggtgcccgggatgaaggcgctcgacatgaacacggccgaggatgccatcgtgcgcctcacccgcgaggttgtccccggcatgattgtcaccggcatggaggtcgccgagatcgacggcgccccgagaatgggcccgaccttcggcgccatgatgatctccggccagaaggcggcgcacctggcgctcaaggccctcggccggccgaacggcatcgacgggacgctcaagaacgtgaccccggcgctgcacccggagatgatcctggcggcgaccaacaacggcgacatcgtggacgcctaaagcaaagcaatgaaccacggacaccaagaggcgtacgtacgctggtgtttgggggcgcaaaatcaataagatggttcggtgaaacggaggatgcttagggacgagggcttgtctttgtgatttgtcagactcgtgtttaattccgatgtttatctttagttttcttgtgttagcgtattttgttcatgccacctgcccgccatgtgctctgctctgctctgcctcacggcagctccatggatgatgaatccttctggaacaagaggagggaataaaaaggttgagttctactatgttggtgtgcgggctctgtttactccatggccggatcgagtttcttttttc

SEQ ID NO: 32425 - DNA, 523 bp, Triticum aestivum
  unsure (1)..(523): unsure at all n locations
  Clone ID: PAT_TA_32425
ntcactttcggcaggtgagcagcatcaaattcggagaggccgacgacgccgacagcgtggtgaagaccgcgaagaagatcccgacgaagaagttcaacgacctgacgggcaacaacatcttcagggcgacgccgcggaggcccccggcacggcggagaagcagctgagcgacgccaagctcaaggagatgagcggcagcaacatcttcgcggacggcaaggcgccggcccgggacttcctcggcggcatccgcaagccccccggcggcgagagcagcatcgcgctggtctaacagcgacgacagcaacccctgatggacaggacaggacagacatagcctacaacattcttcgttcttcaccttcaccccgtcgccgtctcgttcgatctaggagtgattgatttctagggagctttttttctttgtcgtcgtcgttcgttggtgggactgatctgcgattgaacttctggtttggttttttcccctttaaaaaaaaaataaaaggggcgccgttttagagga

SEQ ID NO: 32426 - DNA, 1199 bp, Triticum aestivum
  Clone ID: PAT_TA_32426
gaaggagagccagcggccggtgtacccgttcccggcgatcgtggggcaggacgagatgaagctctgcctgctgctcaacgtcatcgaccccaagatcggcggcgtcatgataatgggcgaccggggcaccggcaagtccaccaccgtccgctccctcgtcgacctgctcccggacatcagcgtcgtggtcggcgacccgttcaactccgaccccttcgaccccgaggtcatgggccccgaggtccgcgaccgcctcctcaagggcgaggaccttcccgtcaccaccaccaagatcaccatggtcgacctgcccctcggcgccaccgaggacagggtgtgcggcaccatcgacattgagaaggcgctcaccgaaggtgtcaaggcgttcgagccaggcctgctcgccaaggccaacagggggatactgtatgtggacgaggtcaatctgctggacgaccatctggtggatgttctgctggattccgcggcgtctgggtggaacacggtggagagggagggcatctccatctcccaccctgcgcggttcatcctcattgggtccggtaacccggaggaaggcgagctccggccgcagctgctggaccggttcgggatgcacgcgcaggttggcacggtcagggacgcggagctgagggtgaagattgtggaggagagggctcggttcgacaaggacccaaaaacgttccggcagtcctacttggaggagcaagggaagctccaggaccagatcacatccgctcggagcaacctgggctctgtgcagctcgaccatgatctccgggttaagatatcccaggtgtgttccgagctgaatgtggatggactgagaggagacattgtcactaacagggcggccaaggcgttggctgccttgaaaggaagggacattgtgacagtcgaggacattgccactgtgatccccaactgtttgaggcatcggctccgtaaagacccactcgaatcgatcgactcgggcttgcttgtagttgagaagttttatgaagtctttggctagattactctcgaggtaaatgtttttctgtcacaaagtaaggcaggaggctttttgttcggctgtaaacttttatagcaccttccgtaaatcatcttttatcgaactatatcctgcattgtatagaaaacagtgttaccgagcgttaattatggtgaactttgtt

SEQ ID NO: 32427 - DNA, 909 bp, Triticum aestivum
  Clone ID: PAT_TA_32427
gccggccgggctacaaaatatcgctcgctcgctcgttcgaggctcggccatggcggactaccacttcgtgtacaaggacgtggagggggcgaccacgcagtgggacgacatccagcgcaagctcgggaacctgcccgagaagccggcgcccttcaagccgccgcccttcgcccccagggccgacgccgacgagcagcccaggtccaaggagtggctcgacgcgcgcgaccccgacgagctcgaggagctcgaggacgacctcgacgatgaccgcttcctcgagcagtacaggaggatgaggcttgcagagctcaaggaggcagcaaaaactgccagattcggcacagtacagcccatcacaggctctgattttgtgcgtgaggtttcgcaggctccaccggatgtctgggttgtggtcttcctctacaaggatgcgataccagaatgtgggctgcttgagacttgcctggaggaactggcgacaaaatatgcagaaaccaagtttgttaaaattatttccacggactgtattcccaactacccagataggaatgttcctacaatactggtgtacaacaacagtgctgtcaaagggacttatgttggtctacagaagttcggtggaaagaaatgcacacctgaatctgttgcattggcgctttgccattcagacccagtactgaatgatggacaaggtggtggcgattcatcccgtaacaatgtcatggaaggcgttcgcaggaagttcatagaaaaggttgtctcccagcttgaaacgcgagaagacgaagatgatagcgactaaaacttactcttttctgctagttttgttttggctcggtgatatcattttgatccacggacaacatttgtctcagctttactggtcttatttggttgtctgtgtgt

SEQ ID NO: 32428 - DNA, 1442 bp, Triticum aestivum
  Clone ID: PAT_TA_32428
gtacaaaatttgatctattttactttaatattttttcagtaatgttctgttggataagatacaatgccaggttgttctctagtaatcacatatggtacaatacaacaacaatgtttggttctgggatgtttggtttgagaaaatcaccttgaccatcacagcttggtccatcgccggataatctcttaaatttggtcaaattacctaatccatcatttagaactagcttagtgcatgcacagtctatacctcaaaccaaacaggggtgcattcatcatccagtccctcaaaccaaacacctcattcaagccgacaaaaaaatggagttacatttgtaaggccagataactgaatctacagagagacgacttgctggtgataatccggtccgcatcagattatgtgctttcaaaaccaaatattcggaaaacaccatcatcagcctggtacttattcttgtcatctcctgcataagccaggaggttgtatttaggattccattcaacactattcatagctgctttacatggaatctgatgaattgatcgtccagtctgaatattggcaatgtcaatgaaaggatcttcactggcatatgcaataaattctccagtgtgattgaagctaactgttctgacaggccactcaagttttgtgaaggttttaatgcatagcagctctttgacattccaaagactgacaagtgaatctgcacttccaacagcaaaatacctatcaaggggatccattgctatgcaatagcaccctgctgtatgggcatttaatttgcagacaacatcaagggaaggatagttgaccacctcaacaaatccaagcccagtagttatgaagaataaatctccagttttattccatgcaatctcattaatctcgtaagggaacttctgtttgtggacgggttttagcttccgaacatccactatggttagctcatcctcccttatttccaacagctatgtgagtgccatcatgtttgtatgtgatgttgatgttttctccactgagttcaacaacttggcatttcccacttcgtgcatcccaaaggcgaattgacttgtcagcagctgcagtggcaactgtgtcaggatgctttggatcccagcataactgatctacactatctgagtggcctttcagttcaatgtctttaaccttggaatggccatggggatcaatgctccagacacgggcagtatgatctatagagcctgaagcaagctttgtgcctatgcagttccatgctacagagtgcaccttcttcttgtggctgtagtattccctggagaccaggttcttgaatctcgtccccggcgctgagctgccgggggcggcggcgccgcctttcttgtcgtcttctctcccctccattattctctctctgcacacgtgggccgccgcgtgtggttgtggggaagcgcacg

SEQ ID NO: 32429 - DNA, 2303 bp, Triticum aestivum
  Clone ID: PAT_TA_32429
gccgcctgccactcctcctctcccccaaccaacctcccccacgccccatctcagcaaaaaagaagctagcacagcccccacacaccatggcccgccatggccaccaccgcctccagcctcctcaagccctccttctccggcgtccgcctcccggcggcggcccgcaccccgtcctgcgtcgccaccccgcgtgccggcgccatctgcaactaccatcatcctcctccacccctccctacgacctcaacgccttcaagttcagccccatcaaggagtccatcggtgtccccgacgagatgacccgccactacatgaccgacatgatcacctacgccgacaccgaggtcgtcatcgtcggcgccggatccgcggggctttcctgcgcgtacgagctctccaaagacccctccatcagcatcgccaccatcgagcagtccgtgtcccccggcggcggcgcctggctcggcggccatgctccttctccgccatggtcgtgcgcaagccggcgcagctcttcccgcgacgagccgccaacataggtacgacgcgcaggacgacttcgtcctcatcactgcacgccccgcccatcacctctctccaaggatgagcccctccacgcgcgcgccgtcaaggcaccgctagttaagcggcagtcgccggagagcgacctccatcgtgatgcaggagcacgtatcccggccgagtcacaaactgggcagccgtcaccatgaactacgacacaccgggcggagcaccggaccacaaagccaggggaggcgaatcggcggcgagctcgggcgggcgcgacaggcgcttgcgggcaccatcgaggtcagggagacgggaggacaccggcaggctggcaggcagcggcgaagggataaaggcgcccgacatgaacaccggccctggatgccatcgtgagcttcacgcgggaaggtgggcccggccatggctgtcgccggcatggagctggccgagaccgagggcgccccgagcaatgggccccgaacttcggcgccatgatgatcgccggccaggaaggcggcgcaccgggccctcaaaggccctcccggcaggtccagcaacgggcatgccatccggcacgctcaaccagcgtgacccccggcgctggcagcgcggaggtcaatcctacggcggcgaacaagcagcggcgcccatcagtggcacgccgtgaacgcaaaaggcaatgagaccatcggtacaaccagttggcgttacgctacgactgggtgtttccggggggcgaaaaatcaataagattggttccgggggaaacagactgactgtttaatggacgatggtcttttctttgatggaatttggtcagtatgctgtgtttaattgcaggagtctctcgccttgacgttttcgccgctgattcatgcttataatggtcatgcgacctgccgtccctgtgctcctccttgctctgcccgcagggagctaaaggagggatcagtatgagaaggttacgaggaggggtggcgaaggtgcgggtggttgcaacggcgagtctaaggcgttggacttgcctttgctcgggggaaccggtacgggaaccagcaccattaccggcccgctggtggtgcttcctgggatccctgctattggcccatgatcatctctggctcatgtgctggcttacaaggagctaaagctcgccttgtcgctttagattctgtaggtagcaccgccgggaaggaaaaagcggacgttttgctcatttccatgttcggtactgagcgcctgtatcaactgtcatctgtactatctatttccagttcatgttctcgtatttttcgttccttgatgtgctacatgtaccatcaataaataataattactatgttagtgaaaaaaaaaacaaagacgcaaacaaactctgacggccgaacggcatcgacgggacgctcaagaacgtgaccccggcgctgcacccggagatgatcctggcggcgaccaacaacggcgacatcgtggacgcctaaagcaaagcaatgaaccccggacaccaagaggcgtacgtacgctggtgtttgggggcgcaaaatcaataagatggttcggtgaaacggaggatgcttagggacgagggcttgtctttgtgatttgtcagactcgtgtttaattccgatgtttatctttagttttcttgtgttagcgtattttgttcatgccacctgcccgccatgtgctctgctctgctctgcctcacggcagctccatggatgatgaatccttctggaacaagaggagggaataaaaaggttgagttctcg

SEQ ID NO: 32430 - DNA, 753 bp, Triticum aestivum
  Clone ID: PAT_TA_32430
cgtccgcggacgcgtgggcgcggccacgcgccagtcgcgtcctccactcgattacccacatgtcgatgctggaagccttcttcggcaagggcggcggcggcgccggcggcggcttccgcgccgccaagtgcaagacgctgctcaagctgtccatcccgcggataaagctgctgcggaaccgccgggagctgcagctgcgccagatgcgccgggacatcgccaagctcctcgaggccggccaggaagccaccgccagaatcagggtggagcacatcatccgggaggagaacatgatggcggcgcaggagatcctggagctcttctgcgagctcgtcgccgttcgcctgcccatcattgaggcccaaaaggaatgccctatagatctcaaagaggcaatatccagcatctgttttgctgctcctaggtgttcagatttgcctgaactgatgcaagtccaaatgatgtttgcgactaaatatgggaaagaatttgctgctgcagctgcagagcttatgccggattctggggtcaaccggcagataattgaactactttcaatccgtcctcctccagtagatataaagatgaaactgctgaaggagattgctgaggagcatgagatcgactgggatccatcagcaacagagacggaatatcttaaaccccatgaagatctattgaatggaccaacctacttcagggggtcaacgctgccactttcaagggagaaacacgtggaaccagtagctgcaa

SEQ ID NO: 32431 - DNA, 2619 bp, Triticum aestivum
  unsure (1)..(2619): unsure at all n locations
  Clone ID: PAT_TA_32431
gtctccggcacgcgcgccagcgcaccctctcttttgatccacatacagctcggtcgatcactgaccatctcattcgagactgcatctgcaggggtgctagtggtgggcctaagcggagcttccatttacctctgcttgtacgcacaccatacaaatctataccaaactaatttatccggcgcgtggaggagaagaatcatccacgatggcttctgctttctctggtccccggtggaggctccgcgtccaccccagaccaccttcctcggggaagaaggtgaagaagcagggcgggtgcgttagaaataccaacatggtggcaacaagatcaacgataggggtggttcacggcccatggccggccaaaagggacctgaggggaggagcaaggcagaccgcatgccagatcggatggtaagggtcacgctttatgacgtctcccgatggcaagtaggacatgacggggaagagagaccgcgtggaccccctgatccaggggccccatgtgcgcgggcgcccccgaggagccagcgaccacgcacctacagatcagccagggcctgcgtgaggacgaatgagtccaacacctggacggactgtaaatccccccggcatgcatgcaacaagaacatcttccacctcgccaagaacttcatgacactccccaccatcaaggtcccttctcacccttgggtatctggggaggcaagggacagggcaaggtcgattccagtgcgagcttggtgcttcgccaaagatgggcatcaaccccatcatgatgagcgccggagagctggagagcggcaacgccggcgagccggccaagctgatccggcagaggtaccgcgaggctgccgacattatcaagaagggcaagatgtgctgcctcttcatcaacgacctggacgccggcgcggggcggatgggcgggacgacgcagtacacggtgaacaaccagatggtgaacgccaccctgatgaacatcgcggacgcgcccaccaacgtgcagttcccggggatgtacaacaaggaggagaacccacgcgtgcccatcatcgtcaccggcaacgacttctcgacgctgtacgcgcccctcatccgggacggccgcatggagaagttctactgggcgcccacccgggaggaccgcatcggcgtgtgcaagggcatcttccgcaccgacaacgtccccgacgaggccgtggtgaggctggtggacaccttcccggggcagtccatcgacttcttcggcgcgctgcgggcgcgggtgtacgacgacgaggtgcgcaagtgggtcggcgagatcggcgtcgagaacatctccaagcggctcgtcaactccagggaggggccgccgacgttcgaccagcccaagatgaccatcgagaagctcatggagtacggccacatgctggtccaggagcaggagaacgtgaagcgcgtgaagctcgccgacaagtacctcagcgaggcggcgctcggccaagacaacgacgacgccatggcgaccggcgccttctacggcaagtagaaagtcctatacttaagatgcatgcgtgcatgcatgcactatatatatgctggaatattttggactcgaatccacttaatcttgcaaattagtcgttgagcctggtttgaagtcattgaggccacattgtttgtgaagccttgtttggtcccccaagtgtttgggtatttcttggagaattctgtgtatgctgagttgatacagaaaaagaagggtgcagcggttttaccagcattgcctttgtttataatgtgtgaattgtaaatgcgtggatgttgtatgacatttgaaacttgaaacctgtagaggaaagaacaatctgaactcatctagttagatgttctttagataaataattttccacttctaatgattatcatgatcaaaaaaaaaaaaaaaaaaaaaagtcgacccggccgcctgcccatcatagaggcccaaaaggaatgccctatagatctcacagaggcaatatccatcatctgttttgctgcgtccgcccacgcgtccgcggacgcgtggatgcaagtccaaatgatgtttgcaactaaatatgggaaggagtttgttgctgcagctgcagaacttatgccggattctggggtcaaccgtcagataattgaactactttcaatccgtcctcctccagtagatataaagatgaaactgctgaaggagattgctgaggaacatgagatcgactgggatccatcagaaacagagacagaatatcttaaaccccatgaagatctattgaatggaccaacctacttcagtggttcaacactgccacttccaaaggagaaacacgaggaaccagtagctgcaactgccgctgacgaacctggtgaagattatcaatctgatggcggctttgactcactggatttgcctgaagtcccaaaagcagcaattcgtccagcttctggtactcaatcaaccccagatattggtccacatgtgcaaagctcacagtcggctgctcatgatttctcacacccacctgacttggaagagaatccaacagctgatgctgcgttctataattatctganaaggtcagagcccccagtttctccgcaatttgc

SEQ ID NO: 32432 - DNA, 734 bp, Triticum aestivum
  Clone ID: PAT_TA_32432
tcgcaaactatacccaaggccatcagttttgtgccgtcgagagcactacggggaactatagggtacatagctcctgagatgatatctaggagctttggcgtcatatcgagcaagtccgatgtttacagctttgggatgatgctgctggagatggctggaggaagaaggaacgccgatccgaatacaggaaattctagccaagcatactacccggcatgggtgtatgaccgactaacccaacaagaccatgtgggtgagatatatgctcatgttgatgctcagatgcatgagttggagaggaagttgtgcatcgtcggactatggtgcatccagatgaaatctcatgacaggccgacgatgagcgaggcaatagagatgctggaaggcagcgccgataccttgcagatgccttccaggccattcttctgtgacgaagggcacgtccataccgatgatacttaccgtttgtcgtccgagttgactgaaatctctgaggaggatatgagtgaaaatattgatgtgtgatgtaatgcacaaaatgatgcactttggtcgtgaatatttctcagaataatggctgtagttatatctattactagtatataagttgatgcttttaatagctagcagagcagcagaactcccgctgctttctccatgccatcttatatatgatgaagctgggaattatagtaaaaaaaaactcgtgccgaatgcgacgcgagaaaaaaaac

SEQ ID NO: 32433 - DNA, 945 bp, Triticum aestivum
  Clone ID: PAT_TA_32433
tcttttcgaccttgatggcaaagaataatgaggaggacgatcaaagttaatgatcccctgaggtatggtgggatcacgatataccaaacggactgggggttttcagcattacaggtgaagaaaatggtgaaggaccttttaacttggcaatggcacccttgcaactgaatggcaataaaaagctatacggaacattcttgccacttcaagactctgattcttcaggtgtcaagggaatatcaatgcttgctcgagatcttcagtctattgtgttgtatgatcaagatggcaagtttgtaggagttcgccggccaagctctaaactccctattgaaatcaatggcaatgaaatattaattgaggatgctattggcagtactggtctggatctcaagactgatccaggaattcctatcgtgtatgctggattcggtgcgctcatgttgacgacctgcattagctatctttcgcatgctcagttatgggcgctgcaagacggaactacagtagttgtcggagggaagtccaatcgagccaaaattgaattttctgatgagatgaaccggttacttaataaagtaccagagttggttagtgttggtgagaaaacagtagataataaatcaagtactgcgtgagggattcgttttgttcggttgagattgctgaagacacgcaggtgttgaattgaagttggttcatagacaagtccctctcgaagaacaggaaatcttacattctattggtgaagacaattcctgttgcaattggactatgtattcatcattcaggtcaagtttgcttgcaaggaattgtacattctcatgggtctatggtgttattgtatcaaaaggaaactgatgttgtcactctattagggcagaacaaagtgataaatataaattataccgtgaagttgaaccattggttcaggtactgattttc

SEQ ID NO: 32434 - DNA, 710 bp, Triticum aestivum
  Clone ID: PAT_TA_32434
tactagaaagactctgctcatcggtcgatgagggtgtcaagcatggcgtccaagggtctcgttgtgtttgctgtcctgcttgctgcggctttcctcgtggccacagctgaacaaactgtgcattcttcaaaagaaaaaggaaaaggtcggccggttgtcctcgaacgcgtgacgcgctgttgctggaggaacatccttaccactaggacgcaaaaaatttaaaaagctcgactttttttgctcgagatacctaattatcgtggggcagcgagaaacgcggttaccgggcggtaaccgaatttaccgcccggtacccaaaaccatgaccctggctacggtggcggcggcggcggcagcggctgcaggtaccagtgctgtgggcacgggcatggtggctgccgctgctgcgcaagccccaacgagatcccggagcccatgtatcgggcggaggtccgcaactaagtgccagatgctacatacggacgttgctacttgcctgcacgtagtaactactcgtatatgtggtcaataagaaggtaggtgcatgtatgtatgtacgcgtacgtacagattgcacagttatgtttattcaataataccagaactctgttctgatcgtgtattcaccctgtaagacttctctttcttgcacagtatataatacatgcaactgtcatgcatgttataacaacagaatatcaacagtaaac

SEQ ID NO: 32435 - DNA, 1284 bp, Triticum aestivum
  Clone ID: PAT_TA_32435
cactttgtgaggaattgcaaggcaacccaaattactgtgacacctgcaaacaatgcgactatgagatcgcccctgcggaccgaagctcctctgccggcgtgcttgcgagggacaacatgcggctggtcaccgcggacggtgagagggcaaacatggactttgtcttcgggtgtgcacatgatcaacaaggaaagcttctggactcaccagcaagtactgatgggatccttggcctcagcaatggggcaatgagcctccctacccagctagccaagcaagggatcatttccaacgttttcggccattgcatcgccacggatcccagcagtagtggctacatgtttctcggtgatgattacgttcccagatggggaatgacatgggttcccgtccgcaacggtccagaggacgtgtacagcacggtagtacagaaggtgaactatggaggtcaggagcttaatgtgcgagagcaggctgggaagctgactcaagtgatcttcgacagcgggagctcatacacttattttccacatgaaatatacacaagcctgattgcttcgcttgaagcggcctctccaggctttgcacgcgatgaatcagatcaaacgctgcctttctgcatgaagcctaattttccagtgaggtctgtggatgatgtgaagcaactgttcaagccattgcttctgcatttcagcaaaacatggtttgtgatcccaagaacgttcgcaattgctcccgagaactacttgatcatcagcgacaagggcaatgtctgcctaggggtgcttgatggaactgagattggccacagctcaacaatagtaattggagatgtttccctccgtgggaagttggttgcgtatgacaacgacgggaatcagatcggatgggctcagtcagactgcagcagaccacagaaagcaagcagggttccattcttcctttcgagagcattgctcggtcaacttctttaaatggcacagacagatgatcaccccgtgttcgcctgaccatgcgctcaccttttcgacgcgcaattctgcgaccgaagctgccataatcatataatggatgtagttaaacaagggatatagggaaaccaaattggaagaaaggtgaatagatatagccagtacctgtaatttttctcggctgtatatacaccaaagaagcagaactctgcatatctgtggatatgatgtagagtatatctcatccacttgtaagactaagtggtgaagcatatcaatttcaaatgagtagcagttatgtgatttctgattt

SEQ ID NO: 32436 - DNA, 621 bp, Triticum aestivum
  Clone ID: PAT_TA_32436
tggtcgtccggacgttccgggtcgaccggagcctgtcactgccgtccgactgggccgtcccgtcgcccatccagcagctctcccacctcgcgcagcgcgtcggcgccgtcaacctcgccgagggattccccgacttccccgcgcccgcccacgtcaaggccgccgccgccgctgccatcgccgccgacctcaaccagtacaggcatgtgcaggggatctgcgacgtgctcgcggcgacgatgaaacgggaccacggcctcgacgtcgaccccctcacggacttcgccatctgctgcgggcagtccgaggccttcgccgcggcaatatttgcagttatagacccatgggatgaggttctgctcttcgacccggcttacgaaacgtatcaaacatgcattgagctggcccggggcgtccccgtgtatgtgccattggatccaccttcttggacactgcacgcggatgcatttttgaagtcgtttactaggcacacaggggcagtgatcttacttagccaacatgctcccacaacgtatcactcttgcattgcgcaggcgctgatcgtccctctggcatgtcagctggatccaccttcttggacactggatgcggataaatttc

SEQ ID NO: 32437 - DNA, 860 bp, Triticum aestivum
  unsure (1)..(860): unsure at all n locations
  Clone ID: PAT_TA_32437
ttcaccaacattgactttgaactcgaaatatatttccatcgtgactggttggaagttttgggatgtggggagtcactgaacaggaaattttaaaaagcaatggtaggacagatcatgttgcatgggccttcggactaggcttggagcgactagcaatggtcctctttgatattccagatattcgactgttctggccaaatgatcagcggttcacatcccagttctctaaaggcaagcttggggtcaagttcaagccattctcgaagtttccaccctgttacaaggatatgagtttctggataaatgatgaatttacagagaacaatttatgtgaggttgtcagaggaattgctggagatcttgtagaggaggtaaaactaatagacaatttcacaaacaagaaaggcatgacgagtcattgctacaggatagcctataggtcaatggaacggtcactcacagacgaggagatcaacgacatgcagtggaacgtgagagaagaggtgaaaagtaaattgagagttgagctgagataaaacggagctggctcacgtgttctttgtatgtaaatttattgagaagtttattaatatatggagaagtgggggccattttgttcttgtaataacccacatcttgtctctcttttttttatgaaggagaaaaaccccttcgcatagttagcacgttcattttgctggattccagccatttgaagataattatccattgctcagttctgatttacactgatatttggcagaccgaacttgatgaacagcattttcccactaagaaaaataaaggaaaatctaagtcgtgttctcgctctcgcccccccccgtgngcatttcttggag

SEQ ID NO: 32438 - DNA, 368 bp, Triticum aestivum
  Clone ID: PAT_TA_32438
gtcgacccagcgtccttaaaaagtgttggtgtgattcagtgatcccagtaatttttctgatatcagtgttattcgaggctcttaatttcaaacacattccagtaattaactattgactatagaagcttttattattgtctaggatgcctggttgggtataaccgaatagagaatgagcttgtgtataagccgctggtggcatagaggcttgagaaatacgattgcatttagtttactgtaattttgttgtgttgccttcaagaagcttaagagatgatctttgtattttgttgcaaatgtggcacttgtgtgtgtaccatggcttcattgcatattgactttaacaaatatgaaagagagatgtttct

SEQ ID NO: 32439 - DNA, 905 bp, Triticum aestivum
  Clone ID: PAT_TA_32439
ggctcctcctccgcccgcgcgcgcccgccttctccctctccgccctcacgctctcccgcgtcgcctactccccggccaactcctccctctccgccgccttcgacgcctccctcctcgccgacaatcccaactccaagctcaccatctcctactcctccctcgtcgcctacgtcgacgctggccccctcctcccccatcgccgtcacctccctcgcgcccttcgcgcaggggccccggaactccaccacgctcgccttccgcctcgacgtcgacgggacatacgtcgggcccgacgaggccgctgcgctcaagagcggcaacgggggcaccatggaggtccaggtgaggctcgcggccatcgccgtcttcgatagagggggctggcgcacccgccggagggccatgagggtgctgtgcgatggagtgcccgtcacattccgtgggaagaacgccaccgacgcaaaatttgatggcccggcacgccgctgccaagtcgtcttgtgaaggatagctgacatgtgtaaataacccagatgttgaatgcagggaccatcctcaataggtacgatgagttagctgatcttataagacgctggccagacaccgattcagcggggttagcgccgtggcttcagtttacctgcctgcccatagaatctgtgaccaggaagagtctgaaatgatgcttaattgatagtatgcgtcattttcacctattatatcatagcttcaagatgggtggacattgaatataccgagtgtgcatttgggaaatgcttggcaagaatgattatccctgggttgctaatttcccccaagtgaggacctcaatcatgtatgggatccttaggggggggcttcatatcatactttaatgtacctgcccgggcgcccccccaaaaaac

SEQ ID NO: 32440 - DNA, 553 bp, Triticum aestivum
  Clone ID: PAT_TA_32440
cgtccgcccacgcgtccgtagcattgctggtcttgagaaagctgatgtcttacttttggttggcacacagccaagggtggaagctgctatggtgaacgcaaggattcagaagactgttagagcaacacaagcaaaggtgggctacattggtcctccagcagacttcaactatgacacttggcatcttggcacagggccagatacccttgttgagatcgctgagggccgacatcctttctgttcaatactgaagtctgcaaagaacccagtaatcatcgctggagctgggttatttgaacgagaagaccaaggtgctgtgttctcaacaattgaaaccgtagccaagaagttcaatgtgacaagaccagactggaacgggcttaatgtcctattgctccatgctgcacaggccagagctcttgatctgggccttgttgctaattccaccgagagtgtcaagtctgcaaagttcttttacctgatgggagccgtcgatgtaaacctggacaacctttcagcggatgcatttgtggtttaccaggggcaccatggt

SEQ ID NO: 32441 - DNA, 2749 bp, Triticum aestivum
  Clone ID: PAT_TA_32441
gcggcccgggtccccgacgctcccccctccccgcctccgcgcgatccaatcgcctcgccgtcgccgccgcccgccgccgccgacgccatgtccttcctcgcgcgggcgctccgccactcgaagccgtacctgccgtcgcgcggccccgcggcgggcgcctcctgccgccggacctcgtcgtcgaccgccgcggccgcacccgaggccgcgacgaccgcggcggccggagtcctggagctcttgttgccgagggatccgctcgatggcccaatctgcgatctggggggggactgtgagctgcagctagaagtgcacggcctttggggctgactgcggtcgtctcaccgatacgcagagctcggttgtggctaagtatttgggcccattggtgaagacggttatgacccgttccatcccgtgatcgaggtctaccaggttagcatctgaggttgctgctgttcatgacctgggtatgttacgccgtgccccatgtgaacaagtccgagcataaggggggaaacttatgctaccatcactaacgcgaaacgtgagtgatatatggcccctttgcgcacttacaagcaatgcatttgcgttaacagccaagaagtgggagatgtcgggcacgccgaggattactggtacttagtgcatgagcgtccaacattcgccgtgacagcacaggccctggagttatgcgcattggtcctcgtctcgatgaggatatcaacgcagaatggatatctgacaaaacacggttttgttatgatggtttgaagaggcatagactaaacgaccctatgattcgtggtcctgatggcaggttcaaggcagtgacatggcgtgatgctattgcggttgttgctgaggttttgaagataagtcaagccagaaagaaattaccggagtcgctggcaaactttctgtatgcacaatccatgatggcgcttgaaagattttgattaataaaatgggttcgcgataacagtgctcttgccaatggggaatggtccgaatcctgcgagcagatattcgatccaaactacctcaatgaatactagcattgccggtcttgagaaagctgatgtcttccttttgaatggcacacaaccaaaggatgctaaataagacggttttcgtactttttaataagacggtagccgcaacacaagcaaagtggggctacattggtcctccagcagacttcaactatgacacttggcatcttggcacagggccatatacccttgttgagatcgctgacggccgacatcctttctgttcaatactgaagtctgcaaagaatccagtaatcatcgctggagctgggttatttaaacaagaaaaccaaggtgctgtgttctcaacaattgaaactgttgcaaaaaactgatgtgttcctattgcttggtacaacgccaagaatgtcctgctgctatggtgaacgcaaggattcagaagactgttagagcaacacaagcaaaggtgggctacattggtcctccagcagacttcaactatgacacttggcatcttggcacagggccagatacccttgtcgagatcgccgagggccgacatcctttctgttcaatactgaagtctgcaaagaacccagtaatcatcgctggagctgggttattcggaacgagaagaccaaggtgcctctgagggatgccacttgtaaaccgtcccagctgtccccacggttggtgatgccaagaatgactggaagatcgtccgtgctctttccgaggttgccggggctccactgccttacgacagcgtcacagctgtgaggagccggatcagcatggtggccccaaaccttgtgcgcgtcgatgagagggagccgtcggtgatctctgccgaggtgaagcctccggtgaagcagcaagtgagcccggccccattcaaagctgccgtggagaacttctacatgaccgacgcgatcacgcgggcttccaagatcatggctcagtgcagcgcaaccttgttgaagaagtgaggccctactctatgttacgcccccttgaagaagttaaattgtcggcatacgagattttagttgcttttccatttcactcaccagttgttgcttggttggttgggagcataaaatttggactgcctctaccctagctagatccgaggagcagcgaaacttgaaagcagtgcatttttctgtaacgtgtgagaagcggagcatacttaataagcttgttttgtcctttcgaattagacggcagccgcaagcaaataattttgttgtatttgggttttcgcctgctcgtttcccggttccaggaagcaggcaaatgtagctgtatgtgcaaattaaggtatacccccattttatcattcactggtgtgctgaatggcacatattagtggctttttccatttcactcaccagttgttgcttgggagtataaatttggactgcctctaccctagctagatccgaggagcagcgaaacttgaaagcagtgcatttttctgtaacgtgtgagaagcggagcatacttaataagcttgttttgtccttttgaattagacggcagccgcaagcaaataattttgttgtatttgggttttcgcctgctcgtttcacggttccagggtgcaggcgaatgtagctgtatgtgcaaattaaggtatacccccttttcatcacggggtgtgaatgggaatggcacatagttttggatcaaaagggggggcccggtacccaattcgccctatagtg

SEQ ID NO: 32442 - DNA, 1063 bp, Triticum aestivum
  unsure (1)..(1063): unsure at all n locations
  Clone ID: PAT_TA_32442
tggtgatgggtgtgtgaacgtgaaagttcggttntcgaatttatatatactactccctccattccaaaataagtgtctcaaacttagtacaattttgtactagagttagtataaagttgagacacttatttttaggaggaggaagtactaaggctggccatagtgggggtaacataattagtatcatttatttgggattcacaaacatgcttatgtgacagataattaaagaaaagagatggttatagtaacataggtagatgtaacatattaaatgtgatgctactatgtgtcatgcatggcgataaatgagaccacctatgatattaatctaagatactatgcatgttactagtctaagttactccccactatgaccagcctaataaagatgggtagtctaaatgtaagtgcaagcgttagactagccacaatgggtagtaacatacactagtaacataaacatatccctagactatattactacgttcattgtgggtagtaacataagtatggtaacatgcaaagcttcatttattaggttatagactcatatttcattgggacatgtgatgttacaataactagctaagttactataactatctctctcctcattaactcactgccacataagcaaatttgctgagttggactcaaatttactgctgaagttactcccactgcggctagtcttatgtgtttgcctgggggattcagttacaaggctgcctcgtgctattttactctaacacccactttgcctgtcggacctcccctcgaaggttggtcttggtgtcgctcggtgcttctcccagcttcctgcctctgcttccccttagtcggcggtgcccccatctctggtgcttctcccgggccaggttggtcttattgtcgtcggtgcttctcctagcttcctgcctcctctgcttcccctttgtcgagagtgcccccatctctggtgcttctcccggccagcaacggggagngcaaccattgtaaggagcaaaatttttcacttgagggagcattatcattctgcttgaaactatgtgacagacgt

SEQ ID NO: 32443 - DNA, 831 bp, Triticum aestivum
  Clone ID: PAT_TA_32443
tctgcccgtggccccgtggtgctcgcccaagacggaaccacccgctggagaggctccagggatggcgctgacccggcggttcatcttcctcttccccgccgccgtcctggccgaactcgcctccgcctccgcgtcgcccttcctgtctgacagcttattccagggcagcaccggatcgacggggaggagcttgctgcagaccaagaatgactgccctatgagcttcgagacccagaactacacggtcctcacaaacaagtgcaaaaggccacaataccctcctaccgaatgttgtgatgctttcaaggaatttgcgtgcccatttgccgcgtacatcaacaaccagagcactaactgtgcagacacaatgttcagctacatcgacttccgtggctacccaaaaggcctgttcgccgacgagtgcctaaaaggaaaggaaggggtttcttgcgaaggcatcccagcggtagacaccggcgtgcccagtggcgggcgacaagttcaaggggtttcgcgtcctttggttgtgctcctgtgtggactaggagcattgttgttcccttgagtggtgtgattccctggacttctccaaagatggcgtgttgtcagttgtaagtagtaaggcttaggattcatttgcttctccttgacactctcttccattgctataatgtatccatttgttacagaactacatgacatcttaagattcaacattatatggatgatcacatcctgctattgggagagtgcacatccgaattgtaaatcagggaatcaaatatcaattaactattttccagtctaaaaaaaaaaaaaaaaaggccccta

SEQ ID NO: 32444 - DNA, 1082 bp, Triticum aestivum
  unsure (1)..(1082): unsure at all n locations
  Clone ID: PAT_TA_32444
tgatgatttctgagaaggagnaatctcagctctgctctctgaaccaaatctagatgaagagcaggctgtgacttctggatccgatgatttcttgcctgctattttggaatctattaagtcaaacgaaaaggaagtcgaactttcacctgaggaggcagcttgggctgattcgtgttttgtgcagacttctgaactgtcagatgaagactggggtgcattgaagcaagccttgcttgattcccttcaagagccaattgaaggttcacgcgataccactgaggtcatgcttgaccaaggcacccatgcactttcagaggcggaatcccacagtctgcatgtggaaaaagatgctcaggatgataatgtagagatggagcaacaaggcaatagcgatgatgacaaggatgctactgaagttggggacgttacaaatgtaattagaggtgcagatgagcatggcaggcaaatggacgatacactgcagatgagctggtttcatctgaagtcatcgagcaggcagagtcgagggattctatcttcaaggtttgggatctagacgtgtcgttctccgaggatgagagcgagctcgaactcatcaaggacctcaagaaactcctcaagtgcaagcctcaggatgctacgtatccgcctcctggtgacgcagccaaggctctgagcgagataaacgttgatgaacttgtggcgagcttgagtaacttgtcgctgcagcgaaaccagtagctagcagtttgttcttggttcccatgatcctctgtgcatctctaccgtccaatggtaatgttgtggcagcaaagcagtgagtgacggtttgtttgttggtccagccggtccattgtgcatctggaccatcaggtggttgatgtcgtgtctaatgggcgcatattacttctttcgtaggcttctttagacttcagacttaggttgacttttgatatttgttttgtacagtatatgtctagacacccttgaaacacgccgtttgagttcaattcaggcagattttggactgctcctcaggccttgtaaatgcaaggtgcttagtaaaataaacgagttttttg

SEQ ID NO: 32445 - DNA, 773 bp, Triticum aestivum
  Clone ID: PAT_TA_32445
gtcgacccagcgtttttgcaaaattgggggtgacgataagaactagttttggaacttcaagctgctcaaggggcctccagagccaggttctggaggccgatctggtactatggacagtgggttcacaatcccagattcttcggttacaacctcctgatgccccatacgtgattcctttgaatggccggggccaagtagagacagaggaaacccttcaagtaaagggccatcctagaacatttgcaattggtgattcagcagctctaagagacccatcaggaaaatttctcccagccaacgcacaggttgcttttcagcaagcagatttcgctggatggaatctctgggcggcaatcaatgaccggccccttttgccgttcaggttccaaaatcttggtgagatgatgacactgggtagaaatgatgctgcgataacagcaaatttcatcgagggactgaccttggaagggcctgtagggcatgctgctaggaagctcgtgtactgcctcaggatgcccacagatgagcaccgggtgaaggttggagtcagttggttggcaaagggtgctgttgattcgcttgcgtctctgcagactgcagtaagtaacataattgcgggctcctgatggtaaagggcacctgctaattcatgaattgggcgagctggatgatgtatttgagacgggttttatgtacgaattttcagtttcgagcatacgttgcacctaactttcgaacattatgaaaattttgaatataagcacgctgttcct

SEQ ID NO: 32446 - DNA, 1301 bp, Triticum aestivum
  Clone ID: PAT_TA_32446
gtcctcggtgacgtctcgggtactcccctgtcggcggccccgggccctgccgactgtcgtgccccgttactggctttcgcccccggggtgcgcccggctgccgcacactctctgccaaatgttggacgtgttgcggcaagcatacagaggctggagagcagcatgagtaagggacatgtcgggacatgccgctgcgggagcccgcctcccggttctgccccatcaatgcatgcataggggtactctggaggcgctttctcctgttcctctgagttggctgatgtggttcgtccctctgttacgaggtccatcaccacggccgtgggcccttccgtgatccccaccgcgggcccggccatctccagcgggcgctttatctctcttgtttccccccacccgggtagcgtcttctctttccccactgccaaaagctccgattaaaagcctttcactggaagcatctccaacaaagatgacaaaacagttgatacaaagcccatcacttggagcagcaccagcactgacgacaagagtgttgacacaaagagcagcattggaagcgttaccaacagagatgcaaagagcattgaagggaagcgaaacattcgaagcgttgtaaacagttatatgaagaattttgatgcaaagcggaacactggaagcatagccaatagcgaagtcaaggacttggatgttaagcccagcagtcggacgatattgtcagtcgttcgatacccaacagtactcagtcgcaagccccaacactggaagtgttgaacccagtgatgtcacgggtactagtgtgatggcgaacacaggccctgccaacagcggtcgcctagttacagactaacactgacacgtcgttgatcaggatgacacagattcgaagcccaaatgttggacgtggttgcggcaagcatacagaggctggagagcagcatgagtaaggtacaaatcgggagatatcgatgagaaaacccatgaccagtaactttttcatcaaagcttggatatgtttattgtggagaggcatattctttttcgttagatttgtatgatttgtatcattgatttgttacgaggttaataactacgtatgtggagccaaccttgatcaagactgaggacctggcaatcaccagctggcactttatatatctatattcctgctaactgtaaaaagttttatatttgcccacagaaaacatttggaggttcatattccttatatatacccctggacaaattgtattaatgctcacagattatttggcattcaaggtacataacattctttt

SEQ ID NO: 32447 - DNA, 1152 bp, Triticum aestivum
  Clone ID: PAT_TA_32447
ggcccctcgcccccccccggcccggcgccggcgcgaagcgagcaagaaggcatggggcggccgtacgcagtgaaggggaagaagaagcggaagctggaaggcggcgaagcctcgcgcgcccctccggtcgacgccgaggcggtggagcaagaggtgaaggaaaatgaggaggtgatggagggggaggcggcggcagaggaagcttttgccgaggaggtgggggaggggatccccatcgtgccccgcccggtcgacagtaagcggcggccgggcgctatcttcgtacttgagagggcctgcctcgaggtcggcaaagtcggcaagggtatgcaaatcttgaattcggatgatcacgcaaactatttaaggaagcagaatcgcaatccagctgattacaggcctgatatcattcaccaggcactactagcaatatttgatagccctctaactaaggctgggaggttacaagctgtttatgttaggactgaaaagggagtgttgtttgaaatcaagcctcatgttcgcatgccacggacattcaaacgtttctgtggcttgatgtcacagttattgcaaaagctgagcatcacggcagttgggaagcgcgagaagctccttaatgttattaaaaatcctgttacccagtatctacctgttggcgtacggaaaattggcctttcatatagtgcggagaaggcagttaatttgtttgactatgttgctaagtccaatgatgatgaacctcttgtgtttgtggttggtgccatggcccatggaaaggttgacaaggaatactcagatgattacatacagattagcggttaccctctcagtgctgcctgctgcctgaatcgaatatgcagtgccttggagcagaaatggaacatccagtgaagggaagtttgaaaacgaacattacatctttgtgttcagatttttatgtactcgttagcgcttatagtgttgttgtgctttttcatgtcttatgtctacaatattagttttgtcgagacatgaatcactggctgtaaaagtattaacactgaatgtttcaagtgcttatgttcctagcaaaaagaattgcctcatcaattaattctacaagaaaaaaactcaactgatatttaagcatagcctgaccacatttatgcc

SEQ ID NO: 32448 - DNA, 1009 bp, Triticum aestivum
  Clone ID: PAT_TA_32448
gtcgacccagcgttcggccgtatcatgggtggagctggagccccgatgccatcttggctggaactctggattgagtgggagatccaagttgttgtcctgaccagctttagtcttcaggttatcctcttcttcttcgcggggatccgccgctacagcgtctcatctgttctcaaggccctcctctggatggtatatctggttgcttgcgatgttgttgcaacgtacgccctggggcacatgtcctcgtcgttgtcgaggaaatcgtccggcgagaaccagctggtggcgttgtgggcgacgttccttgtgctacacctaggcggccaggacaccatcactgcgtacaccctagaggacaataaactctgcaggtcgccaccaccgtgtatctgctctacaagtacatcattgcgggcggggcgacctatgtccgcgccactatgttggttctggcctctggagttgtcaagtacggcgagaggatatgggcgctgaagcttgcaagcaagggtggcgccccaagttcccgtacgccttttctcctggcgatttatgatacttttcttaattctcggcaaagagaagaagaccggcatggccaaaacggtggagactgcttcaccaaaaacaaacagtttggagcatatgcatttactgtgatgatggcacatgcgttgcgccatgtacttgtcaagcctttaatcatagacaggaatgaggcgtccatagactggacttacaaaacaattggtctcgtaaagggtcttgtacaaggatttccatggcaagacgagagcgaagatgcatcggcaaaggagaacaggactatcggggagctgtacaagggagtagaggtgcagctcggcctgatgtacgacatgctctacaccaaggcagaagtgatccacaaaagccgtggccactggatctgtgccatttcacttgtgtgttgcttcgccgctcttgtttaagatagtagctgtgtaaaatatatacatatacaatatat

SEQ ID NO: 32449 - DNA, 2339 bp, Triticum aestivum
  Clone ID: PAT_TA_32449
cgtccgcggacgcgtgggccctcccctctctctcctccctcaaaactctctctccctccctgaaaattctccgcatactgggtgcccaagtggtgccggcatctcgctgaggcgcgagagagagagacagagagatcctcccctgttcccactcccccgccgctcccccgacccgccctctccagcccgccgccgagccgggaggaggtgctgcagctcagctccgccccagctcagtcgccgagcccgagctgatcgacccgccggcggcgagattcggccagggcacgacggagagatgtaccgggtgaagagcgagagcgactgcgagatgatgcatcaggaggaccagatggactcgccggtgggcgacgacggcagcagcggagggtcgcctcacaggggcggcgggccgcctctgaagaaagggccctggacgtcggcggaggacgccatcctggtggactacgtgaagaagcacggcgaggggaactggaacgcggtgcagaagaacaccgggctgttccgctgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgataatgaaataaagaattactggaacactcgaataaagagatgtcagcgagctggcttgccaatatatcctgctagtgtatgcaatcaatcttcaaatgaagatcagggctccagtgatttcaactgcggcgagaatctttccagtgaccttctgaatggaaatggtctttatctaccagattttacctgtgacaatttcattgctaattcagaggctttatcttatgcaccacagctttcagctgtttcaataagcagtttgcttggtcagagctttgcatccaaaaactgcggcttcatggatcaagtaaaccaagcagggatgctaaaacagtctgaccatttactccctggattgagtgacaccatcaatggcgcgctctcctcggtcgatcagttcccaaatgactctgagaagctcaagaaggctctgggttttgactatctccacgaagccaactctagcagcaagactattgcaccatttgggggtgcacttactggcagccatgcctttttaaatggcaccttctctacttctaggaccatcaatggtcctttgaagatggagctcccttcactccaagataccgaatctgatccgaatagctggctcaagtataccgtggctcctgcgatgcagcctacggagttggttgatccctaccttcagtctccgacagcaactccgtcagtgaagtcggagtgtgtgtcgccaaggaacagcggtctcttggaagagctgcttcatgaagctcagggactaaaatctgggaagaatcagcagctttccgtgagaagttcaagttcctctgtcagtacgccgtgtgatactacggtggttagcccagagtttgatatctgtcaggactattgggaagaacctctgaatgaatatgctcctttcagtggcaattcactcactggatccacggctcctgttagcgctgcgccgcctgatgtttttcagctctccaaaatttctcctgcacaaagcccttcgctgggatctggtgagcaggcaatggagcctgcatatgagcctggggctggggacacttcgtctcatcctgaaaacttcaggccagacgcactcttctccgggaacacaactgactcgtccgtcttcaacaacgccatagccatgctcctgggcaacgacatgaacacggactgcaagcctgttttcggcgacggtatcgtgtttgatacttccccgtggagcaacatgccacatgcttgccaaatgtcggaggaattcaaatgaattccttgcaaccttgagcggtatcgatggagattcttggtatccctcaccctgattgttttgaggaaaaattcagagaaagcctcatcgattgtatacgctgctagctcgccgtcgacaggtccttgacggcgtatgcagctgctaccagaagtgctctccatgcaactaagcccccatttccccaataaagttggtggagataagccggttatctattttttgtttgtttgtttggaactagagaccctttttgtcatctctttggcatttatttgaacaatgtaagatcagttactgcttttttctggtgtactctctcttgttgaacatttccccccaaattgtcaatcgatagtagcatcttttttcttgcgcacaaaaa

SEQ ID NO: 32450 - DNA, 760 bp, Triticum aestivum
  Clone ID: PAT_TA_32450
aaaaggtccacgtgtatccttatatcaccaattcgatgaatgtaatacaagttttacatcacagaagttataccactcagaaaattacacaaatgtagctagcgattagttaatgcatggagttaattaggcaagtgtggcgggtggctttgtggatgcgtgagcctatataagcactgtaatcatgttttactttgaaccaagggaaatagaagtgagaaaagacgcttgctgtgtgaaacagcacgtcaccaaactcatgtctcatgtgttcttatgcaagctgtgtgaagcagccatgtggaagaagggagctaggatcagctgcaacacggccttggctgtagtctccgagcatctttacttggtaacatgttcattctttctgttgcttttaaccggcttcatcatcttctgggcagcagccttgagggtctcatcgctcttgcaaaaagcaaacctcacataacggtgatggtaagtttggtcgtcggcatctgtgtggaagaagccacgacccaggtacttgccgccacaccagcattgttaatcaagttcgtcacaaaatctatgtcggaaatttgccaagacttgggcaactcagcaaacacaaagacttgaaccttgtggcttgaagctaatgtggaaaccataatttttcagtaactgaagaatgaagtctcttctctcttgcatagtcttttttcagggactcatagtagtccggtgtgttggttagcgcaaccaatgcagcttcttg

SEQ ID NO: 32451 - DNA, 682 bp, Triticum aestivum
  unsure (1)..(682): unsure at all n locations
  Clone ID: PAT_TA_32451
gagggtgngaaatagttttttttcaatactattaacctttgaaattactaataataagaacttgaattattttctttactgacggactagacatatcgacaagcttatttggtttctaccaagaatttgaataatgggcagaatgcccgaagacgcactgttatgccccaaacctgaacctactccagagctttagtgtatacaggaatgacagcatcccgctcaccggcctacggacaagaaggggagaagcgccccgaggtgctagctaatccaagtagaagagcgtcacgatcttccgcatgttctttgcctcctgacaggtctccatcagcagcctgctgtcatgaaacgcaaagcatatcacctgttggaccttcgagatgatgtccatgttgcataacctgctagcctcaattagtggtagatggtcatactgaggtttctcaatcaagttttgtactttagataatagctcttggctttcaggaggttgcttctttagactttgaggcaaaattacggtaagcaattctggcttctcagctctcaaagcacccctaataacagctgcattagtcccagaagcaccagatgtgaatatatgattttttgttatgaccatagcataactcaagatctcaataagttgttgatgcatataacccatgttccgggtacc

SEQ ID NO: 32452 - DNA, 541 bp, Triticum aestivum
  unsure (1)..(541): unsure at all n locations
  Clone ID: PAT_TA_32452
cggcgggggagcgtgnggagcagttcncggatttccagtctttcgcntacgtcttcgtcgtctttcgcttacgccntcggctgctacgccgtcgccgccgccaagtacggccacccggacntgaggncngtcgagatggagcaccgggaaaatggcgccggcagtggtggaagattcgttggcagctcggtgctgtctagtggcatatgaatgacatgatatgacttgtgctctgtttttcgccattgtcgtcttgttcgatntggtagagtacacgcgacgggcaaatcattgaggggcggacctgaacctgaggtcagtcggtacaagaatagagaggggctgtacattctggttagttaattacacagcaaaatcacagatcaacgttcctttagttttactgtgaagatcaatgaacatttttacatgagaggattagcataggactgtaagagagtccatcacagagggggttttactagcagaaatttggttttgtacaccaggtgtggattaccagaaatttggtttctgtcag

SEQ ID NO: 32453 - DNA, 704 bp, Triticum aestivum
  Clone ID: PAT_TA_32453
aagatgtatccaccaagaacttctttcctcggtagcatcaacaagccacctagcaatgctgcagcaatattaatcagggttggaatcatttgggttaaacgaaagaatgttaacagcaattattttattacatcgaaactagacaagtggttgtttctcgacattcgccacttgttacctgcagcaggtcgaaatcctcaaaccttcccactcatcattcctgttagataagaggatatcactgagtatctgctcctataacgaatgacacccggcaaacccgcgacatatctcagaccaccaaatataacctaagacgcggttctacctttctttgacttgttcttgttttcttgtgtcctctttttcttctctcctggcgtagtccaggcataatcagcagggataacaaaggggtcttggatgtcctccacacggttgctgggaccttgtgctgtcgagaagttctggcggtaaggagccttgatccactgaacccaggagcttgaagacgtctgggctcctgggctcttgcaattgtcagggctggaaggaggtgtgctgaactcttctaatggctgtagctcttcaaactttgtgaatgtcacaagaaccctgattgtgggtacaactggaatggcaaccttgactggaaaagtttctggaggcagttttgtggtgagtagatccctcaaacgaccctc

SEQ ID NO: 32454 - DNA, 547 bp, Triticum aestivum
  Clone ID: PAT_TA_32454
gtgaagcttgcatgagttcatattcatcaggattcagattacagcaagaaggattagcttcttaagctctgagagaactttgacatggcaatagaatctgcacgcagtgctgtccaacacaaactgaaacagcatatgtcgatcatctatctactgacgtccggcacgccggagagcctcacgccggcgcgatggacaccttgtcgacctgcacgacgtactccagcgtcgcgccggggggcacctgcgcaccgtcgtcgccgaagtcggcgccgtcctcgccgaagcccaggctcgccggaacgaccacccgccgcttgccgccgttccgcatggaccgcagcgcgtactcgatgccctcgcacatgcccctggtgtagggcctggagcccatgacgagcgccagcggccgcttcccgtcgccgaacgtgtccacgaacgcctcgccgccgccggccacccgcccctgcaggtcgatcaccaccaggtcgcccggccgcggcacgtcgccgccgcccacccgcatctccgtgtaccggattccatt

SEQ ID NO: 32455 - DNA, 628 bp, Triticum aestivum
  Clone ID: PAT_TA_32455
gcgctagcggggccttatggctacatagcacctgtatgttcctacacttctctagttacagagaagtgtgatgtgtatagctttggtgtggtggtgctcgaggtgttgatgggcaaacatccaggagagctacaagcttttcattcttcactcaatgaccaatttcttctggaagcccttttggataaacgacttccccgaccagaaaccgaggcgaacgacgtgaagcagtgcatctctgtggcatttgattgcctaactccttcacccaaacaaaggccaactatgcaaaaagttcatcgagatctttccatctgaacttacatattaaactcttgcagatgtatcatcttaggtttgtttcgtcagaacaaaacttaagctgccttagctgtccaagcctgctcaacaaataattaacgctatttctgctgggaaaaaaaaaaaatattagccgtgtactcacgatagagtagtgatctaaacgctcttacatggacttacagagagagcctaattgttctttctatgatcatacagatcatgaatcatgcttatgataatattttgggaggaggcccgaagtgatgataaaaaaaaaaaaaaaaaaactccgagactagttctc

SEQ ID NO: 32456 - DNA, 530 bp, Triticum aestivum
  Clone ID: PAT_TA_32456
accgcccaatgggttcaaagtacttgttgctctgcctttgcaccctcctagtgctctcaggagccatcgctagagatatccccgcctccggagccacccccgttgctcatgcggctcccaagggcgatgccggcacccacggtgttgatgttggggagcaacagccgcggcttccacctagattccgctgcccgttccctcccttttgccgcggtgctacacatccatgaaaagaagattgcgatggccatgtaaccatgctaccctggtgcgggaataaataatcaaatcagatctcgcttgaaactatatgtacgtgtgtttttaatctccgtgctactcaacatgttatgcatgcaaccatcgtgcttatcggtcctatgttaaaccagtgccccccttcttgtaatgtatgatgttctatcacctcccttcatgtaatgtgatgtatgtaacgaaaacatccctagccagttctcgttgatggaaatatgagttagaagtaataaataaattgtattattctattt

SEQ ID NO: 32457 - DNA, 598 bp, Triticum aestivum
  Clone ID: PAT_TA_32457
gccgggccggcctgcgcgttgcctacgaccacttgcctccctttgctcggtcgtttaaaccaagtattcaccacccaatgggttcaaagtacttgttgctctgcctttgcaccctcctagtgctctcaggagccatcgctagagatatccccgcctccggagccgcccccgttgctcatgcggctcccaagggcgatgccggcacccgcggtgttgatgttggggagcaacagccgcggcttccacctagattccgctgcccgttcccccccttttgccgcggtgctacacatccatgaaaagaagattacggtggccatgtaaccatgctaccctggtgcggcaataaataatcaaatcagatctcgcttgaaactatatatacgtgtgtgttttaatctccgtgctcctcagcatgttatgcctgtaaccatcgtgcttatcggtcctatgttaaaccatttgccccccttcttgtaatttatgccgttctatcacctcccttcatgtaatgtcatgtatgttatccacttgaataaatcgcgccagagcatcataaaaaaaaaaaaaagaaaaaaaaaaaaaaaaaaggccccta

SEQ ID NO: 32458 - DNA, 398 bp, Triticum aestivum
  Clone ID: PAT_TA_32458
ggagatcttgggtgtctggtcgtgctcaagagttacttcttccatggctgtttaatcccgatcacggtgcaaaccgatatcagcagaaggatcaggagaatgatgatggcgtagcacatccattgtcaggtcgatcttgggtgggtgccttctggagagcatccacaccttgctgtatgtggtcggcagcatgtgaaaccttggaaaaacatggtgcgaacatttcgttagcttgctttataaaatcggttaggtctatttagaacaagcagtttccagaagttgtcttacatgtgtctctatgtggttgatcatttctccttgagactcaaccaatactaacatacccaggaatatctacagggcaaaacccaggaaatggggtacattaagagttt

SEQ ID NO: 32459 - DNA, 566 bp, Triticum aestivum
  Clone ID: PAT_TA_32459
ttttttttttttttttttttttttttttttttttgttcaaaggtagcatacgtttcttatttactatatcatagcccttttttttttttttttaaatgaacatgtgcactgattattaatagtaatagaaaacccagagcctgttgcatacatcaaacatacacgggacttattctatagactgaggaaattatagcttactggaactacatgcctgattaatggacttaagctgattgttgccgttgcccatgtcagtagtcgtatagtccagcacctaagctggcctgcccaggtggagtgttggtgttgccgagaggtaggtgctagttgtccaaggtaaaaactccggcagaaaaagaggctgaatcgctgagagagtgatcaattactatggagcaccggtaactgatctgttgctgcccatttagtgtatctgctttgatcttcttcaacgacacaaccacctctctctcagctcgttaatgaatcaaagagtcacacgagcagagcaaacctagttcgaacaccagcataagacattcatcaggtagtttgcagctagg

SEQ ID NO: 32460 - DNA, 910 bp, Triticum aestivum
  Clone ID: PAT_TA_32460
gcacgacgcaccacagccactcttttcttctcggcggaggcggaggcgaacgaggaaccctagatccgcaaggccggcgacgatggcggcgcttcggtattcggcgaggaggctgggtggctccctgctccatcgaacgcaggccgcggtcgaggaggagggacgccggctcatgcgcccccgccagatctcaaccgagttcttcggcgagcatgctcgtgcaccctctgcacgccaggtacagcagaagaaggaggagctgtatgaggcggtgtctaaggcggaacagaagaagcaggagctgctcaatttgatggctaatgagcagcatttttctgcacaatccactcaaggacaagctgcccctctgccctggaaggtgtactcgaaaagggctcggggtgtgctagatgtagcttgcaaggcgacatttttcgtctatgctggtgcttttctgctcggtatcactggcaccggcaggatgctggggctaacaagccaagtcgccagtcaagacgagatcgacgattgagaaccaatcaaggacaggcccagttcaattctgacccctgcagtttggttagctagcaccaccatgctatggttgtgatatttgtctgacatggtgtcatgttgttttatcttttatatctgttggagtgaaaccgtaaagacttggtgtggacatgcattacatagcgcttgttgtatgttaccgcaggggtacgtcactggcaatcgttgttggtgttagaattgctagattataactgccttaagcagttatttagtgcccaaagtgttgtgcagacgcacgccttctctgtgtaaggtcgcctgttccctacgaagaggcacctattcgttcaagaggcgcctcctcttgtaaaacagacgggaatccttgtgt

SEQ ID NO: 32461 - DNA, 792 bp, Triticum aestivum
  Clone ID: PAT_TA_32461
gcgttctgttacggacacctggccgtgcgtcggtgagccgctacaggatagataacaacatatgatgattctggccgccgcgtcggcacttgaagcggaggtgagcgcgtcggacgcgtgctgtcggagatgagcggaggcgagcgagtcagacgcgtggcatcggacatgggcggcggcgaccgtgccggacgcgtggcatcggacacggacggcggtgatcgtgccggacgcgtggcattgggcatgggcggcggtgaccgcgccggtcgcgaggagtcccgaacaagctggagcgctgtcaagaggcttgccagccgcgctccttccaccgatcggtgtgacaagaagcccaaggctccggtcgacaaggaagctgctctggagacagagcaactgttcgctggcccgacgttcatgagcgtcgtgcccccggatccgagcgagctcccgatcccttgatacttcatgaagaagtgcccgctagtggactagcaagtagcaacaacacatgggattggtcccttactacagtcgtctgtcgtcgtcgtgtaatctgcctttgtagcccaatttcagcgcttgttagatgcgcttctagtagtgtagtaatttgtcatggctctgggttgtgttcatgttagtaaaacccaacccagagaggggcggatgggtggcatggcaatcataaactatcttccatgttattttactccccttgcaatccttcctgcagtctttcctctactgaagagtgaagaaacccctgttttaaaaaaaagaaaaaaaaaa

SEQ ID NO: 32462 - DNA, 418 bp, Triticum aestivum
  Clone ID: PAT_TA_32462
gtagatcagggatgatgaatgtgcttcccacagattccatacgtcacatgaggagctttgttgaactggagtcaaacgaacaaaccaagggaaaggtaaaacgtaataccgtccagaaagattgggttccatgtcgccactgcggtactgggtgatgggcagcacacgaagccgaggagatcggcggcgcgcgacgccgaggagattggcggcacgcggcgttgaggcaatcagcggcgtcgcgacccaggagatgggggcagcgtccagcgattgacccaagaagtcctggcgaccagggatgcggcaagcacggtattcacggcgggcagcacgcactcgtccgcttcaagtgctgatctgatgccaaagtacgtgaagatagctacaggggtacttcggtctttgcaggtgccag

SEQ ID NO: 32463 - DNA, 568 bp, Triticum aestivum
  Clone ID: PAT_TA_32463
gccgccccacatgctatactcctcagtaggaattaccagagcccccaagttagcaatggcaaagtgtctcgccgccgcgctcctgctactggcggtgctcgcgtcctgcgacggggagggaactgaacgagaaggttgcagcgacacacggtgccggcgtcggcgagtccaaggcgatggggttgccggacttgccagctgtgacgctccccacggcccccgacgctccccgacgctccccacggccccgacgctccccacactcccgacgctcccgacgctccccacactcccgacgctcccgctggtgggaaccattaccggtaccaggtacaattaccggcccggtggtggcgcttccggcgacccctgctcacccttgattatctctacctgtacgcactgtccgaatgggacaaacatcggcgttgcgctcatttgctatgttcctttccttgctgagcgtactgtatttatctaccagttcatttttcttgtatttttcgttccttgcatgtgctacatgtatcatggacgtaataaatactactttgtcaaaaaaaaaaaa

SEQ ID NO: 32464 - DNA, 632 bp, Triticum aestivum
  Clone ID: PAT_TA_32464
ccgggtcgaccccgcgtccgctcccccgccgcatccgctgcgcgtgtccacaagctcctgccgcaaccacgcgactctgcccaccgaccaccgcatctgtcgcatgcatcggtggttgccgcacgacgaaggtcacggctggtcccgcgacggcctcggctggaggaggacgataggtccatagcgacggacgctcaagtaagaggagcgacccaatggcggcggcctcgagcacggggataagtgcaggctggggatgcaggagaggtgcaacgcggtgtttggagctcccacgagctgggtgcggcgcatccgacgacgacagacacagggacgcgttgatccgggtgtgggtgctcaattcggtcccgttctggccggatccgtggcggtgctcatctccggcgaggtggcctgtgactcgcgggacgacggcggcgcaagaccacaggaggggctcatctcatgggacatgggcgcgaggtcttgttggcttcggttgccggtggcttgacgcaggggtggccggggtccggcgccatggaggctcttcgaggacgaggaagcagacagcgacgacaacttgaggccggcgggggcgccgtctccgcgttcgatggtcggggtctaac

SEQ ID NO: 32465 - DNA, 673 bp, Triticum aestivum
  Clone ID: PAT_TA_32465
cgtccgcccacgcgtccgcggacgtgtgggcggttgcaacttgcttcgggggtcaaaccgcagacagagcaggggagagtccaaacttctttttttttttgagggagagagtccaaacttcttccttctcgaaccacccgagagagacagagagagatagcggcgatggcgaccaaggaggccaaggtggttcccgccggcgacgtcgacgccgccgtcgacggcgaggatctggtcccggtgctggcgtcgctggagccggtgtacggcgcggggtcggcgctcgacgaggcgcgcctccgcttcgcccccacgcgtccggaagtactacaaatcaagggtcgacaggggagtgatcaagcagagcgaccttggcctgtatgtgtttgcgtcgaagcagtcgagcggcgcagccatactgaggctgtagatcgaccaccgccggccgtggtcggtcgcttgtacatgcacacatacctattgctcgaataaacgcgtgctcgaggcgagcacgctgccattagctaatttagtgcccgcgtgtctgaatgtacaatactagtacaatgtgtagtatttatctctgtttattatgggcgatctgactgccaggttatctaaaaaaaaaaaaaaaaaaaaaaaaaaaaaaaaaaaaaaaaaaaaaaaaaacacg

SEQ ID NO: 32466 - DNA, 1881 bp, Triticum aestivum
  Clone ID: PAT_TA_32466
gacggttgcgacttgtttcgagggtcagagcgccgaagagtaggggagagtccaaacttcttctcgaaccaccatagagacggagagagagatagcggcgatggcgaccagggaggcgaaggcgaccaaggaggcgaaggtggttcccgccggcgacgccgacgccgacggcgaggagctggtcccggcgctggcctcgctcgagccggtgtacggcgcggggccggcgctcgacgaggcccgcctccgcttcgcccgcctcgccgaccgcttccgcgccctctactccgccggccccgccctcttcgcccgctccccagggagggtgaatctcatcggggagcacatcgactacgagggctactcggtgccgcggatggccatccgtcaggacatgatcgtcgccatccgcaggcccgacgccgctgtcgatcgcctcccgcctgtcgacgacagtcgcgccacctgcgtctaacccgccgacccggacaaggaaattgacatcaagaaccacacatcggggccctactttatgagccgatacaaggaattaacatcatatgctacatctgaagcgattaatttaggtgaacatgttggtcatgatgtggatgttgatggcacaaaggcacaaatatgggtgaacttgttcctcttgatgtcgtagttgatgggacagtccctcaaggatctggacttcctcgctcagaagcatttgtatgttcggcaacgattgctatcatgggcattctgggtaacaacttcccaaagaaagaggtggcatagttcacgtgttatcctgcgcgccctatccgggctctgccggggggcatggatctcgctccatccatcgcggccgatccggggcttccctgtggtggtacatttctgtccgctcactgcatcgcagagtccaagaaagcagaaacagctgctacaaactacaacaaccgtgttgtagagtgtcgcttggcagcgattgttctcgccatcaaactagggatggatacaaaaaaggccgtcacgtctgttacgactctctctctgatgttgaggggctatgcgtctcctttgctggcaaagaacggttcttctgatcccggagttgctgtgaagatccttttgcatgaggagccatatacgttggaggaaatagagaaaattacaggtcaaagcctagcaactgtcttccagagctctcaaacttccttggatgttttgagagctgcgaagcatttcaagttatttcagcgtgcctctcatgtgtactctggagcaaggcgggtgtacgcatttagggatactgtattatcgaaactcagcgatgaaggtatgcttaagaagctcggtgatctaatgaacgatagccatcatagctgcagtgtgctatatgaatgcagctgtcccgagttggaagagcttgtaaaagtgtgccgggacaacggggcgctcggagcacggctcacaggagccgggtggggcggctgcgcagtcgccctggtcaaggagggcatcgtcccacagttcatcctcaatttgaaggggaagtgactacatatcaaggggcgacaggggagtgatcaagcagagcgaccttggcctctatgtgtttgcgtcgaagccgtcgagcggcgcggccatactgaggctgtagatcgaccaccgccggccgtggccggtcacttgtacatgcacacatactctcgaataaacgcgtgctcgaggcgagcacgctgccattagctaatttagtccccgcccatgcgtgtttgaatgtacaataccagtacaatgtgtagtatttatcgttgtttattatgggcgatctgactgccaggttatctcggacgcgtgggtcgaccggaaaattccggaccggta

SEQ ID NO: 32467 - DNA, 767 bp, Triticum aestivum
  Clone ID: PAT_TA_32467
cggctcgaggatggtactattgtgtccaagtctgagggggttgaatttactgttaaagcgcgacacctctgccctgcactggccaaagctgttaaaaccatgaaaaaaggagagaaggtgctcctcacggtcaagccacagtatggatttggtgagatgggtagaccagcagctggcgacggaggtgctgtgccaccaaatgctggtcttattattgaccttgagttggtttcatggaagactgtcacagaaataggggatgataagaagatcctcaaaaaagttctcaaggagggcgaaggatatgaacgtcccaatgagggtgcagttgttacagtcaaaataactggaaaacttcaagatggcacagtattcttgaagaaggggcatgatgaacaagagccatttgaatttaagactgatgaagaggcggtcattgagggtcttgatcgtgctgtgctaaacatgaagaagggcgaggttgctcttgtcactattccccctgaatatgcttatggctcaacagagtcaaagcaggatgctgtcgttccacctaacagtaccgtgatttacgaagtggagcttgtatcatttgtaaaggataaggagtcatgggacttgaacaactcagagaagattgaggccgctggaaccaagaaagaagaggggaatgccttgttcaaatcgggcaaatatgccagagcttctaagcgctatgagaaggctgcaaagttcattgactatgacacttcgttcagtgaggatga

SEQ ID NO: 32468 - DNA, 2102 bp, Triticum aestivum
  unsure (1)..(2102): unsure at all n locations
  Clone ID: PAT_TA_32468
cctnaattcccggggggagcccgacgcgtgcgcgctctcgcgcccgccgaaggccaaaccctagcgagctcccttcctcctcccccaagacacaaacctcagatctcacccatcccacgccatggacgacgacttcgacatccccgcgggcgacgacatgatgatgggagacgggatgggtgacttcggcggcgccgaagggccggggatgaaggtgggcgaggagaaggagattgggaagcaggggcttaagaagaagctgctcaaggagggcgaagggtgggacacacccgaggtcggcgacgaggtcgaagtccattacactggcaccctccttgatggtaaaaagtttgactccagccgtgatcgtgatgacactttcaagttcaagttgggacaaggtcaagtgataaagggatgggatcaaggcatcaagaccatgaagaaaggggaaaatactcaggtcaccatacctccaggattggcttatggcgaatctggttcactcccaattattcgggccaatgccaatctgcagttcgacgttgagctgcggcctgaggcacgagacagatttatatttaagactgatgaagaagctgttattgagggtcttgatcgtgctgtgctaaatatgaagaagggcgaggttgctcttgtcactattccccctgaatacgcttatggctcaacggagtcaaagcaggatgctgtcgttccacctaacagtaccgtggtttacgtcggggagcttgtatcatttgtaaagaataaggagtcatgggacttgaacaactcagagaagattgaggccgctggaaccaagaaagaggaggggaatgccttgttcaaatcgggcaaatatgccagagcttctaagcgctatgagaaggctgcaaagttcattgactatgacacttcgttcagtgaggatgagaaaaagcagtcctcgcaactgttgatcacgagcacgaaaaatatgaacgtcccaatgagggtgcagttgttacagtcaaaataactggaaaacttcaagatgggacagtattcttgaagaaggggcatgatgaacaagagccatttgaatttaagactgatgaagaggcggttattgagggtcttgatcgtgctgtgctaaacatgaagaagggcgaggttgctcttgtcactattcctcctgaatatgcttatggctcaacggagtcgaagcaggatgctatagttccacctaacagtactgtgatttacgaagtggagcttgtatcatttgtaaaggataaggagtcatgggacttgaacaactcagagaagattgaggcagctggaaccaagaaagaagaggggaatgccttgttcaagtcaggcaaatatgccagagcttccaagcgttatgagaaggctgcaaagttcattgagtatgacacttcgttcagtgaggatgagaaaaagcaatccaagcaactgaagatcacctgcaacttaaacaatgctgcctgcaagttgaagctgaaagactataagcaagctgaaaagctttgcaccaaggttctggaactggacagccgaaatgttaaggctttgtacagaagggctcaagcttacactcagcttgcggacctagagttagcagaggtcgacattaagaaggcattggaaatagatcctgaaaacagggatgtgaagttgacatacaagactctgaaggaaaagatcaaggaaatcaacaagaaggatgccaaattctacagcaatatgttctctaagatgaccaagccttcagcagaagaaagcaaagcttgaactggagcagtacccaaaggaaggataggagtcccggagtgcgctcacggaagggccagcttgtctgctcagctctatgggctggttagaccacgcatgtgcttggagttgctaaaaactagagaaatttcagttttgaggttgccaggcaatattttttcttgtcaagaacaatgcatgtttagacctttgcatattatagtgtgtgctttccgggaaatgtgctttccgggctaaaaatcgagcctcctgctgtctctgtgatgtgtgccttcctaacgcacccttatgcaaggtttcgc

SEQ ID NO: 32469 - DNA, 662 bp, Triticum aestivum
  Clone ID: PAT_TA_32469
tacggtcgtaattccggggcacgggaaactaaaaatctcaagtacatggaaggatcttacagtagggtgttgcaagacttccaactgtgaccagctgcagttggttcagcaaaaatataaatctctggagcatcaacagcaaaaatataaatctctagagcatcaacagaaagaaaacgatagaaaatagactatttgagcagcagctggtgcggtagtctgagtagagatttcatggtagcgaaggaactttgccgtataattgaggccaacttcacagaaggatcaacacccgaagacaacaatctgaatcgtatttctcatagataagatatgttgctaatcatcttaatgatacaactttacaatgagacattgtacaaaaaacaaacaagtatttttggagtctggatgatgataccgaaggaatttctgctttaggcaatgacggcccaccaatcacacccaccatgaagagttgcttagacaacgaagtcaatttcgataccgatggcacatgcagcgatgactttatctgatgtccatcacttcataaccatctctagctatgtgctttgcttgctaataacattgtaaataatctattgtaaacttcttggaacactatgtatcagcattgagtatccatttccttatcttct

SEQ ID NO: 32470 - DNA, 826 bp, Triticum aestivum
  Clone ID: PAT_TA_32470
cccgtcccgagctcagtcaaggcttagcctccgtccatagctcagtcaagctcaagccgtgcgtgtggcttgcaggagctagctgtggctagaacttcgcacgtccagagagggactgaggagggaggtcgacgatggcgagcagtatccagagggcgtcgttcctgctccaggtcgtccggagctcgtcccgctcccgcaagagggagggcgtcttctccgaggccgcgccctggcagcagccaatctccggctccggcagggtgccccaaccacggacgccggcgaagctggacaccatcgtcgaggaagagtacaactctaccattatgacgaacgaccccggtttccaggtcggggtctcttcttcgtcgtcgtcaacgtcggcctcaacgtcggcgccatcgttaatggccgcggccggggtccccagggcctaccgtttcgccgctaccgccaccggcgcgcagcagacgcgttgttaatcgatcgacgtcgtcggtttttaaggcgagcgtggacggtatatttttgcgaaattaacctcgtttataaattgcaaggaccataataataataatcaaccgagactagctacacgtatcgtgatgctttatgtatcatgtatacttgacgaattaagtgttctatatgcatgtttcccgcgtttatacgtggatgtaaaacgtagtactgctatttacgttaaggaggccaaagatcggagattctgatactctatgtatcatgcatgtactgtaataaaaaagtggcacgaggtctgtttttcgacttctatgcaaataagacccaaacttatgtaccc

SEQ ID NO: 32471 - DNA, 1268 bp, Triticum aestivum
  Clone ID: PAT_TA_32471
cggctggggttttgactggacatctgcatggcattactcatattgacagccgtggagatggtagatgtttcatatcaaatggaaaagatcaagctattaagatgtgggacatccggaaaatgacatccaatgctgatgggtatgtcttaagcaacaggcagtctgcttaatccatttttttgttgctcggatttggacatattggcttactgcagagctatactaatcttattgtttgatacagttccgaaaacagagtccctgcctgggactacagatattcaagatatccacaacagtacaagcaacaaaagcatccacatgaccagtcagtagctacataccggggccattcagttctccgttggggttttgactggacatctgcatggcattactcatattgacagccgtggagatggtcgatgtttcatatcaaatggaaaagatcaagctattaagatgtgggacatccggaaaatgacatccaatgctgatggttccgaaaacagagtccctgcctgggactacagatattcaagatatccacaacagtacaagcaacaaaagcatccacatgaccagtcagtagctacataccggggccattcagttctccgtacattgattcgttgctatttttctcccacatatagcacaggacagaagtacatatatacaggatcttatgatgctagtgtctgcatctatgatgtggtaagtgggtcgcaagttgccaaactgcaaggacatcatcatttggcagttcgagactgcagctggcatccgtccgatccaatgcttgtcagttcatcatgggacggccaggttgccagatggtccaggactcgctccaagcaagatacttgtgaactcgattaaatcgagtgtgcagatacttcgcgtgccctgtaatcttccgatatcaggtgcaatcttgggtcaaaagggatactcggcacggcttgacaaaacaatagaaaatgaaaaggaactctagctatgatgtacatataaaatggaagccaagccaagtgcatatgtagtagtatttcattacaccttcggagaaggtaacgaaacaacctatccttagatggtgcatacgtgtatacgtccttggttgtttttgctcttccggtgagcagttgcagctcatcctttcagaagcagaactgtttgtacttcgtgagagaaatttgttgcagcaaaagcactgtatatttgtacctatactacctgtactttgcaagaaatttctcgcagct

SEQ ID NO: 32472 - DNA, 995 bp, Triticum aestivum
  unsure (1)..(995): unsure at all n locations
  Clone ID: PAT_TA_32472
ctcgtgccgaattcggcaccgagtggtggtcagctagcgagctgaggccactcgtacgcagtggcattcccgtgaatacacgggcgccggccggccggggatttcgtcgccggagagtgtagagtagactgtacagagagaatcgttagctgtgtatcaggagacagattagaggcgggggaggggggatctatagagagggggcgggccgcagtggaggccgcgtgagggtgcgcaagaagctgatgaggctcttgtcgttcgtgccctgcggctgccgtgctggacccatcgacgacgcgccgcctgcggatcagctgcagcagcaggcctgctgccacgaccaccggcgcggcggcaaggaggaggcggaggagggccaggtcgctgggcggctcgccgcagtggaggccggcgcttggggacatctatgagggtgtcgcggtggacgtgggcaaggccgcagcgggtgggcgcgtcgtcccggccaggcccggcagggtggcctccagggtcctgccccgcgcgcacagcgacgaatacaggcacatcgagacggcgtcgtcgatgccggcgttcgcgccgacggcgttcctgttctgatgacggcggcggaccggcgatgacgaccacgaaaaccaagcagcagaatcggaaatctatatacagattgctattactgtctacgtattgcaggactaaggatctgtacagggaataaaccggctcccctgatggcgagctggattaattaattaattaatcaaccactcctactagcctatatgcgcgtcagtgcgtgccgcgtgtacgtaagtgtgatgtgtgtgtatctcggcagggtacggttgccctgccctgtacatgcgtcaactaccatgcatgcatgaccttgtaaatcctaggtcgaacgcaaggtgtaaagtcatgtacatataaaaaagggggggccggtaccaattnnccnatatgatctattacnccgccactgggct

SEQ ID NO: 32473 - DNA, 214 bp, Triticum aestivum
  Clone ID: PAT_TA_32473
gcagcgtgaggggctgcccggcgaggaagcatgtcgagaggtgcgtcgacgaccccgcgatgttgatcgttacctacgagggcgatcacaaccacaaccgagctgcggcagcccagccgcagccagcctgacctttcgggcctccatcgtcgtcgcagaccgctttcgatagccgccgattctagaagaagagataaaaaaaagaagattggag

SEQ ID NO: 32474 - DNA, 661 bp, Triticum aestivum
  Clone ID: PAT_TA_32474
ggccggggcgatgcggcgacggggagcggggagctgctcgccattcctggggtcgggccgcggaaccagaggaagctcgttgagaagggattcgatggcgtggcgccgctcaagcagctctatcgggataagttctttggcaagtctgatgagaagatggttgagttcttgcaaagttcagttggcatcatacacaagaaccatgctgagagtataactttgttcattaaagagagcattgatgaggaggtgaaagacactgacacatctaagccttgcagaagaaagaggctcaccttttgtgttgaagggaatatcagtgtcgggaaatctacattccttcaaagaattgccaacgagactatcgaactacgtgaccttgtggaaatagtacctgaacctgttgcaaagtggcaggatattgggcctgatcactttaacatacttgatgctttctatgctgaaccacagaggtatgcttacactttccagaattacgtctttgtgacaagggtgatgcaagagagggagtcttcaagtggaataaagcctctccggctgatggaaagaagtgttttcagtgatagaatggtttttgtccgtgctgttcatgaagctaagtggatgaacgagatggaaatcagcatttacgattcctgga

SEQ ID NO: 32475 - DNA, 1047 bp, Triticum aestivum
  unsure (1)..(1047): unsure at all n locations
  Clone ID: PAT_TA_32475
ctttgcttctgaacattcgaactgtgctttcccagctggcagactaggactgcaagggattggtattagtccagactgcaatccggagaacagagctactccacgacagctgtttaactgggctctggaacctgctgaagatgggcacgaggataaattgtacgagcttgggtaccaggatgcagctgtgtgggctgagcagaaccctcctgagtaaactgtgaatattgagcagctcggtacagattgagaaggcctggagccccggacaaagtgagcatcttggtcctttttagttttgacgtagacatctagatttgtccttgtttggttgaaagatgtcaattattttgttcgctcagaggttagcagcctcttgtaaatttgtaatataagtgcgcctctatttttaaaatgtacagcctcttggctaggttttataactgtacaattgtaactacaaccaatggcaaattttaacatggtccctcttacctcctaaaaaaaaaaaaaaaaaactcgagagtacttntagagcggccgcgggcccatcgattttccacccgggtggggtaccaggtaagtgtacccaattcgccctatagtgaggcgtattacaattcactggccgccgttttacaacgtcgtgactgggaaaaccctggcgttacccaacttaatcgccttgcagcacatccccctttcgccagctggcgtaataaccgaaaaagccccgcacccgatcgccctttccaacaagttgcgcagcctgaatgggcgaatgggagaacccaattttttaaggggattaagggggtaaaactaccggattctaattgggtngggggatttttaaaattcacaggcccccggcgggtttatggcccccgcacccctcccagcccctcactgaacatggtcacccggaccnatttggcgangcccttccccgctttttttaacttcccgccctcccctgggccttgaaanataaaatggaatgcanttggtggngnttaacttgtttttggcncttataangggnnt

SEQ ID NO: 32476 - DNA, 1127 bp, Triticum aestivum
  Clone ID: PAT_TA_32476
cggcacgaggggcgtgcgagtggcgcgcccagtgggacaacctgcccatctcggagcgcgcgcgcctcaaggcccggcagggcgtcagcgtcctgtcactcgccgacgccgacgtcgtcaccgacgacgacgcgatggccagggtgccgcgcgacgggaagacgctgggcgagatcgtgctccgaggcagcagcatcatgaaggggtacctcaacaacccggaggcgaacgcgcaggcgttcaggggcgggtggttcatgacgggcgacgtcggcgtggtgcacccggacgggtacatcgagatcaaggacaggtccaaggacgtgatcatctccggcggcgagaacatctgcagcaaggaggtggaggaggcgctgttccggcacccggccgtggccgacgctgcggtggtcgcgatgccgcacgcgcactggggcgagacgccgtgcgcgttcgtggtggccaaggacaaggcggccggggtctgcgaggacgacgtgatggccttctgccgcaagcgcatgtcgcgcttcatggtgcccaagtcgggcggtcggtctgggacgtcctcccgaggaacgcgctcggcaaggtcgagaaggtgaagctacgggaggaggcccggaagctggtgccggccgtggcagtggcgccgccggcacagaagacgaaggggaagccgacgacgaagacggtcggcggagggcgccgggacgagcacccggtggagcaagtcatggccatgtcaaggctatagggcatgcagagcgccattgccaacaacaagcatacgtacgttcctacgtgcatttcttcgtgatgatgtcgtacggtttcaaaccatggtggtttggtcaggtaattaagagatctacgtgtgttggtaaaaagtgtaggaacttggcaccatgcatgcaggcgtgccaacgttgcagaaataagcagggagtgcggttaagacttaagagagctgtgaaagctctattctgtgtataggatggaacgagtctgtattagtgcagtggcaccaaactgttttttactctgtttttctcttattttctgatgatcaattggaactttcatatatatatacgaagtaaatatcgaggctggaaatgtgaagg

SEQ ID NO: 32477 - DNA, 914 bp, Triticum aestivum
  Clone ID: PAT_TA_32477
tcgacccacgcgtccgaaaaaaataaaccagagagaggcccaaaaatctattatccacggcaccggcggcgggaagagggtcttgggcaagcagcggcgggagcggagacggtcggaggttgctcgccgccggccgccgccgacgcaatgggaatcaagggtttgacgaagctgctggcggagcacgcgccgagggccgcggtgcagcggcgcgtggaggactaccggggccgcgtcatcgccatcgacgccagcctcagcatctaccagttcctggttgtggtgggaaggaaaggaacagaagttctgaccaatgaggccggtgaagtcacaagtcatcttccgggcatgttccaccggactgtaagattgcttgaagcaggaataaaacctgtgtttgtgtttgatggtgagccacctgacctgaagaaaaaggaactggctaaaggtctttgaagagggatgatgcttcgaaagatcttcatagtgctattgaggttggagatgaagattcagttgaaaaatttagcaaaaggactgtgaagatcacaaaagaacacaacgatggctgtaagaggctgttaagattgatgggtgtccctatagttgaggcaccaggtgaggcagaagcacagtgcgcatcactttgtaagaaccataaggcacatgctgtcgcttcagaggatatggacacactgactttcggtgctccaaggtttcttcgccatgtaactgaccttagttttaagaaatctcctgtaacagagtttgaagtgccaaaggttttggaggaacttggactaacaatgggtcagttcatcgacttatgtattcttagtggatgtgactactgcgagaatattaaaggtattgggggacaaagagccttgaaactcatacgtcagcatggttgc

SEQ ID NO: 32478 - DNA, 2488 bp, Triticum aestivum
  Clone ID: PAT_TA_32478
cccacccgccgccccccccgcgcgtcctgctcctgctccccttccgaatccaccagacgctcccacccgccccctccgcgcgcctcgtcccctcccccctcccctccccttggccccgcctcgccttcttaaccattttggaaattctgatatgcttccaccaagagtgactggaaaaatcttggagttggaaactataacacagtccgaggcttcaagaaaacgctaccgcttcttaagccacttctcattaactacaccggtccagtgctgcgtccgtgcccccagggggttgctgccgcctccctctgccgctcctctcgtgcatgggagcttgcggcgcgcggtgcacagtggccgatctgcccaggcagatgttcaggagactggagttggtggggtccctgcagatggaccagagttctgatggacttcagggtaatggagctctgctggctcctagaaagaatctggctgtgaatgcaaattatctgctgaattgccagtatgatctgctggcccgtccgcgaccccatcgccctatgaccgtaaccccgtcaacgcaatggaagattaagccttacaactaggacctggtcctccaagcaaattttaagttagttgtgttcgatactggaaattttcagattgattcaatggatcctgataagatgctccagtgggaagatatcatctgtgtaagatattgtagcccttctgaggtgcgatgtccaatttgtttggaaagcccgctgtgcccgcagattacatcatgcggtcatatctattgctttccatgcattttgcattatttactaatggggtaaagaggattacagaggtgagtggctggaagaagtgcccactgtgtttcatgatgatatctgcaaaagagttgaccaccatctttgtcactcaacttcagcatttccatattggcgacaatgtgaccttcgcacttctagggcggccaaaaaattcactcactccttttcttaggaattcgtctagtgaatattcttctttagtcgaccatccgtccgatgttttctccaagttcattttgacatctgatgttgagctctccgttagaggggcaaaatcagatctcagtaattggttgcagatggctgacttaggccttgttgatgacttggagaaacttccatatgtttccgctgctttggagcaactggaagaaaggatgaaatactggtctgagttcagatattacagtagcagcccccctctaaaaaatagctcctctcctatctctagtaacaaattgaagaactctgataatccgaaaacttcacatacgaacagtgggcataaactctcccctctttcagatggagatattattaccggtgtttcagggctttctgtttcacccctatatattaactccaaaaagggagtgccacaaaaaatggaagagcgacgtgctgttgcagttgattcaaatgaacaagactcatacacattttaccaggtgattgatggtcagcacctaattcttcatccattgaacatgaaatgccttcttaaccattttggaaattctgatatgcttccaccaagagtgactggaaaaatcttggagttggaaactataacacagtccgaggcttcaagaaaacgctaccgcttcttaagccacttctcattaactacaacgttccagttctgcgaaattgacctgagtgatatgctacctcctatctcattggctccattcatggatgaaatcaaaaggcgcgagaaacaaagaatgcaaactgccaagaaggaagaaaaggacagggtgaaggccgaagtagctgctgctgcgcaggaatctgctatgcgttttgaatatacaaatttctctcgtactcagagcgatgttatgttctctctcgatgactttgaagctctgggaaataatgctgctggaccatcaacgagtccaccggccggtgaacgtaaacttttctccgatgttacacggcttggtttcgcgtctgcgcaagactcgcctcctctgagagctgaaactggagacaccaataatgaaatcacaagggatcaagggccggtatcagcgtcttccgtgtcctttgccagcatcctatcttccactagagctgctgcggacagcagcgtcgagacgcctaaaccaaatggagtcggaaaggcgggcaagaagcgcaccaaggtgctcttatcgaccggtggtggccgccgatactagaggaacgctatgctggaaaacattttatcatttcctttgtagctcatgaacaatgtgtatagtgcagaagttggatttcttattatactgttaaaggagtgttggtgtttgtacatacctaattttatttttgtgatgcgagtcctcccatccccccttctctgcacggaaaataattacgcccacgcatgcagtccgaaactaggaaaatcaccaagtaggtaaaaccactccgacacatcgggcaatcgt

SEQ ID NO: 32479 - DNA, 1110 bp, Triticum aestivum
  Clone ID: PAT_TA_32479
ggctcctcgccctgcctctcctcccgcgcccccttcgggtgctcctcctccccctgccttctgcccctccgcccccctatgggattccctgagatggcacctcacgtttactattttgccgtgcccccttgggatggtcttcaagcccttccttttgcgcctcctccaccaacccctccagccatgctaatttctccactggaacaacttcaaagggacctactggtgcagatagactactactttagtgatgaaaatttgtgcaaggacatattcttgaggagacatatggatgaccgtggttgggtgccattatccttgattgctggctttaaccaggtccaaaggctcctatattgtattgggacaagtcaaaaacttgactaatagtttacagtttatcttggaatacagtcatgcagtctactgtggtggaagtacagggtgacaaaatacggaggcgtgcaagatgggagatttggttgcttcccagaccaaattattctgatggaaattcttctggttcacgttcccccgtgacatccaacattgattcattggcgtctcagcttcaatctgttggacttgaggggacatactatcctcgtgaagctctccttactagatcagcaacttcagttagtataggctatcaagcacctagttacagagtactacacagcaatggcagtcggcttgtgttttggaagcacacgtttgttcggtaaaagggagcagaaacactccgataaaataaaaaatgttgctgggacttacccaaaaaaaaccaaaaaaacagaaaactatatatgaaaaaagaatagctagtgctatgtgtgacttatgaatatatcatggagtagagcttttgctttttcggatatgtgtgttattatgtcgggtttctgctttaatggacagtttgttctctgtgtatactctgttatctcagacgtcatgactggtaccgttcaggcctgttgagaccagacaattatatatataaaaaaagacatttctaataatacttaaaaaaaaaaaaaaaaaaaaaaaatctccgagacctcggccgcgaccacgctattatcttagtaaaaacacatttctaat

SEQ ID NO: 32480 - DNA, 475 bp, Triticum aestivum
  Clone ID: PAT_TA_32480
tacggctacgagaagacgacagaagtgacggggtagaaagacgaatttaaccctgacagagggagagaaatacacgaagtgcgcgtgtgtgattccgatgcccacagggaaatgagatatgtatgcgtgtgagagagattgcacaattcattcacgtatcactatctagcgatcgtggacgtgcatcgcttgaacataagtcaatatctacttcgtatcatggccaaaggtacaatatcgattcaacgctataaagattggacactcacatatcacatttttttctatttcaataaaccttttcagttgtgcatgccaaagttacagtgatgtttcttcaaacaaccaatgtagctatcatgtacatgcaccattgttactcttgcattcaaattcattagtcttggatgatttaagtttccattttgaagtaatatatgtaatattcatatatgaattcaacgggtatgcaatt

SEQ ID NO: 32481 - DNA, 1362 bp, Triticum aestivum
  Clone ID: PAT_TA_32481
ccccgccaccctccccgtcgccggtgtccgccccggtattgatggccgcaggtgatacccgccggcgtccggctcgtgcccagctagcactttggtctgagaggactggctcagagattgttatcgacaacgataagaaggcacaggccccatcagttctttcgcaggcagtaaaacgtgggaagcgtgaaggatttgatgttgtgctgtgtgatacgtcaggacgtggacttcatacaaattacggtctgatggaagagttggtttcttgcaagaaagtcatagctaaagccctgcctggtgctcctaatgagatcttgctggttctcggatggcacaactggattaaatatgctacagcaagcgaaggagttcaacgatgttgttggaatcacaggattcatcctgaccaagttagacgggactgctcgtggtggctgcgtggtgagcgtggtagacgaacttggaattccagtcaagtttgttggcgtcggcgaaggggtggaagatctccaaccttttgatgcagaggcatttgttgaagccattttcccataaatttgaccctgttactagtgtttctcatgtaacaatattttggctaacatgctagaacttattagaagcaattttttcctaacaaagaaacagctcgtgaccagctagaaatttgggctgagaggactggctcagagattgttatcgataacgataagaaggcgcaggctccatcagttctttcgcaggcagtaaagcgtgggaagcgtgaaggatttgatattgttctatgtgatacgtcaggacgacttcatacaaattacggtctcatggaagagttggtttcttgcaagaaagtcatagctaaagccctgcctggtgctcctaatgagatcttgctggttctggatggcacaactggattaaatatgctacagcaagcgaaggagttcaacgatgttgttgggatcacaggattcatcctgacgaagttagacgggactgctcgtggtggctgcgtggtgagcgtcgtggacgaacttggaattccagtcaagtttgttggcgtcggcgaaggggtggaagatctccaaccttttgatgcagaggcatttgttgaagccattttcccataaatttgaccctgttattagtgtttctcatgtagcaagattttggctaacacatgctagaacttattagaagcaatcttttcaacaattacagcttttttggttcagtcgttgacacgtccgcctcacttgtctctatcgttgatccttagaagcaagtatttatatgattcttgtgattaagtcccaaagaagcaagtatgtatatgattcttgtgattaagctcaaaaa

SEQ ID NO: 32482 - DNA, 944 bp, Triticum aestivum
  Clone ID: PAT_TA_32482
ttctactgaacagctgtgcaacatctgcgctgggtcattagatggattttgagcctcatgaaatcttagaagttgtgcctcgggcaggtgacgaccccaacggtcatgcgaatcctcaggcggcggctgctggtgctggtgccggcgccggcgccggtcatccggcagccgggcaggaggacccggtggcggtggcggcagctcagcgagctaaagaagacgcggagtatctggacaagatgcgtgggtggctgatgacggtggccacgctcttcgtcggcttcgcctcccaggcggcgatgcacccgcctccgtggataccgcaggactatctccgactgttgatagccgcgcacggcggagccgcttctgacgccaagaccaagctggccaacgacgagggcctgctcgctgccagggacggaggcctcacggtgccatgtttcatggcgctcaacatgctcaccttcgcgacggggctggtcctgctggtcacgctgctcgtgatgaaaaggggcccgtccggcagtgacatgaatcgcataacgttcctggtgaagggtctcgccgccactgtggcctgtacgtttgccgccggtgtctccgccgatcccgtcgctgctttgctggttcttgtttttctcacgctgtacgccatcttggctttcgtcagagtcatgggctggatccgcggagtaatgtatcagcgggtgtggcaactattgcaaaggagaataggatcttagagtagggcattgtgatgaaaaagtgctaggcgaaagcgaggtagttggcctttgtctagtgcctagctaggcggcacttaagagctctaggtgggcctaggcggttgtgtagttatgaagatattatgtgtatttgtggtattaaatatgtataaattttgattaagagcatataaataagtaaactagccctactat

SEQ ID NO: 32483 - DNA, 766 bp, Triticum aestivum
  Clone ID: PAT_TA_32483
gcgggttctccagcatatagacagcaatttcgagcgccccaaattgagtcctgatgatcctgaaaagcaagggcttgcagaagaactgctggcttattcagacaccttcaatcaagcgatgatgtcggcattgaccgccaagggggcagtgactgctgatgctggcaagagctaagaacactcgtcgaaattcaactgtaaatatatattcatgctgattactaacatgtgattcgttgctggtcaatagaagctgctctggacaaaatagaaacctccctttcaaaatttgatgatgggcctttctttctcggccagttcagtctggtggacatcgcatatgcaccatttgttgatggattccaagtattctttgccaacataaagaactacgataccacggcaggaaggcctaacatgcagagattcatcaaggaaatgaatggaattgcggcgtatgcgcagaccaagcacgaccctcaagaactgcttgctctcacaaagaagaagctcgggatataagggttttctcttggatttggatcggctgatgactgatgaagcatcgccaatgcatgctgcgagcgcaataaattgctatgtactataacgcaaataagttgcgtcgaataaacaacaaattgcctttgcctgggtgccaagttgttgccagtcacagacgctcctactattaccagtcgtttccgtttcataacgttcgttgtactaatactgagagccaatgaagaacatatttctttgcatt

SEQ ID NO: 32484 - DNA, 585 bp, Triticum aestivum
  Clone ID: PAT_TA_32484
gcggccggccgggagaagcatcacaccggacgtacacagctagctgcccagctctcaaagcctcgctcgaatcatcagctagcagcctcgaatcatcaccatggcgtctgccggccgccgtcccacggtgctcatgcagatcgctctcttcttcgtcgtcgcggcggtcatcatgaacagctccgtctgccttggagccgccgccggcgacgccactgcaggctctggtgctttcgaccctaaccgccctgctgtcccgtcgacgggtggtgctggtaaaccctacaccggccgtcggtgcctccctaagtaccgctgctacccaccggctggtggccaaccctaagtaagaagtaagatgcacccgcccgcgccgagaccccgtcccccaaaaataatgcaaggatcgatcgatatatatgtatatactatatgcatgcatgcacgcatgcctccgacgtgtctatgcgagttattctattgccatgcatcaccttatactcctacacagtaatattgtttcctgtactatttacactctgaataaaactggatatatattgctgcaaaaaaaaaaaaaaaaaa

SEQ ID NO: 32485 - DNA, 612 bp, Triticum aestivum
  Clone ID: PAT_TA_32485
ggcccgcttcgagccggccgggaagcatcacagcaggacgtacaaagctagctgcctagctctcaaagcctcgctccaatcatcgacatggccctccaagctccaatcataaacatggcgtccttgggtagcagagctaccggccgtcgtcccacggtgctccagcagatcgctctcttcctcgtcgtcgcggcggtcattatgaacagctccgtctgcgtcggagccgccggccacgacgccgctctagtaggcactgaccctaaccaccctgctttcccgtcgccgcctggtaaaccctacaccggcggccgtgggtgccgtacaatttacggatgtcctgatgtaccaccggcgggtggccagccctaattacaccggcgcacagaccaatctgtcaaaacaatgcaaggatcgatcgacatatgtagctgaacggcgacctagatgcatgtactatatgcatgcatgcctcttatacacgagcaataccgtctcgtgatgtactcgtacctagtacttagactcgaataaaactggattattgcgtctggattttgatgtgaatccatatggtcaattttcgtgaagataaaattaagtttggttcgc

SEQ ID NO: 32486 - DNA, 1810 bp, Triticum aestivum
  Clone ID: PAT_TA_32486
gctacctcctctccccaccatcgcaccatcaatggcgacgacctcgcgcctcctgctcctcctcctcctcgccgccgtctgcctcctcgccggcgcggcggtggacgcgctccggctgccccccgacgccagcttcccgggcgcgcaggccgagcggctcatccgcgcgctcaacctgctcccgggggcgtcctccggccgcggcggcaaggtcggtgcgggggcagtggacgtggcgcccgggcagctgctggagcgccgggtcacgctgcccgggctccccgagggcgtcggcgacctcggccaccacgccggctactaccgcctccccaacacccacgacgccaggatgttctacttcttcttcgagtcgcggggcaagaaggaggaccccgtggtgatctggctcaccggcggcccggggtgcagcagcgagctcgccgtcttctacgagaacgggcccttcaccatcgccaacaacatgtcgctcgtctggaacaagttcggatgggacaagatctcgaacatcatattcgttgatcagccgaccgggactgggttcagctacagctctgacgaccgcgatacccgtcacgacgaggcaggggtcagcaacgacctctatgactttctccaggtcttcttcaagaagcatccggaatttgtaaagaacgacttctttatcactggagaatcctatgctgggcactacattccagcatttgcaagccgagttcaccagggaaacaagaaaaatgagggcactcacataaacttgaagggatttgcgatcggtaatggtctcacagatccagcaatccaatacaaggcctacacagactatgcattggacatgaaccttattcagaaagctgactatgaaaggatcaacaaattcatcccaccatgtgaatttgcaatcaaactttgtggtacagatgggaaagcatcttgcatggcagcatatatggtctgcaattccatcttcaactctatcatgaagcttgttggtaccaagaattattacgacgttaggaaggagtgcgaagggaaactctgctacgacttctcaaacttggagaagttctttggcgataaagcagtcagacaggcgattggagtaggtgacattgaattcgtctcatgcagcacttcagtttatcaagcgatgctcacagactggatgaggaacttggaagtcggcatcccagctctactcgaggatgggatcaatgtgctcatatatgctggggaatatgaccttatatgcaattggctcggaaactcaaggtgggtccactccatggaatggtctggtcagaaagactttgccaaaaccgctgaatcatcgttcttggtagacgatgcccaagctggagttctgaagagccacggtgcactcagtttcctcaaggttcacaatgctggccacatggtccccatggaccagccgaaggccgccctcgaaatgctgaggagattcacgcaagggaagctcaaggagtctgttccggaagaggagccagcgacgacgttttatgccgcgatatgatcgataccgaccaaagaaggggggaaaactcgctaggtggcccgttgcggtctcaaggagtgtctatctgtagctgtctgtttcctttccatgcaccccctcttttccttccccccttgtttcagctggatatgtataaccactaataacaagaaggttggccccgaaatgtaactgcacgatgtgtgctcgatgttgatgaaggatggaatacaacacaccatgggggccgatgtttgagaggcttgcctcatgttt

SEQ ID NO: 32487 - DNA, 1074 bp, Triticum aestivum
  Clone ID: PAT_TA_32487
atccagcaggacgtacacagctagctgcccagctctcaaagcctcgctcgaatcattagctagcagcatcgaatcatcagcatggcttctgccggccgtcgtcccacggtgctccagcagatcgctctcttcgtcgtcgtcgccgcggtgatcatgaacagctccgtctgccttggagccgctggccacgacgccactgtagtaggcactggtagcaacgaccctaaccaccctgcttttccgtcgccgcctggtaaaccctacaccggtcgtccgtgcagcaaaatttacggctgtaatgtaccaccggcaggtggccagccctaattacacccgtgcgcaggcctcatcttccaaaacaatgcaaggatcgatcggtttatgtaacggaacggcggcctagacgcatatactatatgcggcatcaatgcatgcctcctatgtaatgtatgtaacgtatcatcacaagtagtaggtgacattgaattcgtctcatgcagcacttcagtttatcaagcgatgctcacagactggatgaggaacttggaagtcggcatcccagctctacttgaggatgggatcaatgtgctcatatatgctggggaatatgaccttatatgcaattggctcggaaactcaaggtgggtccactccatggaatggtctggtcagaaagactttgccaaaactgctgaatcatcgtttttagtagacgatgcccaagctggagtcttgaagagccatggggcactcagcttcctcaaggttcacaatgctggccacatggttccgatggaccaaccgaaggccgcccttgaaatgctgaggagattcacccaggggaaactcaaggaggcggttcctgaagaagagtcatcgacgaccacgttttacgccgcgatgtgatcgtcaacaccgaccaaaaagggaaaagaaactggctaggtagcctgcacgcgtcgcccttgcggtctcaaggagtgtctgctgtagcttcctgttttccatgtatcttttttctccgctgtttcaactggatatgtataatccctaataacaagaaagttggccccg

SEQ ID NO: 32488 - DNA, 659 bp, Triticum aestivum
  Clone ID: PAT_TA_32488
tgactacaatcacacccggacgtagtacaaagctagctgcctctcatcagtcatcaacatggccctccaagctccaatcatcaacatggcgtccctgggtagcagagctgccggccgtcgtcgtcccacggtgctccagcagatcgctctcttcgtcgttatcgcggcggtcatcatgaacagctccgtctgcgttggagccgccggccacgacgccgctgtagtaggcacagaccctaaccaccctgctttcccgtcgccgcctggtaaaccctacaccggcggccgtgggtgccgcacaatttacggatgtcgtgatgtaccaccggcgggtggccagccctagttacacccgcgcaccgaccaatctgtcaaaataatgcaaggatcgatcgacatatgtagctgaacggcgacctagatgcatatataatatatgcatgcgtgcctcttatacacgagcaataccgtctcgtgatgtactcgtacctacttagactcgaataaaactggattattgcgtgtctggattttgatgtgaatccgtatggtcaatttttgtgaagataaaattatgtttggtaaggaatttacacacatgtatcgctggatagtgaataaattcaatttgtgaaaaaaaaaaaaaaaaaaggccccta

SEQ ID NO: 32489 - DNA, 2527 bp, Triticum aestivum
  Clone ID: PAT_TA_32489
gatctcctacacggcggcgcaattgcatcgagtcctcgcgccgtcccccgtcccatattccctttacccgtcctcgcctcgtcgccggcaatggcgggtcccggcatcggagcggccgcgcctcgcctgtcgctgctgctgctgctgctcgtcgtcgtcttcgcgggctcctcccgccacagccgcaccgaggcggccgtgcggacgtgcacgtacacggtgaaggtgaagacgagctgcgcgtcgccggcgccgacgtcggacgcggtcagcgtggcgttcggggacgcgtaccgcaacgaggcgtacggcgcgcgcctcccgagcgcgccgggcgggagggccttcgagcggtgcggcaccgacaccttccgcgtctccggggtgtgcggctacggcgtctgctacctctacctccgccgcgccggccgcgacggctgggcgcccgagtgggtccaggtcaccgagccgggccccggcgccggagagaagcccgccaccttctacttcggggcgccgctgccggacggcgtctggtacggccacaaccgctgccccaaggccaaggccaaggcagcgggcacggcagcggcggcggctcggacaaacaccacctctgctgctgcttcgcctctgggctagcgcgacctgattcggctctacccaccgggcgcagcccctctccgtatgtaattcggcattcgtcgagaataagcagactgtgcttacagattcagaataagtaattagagaatcataatccgaaatatgatgaggccatgaagacaccactaagtgacaagcgtcgtccgggccgagacgcaagctgcctgcccccctctcacagactcactcgcctaaccacccaactgcccccggctcataaccaccttgcatcgcttcgcccgccccttcgcacccgcggcgcggccacggcccgccctcttcccgccgttcgctcccggcaggattctcgacgacttcgccgcgtggtccgccctgccggtggctccatggcggcgaagcgtccagttgctaggccctttggcgcacccggctgcccccacgccctggccgttccggtcactaacggctggctggggtagacacgcgtacccctgaaccacccgttggcttttctcctgttcgccggccctcggctgaaaccccgttacgaccaggctccgtccgtggcaggcaaaatttaccggcctgtaatgtaccaacccgggcaggtggccaagcccttaaatacaccccgtgccgaaggctttcagtcttacacaaaacaactgcaaaggcatcgaatcggctttatgttaacggaacggggcggctactttagaacgacatataacttatatgccggaccatcaaatgcatgccttccctagtgtaatgatattgtaacgatatcattcacaatgttactctaccgccatgcacgaccttatacagtgataccatctcgtgtatatactagctacttgcactcgaataaaactggactgttgcatgtctggaaaataatgtgaaaaaaaaaaaactggccgtgaacctcaatataaattcggtaatttagttgtctgtttcctttccatgcaccccctcttttccttccccccttgtttcagctggatatgtataaccactaataacaagaaggttggccccgaaatgtaactgcacgatgtgtgctcgatactgatgaaggatggaatacgacacacaatgggggtacgacttttcaaactaggagaagttcttcggcgataaagcagtcagacaggcgattggagtgggtgacattgaattcgtctcatgcgcaattggagtaggtcacattgaattcgtctcatgcagcacttcggggtagccggcatcccagctctacttgaggaggggatcaatgtgctctcatagcccggggaatatgaccttatatgcaattggctcggaaactcaaggtgggtccactccatggaatggtctggtcagaaagactttgccaaaactgctgaatcatcgtttttagtagacgatgcccaagctggagtcttgaagagccacggggcactcagcttcctcaaggttcacaatgctggccacatggttccgatggaccaaccgaaggccgcccttgaaatgctgaggagattcacccaggggaaactcaaggaggcggttcctgaagaagagtcatctacgaccacgttttacaccgcgatgtgatcgtcaacaccgaccaaaaagggaaaagaaactggctaggtagcctgcacgcgtcgcccttgcggtctcaaggagtgtctgctgtagcttcctgttttccatgtatctttttctccgctgtttcaactggatatgtagtccctaataacaagaaaagaaagttgcccccaaaatgtaactgcaggatgtatggtttatgatgttgatgaaggacggaatacaccatggggggcgatgtttgagagccatgcctcatgttttaatcaaaaaaaaaaaaaaaaaactcgagactagt

SEQ ID NO: 32490 - DNA, 787 bp, Triticum aestivum
  Clone ID: PAT_TA_32490
ggttccttaattttccataatatactaataggcaccgacgccaagcaagtagtcagatcatcatttacaggaacacggagtcagacactatcatacagcattggctagcactacagatgaaaagagtacctaggtttcgagatcatacagcattcagaaggtcgtcgccagttaagggtggtacttcgaggctcggatgtgatgataccatgtcacgggcacaaaaagacagttgcataagtcatgcttgcccctactttgggaggaaggacgacatcgcccgtctgaattcaagagatcctagagcagattttggtaaagggctgcctccagggaaccacaaatcacctttgccaggaagcataacctgtgggcttatactcttgtcaccatcacttgtctcagcaggaagagcttcattctttttcttcacaaattcgaagaactccgcaacttgacgagcatattgtcgtttagcttcaatgtccttgttaaaatcaatgtcattttcacagtccaggatcagagcaggaaccttctggatactagaatgcatatgatctcttccaggaagaacacttgatctcgtatttctggatgtagtgagccctccatatgaattggaagctgactgactgacaacaaaccagaaccttgtcctttggacggaagtagccagctctcatgtttctcatgcaaaccttgaaggtaatcaagactgacaccaccctcctctgaccttttccgaaccatcattcttttgtggcaggtgtcagcgagctcggta

SEQ ID NO: 32491 - DNA, 2017 bp, Triticum aestivum
  Clone ID: PAT_TA_32491
acttccagtcacgcgtcctcctctgcatctccgccctcggccacaggaaacagcggcaggcaggaagacacgcacgcacgcacgcacccatggctgcggacagcaagctgcagagcccgctgctgccgccgccggccggtagcgagggcggcggcgaagacgaggggcacggggcggccagcaagcggctggagagcatcctgagcgacgagtcggtgccgtgggcgcggcggatgtgcgcggcgacggcggtggagatgcggatgctggtgcggctggcggcgccggccgtgctggtgtacatgatcaactacctcatgtccatgtccacgcagatcttctctggccacctcggcacgctggagctcgccgccgcctccctcggcaacaccggcatccaggtcttcgcctacggcctcatgcttggcatggggagcgcggtggagacactatgggggcaggcgtacggcgcgaacaagttcgacatgctgggcatctacatgcaacgctccactgtcctgctcatggccaccggcatcccgctcgccgtcctctacgcgttctcccgccccatcctcatcctcctcggcgagtcccccgagatagccagcgccgcggccatcttcgtctacggcctcatcccgcagatctttgcctacgccgccaacttccccatccagaagttcatgcaggcgcagagcatcatggcgcccagcgcctacatctcaacggccacgctcgccgtccacctcgtcctcagctacctcgtcgtctacaagtttgggctggggcttctgggcgcctcgctcatgctcagcatcagctggtggatcatcgtcattgggcagttcatatacatcgtcaccagcagccggtgccgcctcacttggactgggttctccctccaggcgttctccggcttgcccgagtttttcaagctctcccttgcctccgccatcatgctctgcctcgagacttggtacttccagatactggtgctcattgctggcctcctcaaggaccccgaaatggctctcgcatcgctctctgtctgcatgaccatttcaggatgggtgttcatgatctcagttggattcaatgcagcagctagcgtgagggtgagcaatgagcttggggctggcaaccccaagtcagcggcgttctcggtggtggtggtgacggtgctgtcgttcatcttggcggcgataatctcgatagtcatcctgttcttccgtgactacatcagttacatttacacggggggcgacgatgtggcagcggcggtgtccaagctgacgccgctcctggcgctcaccctcatcctcaacggcatccagccagtattatcaggggtggccgtgggctgtgggtggcaggcgttcgtcgcctacgtcaacgtcggctgctactacgtcgtcggcatccctcttggctgcctcctcggcttctacttcgacctcggtgcggcgggcatatggagcggtatgattggaggtacctttatgcagactgtgatcctggtgtgggttaccgtgaggaccgactggaacaaagaggtggccgaagcgaggaaaagattgaacaagtgggaaggcaacaagatgcctctattagcaggccaagaatgaaacagtggatcctgtgtatgatcaacagaaatgtggttcgttcgcaagttgatctccctaaaatgtgtaaagtgcattgttcatcgtgcaattcaccattgaaattccgtacttccgttctgctattccagcttcgcaagcacggtagcagcggcgatcttgtcatgttactagccagtaacgggattctatggcgatgatagattagtgtggatgagatcactttttttgtgtgagatatcaatattgttggactgcactaggggtacagcggtcaataaaaatccattagctgtgtgcatatagtatgggaggcatgcaaaaatcaatttaaagcatgatgtcataagattctctcattctttggtcttcaaatccttctatctctg

SEQ ID NO: 32492 - DNA, 523 bp, Triticum aestivum
  Clone ID: PAT_TA_32492
cagcagtgctaacatacacagttaacaaaaaaacaaacattttgttcacagatacaggcttaggtacaacacatattttgccattcaaacatatgaacgaagttaagacaagatacaaaggcagctactaagacctagtccaaatctagttgcagcagtgctcaaccgaccaggtgtgttacacagtttacaaaagaaaccattatgctcaaatacaggctgaggctgcaacacacgatgcaagatttacaccttaagcacaatgacaacacgagatatagcctagcagctagagcttcaacattgctagagcatcaacacctcaaagctttcgccggagcaaaaaggatcaatcaccgtcctgatgtaggacctgcaaaaaaataaaagattaataactgatgtatcaacagtttcatggcatcttatgtttgcatccaatcaacctatggcaaatccctcatcccagatacatcgaatggaataagggtgacatcaccagaagcacaagatgagcgcatgg

SEQ ID NO: 32493 - DNA, 680 bp, Triticum aestivum
  Clone ID: PAT_TA_32493
cttttatttcagtcttctggtcatttggttacatccgtctctctgaaggcttagaaaaacatccaaagaacctgctaaggctcctccacgtgctgatgttgttaagagccttaaaaaggcatcgtggttaatattcttgggatgggcgctgctgttctcggcatgcaagctactgttggtgctttggtagcaaaagctctcacaacctctgcagtaccctattatcaggctgctggccaaagccctgtcttggctttagatgttttcctagttcaggcttcagcgaacaccatcctgtcgcatttccttggggtggcgagctccctggagctgctgcgctcggtgtcactgcctccagcagaagccgccgtcccggccccggcccctgcacgggcctgagccatggcccgttgggcaggtcaagaaaaaccttcaatccttggctttggctctagacagttgctatttcttgattgcatgtacaacttgcatcaagaatacatacacatcgatgccttccagttcacctggacgcaacatgttcgcgtaattcccgccgagtgtgagctcttgcatgagcactcgcgaaccacatgtggcgcttgtttgctgtgcaagtgcaagtgagtgcagtgaccggctctcgctcgttcttaatcattgtacccgtttcgctggtc

SEQ ID NO: 32494 - DNA, 1683 bp, Triticum aestivum
  Clone ID: PAT_TA_32494
cacctcgactctacagtctcccctcaccaccaccccccccacccacccgcactcccttcacaccccgccggcgacggcgcgacggcgggcgcgccgctccccctcccgcggcggcgctggaagcagctgagcaacaaccacggatgttccggcggccacaacctccgcttccgccaccagaagcgcctcgctcggctgccccatgaccttctccctcttcctccccgcgtccccggcctccaagctccccgtgctgtactggctctcctggcctcacctgcaccgacgaggaacttcactcatcaagtccgggcgcccagcgcgccgccgcggacacacggcgtcgccctcagtcgcccccgggagacctccccgctgtggttctaaatgtatgaaggggtggcagatagttggaattttgggagttggatgatgtatttcatttgtgtgcaacaaatggagaagttgaaaaacgggcgcattgaataattttattgggaatggacctcacataagttttaatttacaacttttaacggggttcacgacgtcctgcttcatcaaattttgaggactctcatatgggagtcggcacggtgcactgaattctatacctaaaagcaaccattggacatatgcaaggatccgtgatctatcatttcctcccataactaaaccaagaaactgcccttgggaccatgaagcattctcagtctatcagggcaccactaaatcagatcgtgagcaagacgatgcaagataggttgttaagaactgcgccgcactttcgccgcctggcctggtggagcaggggggcgagggcacgggcgaccctgagcatctgccggcggtccccgtagtacaacctttccatcttcatcgtcatccccttcttcgacgcccacagcgcgcactacgaccagttcttcttcttcgtcgccaccttcctgcagcaagtactgcgagcagcacgaccccggtccccaaggccggcggattcgccctctacttgtaagccatctgtggtagtgtcgagtgagcggcgttgcctgcctccgtatgctagaatcctgtgttattatgagttgtgaatatgcgtggagtgtcggttggcttgagacgagacgaagtgtgtggaaataatgtggacggcttgcggtcgtctctgaagtgcgcgtgcgtgcgtgcatgcatgccttggctggaaattcagtcggtagaatttgctggccctgctgtagtagcatttgaggtttaaagcgtctgtggcagcctagtaaagcacacatgccgagcgtagcaggtgtcacgtgatgggttgccctcgtctggatctgcaattttttctttgtgcacggaatgcgctatgtcgatcggaatctttgcccgtagtatggcgtgtgaccatgcacgcgcggggagttatttcgtggtcatgtcaaaacttgtacgtgggatcagcagtaatcttactgtaattcgtacagctacaaggtgatactctctcgaactgatacgtggattagcagtaaacttactgtgtactgcacgtttttctctatttcgtacagctacaaggtgatgctacctcttgtcctttttagtgtgcatattagttttgtccgaagtatcagtcctttgatcaaatttacaaaaaaaaaaaaaaaaaaaaaaaaaactcga

SEQ ID NO: 32495 - DNA, 633 bp, Triticum aestivum
  unsure (1)..(633): unsure at all n locations
  Clone ID: PAT_TA_32495
tgccccacggtaagaagctcgcacgagcaggcaggcacacaccggcgcacgtaacacaaaccactacacgcgcacctagagctaaacatccatgaccgccacattcgcgaccaccgtcgcggcctctctgtccgtcgcaggtggccttgggaggctgctcggcctcggcctcggcgcttcgctgcgaccctgctcgccgcgggcgaggacgtgcgtcgtccatgcgtcggggcagcagtcggtgaaagagaaggccgcggccgggctgaccgccgcggccatggcggccgcgcttgtgctgccggaggtcgcggaggccgctggccccgggcttccgccgtcgctcaagaacttcctgctcagcatcggctccggcggggtcgtgctcctcggcatcatcggcgccgtcgtcgccgtctccaacttcgaccccgtcaagcgaggctgatctctgctgtttgtgtaccacgcgcatgcaaaactcctccatctcttcgattattattgcgaaaataacaacggttatcactgcaaataaatttgccgtcaagttcgatcgcccatttgcgctcggatcaattacaggccatgcgtcgttaaactcngatggaanctgngtnccanttaccctga

SEQ ID NO: 32496 - DNA, 793 bp, Triticum aestivum
  unsure (1)..(793): unsure at all n locations
  Clone ID: PAT_TA_32496
ctttctcgccagcgactcgcgaaccgcaacaatcagctagcaccgcgccggaactcgagcagcaggcgaagatggcaccccagccggaggaggcgcccaagccttcgccgggggagtctcgcgagtggacgctgcggttcatccaggccctgggagtggacgcgtccctcccggcgtcggcggagcgtcccgacgcctactccgccctcgtccgcgcgctcctgtcctccgccaccgtctcctcctcccccgcgccgcgcgtctcctgcaccctcaccgtctcatccgccgcaactaacgcctacaacacgctccacggcggcgcggtggcggccgtcgcggaggccgtcgggatggcgtgcgcgcgtgctgcggcgggggataaggagatgttcctcggcgagctcagcacagcgtatctctcagccgcccgcctcgattctgaagtggaagtagaagcgcagatactgaggaagggcagatctgttgtggttactacagttgagtttcggctcaaggacagcaagaagctctgctacacatctcgagccaccttctacatcatgcctgtggcaagcctgtaaatcatctcttacggtacatgtaacagtttcgtatttgcacaatcaaagctttacatgagcataccgtgctattgcaccgataaataaagtaaagaccaaatggcaatttcccccgaggtataaatcatcaagcacagcagtataaattaaggatgcaaagctcttgtangacaacgaactttttcaattaatcctcaattatttccaan

SEQ ID NO: 32497 - DNA, 720 bp, Triticum aestivum
  Clone ID: PAT_TA_32497
ctccagggcatgcggctttcgtgcaggtcggtgattgaggataccgtgtacgggagggctgatggtgtatcgatggaagatgaaggttgcgaagatgagtcacaagtccagtcccgttcttcaaccgtggaagaggtgggtacctatgatccagaaaatcagagctacgccggcggtgataaccaggggcgaacccacgttatggtgagtgggggcctaggcacccacggcttgcgtggaatcccaggcaccccctgaaaatatgaaatttcggtccgccactggtgataactggtccgagacaggaagctactccgagttaaggaccaaggttgctgatggatccatcagcggcgtcgatggtgagagacgcgcagcaaagcgagcaagagttgaggactgatgtgttccgaagatgcttaaagctgttacccttagtaaccgctgaactcagcggtgaaatcctagactaaaaaaggtgtttgtgttaagattagtggcgtacaagtttgcgccagtgtgctgcggcgggttcaatgtcgatctaggagtcctggtaggtttgtgtggaaaaaataaaaggaggttaggttttggtttgtcgaaatccacgtatgttgattagattatgttttcatgtgtggtgtctgcccccaatgactcgtcaactcatgctcgtttgcaacttggtacatcgaacatataaatcgtcgtagacta

SEQ ID NO: 32498 - DNA, 390 bp, Triticum aestivum
  unsure (1)..(390): unsure at all n locations
  Clone ID: PAT_TA_32498
gagggattgcccttagcagtcacactgantctggcatttgcggggaacaaaatgatgaatgacaaggcactggttcgcaacttagctgcatgtgaaactatgggctcagctaccaccatctgcagtgataagacaggaacactaacaactaatcatatgactgttgtcaagacctgcatttgtggaaatatcagagaggttaacagtcctcagaatgcgtctaagttgtgttcagaacttccagaaaatgttgtcagaactcttctcgagtctatatttaacaatacaggtggtgaggttgttattaaccaagatgggaaacaccagatccttggtaccccaacagaggcagccatattggagtttgcaatgtcaataggtggaaacttt

SEQ ID NO: 32499 - DNA, 544 bp, Triticum aestivum
  Clone ID: PAT_TA_32499
ccgataccaaagcccatcttcttctccttgaaatctttttgggttcacagatttggaggatgtcttgcaactgtggatccggttgcagctgcggctcagactgcaagtgcgggtatggatgttttttacaattattttttaacattaatggatgcttctccttgcaaactactctcgtgctatttatgtactacttcatccggtgatccttttagctgttcaagcatcagttccttttgtggtgatgaactattgatctgattcgccgaccggttgccttcgcccgtttcaggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacctacgtgtgatggtgtgaagagtatacctgaataaacgagcgtctgatctgatgga

SEQ ID NO: 32500 - DNA, 1114 bp, Triticum aestivum
  Clone ID: PAT_TA_32500
cgggatgctgccgcttctggccctgcaggtgattctcgagtacggccgcgccggcgccagccgcccgcccgtgacggcggcgctcatcgccgccaacgcgctggtgtacctccgcccgggcgccctcgacgcgttcctcccgccgctctcccgcgtcgccttcaacccgcacctcatcatccagtacggcgacctgacgcgcttcttcctgtcagctttctaccacctgagtgaaacccacttcttctacaacatgacgtctctcttgtggaagggcatacagcttgaaacatcaatgggcagtgttgagtttgcttctatggtcactgccttgcttggcctgtctcagggcttcacactgctcttgtccaaaggtctactccttctcggcaatgagactgcgtattacgatcaatatgctgttggattctccggggtgctgtttggtatgaagattgtgctgaatgcctggtcagatgattatgtcttcctgcatgggatggtcattccagcaaagtatgctgcgtgggctgaactgctcctcattcaggccttcattcccgggacgtccttcattggccatcttagcgggattcttgctggtctagcctatctttggataaagcgatcatactccgggccggacccgcttgctcttctgatctcgggcattgcaaatgttgtgagttggccggtgaaattcgctcagaggctcctgaggcctggtcgtcgtcaggggggcagagttggacgccgcgcagcaagagagagcggcagaggcatgtggcgatgctcggcctgcacttttgacaactcgccttcggtagatatctgtgagatgtgcaacagcgtgcgtgaggaccgtgtttttcccaacagacagcatctccatgatgggggaagcagtgacctctcggttgatgagatccgccgtaggaggctgcaaaggtttgacagatgatgacataatgtagatcaccattaccagtataaattccaaatagtgctaaagatacttcttccttgaatataaactgtcatttgccgggattctatgctgaatccactcattgcgaggattgctgtacatttttgaatatttcctcaccatttg

SEQ ID NO: 32501 - DNA, 334 bp, Triticum aestivum
  Clone ID: PAT_TA_32501
cagaaaacaatccacaccattttgtatcagacatatcagaaatctgcgtacagagggtggagaagatcgatgcggcgcagaggaaacgacgacggccgccggtgccgtagcgcagttgtgcggcgtcgacacgaccgctgaggagtatatcaagaaggtgcacgagcggctggtggcggaggaagctgcggcggctgctactgctgtagcaaggcgctaggtctgctaggcgtagctaggtgcgtgaagtccagcgtatgtgatatgcctgtgcaaaaccgatttgttcttttagattttttcttctattcctatgctcagctttttttttgat

SEQ ID NO: 32502 - DNA, 829 bp, Triticum aestivum
  Clone ID: PAT_TA_32502
aaaccctctctctccccccaaatcgatggagtctgacggcgaggaggaggcggcggcggcgacgccggggaccgccggggcggcgccggcggcgggccggctgaagggctgcccggagctgtcggtggagggcgacatgcgggagatggcgaagacggcggcctggagcgtcagctcctgcaagcccggcaacggcgtcgcctccctccgcgacgacagcctcgacacctactggcagtcggacggcgcgcagccgcacctggtcaacatccagttccagaagaaggtgcagctgcagcttgttgtgctctacgtggatttcaagctggacgagagctacacgcccagcaagatctccatccgggccggcgacggcttccacaatctcaaggaaattaaaacggtggacctcttgaagccagtaggatgggttcatatatcattatctggcactgaccccagagaaacattcattcatacatttatgctccaaatcgcggtgttggcgaatcacctgaacgggagggacacccatgtccggcagatcaagatatatgggccacgaccgaaccccgttccccaccagcctttccacttcacctctagggaatgcatcatgtactccaccatcaggtgatggttcatgtccttcataccggagccaaggtgtggaccttgatcgtggcctgcgcgcttcagtcttccgtgacgaacgccggcgtagtctctgaagtatccagcgtgtgtgaacatgtatgtcgattaagttgctgctggagcattaggctgtctctgtgaacatctaacatgtagtactaattcatgttgt

SEQ ID NO: 32503 - DNA, 928 bp, Triticum aestivum
  Clone ID: PAT_TA_32503
tcccggtggcccgctctctctccccccaaatcgatggagtctgacggcgaggaggaggcggcggcgacgccggcggcggggcggctgaagggctgcccagagctgtcggtggagggggacatgcgggagagggcccagacggcggcctggagcgtcagctcctgcaagcccggcaacggcgtcgcctccctccgcgacgacatgcctcggcaccgactggcacgccgacggcgcgcagccgcaccgggtccacctccagttccagaagaaggtgcagctgcagcttgttgtgctctacgtggatttcaagctggacgagagcctacacgcccagcaagatctccatccgggccggcgacggcttccacaatctcaaggcaattataacggtggaccttttgaggccggtcggatgggtccagatgccattgtctggcactcatccccgggaaccattcccccatacacctttgctcctaatcgcggggttggccaatcacctgtacgggagcgactcccaggtccggcacaccaagatctaggggccacgaccgaaccccgttccccaccagcctttccacttcacttccaggggaatgcatcatgtactccaccatcaggtgatggttcgtgaaccctggtcgcgtgtggatcctccatatcagagacctttatcgtgtggcctgtgcgcttcagtcctccatgacaaacgagtcactgaagtatccagcatatgttatcatgtactactgtagattaagttgctgctgaagcattaggctgtctctctgaacatctaacacgtactaattcatgttgtattccattccatccatgtattcttggtagtacatctttttcctccatttaatgtaacatttcactatttctggaatggattggaagtttctcctggttaaaaaaaaaa

SEQ ID NO: 32504 - DNA, 931 bp, Triticum aestivum
  Clone ID: PAT_TA_32504
ccccgcgtccgggcctccgggctcgcaggccgccgccgcagcgcgcccgcctccccgcgacttcctcgcccacctcgaggactacctcgcccgccgcgacggcgtcgacaagctcctcaagatctcacgctacgccgcgcgcctcgccctcgccgcagggccgctgcccccgccggcctccgcgcgcctcaagtccttcgagtccagcctcggcctcagccgcaaggccttccgcctcggcaagttcgtccaggacgtcaacgccctccgcgcgcaccccggccccctccctccgcccttcgtgctcctcgcctacggcggcgagggcgtctactacttcatcgagcaattcgtctggcttgccaaagctggcctcctcccggcgcacctcctcccccgcctccagcgcctcagcgcctgggccgagctgctgggctacgtcggctccatcaccatcaagctggaagaggtgacgaagatggagtcttcgatcaagatgcggctggcggagggttgtggggaggagaacgaggcggtgaggacgatgcgggggaagctgctgctgaagcgtctgtccgttgtgcaggacgtggcggatgccttcatggcgctaggggacgtgactaacgggaaggggttgctcggtagttccacgctgacggcgtccgccggattgctgtcggcgctgatcagcacgcacaagaactggaattcttgctgaagtcccaaggtatatatagatttcaaaatacgcttgacattaggatgaaataaagctgaaatttaggcaaaacctgtatttctaaaggaaagcgttgcttctgtaatctagatgccgatgttggtggtatgggtggaattcatgctgatgcatttgttggttggagaacactgttgctgctcatgattaatttcaccataatcattttac

SEQ ID NO: 32505 - DNA, 639 bp, Triticum aestivum
  unsure (1)..(639): unsure at all n locations
  Clone ID: PAT_TA_32505
naagnaaatggggccaaatttgaggaggacctggntgctatgcttccaagtgtgatgtgattgtgatcaacacactctcttacggagaaaacaagaggcatgtttaacaaagagaggattgcaaagatgaagaaaggtgtaattgttgtaaataatgctcgaggagcaatcatggatgctcaagcagtcgcagatgcatgttctagcggtcacattgctggatacggtggtgatgtgtggttcccacagccagcaccaaaggatcacccctggcgctacatgcctaaccatgccatgacccctcacatctctgggactacaattgatgcgcagctgcggtatgcggatggtgtgagggacatgctggataggtatttcaagggcgaggacttcccggtgcagaactacatcgtcaaggaaggccagcttgccagtcagtaccagtgaccgcgcgagatgttgctgtgctgtgtaggcttttctggtgagaagctgcgaggaagaaactcctgttgcgtacttgcgttactgtatgagtagctctgagaaatctgtcagcggccacctgtaataaaagaatgccttgctggtatctcaccgtggagatcaataagtcccttttttttcaaaaaaaaaaaa

SEQ ID NO: 32506 - DNA, 592 bp, Triticum aestivum
  unsure (1)..(592): unsure at all n locations
  Clone ID: PAT_TA_32506
agtgacgataccgggagtcgcctnggatacttggccacggatatttccttggtccgacgtgggcgtgttcgtctctaggtcctccagtgccacaagttgtgtctcaagctgtaagttctgtacaaggtgagattgttggattgctacaaaacttctacgtgatagcagttgtaccagtcaactaggatgtctacatgatgtttcttgtattcatggcagcaacaaaatcttgtggcgcaaggttaagctctgatcttcaaaagcattgcaagcttggtgattcttctgcgggagacatgtggtcctgtttaaattatgctgtttcacatgatggtggcgagtctgttattcacaagacatctaatgaagtcatccaataaaaaggttccgaacaaacaatttgtcttcctagacatggctgtagctgcgtgtcaagctcaaaccatttgtttagcttagtttgaacaaaagaaatcttattgtctatgtaaattctgtttattgatgtagttggacgctactgaatgcatgtatggatgttgcagtactgaattttaatcattatgtgtttgagattttctactgaaaaaaa

SEQ ID NO: 32507 - DNA, 609 bp, Triticum aestivum
  unsure (1)..(609): unsure at all n locations
  Clone ID: PAT_TA_32507
ggcatgatcttgcatgcatgtttggtattcaaggccagcttgaagatccgtacagaatggactggaagctagtctatgttgatcatgaaaacgacatcctccttgttggagatgacccatgggaggagtttgtgagctgtgtgaagagcatcaaaatattatcatctgttgaagtgcaacagatgagtttggatggcgaccttggcggtatcccttcacaaacacaagcctgtagtgcttccgatgatgcaaatgcatggagaggatcctgatgtacatactaaattgatgtgcttcttaccattgtttaaaggatacccagaggtttaaggacccaacacacagctagtattattctgaggttagacctagagccaactcactgacaaaattgatcaaatgcttctggtgaaaggtgttcagcgaaccgccttattgcggagctgttgcgtcttgttcccactaaaatacgcttatctatcttcatgatcagattagtttcgtttttggcatacagaactgctccgaatttcataagctacatgtgtttacctgggacttgcagccattgtaatgttacaagtnatcaactatcntaatgtatatatg

SEQ ID NO: 32508 - DNA, 847 bp, Triticum aestivum
  Clone ID: PAT_TA_32508
agtttataaagtttgacttttcaaaaagtccatcatcactacaatatgaaacgaaaggagtaggacagtggcacacagtggccgtgagttcatgtggggctgcttttcaagctattcctccaattcatattacttgtcgctgaaacgaatgtatctagacgtatttactagatacattaattttaacgacaaataatatggatcggagggagtactatttttggtctgctcgtctgaactcaaatggcccgtaacaaatcataggagtcagcctgaatacgagactgccactgccaggcaaaagtaatcagtggagttaagtcaagttttacatcccgaaatgaactcactataactagacctcatacgccgggatagcccggcacaatcaagccgtatatgtcatgcccagtgccttgaggagaaacgtgtaagaaaaggcgtcctcccgcaatttctcgaaccttccagactttgagttgtgtccggcacctacttcacacttgaatagcagaaggttgtcatcccttttcaattccctcagcttagccacaaacttggcaggttcggagtacatcacgcaaggatcgtttaagccggccgtgacgagaatgtggggatactcttgtgctttcacctgcaataaatattaacacacgtaacgcatagcatcgattcatttttgcagtccaattagacatcacgagggagaaacaatgggaacacacggcagttcatatagcatagtcgtgagagcatcaacaaaagggaccccaacaatggcggccttgaataagtcaggcctcatatttaggacagcgcccatcaacaggccacctgcactttt

SEQ ID NO: 32509 - DNA, 1162 bp, Triticum aestivum
  Clone ID: PAT_TA_32509
ctcccgtcggccggacctggctggcggttttagagtgctgcatcttgtcaggcccttcctgggtttcttaccggaagtacagagtgctgataggagaattccattcagagaaaaactcatctacaccgttatttctctcttcattttcctagtgtgcagccagctcccgctctatggcatccattcaactactggagctgaccctttctactggttgcgtgctattcttgcatcaaaccgcggtactgttatggagctgggtatcactccaattgtgacatctgggatggtaatgcaacttctggtaggatccaagatcattgaagttgacaacagtgtgagagaggatcgtgcacttctgaatggtgcacaaaagttgcttggtatcctgatcgctattggagaagccgtggcatatgtcttgtctggaatgtatggcagtgtaagccaactaggaacagggaatgctattctcatcatactacagcttttctttgctggcatcattgtcatctgtctagatgaacttctccagaaaggctatggtttgggttctggcatttctctcttcattgctaccaatatctgtgagaatatcatttggaaggcattcagccctaccaccatcaacagtggacgtggtgctgaatttgaaggggctgtcattgcattgttccatctgttgattactcgatcagacaaagtccgtgccctacgagaagctttctaccgtcagaatctgccaaatgtgaccaatttgcttgctactgtcctggtctttctcatagttatctatttccaaggcttccgtgttgtgcttccagtgaggtcaaagaatgctcgtgggcagcaaggctcatacccaattaagctgttctacacttcgaacatgcccatcattctgcactctgccctgattaccaacctgtatttcatatcccagcttctctacaggaagtacagtggaaactttctggttaaccttctcggtatatggaaagaatctgaatattctggccattctatccctgttggtggtcttgcttactatgtaactgcaccatcaagtatggctgatattctggcgaatccattccatgcattgttctatgtggtcttcatgctgtcagcatgtgctctcttctaaaaacatggattgaag

SEQ ID NO: 32510 - DNA, 573 bp, Triticum aestivum
  Clone ID: PAT_TA_32510
tggcagggggccacggcggtgggcatcttctaatgattcctatggtggccagggagcttatggcagccagactagggatggtccaagctttcagtcgagcttcaataacagcagcagtggcaatcaatatggtggtgctccaagcttccataccagcagtagcaacaaccagaccagtggcgctgcaagtttacctgccagtggcggctctggtgaaggtctcagcttccatgataggttctatagcggcaattcccgtggtggtgaccgtgctaggagcaggagccctcccaaggccgtgggggtctccaactggtaaaatgcatcacgatggtgatgaaacaacggagtagatggagttggttccctaaccaaatcgtagtatcagtcatgttggtttaagcaaagcgtgtcctggaactttgctgacataggttaagcgtgtcggatattttgctatgttgatgtgggggtgcctcggaggcgctttatacggtgtccgtatgctggcgttagtactctatgaaacctggaacctcggacctctttatgcctggtagtcgggttataatc

SEQ ID NO: 32511 - DNA, 887 bp, Triticum aestivum
  Clone ID: PAT_TA_32511
cggccgcgtgggccttcgaacatgcccatcattctgcactctgccctgattaccaacctgtatttcatatcccagcttctctacaggaagtacagtggcaacttcttggttaaccttctcggtatatggaaagaatctgactattctggccattctatccctgttggtggtcttgcttactatgtaactgcaccatcaagtatggctgatattctggcgaatccattccatgcattgttctatgtggtcttcatgctgtcagcatgtgctctcttctcaaaaacatggattgaagtctctggttcatcagccaaggatgttgctaagcagctgaaggaacaacaaatggtgatgccaggccatcgtgagtcaaacctgcagaaggaactgaacagatacatccctactgccgcagcatttggtggagtgtgcatcggcgcattgactgttcttgctgattttatgggcgcaattggttcaggaaccggtattctgttggccgtcaccatcatataccagtactttgagaccttcgagaaggagagggcgacagagcttggtttcttcgggttttgattgatacatgatagcattgggagcatgttatggctacagcacagcttgagtctttctagacagtcgcaatactgcttggctggctggctgttgtggttgtaaccggagattaaattctgtttaggttaccccgacttatttacagttgagaaatctgtagatgctgcgtgtgttcttcaggccagttatggtggtggaccggtccaaacacgggcgtggccgtcacctgtcatcttccgtagacttctcatgtttttgactatatagcaactgaatgttttgggaccaatttagtcatcttgagctggtat

SEQ ID NO: 32512 - DNA, 2326 bp, Triticum aestivum
  unsure (1)..(2326): unsure at all n locations
  Clone ID: PAT_TA_32512
cctcgcgcccttcctccgtctacccctccgtccgcgccggccccgggcctggcccctctccgtcctccccccgcgccccgctccgtcctcccctcctagggttcgacgccctcgccagcccgcggcgaagccaccgcccacctcgccggcggcgtccgcggccaggaagatggctggcggctttcgggtgctacatcttgtcaggcccttcttggctttcttgccggaagtgcagagtgctgacaggaaaataccatttagagaaaaagtgatctacaccgtcatttcttctctctcattttcctggttgtgcagtcaagctcccgctctattgcatccattcaaccactgggagctgatcctttctactggagtgctgtgttattcttgcatcaaaccgtggtaggtgtcagtggtaactgggtattagccccaattgctgacaatctgggtatggttatgcaacttctacgtgggaattccaagattatttgaaggttgacaatacgtgtgagaatggggatcgtgctgtgcttgatggtgcacatgaagtttgctggggtaacctgagttgccagttgtggtgaaagttgtggcatatgttctgtgtgaaatggatggcggatgtgagccaacttggaactttaaattgctgttctcatccttctttgtcttctgttttctggcaagattgccttctgtctacctggacggtttccgacatggttaaatgcattgctatggcgattaaccaatggattattatgaatactttgtgccctaactcaatcgtaagatcacgtgactgttgattttaaccagcgcgtgtcctgctggtttggtaagataagtaatcgcttagcggatgttcttgcttattgatatggtttgtaccggtcgaatcgggcaaatttggcgtattcggtatctaccgccctggactatttcttttgcaactatttccaagttttccgtgttgttctttcagtgaggtcaaagaattctccgtgggcagaaaggttaatacgctattaagctgctctacacttcccaacttggccatttctctgcactctgcctgccaataccaacgtactcttcctatacaacccatctctattccggatgctggtttgtctacactatgtatagcccccatctgttttgtctgactttttcgtaaatgtattggatcttcctatccatgttattctagccttgtctgtggtctttcttctgacaaatccataccatgaagtgtgtattgtggtctagacgcttccagccatgtgctttctggtccaaaacatggatggatgcacgcatttgctctaaaacatggatagaggtatttaaattatctgcctcctcagtgtgggatgcagctaaggaggagacaaaccatcaagcggggatgtcagtacatcgatcctctactgtggaacaatttagtgaaatggtacattccctactgtctctggttctgggctgattttgctcagcgacattggttgctgatgcggtgttcaggggggcgtcagtgaacatataggcagttcgtttgctaccttcaagatgtagaggtccttggaagcttggtttatgaggagtgcgactgatacttgattttattggtaggattttatagctaaagcccatggggtgtgtttctggagagtggccatcatgcacagctgtctaggctgtcgtagtgcaagctgagccttcactgctttttagggtactcggactgattttcagttgataactctgtagatgcagtttgttttattcatggaccaggtattggttgtggactggtcaaaacagtggcgggggcggtcaccctgtagtcctgctgtggacgtgctcaggtttttgcctatgcgtcgacgtaatgtttcgtgtccagtagacgtcatcttttgttgacaatatagtaacttaatgttttgggtccaatttaattatcttaaaatcaaataaaaaaaacaaataactaagaattggagaacaaaaatgcctcacctagtctatgtgtgcactgcatgtgcatgtcgaatgagcttgctctgaagtaaaaacgtgttaatattggcgtgaagggtttcgcccggggggccgtttgagtgagctaactcacattaattgcgttgcgctcactgcccgctttccagtcnggaaacctgtcgtgccagctgcattaatgaatcggccaacgcncggggagaggcggnttgcgtattgggcgctcttccncttcctngctcactggactcnctgcgcttcggncgttcggctgcngcnagcggttttnagctcactc

SEQ ID NO: 32513 - DNA, 1817 bp, Triticum aestivum
  unsure (1)..(1817): unsure at all n locations
  Clone ID: PAT_TA_32513
ccacgatacactccccacccctcgctcctcctgcacgcccagcgcgatctcctccccctctccgaccctgctcgcctccaacctcaccttccccatctaaatccctccacccacccaaggcgcagaggaatcccaacccatcccggatccagccacgcaagggagaggaagagcttgatgtcactagacctgcaatgcatggactgcggcctcgctgcctttgatccttggtacggcggcgggcaggaagacgtcatacagccctacagccgtacatcggcaggaaggggtaggctgttggacaatccactggagggagacgatcagcggtcatcagccggagagccagcggcaacacattcggagagagaaaacggccaagccgtggaagcagctaagcagggaccggcgatgccgccattctcattaacaaggcgaaggagtttgcatgcgggcggaactggagcatccggcgtggaaaggtcacatgagggtccacgcagcctgggtaagtcccctacctcgtttggcacgtcccagaccacgttcacttcgtgtccacccatctacctcacatagccccaacacagactgttggccgcctcgtctatcaagccctcctcatggactgacggtgagctcgtgccccgctgcgtcttagtcggcaatagcctgtccgatgccttgtcttgccgcagttgaaacatactaacgagtacgacgccggctgttccctagctgatgaccatcaagccacccggcaccaacgacccactgactgaaccttcatttgcccttgtgcgccaaccagagggcagcatcatactggccgcaccagctaacgggatcaatcttggcacaaattctcgactatgcctgtatgaccatgtcaccaccttctggagcaagctgacagcgaatgtcgaaatcgtcatcgacggcaacgagtgcattactatgcaaggcaaccacaactggaggatatgaacctactgcggcctggttgaatcacgcgcaaatgattattttctgaaacttgctggagaaacaccccaagcctcatttcttaagactgcctagcaatgcaactcgatcgcccgctctttcggttcgtttcagtccttaatgggcttcatcaacgatggtcgagctgcagcaccgtgctattggtttggaaggccacaatatggagcatcaagactggcatcttatccaaagcgcattggagtgtcgattgccagttcgattcctctgctatacctgaaccaccgctgcctaagctgaaggtccgtgaaggtgtcacagctcagcctaccttgtcgactctccatattggcctgcccaagctgagcctgcaagatgattgcattctttacttactagctaagattgactaccgcgacaggcagcacacatcatgggtgcttgctgttgacatgaagaacaacactgtccagagagtggctgagtttagccccaagagggctattggtttagccaggggctacgattcaagtacgatctccaaatatctcaaagttggtccaagggaaaggcgtgcaagaagctgagcagtgaccggagatgacgccatggtgattaacaagtggaaggagtttgcatgtgagctgaactggagtatatgacctgaaaataatgcatgtgcgttgatggagggtgtctcaggactatccttcgtttgtctgtttctagaccttttttattaatatgtatccatctcgtttctcttgcctcaccgccctctcttgtcgctttatttattatgtnatctgcaacaagnataatangaactatat

SEQ ID NO: 32514 - DNA, 759 bp, Triticum aestivum
  Clone ID: PAT_TA_32514
aacatccctccacattatttattcagctatagttccagataaatctcgcaaccctcttcacccaaaattatgataggaaacgatctgccaattacaaaggagtgaactgaaacagcaggaaacatggttgatatgaaaagcaaaattgctaagagaaacgatgtgatcatgaaataattaaactgagactcctgacaagctaataagcaaaggatggttcactgggccggaaactccggtaaatggaggctgcaaccggtacgagacccagaagtgcaatctggacctgctctgaggtgcttgtcctgacggtgatctgcccactcagcttgttgttcagaccaagtcgaactgccatcttcgacccccttccgatggaaaactgggactgcaagtttgcgcccagagcaaggtcccgacgccacttcatcagagagagacccaaggttgagagcgactgggctatcggatagtctttgtccttcagacgtgcctccaagttagctccatatgcagtgtccccttgggctcgcatcgcgccagtgctggcaactagtgacaacctcttcccaagggagagctggtcctcgaccttcagtccagttgccacaatgtcgcccaggaaagttactgagaaccctccagtggtcttgttcttcttgatattcttgatttttgtctcgccacggagaatatatgcaagctgccgcccaacagtctggatatcaaaaccagcaagcgatgagcattctctccatg

SEQ ID NO: 32515 - DNA, 619 bp, Triticum aestivum
  Clone ID: PAT_TA_32515
cgacccacgcgtccgctgtctggttggcgttatctgtggtggcatgctttatgttgccaatgttggggattctcgtgctgttttaggaaaacatgttaaagccactggagaagtattggcggtccaactgtccgcagagcataatgtcagcattgagccagtgagaaaagaattgcagtcaatgcaccctgaagataggcatgttgttgttctcaagcacaatgtttggcgtgtaaaaggcctaattcaggtctgcagatcgattggtgatgcctatctgaaaaaacaagagttcaaccgggaacctctgtatgcaaaattccgtcttcgtgaaccttttaacaggcccatactaagttcagaaccatccatttgcgtgcaaccaatacagccacatgatgagtttatcatatttgcatctgatggactttgggagcacttaaccaaccaggaggctgttgacattgttcaaagtagccctcgtagtgggagcgctaggaggctcataaaatcagccctgctagaagcagccaagaaaagagagatgaggtattccgatctcaaaaagatcgaccgaggtgtccgtcgccacttccatgacgacataaccgtcatcata

SEQ ID NO: 32516 - DNA, 257 bp, Triticum aestivum
  Clone ID: PAT_TA_32516
ctttttttttaattgtggaggagagctagagacgcagaaattcagggttttagaggtgtagaaattcagggctccaacgattgtaatttgaacatgtccatttgtattctactccctccgttccaaaatagatgacccaactttgtactaaagttagtacaaagttgagtcatctattttgaaacggagggagtatgtgtatgggcgataaaaacgccacgcatctggtacagaaaatatgcttttaacaaaaaaaa

SEQ ID NO: 32517 - DNA, 707 bp, Triticum aestivum
  unsure (1)..(707): unsure at all n locations
  Clone ID: PAT_TA_32517
gnctagttctagnacgcgagcggccgctcgcgatctagaactagtggagcttcattttggtggatgcaaggagttatggtttgcaaacaacggtcctgctatctgaaggatattatggtttgcaaacaacggtcctgctatctgacagtttggtggatgcaaggagttatggtttgcaaacaacggtccttccacatacatggcgtgaatacagttatctgaaggatattcatattacaggatataaagcggcaagaggccaactgcagtttcttcttcatattgtgcaacatgcccctgcattggaggctttaactgtcgatacaactcagttgctcccagaagaatgttttccagacaaagttgacagctcattcctccatcatgttactaggcacgcaagagatcatctgagtcaagaactttcgtcaaaggtgaagctttgcgttctttaagggtgcgcttggtagccgtctcaccctggcatgtctgttctcgctggtgcatgatgtctagccatgttgtgcactatgtttggtagtctgtgtgctgggacatgttgagctgagatcttgtttggtgcgttgcattgtggttgcctcctccacgaggttgtgaggacaccattattagttcagagatgtgataaaaaatagattatgtggacaatgtatgagatttcaataccaaaacaacatttgaacact

SEQ ID NO: 32518 - DNA, 1211 bp, Triticum aestivum
  Clone ID: PAT_TA_32518
ccacgcgtccgcaacttctcttcattgtcggtcgctcagcaggtgctcgaataattcaagcaatggcaaatgttaaggacctttattataacttttgatccatagttgctaacttttagatcacaaaccgctgtagtattccggtctgaacattgggatcaaacccattttgatcatgacatgataaaaatggaatggtgggaagtagcaggtccagtttctagtaaatgggatcgtgggcagatgcataatagtcctatcctataatctgcagttttcaggataaacaggatcaaacggcttcttccccagaccacgctcggctttctgcctaggcaaaccccttttattcctcccaggcacaaccacaatatccttttcagtccaaattgaccgctgactgtggtccaagttcagcaaattgaccgtctcagataagttcgtgaaaaagatcaaacaaaaaagaaaccccaaatgggaattcgaatggtaaagtcaaaaatttccacttggcctagatagctcatatatagttcaatcttgtaatttaaaaggtcaagtcacaagtttggagatgattttttgcaactagtttgctttgatgattctgtaattgcatcaggccattacagaaaatggctctagtcgttcattatttatttcaattcatgaaattgatacagtgcgccgccccgcccgcaatgtcgttgttgcttgctagctgccggtggttcgtgtgccctggtcgctggtgctatagggtaaggtgagtgagaaagagatactgagagggatttgctgctgctgttgttccttgtattgatagaggattgtcgaatctaaagctagctgcaccttcgcatcctatgcactgtcacatatgagttggtgctcctacagtagtgttctaattggcaaaagaacaatgagaagggaaagaagatggtggttaaatattaagtaaaaaagaactgatagaatgaggataacataaaacagtgtgtgactgaaagaaactaaatagtttggtgtgaaacgttgtgcttttctctggtgctgtagttcaatttactacaaccgttctgcttgtaatagcatcttctgcaggaagttcgagatgggagcacttgtttcaaatgctctcctcccattcgcgatgctgccaacaaggaaaacctctgggaagctctgctggtaatgcaatctcctat

SEQ ID NO: 32519 - DNA, 1269 bp, Triticum aestivum
  Clone ID: PAT_TA_32519
cgtagctcgactcggatcccccgcaccggcggcagccacggccgcggccagcttcctcctaagccccagggtgacgctgcccctgcgccgaggatcccgcctcctcgtgtcctgctccgccacttcgtcatcctcctcgtcagatgctgctggaggggtgggattccagggaagggtggggttcttgggcctcgggatcatgggcgcccccatggcatcaaacctcatgaaggctggttgtgatattacagtttggaacagaaccaagagcaagtgcgatcctcttctcagcctcggtgccaagttcgaatcttcacccgccagagttgcatcatcttgtgatgtcacctttgcaatgcttgctgacccagaaagcgcgtttgaggttgcatgcggcgctaatggagccgcagaagggatggccgcagggaaagggtatgtcgatgtgtcgacagtcgatgatgcaacatctaagctaaccggcaaacgtattacaagtactggggcatcttttctcgaggggccgctctcagccccaataaagccagcagaagatggactgctgatctttcttactgcaggtgatgaatccttgtacaagagagtggcgcccctacttgatgtcatgggcaagtcaagattttatcttggggatgtcgggaatggcgcagcaatgaagctcgtggttaatatggtgatggggagcatgatggtctcctttgcagaagggctactcctgagtgaaaaagtggggttagacccgaatactgtcgtcgaggttatttcacaaggtgctatcaatgctcccatgttctccctcaagggcccttccatggttacggctgcataccctactgcctttcccctgaaacatcagcagaaggatctaaggctggcgctggccctggcagaatcggtgtcccagcccattcctacagctgcagctgcaaacgagctgtacaaggtagccaaatcgctgggcctcgccgaccaggacttctccgcggtcattgaggcgctcaaggctgaaatgcagagctcgcagcactagatattgtttcttcagccggccaagtttgagtgtggcattcaaatgtattcgcccatcttgtctcttttgcggacatataaatgtgcttgttttacaggcagagtgtatacagaaatgtaaaatgaatatatacagaatatcaacccttgcaaagggggaaacggtatcgatatttttggtatgtttgtaattaagtttggttatcgcagtcagctgtt

SEQ ID NO: 32520 - DNA, 1502 bp, Triticum aestivum
  Clone ID: PAT_TA_32520
tttttttttattacgcttaagcgcgtactccatgtatattatctcaaaaacaactgcgtaagatctacaggcggattagattaacgagccactacctgcctgcaaccccatccatgacatctcctgaattctacgggacgcgattgctccactgcttactccgccgctgagacaccagatgctataaatttatttctgggttatttccaacctcaagtaggaaaaccggctctctgggatctggatactgattactatctccacgtgacaacagctggtgatgatagctaccatcttagttccccacatggaaataatgtgcccgggggatctggagatgccatgagcccaagacccacattgagccctgtgccagcatgtaaagaggacttttctaggatgaaacttacttcattcgacaaacttatagaaagaacctgtagttcgataagaaatgtgaggcttcactgtgatgctgatctaaggccaagtggtggtgttggaacttctgcaatggcacccgacgcagctgagatacaacttaaaagcccaaactggttgtttggtcaaagaaaacatgcagagacagttccaacagcaaaagttactccagttgaaaatgcgaacgagggaaacaaagatgagacgaatgtgtctctgtgtggggaactgaactggctttcctcctcggcagattcatgcgaggaggacaacttcagaaggtatctagcattcacgacagcggatgtagacaatggctggtacagtggagcactgctatacgatcaagatgagaacagcggtgcttataaacattactccgaattttgccagggtccagtcatggatccttttgagcacgacccagagaaagaagggcactacagggaggctcttagcatggacatcgaacttacggacgatgcacaggtggaggcagaaatgaaagccgctctggacgactaccaggtgataggttcagacctgagcatcatcccgtcgtgcggctccctcgccgaggacccaagccagctgacaaggtggatcattggggacgagaagctgcgcgtcgtcggcgctgtgcagtagctcggttgccgccgagggattgtacagattgctacaacattcgtcaattattggtttcatcgtgcgtgtatatataaggtgcttaaatgtacaaaaagaaggtattcgtccattttttttgttgggagcaaacagaagatcattcttggaggcctttgtggatggatataggaggattggacaagacagacagacagacacgggtttggccggtaaaccaaggatgacaaggtgtatgtataatattcacgattgtctcatgtcattctgttgattaatttgcacatctccaatagtttcaagaaatgctgcaacttcttttttatttattgtaactaatgctacaacttgtcgttgagttatttggacttcctttcgcaaaaaaaaaaaaaaaaaaaaaaaaaaaaaaaaaa

SEQ ID NO: 32521 - DNA, 1197 bp, Triticum aestivum
  unsure (1)..(1197): unsure at all n locations
  Clone ID: PAT_TA_32521
atgagtccgacatggaggtgagcttggatttctcttgggagacgcctagcttcttcgagctctgcgacgctgatagcatgcaccttccggctgaggactctctgtcatgtctgtacgaggactcgatgagctcgccggagggcgccagctcggggctgacgaggaggtgggctggcaggaacatgctcaacgagagggacaggcgcatgaggctcaacgagaagctctacgccattcgcggcgtcgttccaaacatcacttacgatggacaaggcctccatcatccaggacgccatcgcctacatcgaggagctgcaaggagcaggagcgccagattctcgccggccccccgaaccgacggcggcgccgccgtggtccaggcggattcgaccgtggacgacggcatcggctccccgccacggaagattaggaggactacctccgcctcctccatgtgttccccgccacggaagattaggaggactacccctgccacgcatcccgtccaaatcctcgagctggaggtgacgcaggtggcggaggatctggcagtggttaacgtgagacatagaaaagtgcaggaggccatggcgaaggtgtatggggtgctcgagtcgctctgtctcaatgtcatcacggcaagtgtgaccgtcgtggccgacaacattgtccacaacatgttcatcgagacggatggaattgattgtgctcaaacgatcaaggagatggtacagtctcactcggtcatctcaatgtgagaagaagatcactgaagtccatgaatccctgatgaagattagatgttgaaaaggatgcacaaattggcagaccaattacctacacctggttcaatttcactctcatactatagtcatcttcaaataatgtgacaacagttgaaactaactatatggccgaagaaatagacgtgttttatggacttcatgccagcatgcactccatataaattggcaatgatgcaaaactatatcgtatatcgtctcggattatgaggaacacccataagtgtgcatgtattttttaaaataggaaatttcacttttggccctctaaaaaaaaggggggccggtaccattcccctatagtgatctataccgcgccanggcgtctttaaactcnnacgggaaacctgggttccactaacgctgaaaacccttccaacggntaancaaagcc

SEQ ID NO: 32522 - DNA, 702 bp, Triticum aestivum
  unsure (1)..(702): unsure at all n locations
  Clone ID: PAT_TA_32522
ccaggcaaccgcgnaaccagtggcgccggtgccgctcccagggccgccgcctacccgcgaattcttccactgcgcctaccgcggcgccaaaggcaggaatttcgagggcctcgcctcctcccgccacctgcagcggggacgccggaggcgagcttcctgccaggctccagccgaacgcgcgcagtccaacaaagtgcggagcgtcgtcggaaggcttgctgtccaagcggccgacaggggcctgagggtttatctgcaggatgaacatggaacatcagtggacgccctccattacatgatctcaaggggtgttaagaagtctgcccgtgacgacaaatctgatgcgtatgctgctgtgatgattctggatagatacttctcgtcatcaggtcaaggcgctcagattgttcttcctaggcaacaggaactgcaggacaaattaatcgcaaaaccaaggcaagatgctgaaatttaggaatgggtgtccaccatttccaactttagacaagacactgcctactgctagtagaatttaaccattgtgttctgttagagagggctttacatcctgaacatataatacgatcagctaacttcaattgactatgcaatctcatctttagctctcttatggattctgtatctacacttcgttttncgagatacatatgtacctgattcatagatctctagattaacgtt

SEQ ID NO: 32523 - DNA, 404 bp, Triticum aestivum
  Clone ID: PAT_TA_32523
ggtagcaccttccagccaaagtaacgctccgggtcgaacaagccagagcccataatggcttgcggctgcacaggtaagcttccggtcaatggggtatccatccgtctcttcgtggctgggtgaagctttccgcaagatgtcatggcgcttctccatgcatcccgaccatccgctggtttctccagggtgcccgtcaaccgtcctccatccagtagtgaattttgaagtccatcttgagcttgaagtcatggggttgtcatcatcttgactctcacatctcccttatgaatcactcaaccaaccccgtctacgagcatagcaaagtaaactacatcgtcccgggcatctgttacaagggagaaagggtcatcctaccccatgaaactacttaggaacattactta

SEQ ID NO: 32524 - DNA, 464 bp, Triticum aestivum
  Clone ID: PAT_TA_32524
cgggaatcattatgtatttctacatctgctatgtcagtcaagccagagcccatagtgacttgcggttgcacaggtgagctttcgggcatgaagtattcttccgtctctttgagtctgggtgaagctttccgcaagatgtcatggcgcttctccatgcatcccggccaaccactggtttctccagggtgcccgtcaaccatccttcacccagtagtgtgtattgaattcttgtctcctgtcttgaattctcgaggtcctgaagatgcagtccttgtcgatgccatcatggagttgttgtcattgaagtagagtcctccattctcacaccactcccgaacactcataccaaccccgtctactatagcgtagcatttaaaactatacaatgtcccgggcttggtatacacggtgatgggttcctacctcatgcatactactcaactacaagaatccatatcactact

SEQ ID NO: 32525 - DNA, 861 bp, Triticum aestivum
  Clone ID: PAT_TA_32525
gcggcacgtgtggctttgtgggctgcggcgtcccgcgttcaccgtgcgtgcttgcccaggcatctgaaccagcagcgtccaacgggcgacgcgtccatggccatgaccaccacctcctcccgactcaccaccacccagtactccttcctctcctccacgccatgctcgcccaccaccatggctgcgctcccgcggcggcggagagccggcgcgcggtacccacgtatccaggccatcgagttcgaccagaacacggttgtggccataactgtcggcgtcgtcagcgtcgccgccgggataggcatcccgattttctacgagaatcaaattgacaattccgcaaagagagacaacaaccagccgtgcttcccctgcagcggctccggcgcgcaggtatgcaggttttgcaccggagcagggactgttactgtagtaattggtaatggtgaatctgaagtatcaaagtgtgtcaactgcgatggcattggctcattgacatgcaccacatgccaaggtagtggcattcagccacgctatcttgatcgcagggagttcaaggatgatgatgactgaagatttttttcgttacgagctaacgacggtaaggtgaggaatctgatctaaggatgatgctgaatacttggtgacgatgtgtccatcaggaatgatatgattgttttgtgttgtattatatttcctctccttttttggtaaatatgtatggatgtacatgcacactcttttgatgtctgaaaatgactgtccctcattgggcaaagatgatattttcttgttgaacattttcaatatatgtcacatagcgtgttcccaaaaaacaactcccaccaactgaaaaaaaaa

SEQ ID NO: 32526 - DNA, 548 bp, Triticum aestivum
  Clone ID: PAT_TA_32526
ccattccgagcacactagtcttccctgcgcttgctcgctccttcttgcccccatggcgctgctcgccttccagggcatggccatgtcgaccgccgccgcggccctcccatctcacaaccacggcgccgtctcatcctacgtctccacctcctcctacgcgctcgcagcctccgccgccttcccccgcgcccgagctgcgttcgccgtcggcgccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgctcctccagctcctccaaggaaggatcagttcgatgatggggagatcatttcaatcgagattgacgaggacatcctggaataggttgtccgagttctgccttgctttatatttgccctgagcttaattggcctagtttgtaccaaatcaaatactacatattttaagtaattatttcctcgcctat

SEQ ID NO: 32527 - DNA, 795 bp, Triticum aestivum
  Clone ID: PAT_TA_32527
ccccgcgtccgctcaccgcacgcacgcacgcctgagccgatcgagcagacgcgcgcgagccccacacacctcgccgccggccatggccatctccgccacctccagcctcgcgctccacgcggccccgtccgccgcccggcgccgcatgcgcagcgtcgtcgcctccgcaacgcggttcgaccggcgctcggccgtgctcctcctgctgtcggccgcgggtgccgggtcgtcgttggcggcggtggcgccgtctgcgaacgctgccggcagcatcgggctcttcggcatccggaagaagctggagcgggcggaggaggccgcgcgggaggtgggcgaggccgcggtggaggccgtggaggccggcggggaggcggtggcggaggccgggaaggaggtcgccggggagggcatgcagctggccgccgaggcggggctcgccggcgacgcgctcgtgcaggccggcgtggtcgccggcgcagaggcgctcggggtcctcgtcggcttgtccgtcgtcaacggcatcctcaagcccgaggcctagagggttggtcggctcggtccgtagtgtttttgctggcccatccggtgtttgggtttagtgcttacagaaggaactggctatcattatttgttcatgactttgtggtgtggtatattttagtatgattttatagagtgatggatgctcatagttcaacaatgttatgtagtatgcaacaagatcatacaatttgctttgtagggaatttgcgctacattaatgtataaaacttacattgtttcaaaaaaaaaaaa

SEQ ID NO: 32528 - DNA, 686 bp, Triticum aestivum
  Clone ID: PAT_TA_32528
tgaagcgtggattactacccaaagatattatacaactttcgcttgcaaagttttctcgcgtcgttttaccaatcgccccatctgaagttctgatccttagagataacagtttctgcacgaggaacaagtacgggagtattgttcggcctggcatccagtcaattaatgaatctgaagaaatcaagaagggtgtaatggaattctacaaggcggctcttgtgcctgagctagcaaaattcctggatgcatcccttcctccgtggcaagaatgggtggagaacttggaccacttcaccagcataccagatcctcagctggatgaagttaggacagcttatagagcatggaaagacgattacgaccgggtaaaaatggctcgaaagaatactggcagtggctaatttgtctttatcaagctgatgacgaagtggatgaggaaccaaaccacacacccttaagtaatgtttttctcaagcaatcctccatacaggagcaatacttttttgggaggcaatgccgtttatctaacactgagagcctgagccattcattgaccaggctaggaaaacctgcagactgtaagtgttgaattttttgctcccctttcatcaaacttgccaaaagtattgatgcaatatccaaggatttgatttaaaaaaatagggaaccactataaaaccaaaatc

SEQ ID NO: 32529 - DNA, 978 bp, Triticum aestivum
  unsure (1)..(978): unsure at all n locations
  Clone ID: PAT_TA_32529
ttttttttttttttttttggataccaacattggtcaataaataaataaataacagagtcagaatagcacacatacatacatatgtatggagtccatgacatcggtcaataagttactcctcctggggccattattataccatatatatcatatatgcactactggtgttaaaattaaaattcctgcaggggacgaacaacaacaagagacatctgccttttcagcagcggcacgacaaacgacacctacctattcttcctcggtcaatctcgaaacgaagtacatacattactatgatcaaagtcttcatgatggggattaatagaagccctggagaagaagaggccctctgtctgtgcctctccattctttcttcaccattaatcaaggggatgatgatgatcttggccgataccactggcacctgttacatctgcgacccataaggtgcgagtgtgctgctgcgcaggctcacgccggcacctcttagcgaaacagcagggcccctgtgggtgctcgccctgcttacgaggctcgagtcgaggtagagtatgatgaccgttatgtcgtcatggaagtggcgacggacacctcggtcgatcttcttgagatcggaatacctcctttctcttttcttggctgcttctagcaaggctgattttatgagcctccccccccccccaatacgagggttattttgaaaaatgtccaaagcctcctggttggttaagtgttcccaaagtccatcagatgaaaatatgataaantnatcctgtggttgtattggttgaaaaaaaatggatggttntgaatttagtatgggcctgttaaaaggttnangaaganggaattttgaataaagaggttcccggttgaannntcntttttnnagntaggaatcaccgatcgatttgaagacctgaattaggnnttttanatgccaaatattgtgtttgagaaaaataaaatgcctatttt

SEQ ID NO: 32530 - DNA, 2577 bp, Triticum aestivum
  unsure (1)..(2577): unsure at all n locations
  Clone ID: PAT_TA_32530
gcgagggcttcgcccacgcgccccgccgtggacgcgcgcccgtccccgagacgactccacgctgcccgccgcggacgcgcgctcctccatccctagtcccccccctacccccatccatccatccgcaccaaagccttcgctgcgctagatctcgccgcccgcccccgatttcttttctcggcctctccccgtagctcgctcggcagatctgcgcctcctgggaatctccgtcgcttcggtccaaaggctcgattcttttcttgctcttcgctgaggctttccccggatcgcacggtcgggggacacacaggatgatgggtcctgtgtggtgggctgtgctggtgctgctggccatggcggacgccgtggcgtggaggatcgtggtggagaagtacagcgtcaaagtggcctcgtccgacatgctcaagagcaagtagcagggcaccttcggcagcttcggacttgccgggtatggaggctacgtcgtttactgggtcctgttccgcagagacatggattcggggatccgcgcgttcgcggtttactacaagcgtctggagagccaagacggcgccaacatcctcctcatcgtcgcgcaggctggtgatttttagaaaccaggtagggaagccacagctgcgcaatgcagcagcgtttcgtgctgtgtatagattagaagccgctggtgttggctgtgcagcacaaagatactgctggtacgcgaggataattgatgtatgcttctaggaagttccagagttgaaaacattcattttatgacacacgataatcagcataggatgatattgtgatggtttaccctaccactttgtgtcggctctagccctcgtcggataagactgtagtacgcacgtttcaaccacacagtaatgctgagttggttcctaaatttgcatatgcaaaaggagtttgtaaagggcttcagaggaaccgcacaagttcttgagcagaagggttacacacagttcactcctcattatattacatggtattgcccggaagcttttaccgtgagcaagcaatgcaaatcccagtgcataaatcatgggagatattgtgcaccggacccagagcaggatttcagcaaaggatatgatggaaaggatgtcgtggtccagaatttacatcaagtctgtgtattcaaggttgccaatgacactggcaagccatggttgtggtgggattatgtacatgactttgccattagatgcccaatgaaggagaagaaatacacacatgaatgtgcaagtcatgttattaagtcacttggtttggacatggacaagataaacaagtgtgttggagatcctgaagctgatgaggaaaacccaattctaaaggcggaacaagatgcccaaattggtcatggtaaacgaggagatgtcacgatactgccaacccttgtcgtcaataacaggcaataccgaggtaagttggacaaaggtgctgttctaaaagcaatctgttcaggatttgaggagacaactgagcccgctatttgtttgagtgaagatgttcaaacaaatgagtgtttggagaaccatggaggttgctgggtcgacaaggctaataacgtcactgcatgcaaggataccttccgtgggcgtgtttgtgagtgccctattgtcaaaggtgtaaaattcgtgggggatggatataccaactgtgaagcttccggtgttggtaggtgtgagatcaacaatggaggatgctggaaagaaactaagaatgggaagacaatatctgcctgctcgcatgaagaatctgaaggttgcaaatgtccacaaggtttcaagggcgatggtgtaaaaagctgtgaagatattgatgaatgcaaagcgaaatctgcctgtcagtgcaatggctgcagttgcgagaatacatggggaagctatgaatgcagctgtggtggtaacaacatgttatacatgagagagcaagacacgtgcatcagcaaacaagctgcctcctcagtcggctggagcttcatgtgggttattttcttcggacttgtatttgccggggtcggagcatatgcagtgtacaaatacaggctacggagttacatggattcggagatccgcgccatcatggctcagtacatgcctttggacagccaagaaggcgcaaaccagcaacagcatgtcgcgcatgctggtgatatctgagaccagatggcactgcttttgctgagcaacacagaagcgtgcagtgcgtatgtattatcatcggtggcgtcggctttacagcgcaaaagatacggtttgtacgcgaggagatttgatgtatgattctaggaagttacactgttgtgcaccttcattttgtgagacacgatgaacagcataggcggatattgtcacggtttaccctaccacctttgtcggctctagtctcgttgcatactactgtactacgcacgtgtcaacatcctgtaaatacttggtgttcagactacttgcccctgttatatctgaataaatccggagcctataggtggtaaaaaaaaaaaaaaaaaaaaaaaaaaattannaaaaaaaaaaaaaaaggccccta

SEQ ID NO: 32531 - DNA, 593 bp, Triticum aestivum
  unsure (1)..(593): unsure at all n locations
  Clone ID: PAT_TA_32531
gggacaaggagcagaacccgctgaagcggctgctgcggaaccgcgtgtcggcgcagcaggcccgcgagcggaagaaggcctacatgacggagctggaggtcaaggccaaggacctcgagctccgcaatgccgagctggagcagaaggtctccaccctccagaacgagaacaacacgctccgccagatactgaagaacacgacggcgcacgccgggaagaagccgagcggcggcaaggggggagacagcggcaagaagcaccaccaccacttcggcaagggctagcaagcttctctgctctgctgcgacgatggttgttgctaggaaccaccggacgtctgctcatctgaccattgttaggacactgctgttgttgtttgccgccgcagtttgacgcttggcttgtcttcttcttctttttcacccttctcttctcttctcttctccacggttgcccggtcgcccgcccgcttttgatgtctcactgccactgttgtgtgtgccctgtccattgtagcttgttgttaggaatgttgatctatgtgaacattggttgtgtattgtaactgtgcngcnctcttcaaaaaaaaaaaa

SEQ ID NO: 32532 - DNA, 897 bp, Triticum aestivum
  Clone ID: PAT_TA_32532
gaattcactagtgattagcgtggtcgcggccgaggtttttttttttttcttttgaacatgcaacagcttattgtgtcgtataggcaaatacctttcagaagaatacatataaattcatattgaaactagtggaacaaaatttgtatagcttcagaaaagctcaaaggtccttgctgagcaaacttatgtctagagcctatataagccgacacaactaacatttctgaatagctcaaaccccacatattctctggaagatacgacacggcttctatctaccacaggccacctcatccaaaattactcagttggcttgtctgggtcatcttcctcaggatcctccttgtcaggatcatcctcctgtggttcttcttgaggttgtgcttcttcctcttcttcttcctcatcatcatccagaggatcatcagctggtaatggatggggcaatggtgttttcatagggctgaactttgggaagatgtcaggtctcctcccaggcttaggtttctcccattcgatggggaaatcgaggggcgagcgccgcgtaatcttctcctcgtcgggggccacgcacaccacgagcgaaccccacctgcgccgcatcctcgcagggaccgccgcccgcgcgacgaagacgcctctggattcggaggcggagacgccgagagcgcccggcgccgccaccggcgcggcggccggcgccaagaggcaccacgcggacgccatggggagaggtcaagagagcttaagggtaaggtgcttccggcttagggctctcctgggtggaggccggagaggtagagaagtcgggatggaatttgggtttccccttcgtgtggtttggtcgagttgcggcgccttccgcgccgccacccgcggcttccacctagattccgc

SEQ ID NO: 32533 - DNA, 1322 bp, Triticum aestivum
  Clone ID: PAT_TA_32533
ttttttttttcgtatctatatcattgtgacatactactttcgtgctttagtaacacgtgttccttgtttatttgtttactttcatcaaaagagaaacaagacatatatcacctggacaagaactagaaaaccaccttacaaagagagaataaacaaaaaccatacacaaaaacgaaaaataaaataaaatgcaactaaacatacaaaaacaatcgtacatgaaccaccgaccacgcaccccactcgctgttcactacgggtcaataccggctcaattccccctcgccaccggtcttcacttctatcatgcccatcctccccgccgaccgtccccatggaccgtgcgaacacttggaagaacacttccgacggacccttggccacgctctcgacgtcggcccttgctgcagcatcggtcgatgagcgcggcatcgggactggaagggtccccgcacgctttaggaaggccacggtagtagctagtgtcaaagggtgaggaagctcccggggtccatctccacggatggtggtgttgtccgtgggcgtggtgcactgcgtcctgcggagcttgggagcatactgcgcatcaagagatggatccgcgtccccgggtcttccacggccggtaaagttatttagcctctcagagaaggatgtgcagtgtgccatgccgatggtgtgggtcggcgagggccagacccttggcgcggaaggaggggaggaggtcggtgaagttcatggtgggcgccgggagctggtccagcgcctcctgcttgatcgacaccctgccgtctcgccgccccgtcggcacgcgccagaacggcccgccgatgacgccgacggcgtcgcgggatgcgagcgcgaggatgtcggcgcaggagacgacgccggggcactcctgctcgaccagcgccttgacgcggtccaggaaggcgaagccgcgcagcgtcaggttgggcgtcgcgtccttctccgcctccccgccgccggtcgtcgcgttcagcagcaccgacgcgtcgcaccccctgacgaagcagtcgtggaagtgggtgcggatgagggtggcggcgacggagggcgcagtgcgggacgtgccgctccacgtagtgcttcacgatctgctccagcccgcgggcagctctgctcgtagtacccctgccgcagcttcccgccccccgccatcgccgccgcgacgcccaccggccaccacgagcaccgccagcaccaacggcgccgccgccattgtcaccaccactagctagagcctagagcgcgctcgagtggcgggcggtggtgtgcaaaggcacgaggatgctctgctc

SEQ ID NO: 32534 - DNA, 2067 bp, Triticum aestivum
  Clone ID: PAT_TA_32534
gttcgggccggggctcgcgcctgcatgaacgattttattcgccagtatcacagcgtgaacattaatgctcctgcacacaccgagcatggtctctttgtcccagtacccagccacgccgacaccggcgccggcgccactattgctgatgaggtgaagcagttggcttcaagagcaaaggataacagtctaaaaccagaagattatgagggtggcactttcaccgtctctaatctgggaggtcctttcggaatcaagcaattctgcgccatcgtaaaccctccccaatcggcaatcttggctatcggctctcgctgagaagagggtagtccccggggcggctgagggccagtacgaaatcgggtccttcatgtcagccacgctaagctgcgaccaccgggtcatcgacggtgccatgggtgcggaatggctcaaggcgttcaagggctacctcgaggacccgacgaccatgctgctgtaggagtactctttctttgctgtaaatgatgatgatgagagcagtttttctgtgtaggctctcacaaataaagaccacaataaccacgcctcatttttcggcaatgagggctggaaaccaagagcaaacaaacagatcatagacggcacgagatgtttaacctatttatcggcaaatggccgatacacctttttttccctgcgttacttgaccggtggaaatttgttgcctacttttgcgccgtgttctactgaatccgattcaaagaagattgtgtatcgtattgttgcaaggtcccagttcctgggcccgtggaaccaaaagaagagaagaaagaggtttccaaggcccccgagccaacagctacaaagactgaagaatcttctcagtcaggggatcgcttattctccagtcccgttgccagaaagttggcagaagacaacaatgtaccgctttcaagcttaaaaggtactggtccagatgggcgtattttgaaggcagacattgaggattacttgtcttctgcagccaagggttcgaagaaggaagctgcagcagctccaggactaggttatgtggatcttccaaatacacaaatacggaaggttactgcaaaccgcctgctgcaatctaagcagactatccctcactactatctgacagttgatagccgtgttgacaaacttatcaaattgcggagtgagttgaacccgatgcaggatgcatctggtgggaagaagatatctattaatgatcttgttattaaggctgcagcattggctcttcgtaaggttcctgcctgtaacagttcctggatgaatgattttattcgccagtatcacaacgtgaacattaatgttgctgtacagactgagcacggtttgtttgttccagtagttagggacgcagacaagaaaggcttggccactattgctgatgaggtgaagcagttggctctaagagcaaaggataacagtctaaaaccagaagattatgagggtggcactttcaccgtctctaatctgggaggccctttcggaatcaagcaattctgcgccatcgtaaaccctcctcaatcggcaatcttggccatcggctctgctgagaagagggtagtccccggggcggctgagggccagtacgaaatcgggtccttcatgtcagccacgctaagctgcgaccaccgggtcatcgacggtgccatgggtgcggaatggctaaaggcattcaagggctacctcgaggacccgacgaccatgctgctgtaggagttctttttctctgctgtaaatgatgatgatgggagcagtttttctgtgtagctctcacaaataaagaccacaataaccacgcctcatttttcggcaatgagggctggaaaccaagagcaaacaaacagatcatagtcggcatgagatggttaacctattttatcggcaaatggccgataaacctttttttcccctgcgttacttggctggtggaaaattgttgcctagctacttttgtatcgtattcaaagaagactgtgtatcgtattgttgcaaggtgccagtgcctggattttttaaaaaaaaaaaaaaaaaaaaaaa

SEQ ID NO: 32535 - DNA, 1194 bp, Triticum aestivum
  unsure (1)..(1194): unsure at all n locations
  Clone ID: PAT_TA_32535
aatctnttgtgcttagtaatttctcatcttcaccgtgctatacattggttgtaaatgctggtagtatttgtccttgaaagctggagggaaaacaatattttccagcatccactttcctcacggacgtacaaaaaacacaanccatcttctcatacaaagctatgtggttcatctgctgcggacattgaccatctgccaaaaggtccctctcatggatgcgtctgtgaaatcgtcatcgtcggctacaccgtctccttccatgctgccggttttaggcggcgtgagctctgtaaccatgttgaggctgctcacgtcggagaagtccaggccgtcgcaatcgaccgcgcttctctgacggcgaggcggcgtgagctctgtcaccatgttgaggctgctcacgtcggagaagtccaggccgtcgccctcctgcagccgcatcacgaactgcaggttccacaccacgtcttccatggccggccggtcggcgccgcgctccgccaggcacctggccaccgtctcgccgtatttcctcagcgccgccggcctcgccacggcggcgatgcgccggtccacgatcttctccagctcgcccctgccctgccagtgcagcccccactccaccaggttcgacatgggcttcggcagcctcgggtcgacgacggggcgcgcgcagacggcctccagcagcacgacgcccagcgagtacacgtcggacttggccgtcagctgcctcgtccggcagtactccgggtcgacgtacccgaagctgcccttcaccgccgtgctgacgtgcgtctcgtcgagcaccggcccggccttggagagcccgaagtcggccaccttgcccgcgaggtcgccgtccagaaggatgttggacgacttgacgtcgcggtggatcaccggcttgtccacggccgtgtgcaggtacaggaggcccctcgccgcgccggcgcacgcctccagccgctgcgcccagctcagcggcgcagcacgacgcccagcgagtacacgtcggacttggccgtcagctgcctcgtccggcagtactccgggtcgacgtacccgaagctgcccttcaccgccgtgctgacgtgcgtctcgtcgagcaccggcccggccttggagagcccgaagtcggccaccttgcccgcgaggtcgacgtcaagtcgtccaacatccttctggacggggtac

SEQ ID NO: 32536 - DNA, 372 bp, Triticum aestivum
  Clone ID: PAT_TA_32536
ctggtgcagatcgggcacgagctcctcaggaagaacgtgtcccgggtggacctggagaccggccgcaacgtggagatgcctggccagggcaccaacgcggagcagctcgccaggttcgcaaagcagctctccgacgagcgccgccgccgcaaaaaggcgcttcaggttaactagcagctggccgccggctcgctctactgtgttgaatcttgctcgtttggtggatgttttccattcagttttttttcttgtacagcgatgatgtaatatttgtacagttatgtaataatactgtgccacggttggaaaatagattaagggtgttcctgttttgccggagcgagtgttgattaaaaaaaaaaaaccaactct

SEQ ID NO: 32537 - DNA, 599 bp, Triticum aestivum
  Clone ID: PAT_TA_32537
cgggagtcactgtttaaaataaaaatatgctacacgccttgggttcaaaactatatctcatactcagctgggtaatggtttcctctctattcctgaaaactgtgagctgtcagcaaattacttcttcatctggatgcgactgcgacacaattataaaggatactctaactgaaaaccctaaattcacaggctggcaacaatgtttttctaaagcatttcttaaagcattgaaagttaacggaacatgtgtaaacaagtgtaaaaagcaatttgaagaaacctgcaaaaagataaaaggttactgtgatgaaacaagagaaaaggcacttgattgtggaaagtacacaggtagacaatgtgttaagtgtgttgacattgttgtacaaaatgaatcaaggctagaatgtcagactggaatatatggtgtatgtttgtcaaagcctggaaagtgtcaaaataatggtgaatgtccttcaggatgtgtttgcaatgatgatggttgtgtaagacataatgattttacaaacaagtgttattaaaaatattctgaaataaaacaaatctgggttactgttgaagttatgttttgttcgatcttt

SEQ ID NO: 32538 - DNA, 684 bp, Triticum aestivum
  unsure (1)..(684): unsure at all n locations
  Clone ID: PAT_TA_32538
gcacgaggcatctctgtccctccccgcgcggctcggctagcgggcgtgcctcgttcccctgtccaccacagattccacacccccgccatagcacgcgatgccgcagctgagcctgagcaccaacgtgccggtggacgccgtcgccgccgccgacatcctccgggactgctccagggcgctcgccaggatcatcggcaagccagaatcctacgtgacggtgtcgatcgacgggtcggtgccgacgtcgttcgcggggagcgaggagcccgcggcgtacggggagatcatgtccatcgggggcctcggtcccggcgtcaacggcaagctcagcgccgccctcgccgacatcctcgaggccaagctctccgtcagcgccagcaggttctacgtcaagttcgacgatgtccaggggtacaatgtgggcttcaacggaaccacgttctaagacaaatccatcagaagaaagatgttggcgacagtagtgaaccagtaccataccatgccccactgtgtatcatctgcatcttggattttcgtcagttaatatttctcgcatatctgaagtactagtgctgtgatttcaagtcaacagaatgcaagttctgcttttgtttgcttatttgttcagtataaaaacaaagtgaaaacanttaaaaaaaaaaaaaataaaatatattttatgag

SEQ ID NO: 32539 - DNA, 992 bp, Triticum aestivum
  Clone ID: PAT_TA_32539
gacaactacaacgatcgaaatgaaaacaactcctgttaaacttgtgatggatgaacctatcaataaagtatttataggtaatttgcctttcaaaatcaaaaaagattcacttgttacttttgctgaaacatgtggaaaaattttggaagtcattgtgattaaaaggtatcggagaccttttgtttttggcttcattacatttgaaacagagcaagaagctaaaagggcagctaaggaactgaataaaaaggaattggaaggtcatgaagttcatgttgaaatagctcgctctaattcgccccataaagtgacgcgtaaacggtctaccaagaagtctgctaaaaagcaaaagagtactagtacatcatccaaagaagaaaataccgaatcaaatcaagaatctgttcttgatgtggtcgaaaagaagagaaggaagcgtcattcaaagaaagtggaacattcgtctgtggttatatttatagccaatttaccctttgctacaaatgaacaagaattgaaagaattgtttattgattataaggtagtctctgttcatgtggtacgtacaaaaaatggaagatcaagaggctatgggtttgttgaatttgaaaatgaggaagaaacaaagaaggtgttggaaaatgtaaaggatgttgtcttggaagatcgttttatttatatcaaaccttctttggcttctcaagtaaaaagcaaagtggccagcataaaagaaaggggacaaaaagcagaagaaaagatcaaagaggatcctgtgaagaatgacagcgaaaaatttaagaacgttgttaagaaagataacacgatgaaagatgatgttgagaaggataaaatgaaccaagtagagcaggaaaaagaaggaaaaaattgaagaagacgaaaaaaaaaagcaaagatatcaagaataataataaaaatacccaaataaaattgaatagacttcttttataaagaagcagagtattttaatgaat

SEQ ID NO: 32540 - DNA, 460 bp, Triticum aestivum
  Clone ID: PAT_TA_32540
cccacgcgtccggcgcaggccgtcgcgtgcaacgtccgacaagagtgttaaatggccgccgcccgccgccgtgttggcctccatggcacaagccacacctacgcttctacacaccggagagacgatgatcaagatttgaaaaatgaaaaaaccacgctgctacgcccgatgatgatacgacactccgatttttgttacttccgcctccgccgaagatccgacatggataaacacacttaggtagctgttcagtgctctcccctggttgatttctgaaataaaaacatgtggaaatcatcgaacccttttgatccaggcattgctgctctttctttgatttagcctaattctaggacctttcaagtgctccacgttgtactggtgctaagaatgccatataggtaaaaagatgatgtgacaaagtatttaaagaaaagatagaacattatggtgactccgg

SEQ ID NO: 32541 - DNA, 770 bp, Triticum aestivum
  unsure (1)..(770): unsure at all n locations
  Clone ID: PAT_TA_32541
tgaaaaaaggaacttgttgatttatnnaacctatttatttaaacgaagtggtgattttatanntcataaatcacccttttcattaaagcctatcaagtgtcatttaacagaagcaacgttttgtattctttaaaagcaaataataacaatgaactattttatattccacggcaatactaccccaaagaaaacaattcaacagcagtttatgaaaacgcacccacaatgtcagacatttatagctcgtccatcgatttctcgtcatctactttatcccaaagaggtattaaagctggatttttatctggtcaacagtcttcaaccgccatgagaaaagaagaaacaaataatcattctaacaactggcgcaaatcttctcatgacacgaataataacacaccggataataataatgacttgaatatcgttttatcgctagcttcatcgtctacaggcaaacgttcatcctctgtcgacagtgagctaaagagagtaaagaagaagagaaagacagaagatgaagaagtagtcttgtttggtccaatccctactatgaatacaataactattaaaacgaatgatgatgacttgataatgaatgatgaaacgatatttcaagaacttgaaagaataatgaataacaataacactattctatcaccgcctacttcccctatcttatcttatttaacaacacatgatgaattattattaaacgatgattttgtcttatttccttaataaactttttattattgtctttctacaac

SEQ ID NO: 32542 - DNA, 495 bp, Triticum aestivum
  Clone ID: PAT_TA_32542
caagaagacatggagaattgcttacttccggttcttcgacaaggtgtacgatcatgtctatgtatttgtggttgtgaagtgggcaggcttcgcaaagaaaacagatgaagaataaccaatttctctgaaggaggtggagtttgtgctgcaacctattgaatgagagctctggaatattaaccagtgtgcaagatctccagaccagaagcatatgttatattgtgtgccttgtttgcacctctatctaaataaaaaatgaagatgcctatctcttctgatacatttatgactgcactactgtcaaattattgtggtaaatgtaagatcttcagaagcatatgttatattgtgtgccttgtctgtaccccctaaataaagatgaagatgtctagctcttctgatacatttatgctttactactgtcaaactattgtggtaaatgtaagccttcagtattgtttagttattccgatacatgtaaaactttactattct

SEQ ID NO: 32543 - DNA, 834 bp, Triticum aestivum
  unsure (1)..(834): unsure at all n locations
  Clone ID: PAT_TA_32543
cggcctcgagggggacttgcaagcgagagacatcctcgacctccaagcagagagaaagattcatagtatcatacaatgggcaatagcttgaggtgctgcctggcttgcgtgctcccctgcggcgcgctggacctgatcaggatcgtccacctcagtggccgcgtcgaggagtacggccggccggtcgccgccggcgagatcctctctgccaacccgaaccacgtgctgagcaagccgtgctcgcagggcgtcgtgcggaggatactcatcgtctccccggagtccgagctggagcgcggccagatatacttcctcatcccggcgtcctcggtgccggctgagaggaagaagaagaccggctccaccgctggctcgcaaggcgccgctgccgtcgcgccgtcaaggatggcaaaccctggccacggcggcaagacgcgcaaccacgttaagagcaagccgtcgtcagatcacggcagtggccgtgacgtgcggtccgagaagaggtcgctgcaccggcggcgagtgagcaccggtggccggaccgccgtgtggaggccacacctcgagtgcatcgttggagggcaacttgactagttcactacctagttaatttttgttctttcttttcctttttctttggcatgggtgtcatttttctctcttgtgcgcatggttaatgtgtatgcttccttgtggccctttttgtaagtgtacatccatgtaatgtttttcccttccttcatatatatgatggacatggagagggaaggttctgaattcntgttnctaaactactgccttttttctcctccaaccnatttagntgntgttcan

SEQ ID NO: 32544 - DNA, 466 bp, Triticum aestivum
  Clone ID: PAT_TA_32544
gcccccactcttggggactagttttagatcgcgagcggctttctttttttttttttttttttattcatattcaccatgagtagcagaaaacctgaagttgttccacttaatctcaaaatagaatccagtaaaccaatttccatttcagcttcaactagtttattggataatttcttacataatggcgttgctattcatgctgcaaacaatacagtagccgctcaacttcatcaattgcatcaaggattaaaagaaataaaaaaaaagcaacgaaatgatggcaaagaattctaaaacaatccaacattgcaaagtaatacagcattttacctactatctttacgtaaaattttaaattatatcagctatattagcaaagcatcacttcagtatgtcctctttttttttttttaagaaaaaaagtacttgacgtcaaacaacgaataaaatgaacacatttacatcc

SEQ ID NO: 32545 - DNA, 995 bp, Triticum aestivum
  unsure (1)..(995): unsure at all n locations
  Clone ID: PAT_TA_32545
ccccgcgtccgaagaagagcatcgccgccattggtggagctcttgttatttttgtatttatatttgctcactatcgaagtacaattaaagaactaatacaaaccgtggctgtcgaactacgaacaacaccctacagctcgattttattaagttgtctaatcattttcacctctataccacccctcatcggtttcacattctcaaccactatcacaggctttatttatgggttccctggtggtatctttcctgctgtttctggcgcctttttaggtgccatggtagcatttgctttaattcgtaaatacaattttgctcgattcatcaagctttcaccttctaaacaagaaaaatacatggcaatacaagaggccattgaacaaggtggattcaagatgatggttttgattcgactatcacctataccttggcctatcaccaacatgctattatccatcatttccactgctaatacacagcattatataatggctgctttattggcctcatttaaagtatcactggatgtatggattggttctcaactagccgatctgtccaatcctaatctaccaccttctgcacaccgaatagccatgatcacaatgggttgtggtctcttgatcttgatcggtgtcgcttggtggctttatcgactgacgatggaaaaagtaaaagagatggcaaattccaaaaataattcgacagtgacgatagattcagttgtcatcgtaccttcaaagaaagcaatttaatttatttttatttttatgctgatggaagaataatatttggaaatttctgatgacattttctacattcacactantaagtattattgaatacattttcaatcataaaattaatcatttaccacacgctttcctctataaccacaacagtaagggacgataaggatagcaaaaaataaacttgtaagtgttaaatgcatacgtaaatcatgatatccattatctagtttacatgttgcacct

SEQ ID NO: 32546 - DNA, 981 bp, Triticum aestivum
  Clone ID: PAT_TA_32546
aggaaacgaaagtgagggagagatggccaattgctttggtgaagtagttgacaacttcaagctgaatgagatgctgaggtacgtgggcaagcccaagacgcgtgaagaccgggcacgagaggccgtgagcctgatgaacgaggacagcaagaacatcaaggcttccaagtacgtggaaggcgtcaaggactggtacggcgatggggtgtccacgctgtgcatcctgtacaacgcgaccggcgacaccctctactacgtcggcgagcacgactggtttggcttcatcgggcgcacaccctaccccgccgagatcggcaacggtcagtacgccgccttccttcacacccacaacaccggcgccgcgtccggctccgagggggccgtcgtgtaccgcgggaagaacagagatggccaggaccgggactacctggttgcctggagcaccccatttggtccgtggtacagcaacaaggcttattgcgagattggtggcgtcaactacttcgacgatcgttggggtcatgtatccggtaaaatggagaacggaggctactcttgcaacgccaagtccgacgggtgtgagattcaagcaacaactgccacgggtggtagtcccatgttccacgccataatcaaaacaccctttgctccatgagcacctacctatgttaagtacgtccggtttgtgtttgcatccccaataatgtgacccgtcctacccgtatcttggagggtccttgtctactttgcatgtttgctggagacttgtcatcgtcgactacgtacttacgtacgtcttgtactgttgccatttaatcaatcctattgtgctgttgttgccaatcaatgaagggcctagggcctcaatgtacgtctactccacatgacggtcactctcgctccgtgggctcttgttacggtgccatcttcattgcgacatggtcgctatattttcataactagaccatgcatgttcttcgt

SEQ ID NO: 32547 - DNA, 1026 bp, Triticum aestivum
  Clone ID: PAT_TA_32547
aaaaatgaagtttattactattgcctcttccgctctcttggctctcgccctcggtactgaaatggcctctgctgctgaatgtagcaagttgtatggtcagtgtggtggtaagaactggaatggccctacttgttgcgaatctggatccacctgcaaagtaagcaacgattactactctcaatgtcttcactctggaaacagtgacaataaaccttctgaaagtggtcacaaaaagactgctaccgctgctcataaaaagcccactactgctcccactaagaagactggctctagccccagcggcaaatactccgttgtctctggtggagcctctggtactgctgccaccactcaatattgggattgctgtaaggcctcctgtagctggcccggcagggccaaagtcagttctcctgtcaagtcctgtagcaaagatggtgtctctgtccttagtgacagcaatgtcctaagtgtttgtaacggtggtaacagttacatgtgtaacgacaaccaaccttgggctgtaaatgacaatcttgcctacggtttcgctgctgctgtcatgggtggtagtgatgaatctcgcttgtgctgttcttgttacgaacttactttcacttctaccgctgttgctggtaagaagatggttgtccaagtcactaacactggtgtttatcctgaggccaatcactttgatttgcaatcgcccggtggtggtgttggtattttcaatggttgcaccaaccaatggggtgctcccaaagacggttggggcaagagatacggtggtatttcttctgcatcggagtgcgctagtcttcctccccaactccaagctggttgtcattggagattcaactggttcaagaacgctgataacccaagtgtgactttcaaggaagttacctgtcctaaggaaatcaccgccaagacaggttgtgtaagaaaataaactgatttatactcacatcccttacattcattcttatcatgaattcaaattatgcaataaattggtttttattt

SEQ ID NO: 32548 - DNA, 1081 bp, Triticum aestivum
  unsure (1)..(1081): unsure at all n locations
  Clone ID: PAT_TA_32548
cgtccgccctcatccaaatccaatcgaaagtccaattccgtcgatcctaatcgccgactctgggcgtgatgagttccttcgccgtggtttccgacaatggcgacgaggacgcctgcgtgggggagaactccgtcgtggtccccgtcaagagcgaggaggacgcccgcaagggcgaggcctccgtcgtggtctccggcgagggcgagggcacctgcaagggtaaggcctccgtcatggtctccggcaagggcaaggacgccgtcaagccctcatgtacggcgcagtatccctgcgtcaagcggcttcgtgagcggcgcctcctctccttcctcctggaccaaggcttcgacggcgccttcagagagctgaatcgcgagacgggggtgctgttcaacgtggagcacatccggcggctggtgaggcggggacaatgggatgacgccctcttgtacctcaacatcttcctgccgccgctcaaaagtgagaggaggagcctccgcgccaggatcttccacaacttcctcctcatgcacggtcgcttcgccgacgtcgtcgccggcaacaaggacccgtaccctggacaagcagtatgccaacggccgcagtaactccacagacgccgagcgcaggttccgttccatgaactactccatactcgccccggacgccggccagctcagggctgccatcgactgggacagagtgaggagccatgcagagtttgttgtccgcaggatggctcttgctactccagagctgagacgcccgatggtgttgccgtcccgctgcatgatgccgcacgatgtactccccattgggaccggtttgttccggaagagacgcgtgaagaaacaaggcccccagccgccaaaaacagaagctatcttaacagctttgaaacaccagcagtattgcagacagttnagggattcgagcgttgggtcgaaagatgaagaactggaactgctggtccatttccttgatgagactctacaggctggcctaccttgagggtgcacactaagctatgaccttcaacccagcgggaaggaagttgaacttgctgcagattcttctcatg

SEQ ID NO: 32549 - DNA, 722 bp, Triticum aestivum
  Clone ID: PAT_TA_32549
tcgacccacgcgtccgttttttttttggcacaaccaaaatccctcggaaaaatggtttgttctcttcctctttccttacatactccgtgctagaattgctaatcctgtataatatgtcgccaattcacaacagttaccagtcacaaggaacattacctatgaaaaaatggtgtctttcattcctaattactgctagtattatctaacactgtcagaaattcataacttaagacaagaaaaagaaaaggacgtggaaaaaaaggtgtatctctacaagagctagttcacttggtagagaactcaaacagcattgtatgcatgtacttctcaccaggacgaacgatcactgatggaaaattaggttggttgaccgcatttgggaaaccttgcgtctcaaggcagagacctgcgtgcttcccatagactgcacctcctttccccacaatgccagcaaggaaattaccagtgtagaattgcactccaggagcatccccccaaatgtttaggaccctaaagcttgacagatctgtcaccttagccacatgccgcaagcctgacttcacttcgcgagaatcatcaagcacatagttgtgatcataaccaccagggacttggccgatcctttcgccaatcgcaacctcagtcagaaaatcaaatggcgtgccactcacttgcataaactcgcctgtgggtattgaaatttgatctactggagttatctg

SEQ ID NO: 32550 - DNA, 896 bp, Triticum aestivum
  Clone ID: PAT_TA_32550
gaattcactaagtgatttcgagcggccgcccgggcaggtgtctcgagtttttttttttttttttttaaacacgacaaacttcaaatttatataatatcaatggatagttcgcacattacattacaacaacattgttgctttatttgcacaccacattacacgacatacagcatgtaagattcatccgggtacggattacggataattgaaaaaacatattacatacattaccctgccaaaaaatgtattacatacactctattggcccatagagatgtgcaggcagacgtggtttggcccgcaaaacaaagggttcagctagagcaaggccaattttgctctcctggagatcgatactgtgaacgccaggaggcttcgtccaagtgaatccctgcagcatccttgcaatcaacatcattgttaccgagggtaccaaagtgagattccctgggacaacccctcctcccaagtgctaaatgaaatgaaacgtaggcctggttcagtgagaagtacatttgccgcattgagatgcctctctggccgaaactccagtggttcgacccagatcttggggttgcgaccaagtccaaaccggcttaatatgacacctcggccgcgaccacgctaatcacttgggaacttcgtgtccgccatggcaacatgtggtgggttaaaagcatggtacgggtgtatccggaaggcctcccggatacatgatttgagatagtttagctgagaaatgtcagactcctggactagtctctctttaccgacgaccgtgtcgagttcatcaattgctttttgcatgacctccggcctgttgatcatctcagcgagtgcccactcaacagcgttggatgggttgtcaattattgcaaacataatttcctacaaat

SEQ ID NO: 32551 - DNA, 1599 bp, Triticum aestivum
  Clone ID: PAT_TA_32551
gccggcccgaatggggcacgagcgctgacttgcagcagcactaccaccaccagcagtccagcgcacaccaatccagctgatttcgagcacgaccagctcttgcccatcagccaccgtcgtaggctactgtcatccatggccatgaggaacgcgacgcagcaggtggtccgggccttggagccgtcactcaccaggagccttcatgcgtccccgggcagcaagaagatcgtgggcgtgttctacaagggcggcgagtacgcggggcagaaccccaacttcgtggggtgcgtggagaacgcgctgggcatccgcagctggctcgagtcgcagggccaccagtacatcgtcaccgacgacaaggacggccccaactgcgagctggagaagcacatcgcggacgcgcacgtgctcatcaccacgccgttccacccggcgtacgtgagcgcggaccggatcaggcgcggcaagaacctggagctgctcctcacggccgggatcggctccgaccacatcgagttgccggcggcggcggccgcggggctgaccgtcgccgaggtcacgggcagcaacacggtgtcggtggcggaggaccagctgatgcgcatcctggtcctcatgcgcaacttcctgccgggccaccaccaggccatcagcggggagtgggacctcgccggcatcgcgcaccgggcctacgacctggagggcaagacggtgggcaccgtcggcgccggccgcatcgggaagctgctgctccagcgcctcaagccattcggctgcaacctgctctaccacgacaggctccgcgtcgacgccgcgctggaggaggagctcggcgccgccttcgaggaggacctcgacgccatgctgcccaagtgcgacgtcgtcgtgctcaacatgccactcaccgagaaaacaaagggcatgttcaacaaggagaagatcgccaagatgaagaaaggcgtcatcatcgtgaacaatgctcgtggagcaatcatggacacgcaggcagtggcagacgcttgcaagagtgggcacatcgctggaaagtgccgatacggcggcgacgtgtggtacccgcagccggcgcccaaggagcacccgtggaggtacatgcccaacaacgccatgaccccgcacatctccggcaccaccattgacggccagctgaggtacgcggccggtgtgaaggacatgctggagaggtacttcaagggacaggacttcccggagcccaactacattgtcaaggaaggcaagctcgccagccagtaccagtgagcgtccatccatggagccgcagctgcacgcctgcacactccccgtgccagttgccagaaactaaataaagatgcttggccgttgcaatggccatcagccataaatatatctatacctaaataaaatggaacaaaaactggttgctttcatttgctatcagcttcctttgctgtatttatttttcgtaaactgtccttcactgtatttcgtttgaactataataaagtcaaagtgttgtgcaaaagttgtgttgaacctttgaaaaaacacaaaaaaagaaaaataaacaaaaaaaaagaccctgcccggacccccccgggt

SEQ ID NO: 32552 - DNA, 787 bp, Triticum aestivum
  Clone ID: PAT_TA_32552
ggttctagacagggtattgcatctatcaaagtctgaatgagcgacgtgttaaacagcaaaactacgtatcgataaaaacattacctcgatagtcccttctcctcagtaaagaacgaatgcccaggttttaaaccactcttgtccgcttcgccattgaaccacattcacttaagaacctggagcctgtacacagtgatgattgccaatgcaatgcgtgcagcataccctcgtctcacccggaggcgcatttgtcccgcaaggagaccaagcgggcaagcactgagacggcggcggcggcgtgcaaaatgtcagctccaagtccgtctcagccccacagaccttaatctgactacccgcgggtggctcgcctgaagcccatacaatgctttcgcaggtagcatccgttggcttgagtgtcaaggacttgccggaaaagccgtcgccgaagatgtcgctcatatcgtaccagacctggttgacgtcgagattgtaggcgaaaatggtctggctgacgttgggcttggagattccgccttcgatgggcgagatcttgagagcgatgcctccggacttagggtcggtgctgaagggctcgctgtacgatgattcggggtgaataatgttctggtcgctcatgctgctaccaacagaccagaggtagattggatcggtgcagtggttggttacgatggcgcgaccggcggcattgacgcatgcgaccagtgcagtgacggtaagtgcgtcgaagagcattttgaagaatgttgccgattgaagaccgagtttg

SEQ ID NO: 32553 - DNA, 1044 bp, Triticum aestivum
  Clone ID: PAT_TA_32553
gctcaacttgtctgtgcaaaatttatttttgtaattcttgaatactatacaatctagtaagactaggtccagcaaattgattaagttgctttgtaaagttatgcatttgtgcatttaatatcatagaatccaagcgactgggttcaggaggaagtttaaacaatgtgttgacttcatcctcaggtaaaggttcttgtcccttttctgcacgttcagcattttcttgttttctcgcagttaaccatgattgcatcttggcttgttcacgagcaacagccttcttccaatattgatggctatattgttcttgttgttgaagttcagtacaatccaataaatattgtaaattcttttgcataaaaggatccaattctaaatcaaggacatcaaaattaggcgccaagggtctggcttcttccaattcaatttgagtcttctttgtagaagtaaaggtagataaataaccaagacggtcagcatttaacttgggcatttcgatattgtgaagcatcatggtaacgtagtaagaattgtgaatttggacgggcaattcttcaaaaatgtttgaaaaagacaatttggcttgagcaagactttcagttgtgaatttctttgtttcatatgccttcataaaggcatctgtcaatcgaaaagctctaatactcaagttgccttgggctgcactctttgaaacatcatggataagaacaactgattgagcactgagagagttttgataactgtattgagtttcaatcaaactaaggtcaacaaagttacccaaatgagcagagcgataccagcctacagtattattatcaacattgactgcacgaagacaacgcatcatgtcaagttgatattgtgcgctagtatcttcatcaccatcagaagggaaaggaaaacaattagtaacttctaaaacacttttgtcgtctaaaccgagaagttgaccagtaacatcattaggataagattctcgacagtgcttgatgatcttcaaaacgaccaaaccgtctaattgaacggtacgaagtggctcgg

SEQ ID NO: 32554 - DNA, 399 bp, Triticum aestivum
  Clone ID: PAT_TA_32554
atataggcatacataaaactattgttgtttatcgttcattgcataagtacatgcaaaccaaacacgtacttacatgtcgcacccatttattgtaaaagctggtttaataaaccgaaaagcgcacacaagatgcatgctactccctctgtaagatcgtttagatcactaaagtagcaatttaaacactcttatatttttctttatggggagtaagatattgtattgagataatgaagcaaactcatcaagcgctcgggttcctctccggcagcttctcctcaacggtctcgaaattgaagtcgtaactgttgattccggtgtagaggccgtccctcttgatgctgctcctcaccctcccatccgtggtgacgtccacctggcggtagttgaacgggacgg

SEQ ID NO: 32555 - DNA, 1034 bp, Triticum aestivum
  unsure (1)..(1034): unsure at all n locations
  Clone ID: PAT_TA_32555
gagacaacattgatttatttattagttattacacactacgcctcatgactcattcattgtatatatgagggtatagtaataactgagggtaacacgaatcgaaatcacgtcacacaacaaagcccgctggctgctgcaccaggtcaatgagctcttcgttgtgtcattcttcatgcagcagtgcatcttatctggacactgcatcttatttggcaacacccacaagccatgtacgtccattttcatgacaagtaattccgaacggagggagtacgtagtaggagtatattatatcatcacacgcataccacgagttgatgtagaagaatacgggtctcatgcacctatcatgcatgccagcctgatgctgcatgctatactacacgagggcgtgcacaccccggttcctccattagcacagcccggcgtttccattacctcccctgctcatgaggaagaagccattctcgccaaacgtctgcccccacgagttcttgacgacccagtacttctcaccgtctctgaccccgtatcccaccacgagcaccgcgtggtccagcgcggtgccgcatggccctttgtatatgccgctcttgaagtgctgcaggctgcggtcgtgcgtgtcgatgccggcgaccgtcgggcccatcgtatagatggcctcctgcagaaacctctcccctgacctcagtagttgtgcccggtagaccaggcccctacgggtggcgtccttgttggtcctgcactgcccctgttgtgcctcatatgagtactcggcctccttcatgatgcctcccttgctctttatccacagaaacgccctgtagggattcccacccttgcagccgccgggtttctgtgtcgtgtcacagtctagtagctcctgctcagatagatccagtagctccccggttttccttttcagctggctttcaactgctcccactgcggcgaatgcccaacatgctccgcatttctgttggtttttagccggtgtaacaaagccctgctcgttccaatcccagcttcaggcn

SEQ ID NO: 32556 - DNA, 708 bp, Triticum aestivum
  Clone ID: PAT_TA_32556
cttgcaagggctgcatttgacaaatactctgtaacaaaccatatgggacaaagatacaacccataaattgcaatctccttagtggaaagctgttgctccttcaaaacatcaccctcacattcaccaattccacaaataagtggtttcgtctcttctagtacaggaaggtccacatcagtaatttttatcaccacggttttctgtggttccatttccagcatcttgtgaaattcaccattcttcagaggagcgctaccgccaaaggaagacttgctcgcgatttttgaggctttgctgcttccagaattccttctcaacaatctgtaaataaaatccttgagaaatgccaacgggatgtagatgaccatgagggaggcccccaagtaagtaattgcgaatggttgcttgtagttggcgaatatcccctgcgtgacctcggcggaggtgacccatatgagcacgacggcgacgatgaggacgagcccggcacggtacttgagattgggacccatgccgccctccgatcctgcccgccgtcctctgctactgtgctggagacgccgcgtggggagaaggaggcggcggaggcgagcaatttaaccgcgcgcgtgtggggagtgggggactggagttcacctgcccggccacatgcttgcggtggactgggtgggtgagctccgcgttagcgcccccggcctcatcgcccgc

SEQ ID NO: 32557 - DNA, 1866 bp, Triticum aestivum
  Clone ID: PAT_TA_32557
accgggacccatcttcttcctagctcctcgatctaatcgatccatggagcgcctgcttgggctgctcaaggtgaaggtggtgcgcgggctgaacctggccatctgcgaccccctctcccacagcagcgacccctacgtcgtcatccgcctcggacagcagaaagtgaagtcgagcatcaaatataaaaccatcaacccagaatggaacgaggagctcaccctgtctatcacaaactggacgctccccgtcaagattgaagtctttgaccacgacactttcaccaaggatgacaccatgggcgatgcagagttcagcatcctcgactttgtcgagatcgccgtcaaggacctgacccatgtccgtgatgacacggtgatgaagacgttccaacctaacgaggagaactgctactcggccgacagccacatcatgtggaaagacgggaaggtcactcagaatatggccctcaagctaaggaacaccgacactggcgagctcatcatgcacctggagtgggttaacctccccccaggcatgtcgcggtgatttgatttgatttgcagagggaggccagctattgtctgccttttgtgatcgtaatgttgcttcctctatatatgagctatgaaaataattaagcgatgcctatctcattctttacataacacccaccgtaatgatttgtggatctcaccaggatggtgcgtatataatatgagcaacgtcgtggtgagacccacagatcatcacagtgggtgctacgtaaggcatgtgatagacttatgctgctgggggtaatgcttgctttcagttttggttctgcatatggtatggctaaccgcacacgattttaccagtatacaattgttccatcacatagacataggatgatctcgatcatttcccagttgcacaatactccctcgtactgaacacttggcaggaaaagaggcggtatatacaccatcctgacctagtatgcacagtttttttatcactcacgctgacagcagcattaactcagcattccggagtagtccgcacaatccgaacatgcattaccaattgcggcaggtcactaggaaagcaaatgtggcgagctttcattgttgccaccccgtgggctcccatcatgcggggggtggtgcttgcccatttgcacatccccatgtagactgggtccttgatttagcatagggagcttcccttgctgcagctaatttctgaccacggataacgttttgcctccttttccaccagcatgccgcaaatacaactagaaacagaaaagctacaagtaccccgaaagccatgccgatctttgcagcgactgataaatgagggccacactcacgtaaaccaggaattccacacagcccagcattgtccgtaaagttgaatctaactcggtgtagaggtcttcctcccaggctggctggaacccttcctgaaagatcattgccatttaggttcagtgtctgtaaagacgtcagttggccaaggctctccggaatagaaccattgagttcattgaatgacagatctagtactcgtagccctgggatggtacccaaagacaatggaatattgccctttatactattaccgctgaagtttatgctttgcaggtgttgtagcttagatacatcactaggtataactcctctcaagccttggttgtcaagacctagtccatcaatgacccactgccttttggtattgtcaaactggcaatcaactccgctccacggatgctgctgaggaatgcaggggtcaccattccagccaaatcgaagaggaagaccaagtgaacccttcaaagtccgcagagcagtcacttcttgagttaaggtcttcatttcagc

SEQ ID NO: 32558 - DNA, 688 bp, Triticum aestivum
  Clone ID: PAT_TA_32558
agaaccacatgtcaatcttttggtagttctaagcactgttccctttccccaaagggaaccaaacttataggcattatcatctatttggagaacttcgatagaaaggatcgatggatcgccatgaccggtgctgtggaaacaaattgataagctagagtgttgaacaaaaaccagggcttccgcaaatgtcttctcatcatcactactccagcccgaaagcaaagaactgaatagagtgccctcaacagaaacatcaaatattggctcactatcaagattaggatcagccacaagggcaaagaaaagcctgacttggtagtgcccattgggaacattgttgatgtagtaacagttttcagggccatcagacagagggaaatatcgaagagttttcagtgggggtacaataaagctcgggcgagtggcatttgcaaacctgccaccagtataaccaaaatctcggtaccacaacgtgttggtaggtgccgtgtggacatcgtcgaaactcccacagcttatacggatggtaaaaggttctttgctaaggtcggccgcgagaacaccaagaagagctgacgatgcggagacagcgagcagcagcggccacagaagaaatctcttccgcatcgcgcctccccccttcccctctaagaaagacgagcctttctctttgtttggacgccagtcc

SEQ ID NO: 32559 - DNA, 813 bp, Triticum aestivum
  Clone ID: PAT_TA_32559
gttaagcgtgtcattgactatgctgtcaaggttcgtgtgaatgcagcaaagaccgatgtcgaccgtaatgtaaagcacagtatgaatccatttgacgaaattgctgttgaagaagctgttcgtatcaaagaaaaatctcccagtaccgaagttgttgctgtttcatgtggttctgctaaatcccaagaaactttaagaactgctttggctatgggtgctgaccgtgctgttcacgtcgaagtcaaggatgacagtactcttcaacctttggctgttgctaaattgcttaaggctttagctgataaggaagccaataagccagatcttttcattttgggtaaacaagctattgacgatgatgctagtcaaactggacaaatgttggctggtttgctcaagtggccccaaaccacctttgcttccaaattagaaattaacgataaagcactcaaggttgtacgtgaaatcgatggcggtctcgaaaccgtttctactcaattgcctgccattgttacaactgatttacgtttgaatgaacctcgttatgcttctcttcctaatattatgaaagcaaaaaagaagcctttagtcaagatgactcctgaagatctcggtgttgatatttcacctcgtcttcaaacattaaaggttgaagaacctcctaagcgtgctggtggtcgtaaggttgaaagtgttgacgatttacttgacaagttacgcaacgaagccaaggttttgtaaaacctttataaatagaaataataatagtaacaataaaaaagaggaaaaagttttttttcccttccatttttt

SEQ ID NO: 32560 - DNA, 639 bp, Triticum aestivum
  Clone ID: PAT_TA_32560
ctcaagcccctcccccttcggctcgtcgcacttgtcaactcccctccgactccgagggcacgggcggcgagcatggcggcggggccggcggaagccctgaaatccttcgaggagagagcttccgatgccgaggcacggttagcaaagctggaagccctgctgctgaacaaagatggcgcatccgaggcaagttcatctgccatgagagatcttgagtcaaagcttgacgcagccaccaaagaatgtcttgccgagaaggaacagaaccggaagctgaccgtggagaacgagaagctccagtatcgtgtctcccatctcatccgaacaatcaaagaggcggagtcaagatagagaagcctctgataagctggatcccgtaaaactagtcctattttggcttcgagagagacggtcatctcgcaaatctgtctatgtgctcggtgttgacgtctgttggagttggtttgaacttttaatctgtcattccaatgttgatgaaatgtggctggtacgtgtaagcttagcagtaatgcattgatcagatcgattattcgtgtcgacgaacattgagcagcgtgttgctatcggtcgcagcgaacgaatgaaggtgaaagatattctacgggtgcaaaaaaaaaa

SEQ ID NO: 32561 - DNA, 609 bp, Triticum aestivum
  Clone ID: PAT_TA_32561
aatgtggtactcctgcattttatacaaagaagaatgatgtattatggaccaaacacatataatgacgacgcatgtagtgcacctgcaacggtagcttgcaatgcagcatgtctcgaagaagtgaaggacctgtggtgctctatacagcaagaggactagctccggcaaacccatgtactactaaaagaaatctgatatcttcagttcagacgcgtcagccttactgacgcgcagcgcagcgcagtgcacggtgagcgcagctcgctgagaaacccagcccgtcggcgcacgtacgatcgtgtggcggcctaggacgtgttgctgccggcggctgggctcatgtagacgacgtgctgcaggggcctcgccggcgtggaggagcaggacatggaggggctcttcttcacgatggggatgagcgactgcaccacgtccgtcatcagcggccggtactccgccttggtctgtatgcacatcgccgcgatcgccgccacctggatgagatccttgacggcgaactggcccttcagggccgggtccaccatctgcacgagcctctcgcggttcgtcagccgtggaagagcccatgaaaccaggacgtgctgtccc

SEQ ID NO: 32562 - DNA, 1472 bp, Triticum aestivum
  Clone ID: PAT_TA_32562
cgttcgcgcgagccacagttggggcgaaaccgaaattcgcaggctagggtttgctccgcgtcgtgtccacagttcgccgccactgacgccgggatgcagaggtacgggctgcagctccgcaaaaagccggcgacctcctcgtcgtctcgaccgccacctccggcgcgccccctggcggccttcgccgacgacagcgatgacgatgtggaggccgacatcctccgacagtcatcaaagaaacgcgccctcgagaaggtggaggaactgcagaagaaggcgatggaggaggatccctcggtgtttgcctatgatgaggtgtacgatgatatgaaggagaaggccgctcggcccaagatacaggccaaggttgttcgcgagtcaaagtacattgaagcacttaaggagaaagcagaacaacgaaaacgagaacaggacatagtgtatgagaggaagcttcataaagagaggagcaaggaagatcacctgtttgctgacaaggacaagtttgtaacatctgcctacaggaagaaacttgaagaggagaagaaatggctagcacttgcagctgctcagagaccgagcactggctcgtaggagagcgaaggagcagcaaatatgaagatgcatatatgataatctcaacaggcaaaagcttagggcgtgtgtaatacttgccatgtgttttcaacttgcatcatttgccagtggatgatgcaagcacctattctggcagaaaaagattcccgtacgattcctgcttgatggtgccgcttctatggtgaaaatatctgtatatccgcatatgacaagcaagcatacttagacatcagaatggccattctgctatgcataatcacgagaggagaggctaatgtagcccattatatttactgatttgtgtcctgcccaaactaggagagataccttggttcaggcacgctgatggaagtctgagcattcacttgtggccccctgtgatcgggaactggctcgtgacacaaccagggagctgtaaacaggaaggaggtggctcagggattttcagctcgcgtatgatccgggccgcgtaatacgcttgacatttgtttttgacttgcagcattttcagttgttgatgcatgtatctccctggcataaatatattcagcttttgtggtcaaaatatctgtacatggacatttgacaagcaagcacactcagacatcagaatgaccattttgctatgcataatcaggagatgagaggttaatgtgagccaattatatttactgaatatttgcgctgccaaaaaaaagaaaaaccttggcacagtcaggctgatggcaatctgtgccctttcgtgtgttccattgtactctgtaactatgtaatgactcaagctggtagttattgactggtcggtgttgaatcagagatattgagatggtgtatgccctttcccaaataaaaaagatgtatgcagatttttggtt

SEQ ID NO: 32563 - DNA, 936 bp, Triticum aestivum
  unsure (1)..(936): unsure at all n locations
  Clone ID: PAT_TA_32563
cggcacgagcgtcgacctcctgacgccggtcaccggatccgcccgagctcgatnccggcgtcttctctggttcttcgccccagcgagcagcggtgccctctctctcaagcgactagacggcgctctgcagcgagtgtgacaggaggatccaaatgtcatgatcactgctttctattaagtaaggtgttctccgatggctcaattcatggatttgcgggctttcattttgcgtgcgcgtgtcctcaaattttataggcaggcactgcgtatgactcgccgagcccctgcacatgctcgtgatgagttgaggcagacagtacgggcggagattgaaaaaaatcgcaattgtgatgataagcaaaagattaagtttttaattagtgaaggactacagagattgaagggtcttgatgagatgcttgacatgacaggaaacggataatttgagatgtatcatggggactgtttcaatattcagttatctccattgaattcatggaaacaattgtttgacttggttcagttttcatagacagcagaagctgaaaattaggcgtgctggactttttgtgcaaaatctgtgcaacctttttttttgagaatgcagatcaggttagatgggcagcgatagagagtggacttgttgagagttatgtcacaacgtccagattacttttaataaaacactgggattgagcctgcactttatcgcgacaaccctttcgtatttgttgttcaatagcatgatgagtgttttctgtgtgtggtgtatttgtgttctttcgattgaaatcagatgccagagaggttgtatggttgtatgctggtgtggcctaagcctctcgtgcccttcagttatgtcatcatatttacaagcctgctgcataggcaaagtatttccatattcagaaatattgtaaccggtttacctgtgaa

SEQ ID NO: 32564 - DNA, 531 bp, Triticum aestivum
  Clone ID: PAT_TA_32564
attctcaatgtttaaacataaggatggaggtatcgaattggacggaacaaagccatcgtttgtagaaaagagacgtatgttacctgacacaacctcccatttgaacaatactacacctgctgcaaccgtacagccaagacctgtaaatgaagagacaacagcagttcagcataaagtcgcaagggcaaagaccaagagcaacaagagaatgattcgattgggacaaagtaatatcgatccaccctcatttgctacagctgctgaaccaagtaaacacgttcaccggttggcagatttagaaaactctgtgcagcaagaggcagccactactgttcgcagggcttcctctgtacgatcaaaacgtagtaaagcacctaatttatcggaagaaaacacaaaatcagatggcgccttcagaaaaaagattgaagccatgagaaaagaagcaggtacagaatggcttcgagtattacaagaaatggatatcgtaaagaaggaaaattcccaataaaaaaaatttccccgcttttt

SEQ ID NO: 32565 - DNA, 623 bp, Triticum aestivum
  Clone ID: PAT_TA_32565
cacctttgaggatgaactaccagcggcggctgtgctcgacatccttcctctctgacgattgcggaggtcgcggcaacgaagacaatggcgccggtgccggaaggatgacccggaggcaaggtatctgttcaagcggacgacgtttaatgtatgagggatagagagaaatgtctttgtatttatggtgggcagagtaatattgaacaaaattcaggccttcttttactaatacccagaagctaaattcaggttttggtgagaagaaaagtgaacctaaaggttacagtactattaataggaaactatgttggttaaagcccatggataatagtgtttcagtcactagacagattgctgaacagatgaagttgatgtaaaatctctggtcacctgccaattaagctgcttgaagatcaagttcaacattagtcacttttcaagtttggtagtattcagtttgcaatagtgatttctgaattttcaggctgctggtaacttagtgctaagtggcattcaattgtgtcaagacgaatttgatttgtaattgcaaggatagtttttgttacgtgaggtatttctcggaaccactatgtattagatcactttgttattccacagttacc

SEQ ID NO: 32566 - DNA, 796 bp, Triticum aestivum
  Clone ID: PAT_TA_32566
cttcacaaggcaagatggagcttaacaagactgaagatgcagttgctgccccaactgccgtacaagaagatgagaaaacccatacattggggaatggcaagctggaagaacctaacagtgctgaaaatgtacctgccgatggagagatggtctcaagagtgaccgccgagcataatgattccttaactacgctaaaacgagccgcagcgactgctgtttcagcagctgctgcgaaggctaagctccttgctgagcaggaagaagatcaaattcgacggctagctgcactggtggtcgagaaactgctgcagaagacagaggcgaagatgtcattatttgcagatgttgagcatgtggccctgcgcacaagagaatacactgaaaagaccagaaagaagcttctgatggagcggaacgcaataatcgcagctcgcatgggcgcactgccatctaggccgaaccagcagggtgcagctgggaacagattgccgcccggatatggcgcccctgcagtaagaccgccgaacgcaatgccccggccgagcagctgagtcgatgaggtaaaacctgtcgcctcggtgatcgacctgtatacccgattcttttagaagcacacctcagaccaatcaggcataagttatgttgttgttgtagcattcatgtaggagcgcaccgtatcgtgatctgtataaggaaaaaaccggccgttctggctctggatgtgatgctctccgtgcaccctgcttgtgactgagccatgttatgatcttccgtgtagacctgaagttaacgaaag

SEQ ID NO: 32567 - DNA, 1049 bp, Triticum aestivum
  Clone ID: PAT_TA_32567
ctccgtttgccgcgtgccgacctcagcaacgatgggcacgggcacgggcacggcactagggccggccatggccgccgccgcctccagcacggcccaccggcctcggccgctgcctgccgcggcgaccgcgaatcgcagcgccagtcgccccaccgcctccgcgccgcccgggagaacgctggtctgctccgctccccggcagtcgaggccgccgcggcgcgccgtcgcgaccacggcccgggcggcggaggccggggcgccgtcgtccacctcgccggacgccgtcacctactcctccagcatcgacaccgacatgcccctctacgagcccctgggggtgtcgttcgacgagtacctccaggaccgcccccgcgtgttccgcgccatgttccccgacgagagccggagccagcagctcagcgatgaggagtggaggatccagatgctgccgctggagttcctcctcatcaccgtgcgccccgtcgtcgtgatgcagctgcgcaaccgcaacgccggcgggctcgacctccgaatcaccgagtgggagctgagggggctggacagcggctacacgccggcgagcttcgacctgggcgtgcgggggtcgctctacgcggacaggggacagcggcgcggcagccggctgaggggccacctggagatctccatcaccgtcgccctcccgccgcccctgcgcatcgtgccagaggccatcctccggggcgtcgccgagtcggtcctgtcgacgcttgccgagaggatgaagcgggacgtggacgtcggcctcgtcgccgacttccggaggttccggctggagaaggcggcctccagagcggcggtggcgagagcggacagcaaagcctgaaggctcgctcgtgttttcttgttggggattcgttccaaggattgtttttgcaagatcctgtgatgttgcgtgcgatacatacatatgcattcccgtgtatagagttcgattcgaagtacctgtaggccctttctctggtgtcaaaaaaacttgaaccaaagttcatgatcctttaaaaaaaaaa

SEQ ID NO: 32568 - DNA, 492 bp, Triticum aestivum
  Clone ID: PAT_TA_32568
cacgtctgccgatggggctcttctcgtggtggaggggctcccgccgcggctcgccggagcaggccccgagccagcaggccgcgaagggagcgggaggcgcgcaggcccaggtggccgtccccggcacccatggggcggtggaggtgctgcggcagcggcagccggacgcgacggtcttcgagttcgggtcggcggcggagtcgggcaccgccgtcacgctcgccggctactgccccgtctccgacgagctcgagccgtgccgctgggagctggtgcccgccaccggcgagggcgccccgcagttccgcatcgtgttctgagcacgaggagataagcaccccctatgctgccgtcgcgctatctatcttgggtgttgcgaggtttcttgggtacaaaggtgtgatctttggctgtatactggtgcttgtgcatttcccgaaataaagcttgagatattgatgagtcctggtggatgataacatgtgctggctg

SEQ ID NO: 32569 - DNA, 851 bp, Triticum aestivum
  unsure (1)..(851): unsure at all n locations
  Clone ID: PAT_TA_32569
aaaaagntaaaaaagcccncnaaaaaaagcgcnatttttnccnaaaggattagnnggttccttttttttggggcacggaaacnttncccttgncccttaccggcccgggattttcnacgatntcttagncgaaccggnacagncctgnattccctgttnagttcancaccatcattggacgaaggcgcaatttntttccatccctccgggtccccacggctcccgttcgggcgctgctcgtggtggtgggcctcccgccgcggctcgccggacctggccccgggcctgcgtgcccccggcggagcgggcggcccgccggcccccgtggccgcccccggcacccttgggccgcccgcggtgctgccctcgtgccggccgcgccccgcggtcttcgagttcgggtcggcggcggagtccggcacgccgtcacgctcgcagggtactgccccgtctccgacgagctcgagccgtgccgctgggagcttgttcccgccaccggcgcgggcgcggcgcagttccgcatcgtgttctgagcacgaggagataagcaccccctatgctgccgtcgcgctatctatcttgggtgttgcgaggtttcttgggtacaaaggtgtgatctttggctgtatactggtgcttgtgcatttcccgaaataaagcttgagatattgatgagtcctggtggatgataacatgtgctggctgaaattctgggcttgctgtcgtttgtgatgaacaaattagccaatttcggcagctctttataacactaccaaattagattgctgtacttttggcttttgtatgcactgaaatttgtgggccagccatttgttgaaataaaaaaaaaa

SEQ ID NO: 32570 - DNA, 581 bp, Triticum aestivum
  Clone ID: PAT_TA_32570
acttctcccgttctgtccatcctagctgacgtcctcctcatcctctatcgttcttgatttgtatccgttcatcccgtcagaactcagaggatcaacagagcattgttctgcagagtttttgctagctcttcctgcgactcgatcatgagctaccagcagggctacccgccgccgggcactgcagcagcgtaccctccgccgggccaccagcagcaggcctacgtcgcgccgccgccggctatgtaccagcaggatcagcagtaccctcctgccggcgccgacaccaccagccgcggcggacacggaaacggcggcgatggcttcttgaaaggatgctgcgcggcgctctgctgctgctgcctcctcgacgcctgcttctgatccacttcgtcccatgtttttcgaccggcacgatcagacgtggcatatactgtagattatagagtatcgtcatacttattttgcttcttttttaaacgtggttcatgtgttgagtactagtcccagaacaggaatttttttttgagaggcagaacaagatttcttgtgtgataaaaaaaaattaacaagtttctgtgtgt

SEQ ID NO: 32571 - DNA, 635 bp, Triticum aestivum
  Clone ID: PAT_TA_32571
catcccgttctgtccagtcctagctagttcctcctcctccttcctcctcctctcctgatcttgattggtagaatatctgttagttgcgtcagaactcagaggaacagagcattgttttgctagctcctcctgcaactcgaccatgagctaccagcagggctacccgccgccgggcaccgcagcagcgtaccctccgccggggcagcaccagcaggcctacatcgcgccgccgccgtccacgtacccgcaggaccaacagtaccctcccgccggcgccgacaccaccagccgcggcgggcacggacacggcggcgacggcttcttgaaaggatgctgcgcggcgctctgctgctgctgcctcctcgacgcctgcttctgatcgagcttgtccagtgttgtccgaccgtcattaactcatgatcaggcacggcatatagattatcgtcatgatcgagtttgagtactagtcccagagcacgattttcgtgtgtttaatcgcgtgcgttgttttgtttccattcgtatgatccagatagatagccatgtggttattcaataaaatgcatattctcttaccttgttggcagcgatgatcgaattattcgcgggtatttcacaatagttaattggcatcc

SEQ ID NO: 32572 - DNA, 741 bp, Triticum aestivum
  Clone ID: PAT_TA_32572
ctgtgcggggctcgcgccggccggactccatcccgttctatccgatcctagctgattcgtcctcctcatcctctctatccttcttgattggtatccgttcatcccgtcacaactcagaggaacagacagagttttcgctaactcgatcatgagctaccagcagggatacccgccgccgggcactgcagcagcgtaccctccgccgggccaccagcagcaggcctacgtcgcgccgcctccggctatgtaccagcaggatcaacagtaccctcctgccggcgccgacaccaccagccgcggcggacacggccacggtggcgatggcttcttgaaaggatgctgcgcggcgctgtgctgctgctgcctcctcgacgcctgcttctgatcgacttcgtcccatgttgttccaccggcacgatcaggcgtggcagatagattatatagagtatcgtcatacttattttgcttcttttttaacgtggttgatgtgttgagtacttgtcccagaacaagtttttttttctttttttttagaagcagaacaagatttcttgtgtgtgataaaaaaaaattaacaagttcctgtgtgtgatagatagacatgtgagatttatccgatggccttatggaatgtatattttcttggtgcattctaaaaaaaaaaattgtcgcatttatttaatgaagttcaggatctcgtctgagaccacctccaaaaaaaaaaaaaaaaaaaggccccta

SEQ ID NO: 32573 - DNA, 766 bp, Triticum aestivum
  Clone ID: PAT_TA_32573
actgtgcggcgctcgaggccggccgtcccccccatcccgttctgtccagtcctagctagttcctccttcctcctctcctgatcctgattggtatctgttagttgcgtcagaactcagaggaacagagcatcgttctgcggagtctttgctagctcttccagcaacccgaccatgagctaccagcagggctacccaccgccgggcactgcagcagcttaccctccgccgggccagcagcagcaggcctacgtcgcgccgccgccgtccacctacccgcaggaccagcagtaccctcccgccggcgctggcgccgacaccaccagccgcggcggacacggccacggcggcgatggcttcttgaaaggatgctgcgcggcgctgtgctgctgctgcctcctcgacgcctgcttctgatcgacttcgtcccatgttgttccaccggcacaatcaggcgccgcatgtagagtgcattttgcttcttttttgtgtgcggttgacgtgctgagtactagtcccagagcacgattttctcgtgtgtcatgtgtgcgttgttttgtttccattcgtatgactcagatagatatatacatgtgagatgcatctagtggccttattcaatgccatattctcttggtgttattcaccttgttggctgtgctgagtgaattattcacagatcgaataatttcatgatacttgtagtgaactgggtgcagataaaatgatgttgcaatgttgttgatccatctgaatcgtacactaattt

SEQ ID NO: 32574 - DNA, 669 bp, Triticum aestivum
  unsure (1)..(669): unsure at all n locations
  Clone ID: PAT_TA_32574
ctcacgcgcacacatcccaatctcttcctgctccgtctccgtgctagggttcatcgtaccagccgccatgatgccccagccgcagcccggcgtcgtcccgccgcagtggggcgccatcccaccgcccatgccgcctcaccacctctacgcgccgccgcccccgcagatgtggggccagccgctgccgccccagcaggcagcgtatgggcagcaggccgcgtactacggccggccggctgccccgacgcaggcgcccgctgggcccaacgaggtcaggacactctggttaggggacctgcagtactggatggacgagaactacgtctacaattgcttcgcgggcaccggcgaggtgcaatctgtgaagctgattcgggacaagcagactggacaacttcaaggttatggcttcattgaattcacaagccgtgctggcgctgaaagagctcttcagacattcaacggggcaatgatgccaaatgctgagatggcatacagattgaactgggcgactgctggtggaaaacatgatgatggcgctgattacacaatatttgttggtgatttggctgctgatgtcacagactacgtattgcaagagacatttagggtacagtatccctctgttaagggtgcaaaagttgtanacggataaactgacatgcgccc

SEQ ID NO: 32575 - DNA, 883 bp, Triticum aestivum
  Clone ID: PAT_TA_32575
atttgttatgataactgagagaaataaatctcttttaggcttgctaacagtcaaagatttccaggatttctgcaaaaatgtaaaaagtaccaggatgcaacctgaggtagatgaatgtctggtatctaatgtttgtggagccgttagatgtaaaatatggtccgtgacacctcagatgccacttactgctgctgaaaagatcatggattctcatggagtagaccaagttcctgtagtttcagaacatgttaatcatcaggatggaggaatcttgattggttttgtagacagagaatgcatcaccattgctcgaagagctttgtcagcaaaagaatttttcagtttcacatcggagatcagaagggaagagagatgatgcggattcacttaataatttgcttgatattctggagctttgaaatttcatttgctcatgtcggcttatgtgattaagctggtcaacagccaagaaatcataatcgaccaggtttgtttggtaacttcagaattcggaaagtgaagtagctggctgaagttttttccatttctatcaagactgtatgtgcatgcgcagtgcattgctgcattattgttgtaagagcacgctattttctcagtagttagatcgctgcaccttgcacctaacttgtgcatacccctgttctccttttctgcaaaacaaaatggagtatgttcatttaggaactgggccagtgcatgggcacttgagcgtgcctactacccagtataattcttcaactgagaattgaactattcgtcaacgtagacacttgaaagacaggcaataagatcaggctatgtcccactcgtatttctctttgcatgttgttagtagtttgaattaaatgaaccaaatttgcat

SEQ ID NO: 32576 - DNA, 760 bp, Triticum aestivum
  Clone ID: PAT_TA_32576
ttggattgctcagaaggttatgtatgaaagattcggggaggacttcattgtaaattttgtagcaaaagctcttccagaagctcactgcccaccggagctagctgaacagtactaccaaaagttacagggaaacgacataaaggcattcaggtcattttatcaatcacttatcgagaaaataagacaacagcagaatgggagtcttgtgttcagatagcatcatcctattcattttcaatctgtttgccagaagactcgtcagctgtatgatttgagtatagggtagttgtatcagtgatgtatataaagctaccatttctgagattagaagatgtatactgcgggaacatttttacagactatatggctgccgtggcgaagttgactgttcaccgcatgtcatcggatgcatggaagtataacccaagagtttgtcatgagagaaaaaaaaatacaacagggttccatttattcgtttggagacttctcaccagagtgaattggttgtttgttctcctacccgggcttgaaattttgtaaggtaatctcagtgagctaaatatccgggatagaaagaggtgtacgtgtgggctgtgtttttcctgacagaagttgtcgcaccgcctgttgtcgtgtaccaaattttgtcgagctgctgtggttggtttccacccccatttagttagctgggggtgctgtacagactctataatgttcaccttcttattcgtccgtccgatctagtgcccgcagtggtatc

SEQ ID NO: 32577 - DNA, 1587 bp, Triticum aestivum
  Clone ID: PAT_TA_32577
aatccgcccgccgtccaacaccccgcgcgcacaccaccgccgccgccgtcgaccccttcctccctcgcacccatggcgttcgcactcaaggcctccgcctcccccgccctcgccgctgcctcctcggcggcgtcgtccccctccttctcggccgcctccgcggcgccgaggggccgcgccgccgcggcgaggagggtctcgctccgcggggccgcgcaccccgttgccgccatcagggcgtccgccaccgccgtggccggggacaagcgcaccatctccggcacgttcaccaacctcaaggagcagggcaagatcgcgttcatcccgttcatcgtcgccggcgaccccgacttggcgaccacggcgaaggcgctaaaggttctcgatgcgtgtggttctgatgtgatcgaattgggcgtgccgtactctgatccgttggctgatggccctgttattcaggcttctgctacacgcgcgctgacaaagggcaccacatttgaggatgttatctccatggtgaaagaggtggtgcctgagctgtcctgccctctcgcgcttttcacatattacaacccgattctgaagcgcggtgtcgccaacttcatgtctgttgtaaaagaagccggtgtacatggtcttgtggtacctgatgttcctctggaagagacagatattttgagaagcgaggctgccaagaacaacctagagctggtgttactaacaacaccaactacaccaacagaaagaatggagagaattacaaaggcttcagaaggatttgtttatcttgtaagcactactggagttactggcacacgtgcaaacgtaagtttcaaggtggaagctcttcttaaggaaatcaagcaggtcacagataaagctgttgctgtcggttttggagtgtcaactccagagcaggtgaagcagatcgcgggctggggtgcagatggtgtgatcgttggtagcgcaatggtgagacagttgggtgaatctggttctcctgaagaaggattgaagaagctagaagaattagccaagagcctaaaggccgcatttccatgaaacatgcatttttatcttttgtgggggaaatcgcatgaataccatatattttttttagttccgttttacagtgtagcattacattcctggctttagattttgaaggatcctgttgtgtgatagaataattgtacccatgtgttgaatgctcgggtgaataaattaattgaggctagtgttacaaattatgcaaaagaaagcatctttctgtcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccggtttaaaaaaaccaaggttaaaacccgggggttggcaaaataaaactttttttttggggccccaaaaataaattccgggggcggggttttaaaaacggggggcgggaaaaaccctggggtttaccaaataaaagcctttgaaaaaaaaccccttttttcaaggggggt

SEQ ID NO: 32578 - DNA, 1081 bp, Triticum aestivum
  Clone ID: PAT_TA_32578
taatggtgacccctttgaaagttggcagacttggtaaccgggtgctatggttacaagcaggttgagccttcatgctcatgttgcacatgtgagtttagtgtaacagcccctgagagaatcgagaagctaaggaacctacaagtgctaggggtggtgcacattgcgcgtggaagcaaggtggcaaagaacttgggggagctgactagcttgcgcagattaggagtggatgtcgatgcgaccgaggaagtagggaaggacttgtgcagctcagtatcaaggcttgttcatctggaacggcttgaagtgcgctctaggtcgcttgaatttctgaaggaagcaaagaaagcagaggaaatgccaccaaagcatctcctatcactgcggcctgtgtggccgtttgggcaacctccctggctggatggatcgtctcaaggatctggccaaggtaaagctaattcagacacagttgaagcaggttgacgtcgaggtgatggggaagctgcgcaaccttactcttcttgcactctgggaggagtccttcgccgagaagatgttatgttttggggaaggtacatttccgaagctcaaactgctttacattgaagggatggagaacatcgagagcatacaaatcaaagatggtgcattggccgtgctcgagaaacttgaagtgaagaaatgcgttaacttggacgacagtaaggagggcttgtcccttgtgctggtcctccaaaacctgaatgaactagtcttgacaagttgcggcgacaaaccgaagctggagaaggaacttcaaaagcagattagtggatttaagaagcgccccaagtttattactggaaagtccattgtatctaggagttagcttacgcgctacctctgttctgatgtagatgatgcacacaagtttatttgtactctcgagatatagtagtagtaatagatttctcatgtaatttcgtaaaggaatgtaatgtatcagtatcataagtttgaacatattcttacaaaaattagccggcaaagttgcttggtgaagatcaagttccagagcgaagtttttgcttggtgaacttcatct

SEQ ID NO: 32579 - DNA, 400 bp, Triticum aestivum
  Clone ID: PAT_TA_32579
tgaagacggtgatggtgatggtgacgggatggatgcagctgcgcctgaaatcaagacgtatgaagatggcgggactagaataacagtagtcacctgtgaaattactcatggagaggaggatgaccagaaatccgtgtcaaggagctatgctaagaagagttgcggtgtggttagtgccaagaagcagcccagtttaggcgtgaagaagccgccaccaaagaggcaattcagcaaaagcaagaagactaaaaaggttgacacgagtagacggaagaacaaaggaaagcattgacgttgtgtatgcctgtggctgtggacggacgggcctgagttgcatttattttttaagataagaagataacaaaatcggttacgaattgtgttcctgttgctgcaaaaa

SEQ ID NO: 32580 - DNA, 774 bp, Triticum aestivum
  Clone ID: PAT_TA_32580
ctgggctgtagcggcacagtgcgatttgtgtttgtgtggtcttttaattttttctaacgcgaatcttggatctatagggatttcgtgactgggtttcacaagagaaagaagaagaggagaaaggaggcgcagaggattacgtaggagaaggacagacggaagcgaatagaggctcgcaagaagagaaagcaagagaaagagattgctctatacgataaagtcgtgtcatcagaaaatgcggatggtgaagacggtgatggtgatgggatggatgcagctgcgcctgaaatcaagacatatgaagatggcgggactagaataacagtagtcaccagtgaaattactcatggagaggaggatgaccagaaatccgtgtcaaggagctatgctaagaagagttgcggtgtggttagtgccaagaagcagcccagtttaggcgtgaagaagaagccgccaccaaagaggcaattcagcaaaagcaagaagactaagaaggttgacacgagtagacggaagaacaaaggaaagcattgacgttgcctatggctgtggagggacgggcctgagttgcatttatttactaatcatgcccgtgcgttgggagagaaaaagaaatacacgctagccaaataagtatgactcaataccctgacgtatgagcgtcctttatttgaacacagtgactcgccatgttatgaacatgttttataatttgtgaacagttttgtaaaataattaatattttttgaaactgtgaaaattttatgatttccg

SEQ ID NO: 32581 - DNA, 1097 bp, Triticum aestivum
  Clone ID: PAT_TA_32581
tcgaccccgcggccgggcagtccgtggcggggcgtcgcacgcgagaggagaaggcgagagagggggcgcgctctattccgcacgcgcccgccagccgcaaccccaaagagggcggcgcttcctcgtctctagcagagagagagagagagtgagagagagagagagaggaaaggtttggccatggcgtgggaggaagagggattggaagaggagcacgaggaggatatggaagcgtcggaggaggaaggggaggatgtggtggtggggcagatgccaacgttcatggtcccaaagcacatcaataagcgcgccctgaagaacaaggccctctccgtctccctcgacaagaaagccctcaaggatttcgtgactgggtttcacaagagaaagaagaagaggagaaaggaggcgcagaggattacgcaggagaaggacagacggaagcgaatcgaggcacgcaagaagagaaagcaagagaaagagattgctctatacggtaaagtcgtgtcatcagaaaatgcggatggtgaagacggtgatggtgatgggatggatgcagctgcgcctgaaatcaagacatatgaagatggcgggactagaataacagtagtcaccagtgaaattactcatggagaggaggatgaccagaaatccgtgtcaaggagctatgctaaggagacttgcggtgtggttagtgccaagaagcagcccagtttaggcgtgaagaagaagccgccaccaaagaggcaattcagcaaaagcaagaagactaagaaggttgacacgagtagacggaagaacaaaggaaagcattgacgttgcctatggctgtggagggacgggcctgagttgcatttattttactagcatgcccgtgcgttgcaatgggagagaaaaagaaatacatgctagccgttgcaacgggagagaaaaagaaatacacgctagccaaataagtatgactcaataatctgacatatgagtgtcctctattttaacacagtgactcgccatgttatcaacatgttttataatttgcgaacaattttgtaaaataattaatattttttgaaactgtgaaaattttatgatttccg

SEQ ID NO: 32582 - DNA, 619 bp, Triticum aestivum
  Clone ID: PAT_TA_32582
ccttaatatataatcgattcttttaataaacaaaaaaatgtttttctatctatatctcatccctgccaaacaaacaaaaaaacctactaccattcaagcagcatatgttgatgtaacaggatgatgtcaatataacatgactgccctaagtcagacgggatctacatttagcgaaaattttacaggttcctgctgcggctgctgggctacttgttggggatagtttgggtagccagcatatgtcccatacccatacatgtttgggtcctgaggttgagtagcagcatatccataagccccgtagccttgtgcgtagccatagtagccagcattagcagtagcaccaccccagtggttgaagtcctgttgaaactgaacttgtttgtttgaagggcttcgaccccatgaaagcctcacgttctgccctccaatcatggtaccttgcagcattagcagggcttcctctgcagaggatctgctagcatattgaacaaaaccacattttttgccaacaggtatcttaacatggaccacatcaccatatggagtgaaaacttgtttaaaaacatcctcagtagcgttggggtcaaggccaccaacaaatataggggaattgcta

SEQ ID NO: 32583 - DNA, 1133 bp, Triticum aestivum
  Clone ID: PAT_TA_32583
gttggcatcctctgctgtgctcggcccggtggggacgagactgcgggacccggggcgatctacagcgcggagctcccggcctcgcccgaccctattcccgcattatgcgacgtgttttggacgagctcctctcctcctgcgtcagcatgggctatgtattccaaatggtcctgattgtcaaggccactagggaaggtgaggacgttggaaggcccgaaatcactttcgtcgttatgatctacggaaagccaatgtacggcgactccggtgttctactgcgatttaaacgcctggagcatgggcttgtcacaacatatatgcaggaattaaagcatgcttcaggggagtacgtcgttataatggatgcggatctattttatcgtccaaactgtttgccaagcttcatcaggaagaagaaggcaaccggtgcttacattgtaactggcacccgttatgttagcaacggcggtgtccatggttggaatcttatgcggaagttgaccagcaggggagcaaatgttctagcacagacgttgctacagcctggagcttctgatctgactggatcgtttaggctatataagcgaagtgttttggaggatgtcatctcctcctgcgtcagcaagggctatgtattccaaatggagatgattgtcagggctactaggaaaggttatcacattgaagaggtcccaatcactttcgtagacagggtcttcggaatctcaaagctcggtggatccgaaattgttggatatttgaaaggccttgtgtatctgttgctcacaacatagggcgaaaagacactgtatgcatgactgttataggacatactcttgttagagtgatttttcttatgttttcacagcttgagctgcataattctgctaacgttttcagacctacaattgaattatagacactagttttggtctgtgagtaaccttttatgaattgtgtcatgtgacacagcttgcattacatgaagttacgaacattcccgacccaggttgaattatatgcacgaaactttgtctttggctgcttatatgatccatgtggcatcttgtgttccgtgacctgtaattactcaactgcttgccaaaaaaaaaatctcaggccctaaataaaaa

SEQ ID NO: 32584 - DNA, 2275 bp, Triticum aestivum
  Clone ID: PAT_TA_32584
gaatcgcgacatgcttgccggcgcctccgtcccctgtccgtcttccacaaccgatctgccatctcctccgcgaccgcgccccgttctccggcagcccgccgtcgacattctccaggggtccgcccgacctccctccgcggcatcggcccgggcggcgatggcgtctccgtcccacacctacgagtccaaggcccgccaggccctcctcgcccccatcggcacgacccacgcgccccaccgcatcgaccacggcgtcgacggcgatcgactcagggctggaccagaggacttccaacccggctgcccttgccacgagccagaccaggccaccatgtacaccgttgacaagctctcagagatggcagagactgacaagcttattcaggggattcagcaccggctcaaagttgcagggtttcatcacggggagcatctacaagtgctccacgttggtccaggtgggaaagccgaaggagactacagtgaggatgttgtggggcgaaaacccgattgccaggagagaacggagaggtgctccaagtcgctctgagctagcttgaagatacggtttgcatcggtgacgctgtgaaagcgtgcccgaaaggagggtgttttcagaattgtaggacgcatttttgtgaaacagtcttgagcggatgaagcgtcagatcaggttgagacccatcagcgactaccaaaggtgtacgcttgggatgatatattctttgacttatgtattgtaacttgttgctaccatgctagtcgtacacgctatattaagctcgtggtccttaaccttgttgtaactcatgtcttgtgactcgatataatgaaattagtatttctgcttttgtcacgttccacttgcttcagcttggagaaagacaagtaaactatcatgatataatgaaataaatatatcgactcgtgacaccaaaagtggaaactacccgggcaaccgatgcaggccgctatagcgtttgctctgctgtcggtgttctgcccttatctcttcagtatggatttccaattgttcagaaatttctggagggtgcttccagcattgacaaccacttccacacatcttcatttgagaaaaatatacctgtactccttggtttgttgagtgtgtggaatgtttcatttctcggatatccggctagggcaatattgccatactctcaagcacttgagaaactagcaccacatattcagcagcttagcatggagagtaatggaaagggtgtctccattgatggtgttcgacttccatatgaggctggtgaaattgattttggtgaacctggaacaaatgggcaacacagcttctatcaattaatccatcagggaagagttattccttgtgatttcattggcgtcataaaaagccagcagcctgtttacttgaaaggggaaactgtcagcaatcatgatgagttgatgtccaatttctttgctcagcctgacgcacttgcttatggaaagactcctgaacaattacagagcgagaaagttcccgaaaatcttatctctcataagacttttcagggcaaccggccatcactgagtttcttgctgtcttcattatctgcctatgagattggacagcttttatccatctatgagcaccggatcgcagttcagggtttcatatggggaatcaactcgtttgaccagtggggagtggagctgggcaagtcactggcttctacagtgaggaaacagttgcatgcatcacgcatggaaggaaagcccgtcgagggcttcaaccccagcagcgcaagtttgctcacacggtttcttgcggttaaaccatcaaccccatatgacacgacagtgcttccaaaagtgtaagctgagggaggtttagtagtcctacaaagaagtgtaacctgaggttgagactgataatcgacaagctaggttgagcttgtggcataacaagttttcttccttctttcttgcgacttgttacaaccagtctggttgtactgtaattttgaagttcctcttgcttcagcttggagaaagacaagtaaactatcacgatataatgaaataaatatatcgacttgtgacaccaaaaaaaaaaaacactctgggaataccgaggatgaaaggttctcttttctctatactgtatatcttttagaattttctttgttgttggatgcaaagcaaaacgccgttagggtcatgcagaaaacatgtgatgttgagggcccgtggcatccacatgtgctgttgcgccgcttgcatagcaatgttgcataat

SEQ ID NO: 32585 - DNA, 564 bp, Triticum aestivum
  Clone ID: PAT_TA_32585
aaacctggaaaaacctaaaagcaaagatagggtggagcatcctgcaggcgctaagatcatggatgatacttctgcccagcaacaaagagagctgggagcctttttgaatcacctgctgcattacctcaaacagcctctgaggataaaaagtggataacctctctggacacgcaagcttgcttggggggtctcagtctgtcagacgatgaaggaccagcgtcccctaccagcgagaagacagggaagcacaacatcatcagcccaatctcagttctggagatgggggtgtggtctccatcacccggggcggcgccgatgaaaagggtcaagaagatgatgtccacgggctcagtgaaaccgaagctgcagatcgcgatgtaattcgtctctagttcaccttcggttgcctgcgagcaactctcattcgaatagtttgtttttatcttcctagtttcttgtttgccttctggtacatgctggacatgacgttttcggacctatctggtttcattctgagtaatggaactagaaaatgactgataaatatattcctaaacgaatatc

SEQ ID NO: 32586 - DNA, 954 bp, Triticum aestivum
  Clone ID: PAT_TA_32586
cggacgcgtgggcggacgcgtgggctgatccgtgcctgtgttggtccccggcggctgcggtcgacgtttcttggtgattgctggccggatctggcggttgggcgaggatccgggggaaacccttggccggcgcggcggcccccccaaagtcgacgcctttggcgccgatccccttcttggaggctttggggtggctcctctcccattcgcctcccccctaagctccggcgaaagtcggcactcccctgatctgggcgtcgacgacaccttggtgccgtgatccttcttgaaggcggcgaccgggatgtgctcttgggggtggagcggctggtggcttggctccgaagcatgacgtcctggtcttcctgcgacttcctgctcggcttcgcccggtgcatagtgatgccttcttcggtcttctccatcggtgtgcgccttcgttcgacagctcgcgccccgtgctccgtgctgccactgccggcttggtgctcgtttggttggtcctctgtggtccgctggtcagctccatctgcttctcctacggcagctggacaccttgagttgggctttgtgatagccattctgctgttcgccgttgcggcactcagcgagcctgggtgaaagggtagtggccctttgcgacggtggagacagctcaactgtagcccatgtttggcctgtggatgcagccggagctcaatgctttctcaatgtggccctccttccgtttcttagttggctagttggtgtaggcgtaatgctgggcgtcggcatcagtgtttctgctgttgccattgtgttgttccacctagtgccttgtatctttctttccgctttcctttgcatttcatctgtatcatggtgcctttgtaatcctggccggttgatggctttgttaattcaaagtcgggctaggttcgagctcttctcgggctcggccggcgccttttctct

SEQ ID NO: 32587 - DNA, 2038 bp, Triticum aestivum
  Clone ID: PAT_TA_32587
cccccccggccccgcctccgccccccctccccctcccccccggaaccctagccagcccgccctccatggccgcggccatgctcctccgccgcctcccggccgcgcgctcccccatcatggcggcgacgcgcgcgatctccgactccacggcgccgctcaccatcgagacctcgatgcccttcacggcccacatcgtcgacccgccctcccgcgacgtcgccaccacccccgccgagctcgtcgccttcttccacgacatgtccctcatgcgccgcatggagatcgccgccgactcgctctacaaggccaagctcatccgcggcttctgccacctctacgacggccaggaggccgtctgcgccggcatggaggccgccatcacccgcaaggactccatcgtcaccgcctaccggcgaccactgcatcttcctctcccgcggcggcgacctcgtcaccgccttcgccgaggctcttgggccgccaggtcgcctgctcccgcggtaagtgcggatccgcgcaatttttcacaccactgggcgccaacttccgacgggggccgccggctcgtccaacgcctaggggcccctcaggcagcgggtggagccgttcgcccaagaagtccatggaaggaggacagcggctcgttgtccctccttggcgccggcgtcgcggtctagggccaggactgggaggcgctcaacgtctcgggcagcaggaaggtgcacgccatcgtgatctaggagaacatccaatacgggctcaaaacggctgggaagggggaggtgtaggtcccacgccccttctatgtcggggtcactgagggactgacttgaacgtcgacggaatggatgtgcgtgctgtacagcaagcgtggaaattagctgaaaggcttgccattgcaaatggtcgaattgttcttgaaatagccacgtataagtaccacggaccactatatgtcaagattagggaaaacacttaccgcgccagggataagatcatcgggtgttcgtcaggagggtgatccaattgaaagggttagaaagttgctcttggctcatgacttagcaacccctgctgagctcaaggacatggagaaagaaattaggaaagaagtcgacgctgccattgctaaagccaaggaaagtcctatgcctgatgcttctgagctctttacaaatgtctatgtcaagggttttggcgttgagtcatttggcgcagacagaaaggagttgagagctacactcccataggtcaccaacctgaagatgaagatgagtactcttctaacacgatgatatatcgaggaggaataagcattggtgaacaaacccttgggtgttgctggcagtttttgttgcaaaacgaacctgtatagagatgtgatgtcaggggaattcgttccttatttgttttgttttcctttttttctgcaattcagtttaactgctgctggctggcttcttattgaagctagtgatttggcctgcataatcgcttctgttcgcaaaatcatgaggtggaaaataatgtttgcctgtgtcgtaagtctcagttatcgattacacttgcagtccttgccgtatggcgactgttatatttccctgttctcttagtcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaggggccccaaggcccggggccgctaaaaaaaaaggggaccccccggccggcgaaatttaaaataaaatttaataaaacccggcaaccccagggggggccccgaacccaaattcccccaaaaaggaccgaaataaccggggttaaggggccgcgttttaaaaacgtgggaaggggaaaaaccggggggaacccaaattaaaaccccttgaaaaaaaaccccttttcccaggttgggaaaaaaagaaaaaggccccaccaaatcccccttccaaaaatggcaccacccgaaaggcca

SEQ ID NO: 32588 - DNA, 652 bp, Triticum aestivum
  Clone ID: PAT_TA_32588
gttctccgtccatcctttccccctcccggcctttccccttgccggggaaggctgaatctgaagtcctctccaagtacccatcctcagctgttgtattgaggcctgggtttatttacggtaaaaggaatgtcgacccacgcgtccgaaagtcgatggctacgagataccgctcgacatcgtagggcaaccactagagaagctactttcctctgtcgaaaatttcaccaaaccattgagtgcattgcctggttcggacctggtcctagcaccccctgtgaacgtggacgatgtcgcctatgccgtgatcaacgccgtcatagatgacagcttcttcggagtgtttacaatcgagcaaatcaaggaagctgcagccagtgccagagtgtagagatctccatatctggaagtaccttaggagggatgctcatgttgttgcaaatcttccataataggggatagctcaaggccaaactcagtactgcaatgttgtgcttagagagtttaatcccttccacacgctccagttcctcatgccgggcttcttcatagcaggcaatcactcttcacaaagggctcaccttcttaccgcccatacgtgcacagctgtgggtcgagcacaaaaatgggttgcaacaaaaaaacggcaaaaaaa

SEQ ID NO: 32589 - DNA, 1551 bp, Triticum aestivum
  Clone ID: PAT_TA_32589
ggaccggtgggccggcgatgggtcggcgttcggggatggccgcggccagtggccgccccccgcgcccgagcaggtgggcggcgacgtcgagacacacgtcgcagattttgtgatcctgtgcaccgggagattcagcggcatcccaaacatacccacattccctcccgacaaagggccggagaagttcgacggcacggtgatccactccatggactactccgacatgggcaccgcaaaggccaccgagctcatcaggggcaagttcgtcaccgttgttggctaccagaagtctgctcttgacatcgccgcagagtgcgcaaacacaaacggagccaagtatccatgcacaataatatgtcgaacgaagagatggatcatacccgactactacgcttggggcgttcccattgcgttcttctacctcaaccgcttctcggagctcctagtacacaagccaggagaggggctgctccttagcattcttgctaccttcttatcacccttgagatggctgttctcgaagtttgtcgagagctactatagatgggcggtgcccatggataagcacggcatggtgccagaccacagtttcttccaggctatcagctcttgcttggttgcaatattgccagacaaattctatgacatggtcgatcaaggaagcattgttctcaagaaagcaaagagcttcagtttctgcaaacaaggtgtcattgtcgaaggtgattccgcgccgataaagagcgacgtggtcatattcgccaccggatacaagggagaccaaaagctaaaggagatgttcacatcatccttgttcagagacattgtgactggcccaccatccagtattattcctctctacaggcaatgcgtgcatcctaggatcccacagctggcgatcatcggctactctgagagcatagcaaacctgcacacattcgacatgcgctccaaatggttggcgcatttccttgacggggtatttcagttgcctagcataaaatctatggagatggatataaaggaatgggatgaatacatgaagaggtactctcgcgaatacttccgtcgatcttgcgttggagctctccacatctggtacaatgaccagttgtgccaggacatggggtgtgaacccaggaggaagaaagggttctttgcagattggctgttgccatatcttccatcagattacaaggatatcaacctgaagaagtgacatatgagatctgtcgcgccatcgccgctcttaaatcaaacagaaacattgccattccagcgattctgtgctgactattgtacaaactaaatgtcatagaataagctcttcggttgaacctagatctggtgccctgttcctaaatagatgcagcaagtcaggtgttaaatcatacagtacctgttactgtcctcccaggactgcttccaacgagcaaaccattatcagtattagtttcaaaagatgatgatatgcttcatgtaaacttcctggtgaactatgtgcgcatcaacctgacatgccgtcaaataaaaaactgagcaaaaaaaatc

SEQ ID NO: 32590 - DNA, 686 bp, Triticum aestivum
  Clone ID: PAT_TA_32590
atggtgtagttcaacaatttgtgggccatggggtaggcaaagtgtttcatgcggagcctgcagtgcttcatttccgcaataatgaaaagggccgcatgattttgaaccaaacatttaccatagagccgatgctaaccatagggagcacaaactcgaccatatggtccgacgactggactgcggtgacggaggacgggagcctgtcagcgcagtttgagcacacgctactgatcactgaagacggcgtggaaatactgacgcagtgttaagcccggccggagaacaaagaggtcaatgagtgaaaggctggatggcagggacggcagaacctgcattttttttctgggactacacatggtccaatcaaactccaagtgcaaaactacacttttttttcttgatacatcagtaggttgatgcatagattatatacaaagttttgcatcgttgttgggattatagggtgagcttgcagatcagatcagcccccttggttgttgcgggtaggcctgaattctgactgactgcctggattctgattgagttggttggttctgcggttgatgaaagccatgtcttgccgcatttgttggcagaaagaaattaagatctgctttgctttattgatacttctccccgattgattatcagcctgatgctgcttcatcaatcaaaacttttctgca

SEQ ID NO: 32591 - DNA, 206 bp, Triticum aestivum
  Clone ID: PAT_TA_32591
gcactctgctgggccgacactgacactgagagacgaaagccaggggcgtgtgcataaagacttctcagttgtcatcgacaagatcgggccggctccggtgtggacagtggtcgttcgtgggccagctaccttcatgtaatgtttattatgtttggggtgctttgtacttcatgtgaacctttacaataaagatctacttttacaag

SEQ ID NO: 32592 - DNA, 765 bp, Triticum aestivum
  Clone ID: PAT_TA_32592
gccacactttgctcgaggtgatggaggaggagctgagctgagcagagctaataggcgatggatttccaggcgccggccggtgatgaccgccggagcaccgacctcaacaagcaggccgtggacgagcaatctcctcagcaatcggcggccgatggcaaggccaaggcaggtgctccatgcctctacttcaagaaaggcacgtgtgcgggaggaaacatggggcatgatgcccatggccatgcgccacactttgctgcaagtcatgctcactgagcctaccgtatagcagcagcaaagagaatactacgtattacaataaatactacgtacttccactttctatttctgttatgaaccaccgtgtatgtgtggtccttgtggttgcggttacggtctcccgggctcctcaacttcgtggttgtccggcgtagattcctgccagctcctcggggcggtgaggttagggtattcttgtcgtgcgtgtgcgacggcgagatttggtgtcgggttcatgggcttcaacggcgatgactgcggcttcagagcgggcacatgtcattaggggcgtgtgcataaagacttctcagttgtcatcgacaagatcgggccggctccggtgtggacagtggtcgttcgtgggccagctaccttcatgtaatgtttattatgtttggggtgctttgtacttcatgtgaacctttacaataaagatctacttttacaagaataaaaaaaaaaaaaaaaaaaaaaaaaaaaaaaaaaaaa

SEQ ID NO: 32593 - DNA, 971 bp, Triticum aestivum
  Clone ID: PAT_TA_32593
cccgatgccattttcacgaggatagggtctcacaccctgacccacggatcattgcagtcagcggcaatgccatcaagtcacaaatatgcaattgttctgaattggaccacgagcttgggtcgttgatcgtccggcgaattggacagatggagtcacatgcacaccgtgccagccccgacgaactataccggttgctcctcgagcccgattttgcgtgtcacgcctttgcaggggaaaataccacaagaatcatgtcaatacaaaggcaagtcatcgaaaatgaagtgaagtgcaacatcgcaaactgtcggatggttacaatccccgccgtcatgcaacatggttggtgctgcttcaactgggacatgatggcccacgtgataaccataatggacccaatggcataccagacagaggacacaacacggaaaacttgttttatgtacgcggctgacaagatacacgacgctctttttgattgcattgaagaattcttcaccgagtggcactgcagcagacattcatggacgaagaagtcacctctactgtctaccacaacattcacaaggccagagagtgccctgtgtgtcgtccacctactaagacaattcaaagggaattcactggcaaaaccacttaccagggcagctatcgccaacgaaaggggctcgctcctcatcgagctgatccacatgaaaggcaacaccgcccctctgcagctagaaggactcgacaccattgccgacgctctgaatgagacgatgaaagacttaggggtttaggtgtggcgaagagtgttagttctaatgtatctaggacggcactggataataatgtagaacaagtgtcccgtggtcgctcattatgtatctacttttaactagtatttttcttgtaatcagcaacatttacatttccctgaatatcgcagcgtccaaacaataacaactggtaactgtcaagattttcat

SEQ ID NO: 32594 - DNA, 1577 bp, Triticum aestivum
  unsure (1)..(1577): unsure at all n locations
  Clone ID: PAT_TA_32594
cacgaggcagcaaagnaatcgcctagcgaaaatccttgcggctcggattccggcggccgccgccgcgatgaagctcgtccaccgcaatctcgcccgcaacgggcccggctccgccaagctgctgccggaggaggaggacgacctgtggcacgcgtacaatctcatcgccgtcggggacagcctccaggccgtcactgtccggaaagttctcagggattctgcttcgggaggacgtgatgcggagcgcgtgaagctaaagttggagattgtagttgagtctgtagattatgacaaggaggggaacgttttgcgcgtccgtggcaaaaatattactgagaatgatcacgtgaagattggccagtttcatactttagaacttgagctgaagagaccttttgttctacgaaaggaatattgggattggttagcacttgataccatccaacaagcatgtgatcctactgcaagtgctgatctagcagttattcttatgcaagaaggacttgcccacttattccttattgggagaagcataacagcaacaaggtcacgtattgaaacctcgattcctaggaaacatggacctgccattgctggttatgagtcggctctcaagaagttctttgagcatgttttgcaggccttgctgaagcacattgattttgaagtggtccagtgtgttgtaattgcaagcccaggttttactaaggatcagtttcgtgattacatgcatcttgaagctgcacggcgagacttgagagtaataattgagaacaaatcacgcattattcttgcacatgcaccttcaggctacaagcatagtttgaaggaagttttggacaccccaggtgtgatgtcactgataaaagatacaaaagcggcacaggaggtgcaagctttgaaggagttcttcgctatgcttactaatgactcagcccgagcgtgttatggacctaagcacgttgaggtcgcacatgaacgtcttgcaatacaaactcttctgatgacagatactttgtttcggaacacggacattgctagcaggagaaagtatgtgaacctggttgagtcagtcaagaaatatggtggtacagtgcacatattttcttcgatgcatgtctccggcgaccaattggcgcagttgacaggaatagcagctatacttcgtttccccctgccagatttggaggacatcgagatgtgattagtccagccctgtctgcagctgcctaacatttgttgtaccaagctgttaacttatagctgatcaagtgtaataacaatataacagttggttctatgtaggtagcaacagaaagaaatcctgacaacattttaatatatccttgttgtaaatggttagctatgccacatctattggttattcttgacttaataataagggccctctccatttttgcccttgagatgtggatggtggggtacacaggtcggccagggctgcgacttctctagcttcatgtcgacatatttcgctgtgtaaccccccttgctatatgtgtattcctttaaacattactggatgaaggttggccgttctctggaaaaaaaaaaaa

SEQ ID NO: 32595 - DNA, 833 bp, Triticum aestivum
  Clone ID: PAT_TA_32595
gtgactggtcctttgggtggtgttccgaagactgcatgaatgaagaatcggtgaagagttcagcatcagcaatgttgaagctgggtactcatgaggtgatccttttggtagcaatgttgatgatcctgaataatatgttgtataccataccagagaaagatgattcattgactaaaaaaagggttcccccaatttccctggagtctaccagcacggtctatggacatggacgcggcatgctgtatgaagctcaagaggtgattgatcctttgtgtaatgtttcgtgaagtcttgagatgcgaccagcaaagatgatgctgggaaatgaaaaaaaaaaaactgtggttgcaatgttgacgatactttaccttcagagaaatgtgacccttgattcattgtccctttccccagaccaatggtaatggtggtgaaacacgcagtttcgcagaagcagtaataataaggtatgaagttgcccttgtgtggaatagttcctcagttgttacacacagaaaaagggtatgtactgttgcgtattatgtaacttgtgtttgggacttggaaaagtttgccgtgtcgatatatctcttgagcgttcatcctcattccatagtagaacatttgatatccagttgttttgctaattgattgatagcatcattcaattttagtgcaggaagctgcagaagcgttattcagttttcgtagacgatgtttcagaaagccaagacctaatatattttgaacttcattgctgtacacaaaatgaagcttcattgctgcattttgaaattgtgcctctaaatatattccgaacgttctttgtcttgatt

SEQ ID NO: 32596 - DNA, 518 bp, Triticum aestivum
  Clone ID: PAT_TA_32596
gttagtaaaaagatggatcatctattttggaacggagggagtaataatgaatataaaaactaccatttggacctttgaacaagtggggttgttccacgcgtccgtttgtagtgctaaaattgatacgaggaaaatagcatcaaaatcaaactacgaatgcatattatcacgtgccttttattgagttaatttacaacattgcacatcttttctgtgtggagttaactttatagttctgtaatacactagacttgctctggctaagtttctcccaatatatatggtagaatagcctactaaattttttaggcttagcacataaattaaagcacagttactgggtttgtataattgtaggcctggttaattgtgtggtgtaccactgcatctcaagtgttgtgtgttcttgttagccatccaactaacgcatggttcgctgctcagtgtcagggccctgctgaggttaatgtggtgaaagatgtgtaaagctcactagcgggcttgaaccagcttaaacg

SEQ ID NO: 32597 - DNA, 709 bp, Triticum aestivum
  Clone ID: PAT_TA_32597
gtaaatgtgaccgtaacacacgatgctttcatatgctgcatacaaggaagtgtatttacagcctccaacaaaaatcataccttaaaattctgaataattatagtttcatgattctcaaataaggtcctatactcctataatttgtaaaatttcacttcaacctatcatttttaaactgtacattcatacctaaaatagaccactactagggcacactccatctgctacgtaccagtaattcagttcatcaattgcatactgagtgctgaggcgtacgtacgacggtgcatgtgcatgtgcgagctggtcaagctcggcgacgaacgccgcggcgtgctcctccctgacgcactgcgttagcagccgctcgccgtcgcccgccgtggccctgcacgagaggaacgccatgcaccccggcaccgtcgactgctgccaccgcccgaccaccctcgccggcgggccgccgccgaagtctgcgcggtcgaagccgatgttccgccagctggtcaccatcagcgcgttgtacccgaaggccgcagccatctcgtcctcccccatctcctgcacggcgccgccgccgccgcccatgttccgcagcagctccggcaccccgtccttggcgcgcttgatcaggtccaccacatcgttcatgccgccatccccggcgccggccacctccccggtcgtcgccaaggccagctgcgccacc

SEQ ID NO: 32598 - DNA, 810 bp, Triticum aestivum
  Clone ID: PAT_TA_32598
ttttttttttcagtaatgaaaatcggaaggggcaagcccttctttgataaaaaaaaattcagcacgtaattcagggtaaatttcgtatacgaccatgctctcctcatacccgaaatttagcttaacttttgtgaatattttaattttgacagtttatttatctcaccagaaaataccactcatgttttacaacgaaacaaaattggcacgtgacgatgacacggcggcccggagctcgtcgtccagctcgagcgccgccatgtgctcgggtgacagcgacacctcggcgtccacgctgcctccgccctcccgcccggggtacagcaccgtcctcccgtcgttcttgttcgccctcccgctccgcaccgccgtcggcttcccccacccgaagtcgcacccgtacgcgtcgaaccacggcgagccccccatcatcgtcagccgcaccgtcaccacgggctccgccgtccacgcggccacgcgcgcccggatggacgcgtccgtgttcgccgccaccgcgcggcccacggccgccgccccccgcccgtgcccgccgcgcgccagcagctccgacacgcgcacgggctccgtgctgacggcgtagaggctgttgccgaagtactccgccggcagcgccggccggagccgcccgcggttgttggcagccccgcggaacgccgtctcgtcgtccggggccagccgccgggcgcgggtgatgcaccgccaaatgagcgaggtcaggccctggtaccgcgtcagggcggccgcgcccgccgcgtccccggcagctaggagctcttcgcgggcgggatc

SEQ ID NO: 32599 - DNA, 991 bp, Triticum aestivum
  unsure (1)..(991): unsure at all n locations
  Clone ID: PAT_TA_32599
ccacgcgtccgcccacgcgtccgcggacgcgggggccgagcctttcatcaagggacaaaccatcatacgagacagacgccggccgcgacacaagtggacgatccccggagtgcggatcgaatggcgccggtgagcaacgagacgttcctcccgacggcggcctggggggaggcgacgctgcgcccgtccttcgtgcgggacgaggacgagcggcccaaggtggcgcacgaccgcttcagcgatgcggtgccggtgatctcgctcgatggcatcgacggcgcgcgccgggccgagatccgggaccgcgtggcggcggcctgcgagggctggggcatcttccaggtggtcgaccacggcgtcgacgccgacctcatcgccgacatgacgcgcctctctcgcgagttcttcgcgctgcccgccgaggacaagctccggtacgacatgtccgggggcaagaagggcggcttcatcgtctccagccacctgcagggtgaggcggtgcaggactggagggagattgtgacctacttctcgtacccggtgaaagcacgggactacgggcggtggccggagaagccggcggggtggcgcgctgtggtggagcgatacagcgagcgactcatggggctgtcgtgcaagctgctgggcgtgctgtccgaggcgatgggcctggagtcggaggcgctcgccaaggcgtgcgtggacatggaccagaaggtggtggtcaacttctacccgcggtgcccccaagccggacctcaccctgggtctcaagcgtcacaccgaccccggcaccatcaccctcctcctccaggacctcgtcggcggcctccaaggccacccgcgacggcggcaagacctggatcaccgtccaagcccatctccggcgcaattcgtcgtcaaacctcggcgaccacggccacttcctgagcaattgcaagtttcaagaacgcgggaccaaccaagcgggtggttaaacggggganaacan

SEQ ID NO: 32600 - DNA, 657 bp, Triticum aestivum
  Clone ID: PAT_TA_32600
catttgctgatgttaggggtggaggggatccatcatggcatctagcaggcaccaaaaccaacaagataaattcaattcaagattttgcggcatgtggtatgcatcttatcaaggaaggttttgtgcatgaaagtcgtctttgtgctatgggctgcagtgctggtggtttgctggttggggcggtcgttaatatgttgccaaatttattctctgctgcagttctcaaggtcccctttcttgatatatgcaatacaatgttggatcctacgttacctctcaccatcttggactacgaagaatttggtgaccctaatatcccagttgaatttgatgcaatccgtagttattctccctatgacaacttatctcccggcaaatgttacccctcaattctggtgactgcctcttttaatgatacaagggtaggagtctgggaagctgctaagtgggtttcaaaagtgagagatgtcacgtgcccatcctgttccaagtctgttgttctcaaaactaatatgcagagtggccattttggtgagggtggacgcttcatgcggtgcgaggagacagccttcgagtatgcgtttctaatgaaggcattgggaatggatgataagtctgcgaagtaatgaactgacactcaaggcttactgtgctgca

SEQ ID NO: 32601 - DNA, 391 bp, Triticum aestivum
  Clone ID: PAT_TA_32601
cctggtggtcgtggtcttgctggtggtcaacaccatcaccgtatcaacatggataagtaccatcctggttactttggtaaggtcggtatgcgtcacttccacttgaagaagaacccttactggcgtcctgttgtcaaccttgacaagatctggactcttgctggtgaaggtgctcgtgaacaatacaagaacactgaaaaggttcctgtcattgatgctctccaaaacggttatgccaaggtcttggccaagggtactatttctcaacctgtcattgtccgtactcgttttgtttccgcccttgctgaaaagaagatcaaggctgccggtggtgttgtcgaactcattgcttaaatttttattatgtataataataaaaacatagctactc

SEQ ID NO: 32602 - DNA, 1273 bp, Triticum aestivum
  Clone ID: PAT_TA_32602
gccgcagtccatcgcaggggcacctgcagctctctctcccacttgaggaggtacatcgccagcaaaggcttggaggtgagctcgtggtctacccagcgcgagggctggcatcctctcaagcaatggtgcagtgatggggcggacgcgtgggcggacgcgtggggtgagctcgaggtcgctcacggcctccctcaggcgtgtgtgatgtagtgtggcaacaaggccgcatgaggttccagctcttcagcgaccccccttcatcatattctggtgaggtaccagcccaccgacttcatgtagtatggacggcgttgccgcgcagttcgccgtgcgaatctcgtccagttcagactctcaccgaggatttgcagctctcccgcgagtggcttgtggtctgtgcaggtcgagcgtgcagcccactattggttcctccaccgctgcaagtcctcgacctgttgcgctgtcatccatggtgtggtccacacggccagagtatgccgcagcccacatctccagcgggtgcagctcgtggcccgccaatgtgcagttttggcaaccggtgtttgcaagattggcacatgtacttccgacggatccatgcgggatcctcaccgccagccatgccacctcccgcgggatcctcctgctatgttgtgtggtatgaatccctcaccccttgacctcttcctggctgctgctgcaccaagatcctgtgcatgcgggtgttgtggttgtgcaactcggagatgctcgccattcggttcagggctcgtgcttgtgaagtccggcaagcaccatctcttcctatctggtcggtcgaccattgccgtgcagctcggagacgctcgccatgcggttcggagctcgtgcgtgtgcagtccggcaagtgtcgtctcttcccctgcaatccgtcgaccatgccatgcaactcagagatgcttgacatgcggttcagagctcgtgcgcgtgcaatctggcgagtgtccgtgcatgtgcagtcgggcgagcatccgtgtatgtgtgttctgctggccctcaaaagcaattctgccggtatatgtgtgtggctgtaaaacaattctgctcgtatatgtgtgtgtctgtaaaacaacgaatggatgtatgtgtgtctatgagcatcatcggcatccatagacaaaggcgcaaaacaaaatgtgcgctggttagctctgtcgtggcttttgtattctgctgttcatttgtttgttaaaaaaatcaaagaatgttggtgtgagataaaaaaaaaaaaaaa

SEQ ID NO: 32603 - DNA, 427 bp, Triticum aestivum
  Clone ID: PAT_TA_32603
aatggttcatcaaatcacaccaaagggctcactctattgggctgtaccagcaacaatggtcgctgctactacgtacacatttatgagacttaaagcagcatctattgtttcagtatctaatccattaacttatattccttcgggtgaacctacttttgattcggctaatttagatcgtattcgtgatgactggaaacatcgcaatcatggtattggattaagagacgttagtcgaagtggtggtggcgtttgataagcaagcaaggctatgcccttcaattacaacaacatctgtatatttccttattattttttcatgtaaacattcatcactctttattcatagctaaaaaaaataaaataaaaaaagagggttacagagcatgatggtttctcacgttattagagaaaatgtcagctcaggggt

SEQ ID NO: 32604 - DNA, 663 bp, Triticum aestivum
  Clone ID: PAT_TA_32604
cccgagccgagcttccctagtggagtggtttagaaacctccgccgactcttcctccaactgtttcagtgcagtaggccctctagcccggcgggtgagcgggagcgcgcgcgatggagcggtgcgggagctggtccgagtccgacgccgcggcgcaggcggcagcgcagaaggccgtgccggcgccgttcctgaccaagacgtaccagctcgtcgacgaccccgccaccgaccacatcgtctcctggggcgacgaccgggtctccaccttcgtcgtctggcgcccgccggagttcgcccgcgacatcctccccaactacttcaagcacaacaacttctcctccttcgtccgccagctcaacacctacgggttccgcaaggtcgtgccggagcggtgggagttcgccaacgagttcttccgcaagggggagaagcagctgctctgcgagatccaccgccggaagacgtccgggtccaccacgtcgtcgtccccgccgcccttcttcgcgcccccgcacttcccgctgttccacccgggcgtttcggtcgcgcatcaccaccagcagttcgtgggcgaggacggggcaatggcggcgcacgctggcatgggcgtcccgttcatgcagccgcattggcgcgaccagggcgcgcctcggctgctggcg

SEQ ID NO: 32605 - DNA, 658 bp, Triticum aestivum
  Clone ID: PAT_TA_32605
cccacgcgtccagatcattagtctcgagattgaatgaaggtgaacgagacgaagaagacgaggataagcaagcccgaagaaggtcgcaccgaaggacaaacctacactaataactcaaacacttgcctggttccagtgcaatgatatcatcatcttacaatgcatggtacatcgtccgccagggacctgcgaagggtggcgcacaagggaacgctgagcaaccgaccgagtgcaagcagcagtagaactttgtggatgcagttgttgcagtattttccattgaactgccctggggggaggagcttttatgctggttgtgttgtgcacgggtgagacgtctggtgtggatatttaccgtaggcatggttttgtatctggtggcgaggtgattgtgctggtgtggatggatggtttgtgggacggtcatgttagcgtgttattcttattatggtctctagctatatgcagtcgaaggataccctaagattgtgtaattatatttgaactcgtaatagagccttttattattattttttgtgccatcatctcgtgttcattgtgatagtgttctacagtatgcagaacattcataggtgcattttagataactccgtcagagagaagcactttgatcttgtcggttcataattcatttcct

SEQ ID NO: 32606 - DNA, 720 bp, Triticum aestivum
  Clone ID: PAT_TA_32606
ctaaaactgaagagtgcgagagctttttcaactttttcagccccccacaagtacctgatgatgatgaggacattgatgaagaagccgctgatgagcttcagggtcaaatggagcatgattatgacattgggtctaccataagggacaagatcatccctcatgctgtttcttggtttactggtgaggctgtgcaagctgaggattttgatgatatggaagatggtgacgaggatgacgacgatgaggatgatgatgatgaagaagatgatgaggaggatgaggacgaggacgaagacgatgatgaagacgaggaagagctaagcaagccaacgaagaaggtggcgggcaaaccgaagggacctgcgaagggtggcgcacaagggaacgctgagcaaccgaccgagtgcaagcagcagtagaactttgtggatgcagttgttgcagtattttccattgaactgccctggggggaggagcttttatgctggttgtgttgtgcacgggtgagacgtctggtgtggatatttaccgtaggcatggttttgtatctggtggcgaggtgattgtgctggtgtggatggatggtttgggacggtcatgttagcgtattattcttattatggtctctagctatatgcagtcgaaggataccctaagattgtgtaattatatttgaactcgtaatagagccttttagtattatatttatgccattaaaaa

SEQ ID NO: 32607 - DNA, 1645 bp, Triticum aestivum
  unsure (1)..(1645): unsure at all n locations
  Clone ID: PAT_TA_32607
ggccggccgggcagggctctcctcgccgcccaactcccgctctccctagggcttcctccctcctctcctcggcggcgcggcggcgaagtccaaccaggccccaccggagctccgaccatgggcggcgagaaggagaacctcgacctctccgacctcaacagctccctccccgccgccgccgccgccctcagcgccgaggaccgcgtcggtctcgtcaatgccctgaaggataagctgcagagcttggcggggcagcacgcggacgtgctcgagtcgctctcgcccaatgtcaggacgcgtgttgagtttctgaggggcattcagagccaacatgatgagattgaggcgaagttttttgaggaacgggctgcccttgaagccaagtaccagaagctgtatgaaccattgtatgctaagaggtatgacattgtaaatggagttgtggaggttgatggtgctgctaaagaacctaccagtgaaaatgctgccgaggggggagattcagatgctaaaggaatcccagatttttggctcactgctttgaaaacaaatgacgtgctgactgaggagatccaagagcgtgatgagcctgttttgaaatatctaaaggatatcaagtggtctagaattgatgaccctaagggtttcaagcttgagtttttcattgatacaaaccctttcttcaagaactctgtcctaacaaaatcctatcatatggttgatgaggatgacccaattttggagaaagcaatcgggactgaaattgagtggtatcctgggaaaaatgtgacacagaagattctaaagaagaaacccaagaaaggttcaaagaacaccaaacctattactaaaaactgaagagtgcgagagcttcttcaactttttcagccccccacaagtacctgatgatgatgaggacattgatgaagaagccgctgatgagcttcagggtcaaatggagcatgattatgacattgggtctaccataagggacaagatcatccctcatgctgtttcttggtttactggtgaggctgtgcaagctgaggatttcgatgatatggaagatggtgacgaggatgacgacgacgatgatgatgatgatgatgaagaagatgatgaggatgatgaggacgaggacgaagacgatgatgaagatgaggaagagctaagcaagccgacgaagaaggtggcgggcaaaccgaagggacctgcaaagggtggcgcacaagggaacgccgagcaaccgacggagtgcaagcagcagtagaactttgtggatgcagttgttgcagtattttttccattgaactgcccagggggaatgagcttttatgctggttgtgttgtgcacgggtgagacgtttggtgtggatatttaccgtaggcatggttttgtatcaggtggcgtggtgattgtgctggtgtgggatggatggtttgggagtttgggacggtcatgttagcgtgttattcttattatggtctctagctatatgcagtcgaaggacaccctaagactgtaattatatttgaactcgtaatagagccttttattattattttttgtgccatcaggggggcccgggcccggttccccattcgccctcctatancccccctnaanggcgtcntttaaaactcc

SEQ ID NO: 32608 - DNA, 1720 bp, Triticum aestivum
  unsure (1)..(1720): unsure at all n locations
  Clone ID: PAT_TA_32608
taagggtatcatcagtgataagcaacagccctatcatcatgaatgtggactgtgatatgtactccaacaacaacgatgcggtcagagatgcactgtgcttcttccttgacgaagaaatgggtcacaagattggatttgtgcagtaccctcagaactataacaatctgagcaagaatgatatatatgggaactccctccatgtcatcaatgaggtggagatgggtggtatggacagtttgggtggccctctgtatattggcaccggatgtttccacagaagggagatcctttgcggcaggaagttcacaaaagactaccaggaagactggaatgcagggatcaaggacaaattacaagagagcatagatgagactgaagagaaagccaagtctttagcagcctgcacatatgaacatggcacacagtggggagatgagattggggtaaaatatggttgcgcggtggaggatgtaatcaccggattggcaatacattgcagaggatgggagtcggtctacaacaatcctaaaaaaccagcgtttatgggtgtaggtccaacgacacttgctcagacaatattgcaacataagcgatggagcgagggtaacttatcaattttcctttccaagtacaacgtgttcttgtttgggcatggaaaaaccaagctacgacatcagatgggctaccatatctatggactatgggcacccaactcactcgctacgctgtattatgttatcatcccttcactggccctcctcaaaggcaccccccttttcccagagattacaagtccatggattgcacccttcgtatatgtcttctgtgtgaagaccatgtacagcctatatgaggcactatcatctggagacacgctgaaaggatggtggaatgggcagaggatgtggttggtcaaaagaataacctcgtacctctttggagtccttgacaatctccggaagttacttggactgtcaaagatgaattttgtggtttcaccgaaggtaagcgatgaagacgagtccaagaggtatgagcaagagattatggaattcgggtcgtcggatccagaatatgtgatcatcgggactatcacgttactcaaccttgtttgcctgctgggagggctaagtaaagtcatgaaagttggatggaataatatacacttggatgcacttttcccccagctcattctctgtgggatggtggtgataaccagtatcccattctatgaagcaatgttcctgaggaaggacaaaggcagaataccattcccagttacactagcttctattggctttgtgatgttggccttactgccagcaatagtttaaggtcccacaagaggcatcagtgtgtaattaagtactcaagttggtatggtttatggttctctcgaaacacttgctctgatagtttcatgtgcaactagaattatatgtggtgcagccccggggtggccagaggcaatttgcgtaagcccttcgactcgggattaaccatggatcaaattacccctgtgaaaataaaaatgcccaaccagaagatgtcaagaacgccgatgcaatcgacgacagatctaactcagtctcctctagcactagtaaaatcccagtatgggagcaacctgtacagaatcagggttttaggtgggcacatgaatacattggatccaatcgtctgcaccattaataaagaananccgtccagatttagcaag

SEQ ID NO: 32609 - DNA, 1003 bp, Triticum aestivum
  Clone ID: PAT_TA_32609
cggacgaggcacctcgtccccccgccgtgacaaactctgcctcgccgcacgcagcagagcatggctcccccccgcggccgcctcctcgccgcggcattgtgcctgctcttcctcgccggcgcagacgcgggcaccgtgggcgtgaactgggggcgggtggcgaacgacctgcccagcccggcggcggtggtgcagctgctcaagcagcacggcatcgcgcaggtcaagctctacgacaccgagcccgccgtgctgcgcgcgctcgccggcagcggcatcaaggtggtcgtcgcgctgcccaacgagcagctcgcggccgccgccaggcgcccctcgtacgcgctcgcctgggtgcgccgcaacgtcgccgcctactacccggccacgcagatccagggcatcgccgtcggcaacgaggtgttcgccacggccgccaacgtcacggcgcagctcgtcccggccatgatcaacgtgcacgccgcgctggccaggctcaacatggacaaggccgtcaaggtgtcgtcccccgtcgcgctctccgcgctcgccaactcgtacccgccctccgccggcgtgttcaaggaggagctcgcgcagtcggtgatgaagcccatgctggacttcctggcgcggaccggctccgacctcatggtcaactgctacccgttcttcgcctacgcggacaatgccggcgtcatctcgctcgactacgcgctcttccgccccaacgccggcgagctcgactccgggagcggcctcaagtactacagcctcctggacgcgcagctggacgccgtgttcgcggccgtgggcaagctgggcagctacaacggcgtgcacgtggtggtgtcggagacggggtggccgttcaagggcgacgcccaagaggttggcgccggcgcggccaacgccgcggcgtacaacggcaacctcgtccggcgcgtgctatccaagaacgccggcaccccgcgccgccccgacgcggacatcgacgtgtacctct

SEQ ID NO: 32610 - DNA, 561 bp, Triticum aestivum
  Clone ID: PAT_TA_32610
tttttttttttttaaccaaagagcaatgagctcttccccgtagtatatatatgccgtgtaccatcatgcactacacatgtacagagctgctgtaaattaaagtgataaacctgtgactaaacgagcgagtaaactgtaaacgaattaatctgtgcggtagcagtaaaactaaatctcggcgctgtacggtcccagtcgtcgttcagtcctcagtaggcgccggcggcgaagtcgacggggtagacggcgctcatgtccggctggaagagcccgaagtgctgctccgtgccctcgggcttctggttctcgttgaacatggcgaacaggtacgtctccacggccttgcccggccgccgcggcgtgccggcgcccgacgccgcgtgctggatcacgttgttgttgtacgccgccgcgttctccacggtggcgcccgtcccgccgccgcccgacggccacccggtctccgacaccaccagcttcagcccctgcgcgccggccttctccaccgccgcgtgcgccgcgttcaggatcgcgtcgaacatgttggtgtacaccagcccg

SEQ ID NO: 32611 - DNA, 632 bp, Triticum aestivum
  unsure (1)..(632): unsure at all n locations
  Clone ID: PAT_TA_32611
cccacgcgtccggttatctgcaatggccgcgacgatggtggtgcacgtggtgctcctcgccgtgccggcggtcggcgggttcatgcaggcgttcaagttctcggtcctgctctggccgttcaacatcacgctgccgctgctccgccacctgccgcgcgtctgcctcacggtcatggtgcacgtggtgcactacgacgccgagctgcgcgcgtacctcaccggccgccggacggtgccgctgccggagccggggtactccaccctccgcggcgcgcagtggcgcacgcgtgaacagctcgccgcgcacgccatgatcgccctcgtcgacatctcctactgatgtcgcgtacccaacagctgcttaattctggcggtgctcttcttggtcgtataggttagttataagaatttcaattggatcctgcacatagccacatgggtcttccatttctctttcgaatctcctactgattcccgtaccaacagctgctaattcggcgtgctcttctggttgaaagttggtcaaactttttttgnggtgtctctgccgtanagtagtataaaattcattggtatcaatagcaatggtcccatnaaanaaaaaaaaaccagggggccgtcaatnnccnttg

SEQ ID NO: 32612 - DNA, 746 bp, Triticum aestivum
  Clone ID: PAT_TA_32612
cccacgcgtccgatccatctgtcctcccttgcgctccgatccgcacgagatcaccgattctgcctcctgatgccacgccgctccccagcgacgaggctgctcccattgttcccatcgacgcttcatgatccacggcctcccccatcctcttctccatacaacaccgatgtcgccgtcccgtattccccaccgctgtcttgccaactgtagcacgccggatcctcttcttcagaagctgccgcctcacgtgcaatgccaccacccatggccctccacggacaccaccatcacgggcgtaacttggacaacagaccccatgacggcagaaggaagagcaagtggggggtatcgagactggccaccatcgtgaggataccggcgtccgtgcgcgtggtgatggcatggtgacgcaagaaggtcgtgttcctggtgtgccgcatgctccgtctccatccacgtccgcgaccgcaagacagggagatgcatctggaaggaggcactggggcaacatcaagaagttctgttaaactgattcatagcagcatctcaaagttcaatcagaagaagcgcgacattgtggtttctatagggtgggaggtatcctccatatccctgagccgaacaagctaaatctaaagcccggatgtgttcttgcttacacatgtggacatagatataggagggcaattgtaattgatgatgatagaacttgcccgtttgatgccacggacgttgggaagtattcg

SEQ ID NO: 32613 - DNA, 747 bp, Triticum aestivum
  Clone ID: PAT_TA_32613
tcgacccagcgtccgcggacgcgtgggcagagcaacccgaccaggcatccatggcagcctcgccctccctctagatagatgcatggggtgcccccgcgccgtgcgggcgtgtcgatcggcgtgtgttgcgaccgtggcgatctgcctcctcccggtattattgccgctggtgctcctctggctgccgcttctctccttcgccgtcgccgtcgtccggttccgccgccggcggaggagaatgatgatgactaggggcggctgctgctttcacggcggtgatcgatcgcctccgccagaaagtgagccggatggccaccgggtggcgcggctgcacaagtacctcgaggaccagatggagctagtggaggaggaggccgggggcgccatggcggccgtgcttgccagaaatccatgggcagcgtaaggaaagaaacccgtgctttcttgccggaaacttttcccccttttcgctcgacttttctggctccggcagatgttgctcgcgaggttagtagcaaggcgccgagaacttcgtctcctgattagaggttgttggattgatatgttagctggaatggttggagttcttgttgatttcatctcagcccatgtatcttccacttataattttttgagttggcgagtccgtctactatctcctcagtatttctcctctcaactctgacaaatgagaccatacaaatgtacaagttgagcaagaaacgatgtgcttttggtcgtgcttac

SEQ ID NO: 32614 - DNA, 1936 bp, Triticum aestivum
  Clone ID: PAT_TA_32614
cgtccgctggactcagtaccatcttccttctgattggccattggggtggccgggtgggaaggaaggaaggaaggaaggaggcgaccacagccagccatggcgaccaggccggggcctttgactgaatggccgtggcagaggatgggcaacttcaagtacctggtgatggcgccggtggtcgtccacggcgcgtaccgggtgatgaacaaggggtggggcgacatcgacctggcctactcgctgatcctgcgctgatcctgccgtccgaggcgctgcggatgatccacaaccagatctggatcagcctgtcccgctaccagaccgcacgcagcaagcaccgcatcgtcgaccgcggcatcgagttcgaccaggtggaccgcgagcgcgggtgggacgaccagatcgtcttcaacgggctgctcttctacgtggggtacctggcgatgccgagcgtgcggaggttcccgctgtggcggacggacggggcggtggcgacggcgctgctgcacgcggaggcaacggcgctgctgcacgcggggcccgtggagttcctctactactggttccaccgcgcgctgcaccaccacttcctctactcgcgctaccactcccaccaccacgcctccatcgtcaccgagcccatcacctcggtcatccatccttttggcgaacacattgtctatttcacgctctttgcaatcccgatgttgtccacagtttatatgggaaatggctccgccctcgtgtttgtgctgtatatcgtttacattgacttcatgaacaacatggggcactgcaactttgagttggtgccaaagtggatgttccaagtctttcctcctctcaagtacctcatgtacaccccatcgtttcattcccttcaccacacgcagttccgcacaaactattcactcttcatgccattttacgactacatatacagcactatggacaaggcatctgacgagctgtatgagaactcactgaaaggaacagaggagacacctgaccttgttcatctcacacatatgactaacttgcaatcggcttatcatctaacgcgtgggttcgcctccatagcatccaaaccatccgataactcggagtggtatatgtggacgctgtggcccttggcatggctgtcaatggttgtagcatggatttatgggtcatctgcattcgtggtcgagagaatcaaactgaagaagatgaagatgcaaacatgggtcgtaccgagatacaacttccaatatggtctgacatgggatagagaatcgatcaatgacttaattgaaaaggcgatattggatgctgatgtcccacgcgtccgggtgctcagtctagggctactaaatcaggcaaaacagctcaatgggaatggtgaactatttagacaaaaatacccaaaattaggagttcgaattgttgatggaagtggcttatcaactggagttgtcctaaaaagcattccttcagatgcaaagcgggtcgttcttcatacagggacttgtaagatagcccgtgccgttgctatggctttatgtggcaagggcattcacgtgatcatgaatcgtaagaaagagtatgacatgctcaagtcacagatgccagagaacagagcaagctacttgaagtgctccagcaatgacataaccaagatttggctagtagagaggatcgacgacaaagaacagaggatggcaccaaaaggaacagtgttcgttccaatatcgcagttcccccttaagaaagtccgcaaggactgcacttacttgagcactccggcgatgaagatcccggacactatgcagaacatccactcctgcgagaactggttgccgagaagggtgatgagcgcgtggcatatcgccggaatacttcatgtcctggaagggtggagcgagcacgagtgcggtgagcacatgatggactctga

SEQ ID NO: 32615 - DNA, 1279 bp, Triticum aestivum
  Clone ID: PAT_TA_32615
ggtccacggacacgcagtatgaaaactcactcaagggcaaggagaaagaagtagacgtggttcaccttacgcatctcaccagcctgcagtccatttaccatataaggaccgggttcgcccagtacgcctccaagccgtacacttccatgtggcaactgcggatcatgtggcccgtgtcatggctgtccatggtactgacgtgggcatacggttcttggttcacagttgagaggaattccatgaagaagctccggatgcagtcatgggctataccaggatacactttccattatggactgaacaaggataaggaggcaatcaatgacctgattgagaaggcaatatctgaagctggtaagaaaggagctaaagttgttagccttggacttctgaatcaggcccatagcctcaatggaagcggagagctttatctacaaaaatacccaaagttggggttgaaactggtggatggaaccagtctagctgctgcagtggttgtcaatagtattccccatggcgcggaccaagttgttctttcaggaaacatttccaaggtggcctgtgctgtggctgcagctctatgcaagaaaaatatcaaggtgataataacaaacaagcaagactatcatttccttcagcccaaaataccagaagatgcagctgacaaccttttactgtcgaaaaccggtatggccaaggtgtggataatcggagaaggcgcagatgccaccgaacagctcagggcgccgaaaggaacacggttcatcccgtactcacagttcccaccaagaatggcgcgcaaggacggctgcacatactcgacgactccggcgatgagcgtgcctaaaacactgcagaatgttcattcgtgcgagaactggctgccgaggagggtgatgagcgcgtggcgcgtcgcggggatcgttcatgcgttggagggatgggacgagcatgagtgcggggacacggtgctcgacatggacaaagtttggtctgccgcacttctgcatggctttcgccccgttgctgaagcttgatcgtctggttgcaacttgcaagtcgagtgaataagcgttacgcagataaggatctggttgtatcttgtatgctcgctggagccgtgctgaggaagaaggagcagacatactggctagcagatgagtggcctataattaattaagtactactactagtttgatgatctatgccaaggttacttggttagctattactggattatttacctcctatgataatgagttgatgacttggttcgacc

SEQ ID NO: 32616 - DNA, 1087 bp, Triticum aestivum
  unsure (1)..(1087): unsure at all n locations
  Clone ID: PAT_TA_32616
cccacgcgtccgctcactcccacagccgcgcaacagagctagcagctctgctgcgaagccgagctccggcaagggtctccgaggagcgaaccatggcgtccaagcccggccttctcacccggtggccatggcacgacatgggaaactacaagtacgcgctggtggcgccgtgggcggcgtacagcacgtaccggttcgcggcggcgacggcgaggggcgaggagggggacctgctcagcttcttcgtgctgcccacgctgctcttccgcctgctctacacgcagctgtgcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattctccgggggctccacaaccaggcctggatcacggtgtcccgcctccagaacgcgcgcggcaagcggcagatcgtcgaccgcggcatcgagttcgagcagatcgaccgcgagcgcaactgggacgaccagatcatcctgagcgccatcctcttgttcctgggcgcgctgcacctgccgggcgggcagaacctgccgctgtggaggacggacggcgcggtgctgctggcgctgctgcacgccggcccggtggagttcctctactactggttccaccgcgcgctgcaccaccacttcctctacacgcgctaccactcgcaccaccacgccatcgtcaccgagcccatcacatccgtgattcatccatttgccgagctcgtgcctacgaactgctcttctcgatcccgatgatcgcctgcgttctgacaggaactgcatcatgacgttgagctctacatgctctacatcgactcatgaacaacatggactgactcctggtgagccttcaacatgcgggcgcgcagaacctgccgctgtggaagacggacngcgcggtgctgatcgcgctgcttgacgccggcccc

SEQ ID NO: 32617 - DNA, 1103 bp, Triticum aestivum
  Clone ID: PAT_TA_32617
ggaagaaatcgcgaatgtttccacatttttttgattccacaatcaaggcacagtaacttgaaggaaacaattttgtaaatctaagaaaccagtcggtttcagacctgtttcaacttttcattacatcaacttgcgcggcaaaggcagtcgtcccacaacatataaaaggtagaaacacatgatgttctatatcgtcggggtcggtgtgacaaactccgccatggtacaagaaaacagacagcgcgtcgcctgatagtctcctactctcatcttagtccttgccaaagtcggcgctgtagtgtgcgctggactcgagcttcttggcgtcattcaacttccgaactgcctttattacgggttggggagtgacgtgtggacgctttggtggaatggggcggatgccaagctgggtgagtgctcggcgggcacccaagtcgtgccctactccgagttcccggtcaccgccggtggcgacgcccgcggggactgcgtgtaccacagcacccccgcgctcgtggcgccggagtcgtacgagaacctccacgcctgcgagaactggctgccgaggcgggtgatgagcgcgtggcgcgcggcggggatcgtgcacgcgctggagaggtggcccgggcacgagtgcggcgacgcggtcaccggcgtcgacaaggcgtggcgcgccgccctggcgcacggcttccgcccctacgacgccgccgccgtccgccacgcggcgaacggagcagccaaacccggccaagcgcgcgctgatgccaactgaaccgaccgatcgccgccgctctggaaccagatgtagtaccactatcgtgtctcgacgatgctttgctaccagtagtaatcttctcgcaaaataatcctcccgcgtttatgtctgtcatcatcaggagcttcaactgatgaacacggttatgaatgagatcaggctatctgttcgacagtgaagcgcagaagggagaatagtgaagtgctcagatggatcggctcgcctaggacagtctctcagtgacgatgatgctttgataaactctcggtattaccgtatgtcagtcacttagcttgacgagtttcaggcgatgaacactgttatc

SEQ ID NO: 32618 - DNA, 762 bp, Triticum aestivum
  Clone ID: PAT_TA_32618
cgtccgcccacgcgtccggggagaaggaagcacttaataacctgattgtgaaggcaatatgtgaagctgacaagaagggagctaaagttgttagtcttggcctcctgaatcaggtagtacattgttttcttcagctgtccaaacttcaaactagtatatgtcatcatcttaaatcaagtggaatactgtgtatcaaacgttcaactatgtactaacgtctgaagaaaaatcctcgcaaaaaaagaaaacttctgaagaaaaaacttcagttcacatgctcatgatctagaagtactgatgcagtgtagctaatgttgatcaaacaagatgcatgtagggaaaatttagagatgcaacatcggttgcttatataacagataccacgttcacaaatatgtgtgatcatatctttaccccaacaggcccaggatgggcacgcggtgagccgggtggtggagcgggcggtggcggacgcggaggcaagcggcgccgcggtgctcacgctggggctgctgaatcagggctacgagctgaaccggaacggggagctgtacgtgatcaggaagcctggcctgaagaccaagatcgtcgacgggacgagcctcgccgtcgccgccgtgctccacatggtccctcgcggcgccagggacgtgctcctcctggggaaggagtgcaaggtggtgtgcgtgctggcccaggccctctgcgaacgcgacattcaagttcgggtggtggacgcggatctgcacgaagcgctggggc

SEQ ID NO: 32619 - DNA, 936 bp, Triticum aestivum
  Clone ID: PAT_TA_32619
acccacgcgttcgcccacgcgtccgtccacgcgtccgggactcagtaccatcttccttctgattggccattggggtggccgggtgggaaggaaggaaggaaggaaggaggcgaccacagccagccatggcgaccaggccggggcctttgactgaatggccgtggcagaggatgggcaacttcatgtacctggtgatggcgccggcggtcgtgcttcacgtgttgcttacatcgaacaagcgcggcaaagacagtcgtccggcctacatataaaaggtagaaaaacatgatgttctatatcgtcgggggccggggtgacaaactccgccatggtacaagaaaacaaacagcgcgtcgcctgacagtctcctgctctcatcttagtccttgccaaagtcggcgctgtagtgtgcgctcgactcgagcttcttggcgtcattcaacttccgcacagccttcatgaagtcttcgtggatgacgtagtcacgctctgctcgaatggcggccatgccagcttcagtgcagacattgcgaagatcagcgccgttgaagccctcggcaagcttaaccacagcctcataatcaatttcgccatgcttggcgataccagctgcatggattttcaggacctccgtcctggattgctcattcggcagtggaatctctatcttccggtctaggcgtccaggacgaaggagcgcagggtccaagacatcaggccggttcgtcgccatgatcatcttcacctttccgagctcatcgaatccatccaactgatttaggagctccatcaatgtccgttgtatttcacgatctgcactagtgccctcactgaatcttcggccaccaatggcatcaatctcatccatgaaaataatacatggttgatgctcacgtgcatagttaaacatttctcttataagacgtgcactttcac

SEQ ID NO: 32620 - DNA, 730 bp, Triticum aestivum
  Clone ID: PAT_TA_32620
aggaagttgccgtgtgagacctgaaagttaggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctcaagaaaaaccttatgcaagcaaggctggataagaagatgacccaggcacaacttgctcagatgatcaatgagaagccacaggtgatccaggagtacgagtcgggcaaagcgattccgaacaatcagataattggaaagcttgagagggcacttggagctaagctgcgtagcaagaagtaatgccttgaagtagcccaaaagctcttgtaggctgttgctgttggttgatactgaataactatgccacagaacgactttatgtatcattatattctcgtgctctaaaatgtgtttgtcatatgtcccagtgtaagagctgcattgaacatgcagactgacatgataacctgcgtggtttatgcgtggtgtttgtcactggcttttgctaatacaagtttctattgtgagctaattacacaaaccctttattcatccccaaattctt

SEQ ID NO: 32621 - DNA, 834 bp, Triticum aestivum
  Clone ID: PAT_TA_32621
cgtccgcaaaaatatcttcctcctctttcctgcgcctccattatcccttgcgtggttttagtctgtgaactcgagagaccgagcgaggaaagttgccgtgtgagacctgagagttagggagatatggctgggattggtcctatcaggcaggactgggagccgatagtggtgcggaagaaggcgcagaacgccgccgacaagaaggacgaaaaggccgtcaacgctgcccgccgctccggcgccgagatcgacaccaccaagaagtacaacgctggaacgaacaaggctgcatctagcggaacttccctcaacaccaagcggctcgacgacgacaccgagaacctttcccatgagcgtgtttcaagtgacctgaagaaaaaccttatgcaagcaaggctggataagaagatgacccaggcacaacttgctcagatgatcaatgagaagccacaggtgatccaggagtacgagtcgggcaaggcgattccgaacaatcagataattggaaagctcgagagggcacttggagctaagctgcgtagcaagaagtaatgccttgaagtagccaagccctgtttacttgccttgcattacatttgctaggtcctaaaagcttttacaggctgttcctgttggttgatactgaataactatgccacggaaccactttatgtatcattatattctcgtgttctaaaatgtgtcagtcatatgtcccagtgtaagagctgcattgagcatgtagattgacatgataacctgcgtggtttatgtgtggtgtttgttactggcttttgctaatacaagtgtgttgtgaggtaattacacgggccg

SEQ ID NO: 32622 - DNA, 3124 bp, Triticum aestivum
  unsure (1)..(3124): unsure at all n locations
  Clone ID: PAT_TA_32622
cccacgcgtccgcggacgcgtgggtgcagaacaaacagataagctaggtagcaagctgctccaaggctccaggacaccatggccacaaaccccggcctcttcagcgagtggccatggaagatgctcggcagcttcaagtacgtggtgctggcgccatgggtggcgcacggcatccaacaggtggcgaccaaggggtggcgcgaggccgatctggggtacctggtgatcctcccgtcgatgattcagcgggggctccacaaccaggcctggatcacggagttcgccgccacagaacgcgcgctcaaagcggtacatgcggatcatgtggcctctgtcctggctctccatggtgctcacgtgggcgtacggttcttggttcaccgttgagaggaatgtcatggagaaactcaaaatccagtcttgggccataccaagatacaatttccattatggattgaactgggagaaggaagcaattaataacctgattgtgaaggcaatatgtgaagctgacaagaagggggctaaagttgttagccttggactcctgaatcaggcccagagcctcaacggaagcggagagctttatctacaaaagtacccaaagttggggttgaaactggtggatggaaccagtctagctgctgcagtggttgtcaatagtattccccatggcgcggaccaagttgttctttcaggaaacatttccaaggtggcctgtgctgtggctgcagctctatgcaagaaaaatatcaaggtgataataacaaacaagcaagactatcatttccttcagcccaaaataccagcttcctgcgcagtcttgattttacacctctgataagtgccgtctggggagttcgtctgggaactcgtgaggcttggagaggaagagtaccgagggaagcatgtggcttggagagatctgagtgggattgggacctatggcggagataggggctgccgaaagtggcgaggaacaaagcgcagaaacggcggcgaacaggacggaccgaaacggccggcaacgctcacaggccgctacggctgccgaccatccgacaccaccccaagcaacttcacaacgaaatggcaacgaataaggacggaatctgctcgccaacgaccctaaattccctcaaccggcgccacgctcgacaccgaagaccctttcccattgtgcctgagtgcgacgtggagctagaagaaaaatcctaacatgcatgggaaacgacaggcagaagaaacgcaagagccagacactaacttgacacatgacccactgcagaagagcaagcggaagcggggaggtgatgcaagtacgggaagtcatgggggcgaagagcccgaacaatcaacgagaaattggtaaggcacgctacgaggggcacatcggaggtaaagcagcgtagcaagcagtgacacctttaaggccaagccctgtctctttgactaacacttcatttgcttggtcctcaaagctgcttataaggctgtatactatagatttgatactaagtatctttaccacagaacgtctttctgtatcattatattcatcagtcattctataaaagtctcatatgaaaatcaaacataagagatgcatagagcctgaagatttacctgctaaccttgcgtggtttgttcgtgctatatcttagtgtatgatcgctcgtgaaacgatctttagcaagttaaccacccatgttcctagcaatggctctagcaagcatcctctttcccgttccaggtgcaccattgaggagaacgcactgtggtggtttaatcccaacacgaagaaacaattctggattcataagaggtaactcgtatggactcccgcagctacccttatttgatccgacagtccacctacagctgagtaactgacattgccggggtcttcgtgtagcatgttatagaccacgggatcaacctcacgtggtagagtgcgcattattgttaatgttgtcatgtcaaggacaactcgtgttgcagctgtcagcttttctttgtcaactttgcttctgcagccaaccacataacgtgggccactactggctttgacgataaatctttcactgtccaatggtcgaagtacttcaccaatgatttggcccacactctgcaaggacttcaaatcatcttcagttttatcgtaatctttctttgccttttttaggttttccctacctgtgcggaccctcgtctccagctcgcggcagttgaggagcttgttgcggtactccgtgatgacggtgcgccggcgggcggcggcggcgtcgtcggcctcggccatatcctcctcggcggcgcggctctgctttgcttccttcccaagatgagcggacctgtgagtgacgaaaaccggcattggcaaggtgtggataatcggagaaggtgcagatgccaccgaacagctcagggcgccgaaaggaacacggttcatcccgtactcacagttcccaccaagaatggcacgcaaggacggctgcacatactcgacgactccggcgatgagcgtgcctaaaacactgcagaatgttcattcgtgcgagaattggctgccaaggtgggtgatgagcgcgtggcgcgtcgcggggatcgttcatgcgttggagggatgggacgagcacgagtgcggggacatggtgctcgacatggacaaagtttggtctgccgcacttctgcacgggtttcgccccgttgctgaggcttgatcgtctggttgcaagtcgagtgaataagcgttacgcagataaggtcatatgctcgctgaagggccatgctgaggaagaagaagcagacttattggctagcagatgagtggcctataattaattaagtactactactagtttgatctactactaccaaagttactaggttagctattactactgcattattcatctcctacgataatgaggtaatgagacttggttcgacctagctatttctagcgccatctgcccttgcgtcaacaacagatgcaattcaacgaagaaacaattgtgggtgagtggttcggcagtgtttcaattgactcagaactgttgtgacacatgtgccgacggtagtacttgacggatgcaaacattaaaaaagnctnaccaattta

SEQ ID NO: 32623 - DNA, 866 bp, Triticum aestivum
  unsure (1)..(866): unsure at all n locations
  Clone ID: PAT_TA_32623
catcatcccaatcgacctctcgcacactccctcgacctcgagaaggtcttcttctccacttccggctccgttccgccgcggtacccgagaacctctcgtcgccgttaggccatcttcgccaccaaaacatcgtaagtagtcgtctagtccaccatgtagtcgatcccgcgcctcaattcgtcaaccggagccctcttcggcgggatccgccaccacccgacgccaccgtccgccggaaacgacctcgccatcattctggtgctcgccagcgacaaccaccaccacccactgatgtggggtgccaccccgagcacatcccagccattgccacctcctgaaacgccggcgatcgccgccggtgaccactgcaccccctccgtacgcgcgcacgatcatgggcttgtccctggcttgttaatttggccagtcctggaggaggacgagcttgtggaggaaggttgcgctagcgagcccgacgcttagagttgttcctggttagtcaaccgtggtcttggagtctaccacatgtatcatccgctgtgctttcgcttcccaaataaaatagtcaagcctcactctgatgcttggctctattttattgtatcggtgttgtactaccatcaaaccactgtcatataccgccaccaccatatattgcaaatttgtaataaatagtggagcaccctggctcaacccgatgtaatattatgtcgtactggttataaatatcaaggaagtccaccagttgttttgacaatggggcggggcccgcttccgactcgcctgtgatgtgtcctggacgcgcgccccgcgcatcgtttaaacncctgacnggaaaacctggcgttaccaacttatcgcctgca

SEQ ID NO: 32624 - DNA, 671 bp, Triticum aestivum
  Clone ID: PAT_TA_32624
gcggggaccagccggagcattattcagtggaagctctcacgctctgcctctgcgtctgcctctctccccacgacgcccgggccggcgacgaagccggagctccactcccgagacgatgtcggccgccgccggcggcagctcctcctcgtcctccactccagcgccgcggttggaaggaaaggttgcgctggttaccggggggggctgcggtatcggcgaagccatcgtccgcctcttcagacagcacggcgccaaggttggcatagcggacatccaggatgaagccgggcagcagctccgcgactccctcggaggcgaccccgatgtcctgttcgtgcactgcgacgtcaccgtggaggaggacataagccgggccgtcgatgcggcggctgggaagtttggcaccctcgacatcatggtcaacaatgccggcattacaggcgacaaggttaccgatatccggaacctcgactttgctgatgtcaagaaggtgttcgacatcaacgtgcacgggatgctgctgggcatgaagcacgcggcgcgtgtcatgatcccgagcaagaaggggtccattgtctcgttggcgagcgttgccagtgtcatcggagggatggggcctgacgcatacaccggggggaagcacgcaagggagggactgaccaagagtgagg

SEQ ID NO: 32625 - DNA, 801 bp, Triticum aestivum
  unsure (1)..(801): unsure at all n locations
  Clone ID: PAT_TA_32625
ataaaacagagcaccaccgccacctccactctccaaacgatctctcccctccgccgctcgcccgaataaaaaccccaggccggcattgacgcatccagcgcaccgccaatccgctattgctaagcagcacagttaagctaccggcgtacaccccagggctcaggcaggcaaggcagctccgacttccggcaagacattatcaaggagttcttcgtcttcctccgtcctcccatccatcgtgcatgaaagccggcacagctatagcagcactcgtccattggtgctcgttcttgcgatcaagcgatcggtcgatgacgcttgacggcggcatgccagccaccaccgacggcgccggcgtgcccccggccgcagagaggggcggcagcggctgcggtgcccgcgtggcgccggaggtggtggtggagcgggatggcggtagcggtgccggcgctacaatccctgcgacggagagggctgccgccgtggcgatccctgcgatggagagggacggcggcggctctgccggcgtggcgccgactgaggcggagagcgacggcggcgggaggagctgcggcgagcactgcgtcatccaggtggtggaggagtcgtgctgcgcgcggtgcgtgtgcgtgggcccgaacccgatgatggcgcggtacgtgtacgcgctcatcttcctggtgaccaacctgctggcctggacggtccgcgactacggccactcggtgctgggcgagnctccgcggctcaagggctgccagggcgcgcgctactgcctgggcgcccgaggcgtgctgcgca

SEQ ID NO: 32626 - DNA, 1089 bp, Triticum aestivum
  unsure (1)..(1089): unsure at all n locations
  Clone ID: PAT_TA_32626
cccacgcgtccgccgttccccacttctctgcttgatctggcacagcacctcaccacatcgtctcttccctgctcatggcgtcgtcttcaagggaggcggggggtgccccgcatctccgcacggcccccgccgctgctgcacgccccaggggcgccggtgaggccgagggccgccggcgaccacgcgccccggacggctgcgcggttttgcgccatggccgcggcgaactgccgcagtatccgacgcgcctccggtgggggcgtgggagagaggggtggtgtcgccggtgatgaaggaggcggcggcggcgttgacgacgagccctgtccttccatctcctcttcttcttccttgatggccatgttcagatcggggacggtggagtaggcgtggacttccactgctgccggcgtcggagacgggagatccgggacaggaccgtatccaggagggaagaagtgctccggcagttcatccgacggcgtcggtgacggcagccgcggttgtgcgcccgtacgcgctgggcacggtccaaactcgtgctgcaggcagtacgggggcagtggtggcggcgcgagttcacaagggaacatctcctcttctccgagaaacggcgccgatggccctgcaagcaaccactccatcggagggatggagaagacagttggtgtagtcgcgtgtccgacgtactcgttggcgactgccggagccgaaggcccggcctggtgcattgcaggtatctctccatttgcagtagtggccgtggcggaaggcccagcctggtgcacagggtggttgccatggcgtgcatatccacggcggcggttctggcggtggttccaggcgaagaagcggcgacgtgggccgctccttacaccaaggccatgacggcgacggntctggcggtggttccaggcgaagaagcggcgacgtgggccgctccttacacaaggccatgacggcgacgtgcggcacggtggcgaggagtgcgggaaacgcgacggctctctccttggataaagcgagcgaaagcgaaagccgcagatgacaggtttctccctgccatgacctaccttttcttttccttcc

SEQ ID NO: 32627 - DNA, 659 bp, Triticum aestivum
  Clone ID: PAT_TA_32627
gcgccgcctctgcgctcaccgcccagcgccccacccgggaacccacgcgtccggcgagcaccaccggcatccaggcggcggctaacggcaagcggcgaacgtaggcagtttcatgatgggtactgaggactctaaagatatgctgaagaatgcggactggaaaacagtgagtggtccagtgattactgagtcaagccagccaattgttaagaagcgtcttccaaagaaaatcagacaagtccccgagtgttactttctgccccggcgatctctaccttctgcattggcaatctatggtgctgtttgtgccgctggagttggtgcaggaatgttgcttgaggtttggataaacaaaaagatcaaagaggatggtggcgttgtctgggagatgggcaaatgatgctcatgcaccttgagttggtaacaatctgttttgggatacccactcggcttcagttatgctgcttaagctataccgcagaaataagcgtagatttgttgtttcagactatctgttgagattgtgacaaaagtaaagaatgttttcctgtgtatttgtcacaaccttgcccctgtgtttctgacttggttgtacaagctgtgtgatgcttcaaactttatacttaggagatgtttggtgatccaaaaacacaaaaccc

SEQ ID NO: 32628 - DNA, 1290 bp, Triticum aestivum
  Clone ID: PAT_TA_32628
gaacaaaccatgcagaatagcaacgtcgcaacacagcaaccagagatgaatatgcttgatgcagataccaattttcccaagtgcaatgctagtgattgttcgactcaaaaagaagcacctgaaaagagcactagcctgaactacatgttgttatcagctagattggcaagagcacttgaaacgacagaacatggtaaacacagcagacaatctgtacaacagcaaccttacattaggcagttactcaagtggcaaggaaaatctgcctcccaaaaggcttgtacgcccaagcaagtatcaatgctcacctttcgataacgatctgagaggccctctcacgccatctgagaagcagctacacagcaacattgtggcactaggcaaaattgaacctgatagaagggcagtgttggtcgataaaaccagtctatcccttggacaactcggcaattcattcgacaccaacggacatgtggaagcttatgttttcaatgttttctgccggttgctctttcgtgataaccatccaaggcaatcaaagaagcactacttcttcactactatcgctgattattttcttcaagcatggactactgaagaaggaaggatattaatgagaaggagagcacttataagttttagtggagcaggaacaacattgcctctacatgaaagtgaacgtctgttttttttccatcagtacatcacgagcactggatattgtttattgttgatattgttgcaagaaaattcattttcctagattcagtttattatggcgagtcaccctttcacatggaggtaaaagatttgatgataaacaattttatcaaaacatgggaagagtcgagactcgggagaatggggttcagaaactttggtatagaatacccaaacatgcctaagcaaattggaagagatgcttgcgggatttttgtgctcaagtggatgcaaacttttgcttcgcggaatcctctccagccccaattcaggatgaaggacgtggcagatgcaagggtcagacttgctgttgatatcctcttcagcaatcataacactgatgatgatgccaaaagacttgtcaagtactttcgtcaataaactgggagttgaggacagcattgatctacaaggggggaggggcaaaaagaatgaagaactaaataaatactctagattttttagatgtctttctctttttttgtacatgttttttgtgttcgctcgatgagtatcttgggaaaatcaacggatataccaaagtaatgcaaagaattttttgttcggatg

SEQ ID NO: 32629 - DNA, 792 bp, Triticum aestivum
  Clone ID: PAT_TA_32629
agatgtttgggccagcatgggccaaaaggaggaagctgaatataggaaaaaagtattccaaggattcatggtggatgaagccctgatggagatggctggtccaaaagccttccttatgcattgtttgcctgcggagagaggggtagaggtaacggacggtgccatcgaggcgcccaattcgatcgtattcccccaggcagagaacagaatgcacgcccaaaatgcaatcatgcttcatatgctcggagcttgattaccctatcattgtatgctagactgctcagtgtcacatcattatcgaaattgaacattattactggatactaggttcctttggcatactgtaacccttggaggagggtttcgtgagggtagagattttggaacatgtctagattactttggattgtcgcagagcatgcggtactgtgtcaggtctggttaatctaacataaatttgctacatggctttccatgtggtcgtattcccccaggcagagaacagaatgcacgcgcagaacgcaatcatgcttcatgtacttggagcttgattaccctatcattgtatgctagactgcttagtgtcacatcgttatcgaaattgaacagtattactggataccatgctccttcggcatactgtaacccttggaggagggtttcgtgagggtagagattttggaacatgtctagattactttggattgtcgcgagcatgcggtactgtgtcaggtctggtaatcttgaataaatatgatacatgcatttcaaaaaaaaaaaaaaaggccccta

SEQ ID NO: 32630 - DNA, 1155 bp, Triticum aestivum
  Clone ID: PAT_TA_32630
caaatccccaacccgaataagatcagagcgcccaactctgacaaagagcggtcgagcagaggatgacttcgccgagcctcacgacgtgccggcatgctgcagctcgtccgcgtgcaagcagggtcactggccgcagcggcgtcagggcggcaccgctccgatcaagatcaggaaatggttttgcaccgagcgtctcgtggtcgtcgccgtcgccgtcgagagcgatcaccagttgcgctctgaagcccccgccatcgtacggcggcaaggcgacggagaagaagaaggtcaaccccagggatctcttcaccttctcctaccggttcaacaccgacatccccatgggtgagactccaggggcgtccatcgacgactacctcatgaacaggccgaggatcgtcggggccgtgttcccggacaagcgcaagcgcaccaaactcaacgacgaggagtggagagtgcagctggtgccgatccagttcctgttcctgtcggcgtgcccggtgatcgccgtccgcttcgtgagcaggtccggcggggtggggtacccgccccacgtccccgtgcacgccaccagcctcctcctcatggaagtgacggactacaagctgaaggggctgcagagggacgcgatgccgtcgcacctggcgctgacggtgcggggctcgctgtacccgcagccggaggggcggaggagcctgcggggccacgtggagatgagcgtggggttcaacctgccgccggtgctggcgctcgtgccggagcccatcatccggggcgtcggcgacaccgtgctccggcagctcgcggagcagatgaagcacgacttcgataccggcctcgccgccgacttcaagaagtaccgcaccgagaagctcaccgaggggaggacccccgaacactgaaccacattttccttctcttttttctggtggcgttggctgctgcccggtaacagtaactattcatggaagattctttcgaacttgtcgcacgaccaataataagttgctaatgtatcgtgttattcgtcagtgcgtcgacatgactgacaagacagtaacttaggactcaatagttgtaaatactgtaaattatggatacaagaaaattcagttatacagagactgctaatctcaggataacttccgtgtc

SEQ ID NO: 32631 - DNA, 790 bp, Triticum aestivum
  Clone ID: PAT_TA_32631
tccgccacgcgtccgcccacgcgtccgcccacgcgtccgcgaaaaaactacagagcctcaagctgtatggtaacctggtgaaattgcccgactggatggaggcgctccggaatctcgtgaagatggagctgcggagcagcaggatattggaggttgatgcggccatgcaggtcctcggcaatttaccaaacctggccatactgcgtctgctgaggcactcattcactggtgaagagcttcgtttcagtctcaatcgggacgcggcattcccgagtctgacggtgctggagctcagcctcctagacaagctcgaatcggtggagttccaaggaggggcagccccaaagattgagctgctgcagtttcgtggctggcgttacaaagccaacacggtgttgtttgcagggcttccttctctcccgagcctcaaggaagttttgctcaagggtcgctatgaggatggcttcgtggatgacttgcgggcccggcttgcgggtaatccaaacagacctgttttgaagctcaactgaattgtttcagactgcgtattccagattcgatcgataaaccctcccctagtagtatacatatatctgtgaacgtcaaaagcttcagtgatgatttatacgtgtacccgtaattggtcatagtagtataatcataagctgtttggtttttatttctacggcaaaaaaaactggtcctctttccgatccatattacttgttttaaatttgtctggatccggaagtcatcatttagaagaatccagtttggccattttgctccc

SEQ ID NO: 32632 - DNA, 904 bp, Triticum aestivum
  Clone ID: PAT_TA_32632
gcaatccaagcccgcagcttaagggggaggcagcggagcacaatccagtccaatccgatcaccacccgagtagaccagaccagagcggagcggccgggaggaggaggaggtttagctagggttctcgccggcggtccatcgatcggctcatcgatgcggaggttccaggagtccgtcaaggccctcgaggccgacatccagcacgccaatgcgctggcgtcggagttcatgagggactacgacgggtcggtcatccagatgcggatggcctacagcgccgtagcgcatgtcctcgtccagtggaccgactgccgactcgccagcgcgctcggcctcctcaagattatgatttacaaggtgtacgcggaggatggcacgacgaccttgccaagttgggagagggaggccagcatcagagaattctacggtgttatattcccgtcgttgcttcagctgccaagcgggatcactgaactggacgacaggaagcaaaggaggctgtgcgtggacaagttcaagagaagggatggcgatttctctcagctggatttggagagggaggtcgagtgtgggatttgtctcgaggtgaacgctaaaatcgtgctgcccgactgtacgcactccttgtgcttgaggtgcttcgaagaatggaatgctaaatcaaagtcgtgccccttttgccgcgcctgtctccaaaaggtgaagccgagcagtctgtgggtgtacaccgatgatcgtgatgttgtagacatggatgcattgacgagtgaaaacattaggagattgttgatgtacataaataagctgccacttgtagtcctccatgttgttgaccttgacatttatgagtaccatagcaaatagaatgccttgttcacaaaaaaaaaaaagcacagcaaccatt

SEQ ID NO: 32633 - DNA, 1089 bp, Triticum aestivum
  Clone ID: PAT_TA_32633
ccggcaccaggtagaagtagtagaagagttaattcgtcgtcgcaggggtggcccgtgcgggcccctcggggctgacgcaaggtggtgccttggtgctgaactctggacgcccaaggtcaaggtacactcctcggcctcctgttcgtcgcaagcagcggctactgctacaagacacgccggccgccggtgctcctccggctgaggccccggcggcggcggccggcgaaggccaggccggcaagggcccaggagccagcagagggaggggtgcgccagcgcgctggagccgccggtgcgcggcgggcgccgccgcgcggtcgtcgccgccccccgccgcgtccgcctccgcggcctccgcctcccccccccccgccccgtggacgtgtgcctcatggacatcacggggagcgtggtgctccaggtcctcaagaagttccggggggcggggggctccaggtcctcaagaagttctaggaggtgggaggggtacaggtgcggcgggtgggaggagcccgagcgcggcgacgcgccgcgggggcagagggcgccgtggttcacggtggtgagcaacaagtggggccgcgggccgcgctgcgagttcaggagcgacggccaggcggtgcgctacaagatggacggcggcaggcggcggcagcaggcggcgcgcgcctcgtggatcgtggacgacgccaccgggctggcggtggcggaggtgaagaggaagctgacggcgacgggggtgtccctgggcgaggacgtgctgacgctggtggtggagcccaacgtggaccactcgctcatcatggggctccttgtggtgcatggcctcataaaccactccatgtgagcatcgcatcgtacgtgcagcagggacagggtgtaattatcttgttagatgcatgctcagatgcatccagcagatcagtgtaatttctttctttgcactgctgtttcctccttctttctttccttcttttttccaataaggtttctccttaccttggaaaaccttgtggcgtgattatacagtatttgtttaggcaggacgaccgcctatccatttagcaaagaataatttatgttcacaaa

SEQ ID NO: 32634 - DNA, 910 bp, Triticum aestivum
  Clone ID: PAT_TA_32634
gggaccttcttccccgcgccgccacctcccgtctcaacagtgattactgatgggaaatcccctcctatacacccatagaatctgagcaccaacaaacaatatttttcttggattcctctgatccaaacatgaagatgcaccgcgcatgcaaaatctgtggagaaataggacacaccgataaggaacaccaggatggatgcccctattgtgaagcgagccacttgggtgaagaatgtcccactacgcaaggtcacctgtttcatgtgtgaagggactaaccacaatccagcccagtgtcgtctactcaccacgacacaagtggttcagcaacagaggaaaggaatgaaggaagctatccaggaattcatggcagcacccatgaagaaaaggaagaagaggcgctacgccaagaagtgtagaacaaggggcactgtgccaacgcgtgtccagaactgaaaggagagagaaagatgggggcgctactccagcccttgtccagaattgaaaagagggagagggagatgggaaccttggagcaaagaagccccatgacttgtcaggagtagtttgtttgatactcttcctttctgtatcgacccattcaccgcactattccaggggagccaatgttagtaattggaggacagctatctgaggcaagcaataagtgtattaggaaactttttacgttatcttggagatgctgggttgatacgtgcaatgtcaatggaagaggctatacgtttcctgtgttgtaattgctatttcttttgtgagcagaatatgactaatgggtccttgcgcggtgctttgctggtatgtcaatgtactgggttttttgtatttggcgtaaacttgtatgcactgggcgcttcgcttgtacatcgtgctggaatatgtggggttttac

SEQ ID NO: 32635 - DNA, 790 bp, Triticum aestivum
  Clone ID: PAT_TA_32635
catggatcttgttggggatcagcctatctgtgcttgcactgcctgggcatgtatgatgaaatcagaaatatttgagtttcttaaagatggatttcatgaagtcagcaataccctcgatttatcctttgatgatgactctgttgctgtcgaacaaattcccttcctagcaacctagctagttttttgaaagagaataagtccaattcctgtgagccaccagctagatgtctaaacgatttatgaagagctaccaccacattcctctaactcctgataatgttgttgtgttcccttctcgtgctgtggcaatagaaaatgctcttcaattgttctcaccggcgctcgcaattgttgatgaacatttgaccagacacttgcccaagcaatggttaacatctttagcaattgaggctagaacagagtacagttactgtgattgaggcaccacgccagtcagatttactgattgagttgatcaggaagccaaagcctcaagttgttgttactgggatggctcaatttgaggctatcacaagtgctgcttttgagaacttactaaatgcaacaaaagatgttgtctccctggttattcctggatatttcagagcatctagagttgtctagtctgccaagctctaatggtgtatttaaatatcttgctggaaagaccctaccttcccatgcagctatactgtgtggtttagtaaagaaaccagtttattccgatctgaagtttcttttgccatatctgaagatgcagctgtatataaagcattgtcacaaactattg

SEQ ID NO: 32636 - DNA, 690 bp, Triticum aestivum
  Clone ID: PAT_TA_32636
cccacgcgtccgatgatgatgactcaagtggccaaccacagcaagaggaaccacaccgacggctacttcagcgggcgctgcagcagctcgtgtcgccatttgggaagacggacacggcttctgttcttcaggaggcgtcgggctacatcaagttcctgcaccagcagctcgaggttcttagctccccgtacatgcgccctcctccggcgcccggcgccgagcctgaggaccccgagcactacagcctgcggaaccgcggcctgtgcctggtgccggtggagcagacgctgcagctgacccagagcaacggggccgacctctgggcgccggcgaacaccagcaggcgcacctgaagcgaagcccgaggcaggcctcgacggcggcgatggccgcactgcgtggcaggggtagaattccggtgcaagcgcgcgcatgcgcatggctgacccaattcggtcaatctcctaacacaatcgtttcgtttcgtttcgtttccgtgaacctcaatcagcagaccctgtgctggcgccggtagtatgtaatgtgtaatcgtcgtgtatagcgagacgacgcaccgccgatcgatcgatcgtggtcgagtcgttgcgtcagtgactatgtgcatgtggtttaacatggtagcgacctgttgctgtcgccgactaatcatcaaaatcagcagttccattc

SEQ ID NO: 32637 - DNA, 1224 bp, Triticum aestivum
  Clone ID: PAT_TA_32637
ccgctccctccccgcgaccctcttccttttcccttccaaacgcgctggtcctgtccagtcccctcaggtccccgggcagccccgcgcttccccccccttccttaaaccccccacaagccttgttcctttcccttgtctcgagctactcttgcagtcccgctcctcttctccaggcctctccggctccaaacacagacgagtaggagcgccggagctagctgccgtcgcggcgcgccattgccagtggagtcgagtatcggagcaagataagtggagctagagcttccgccccctctcggcgttgctgatcaaactgcctctgcagcagggaaaaaggagcgacagcaccagcagccagcagcagtagcgggagaggaagatgatgatgactcaagtggccaatcacagcaagaggaaccacaccgacagctacttcagcgggaagcagcagcagcaggccgtcgccaccaccgccaccagcagcggctcggaggagttcgcgggcatggggtccaagaagccgaggaacgccagccccaggggcggcggccccatttctcccagggagaagaaagacaaggtcggcgagagagtggcggcgctgcagcagctcgtgtcgccatttgggaagacggacacagcttctgttcttcaggaggcctcgggctacatcaagttcttgcaccagcagctcgaggttcttagctccccgtacatgcgccctcctccggcgcccggcgccgagcctgaggatcccgaccactacagcctgcggaaccgcggcctgtgcctggtgccggtggagcagacgctgcagctgacccagagcaacggggccgacctctgggcgccggcgaacaccaccaggcgctgctgaagcgaagcccgaggctggcctcgacggcggcgatggccgcactgcgtggcaggggtagaattccggtacaagcgcgcgcatggctgacccaattcggtcaatctctaacacaatcgtttcgtttcgtttggtttcgtttctgtgaacatcctcagcagaccctgtgctggcgccggtagtatgtaatgtgtaatcgtcgtgtatagcgagacgacgcaccgccgaccgatcggtcgatcggtccccgtggtcgttgcgtgggtgactgtggttaacatggtagcgtcctgttgctgtcaccggctaatcatcaaaatcagcagttccattcatgcccgtccgtgctc

SEQ ID NO: 32638 - DNA, 882 bp, Triticum aestivum
  unsure (1)..(882): unsure at all n locations
  Clone ID: PAT_TA_32638
ggtaggattattcaagagataattcagtacatagggatcaccagctaattttcttttccaaaccatggcagccaatttccttaacactatgctttcaagtttccactgaatgttgtacaagtttactggctactgcagagccctatagctcaaagagagagccttcatttcttttcactgatgtctccttgacagtcctactcaagagctggtgctacctcagttggattaccttcaaacacatcggcgccagatgattctgactcttcggggaactcctgggcttgggttgattccttaaaagcaggagtgtctctgaagtctgatgccccatcgttatatgtagccacggcaacgccgcaagcaaccaaggagaagaagacgccgaaggcccacatgtactgcacgaagaagccgaggacctccatgttgggcccctcccagaagtcgggcttctccgggtccggcaggtacggcatgggctccgtcgacacctcgaaccccagcggctccccctcccactccacgccctcccacgccgggccggtgtcctcgtccgcgtcgggggtctcgacgccgccgcggcgcttcttgccgccgcgctcctcgaggcgccgctgcgtgcgggacgagacgccggcccggcgcgcgagcgccacgtgcagcgccgcgcggcggcccaggagtgggaggcgatggcgggcggcggtggccgcgccgaacggcgtgggggagctgaggagagacatgcggcctggagctggacgcggaagtggctctgcgcgactgtgcgcgcgcggggatgtgaggtgctgaccgcgagccgagagaggtcacgtggagagccttttttccgcgaaccggccgnngcctcgagcggcc

SEQ ID NO: 32639 - DNA, 3002 bp, Triticum aestivum
  Clone ID: PAT_TA_32639
gcgacttccgctatcgactccacactccaacctggttgtgcgatgccgctcctcattccttctcctcatgctgctcaccgccggcgcggcgggggcagagtcggcgaccccctcgccgcacataggcctcaaatacggcgacaacaccgacaccctcccctacccgaccttcgtcgccaccttcctccccacctagtaccaccatcgaccgcgtcaaggctcttcgacgccaacccccaacttcatctccgccttcgccggctcccccgtctctttcgccgtctcccttccccaagtccgccctcctggcccccgccgacaaagcctcccgcctcgacgccgcgcgctcctggatccgcgccaccctctccccctacgtacccgccaccaacgacaccctcctcctcgccggcaacgagatcctcctctccaccgacaccaaccgcatcctctcccgcctccccgccatgcgccgcgtcgcgcaggccctcaagcccgagggcctcaccggcgtccgcgtcggcaccccgcactaccccggcatcctcgccccatctgacggcatcccctccaacgcctcctcccgagcggcctacagcaccaagctgattctgcctgtggcgcagttgccagcaagcccccgaagcgcgccacacgcgtgcgtcagcccccacagttcgcagactcatgcctgccacgcgactacccgctgctccccccccaaaggccgcacccacttggcgtgcgacttcaagggaaccggcgtcgtcacctccagcgaccccagttacggagtctgtaaggacgtctcctagctcgacgcaggaggccacgacaggaccggggcaggggccccagcccccagcccactaccgtctccagctcgtagccgcggtggggggagcgacagaggcctgctcatactgccgagcttgcggcatatccttctaaactggactctgacggccacgctgcttccgcccttctagtcatataaatatcaatcaccgccagttcgcttagcgcggacaggccgctgtagggtgctgttgccccgtcttgccttgcaccgcattagtttattttccgtgaccgcccccgcacggcgtcgcactcgctgcacaacatccaccaaacctaccgcgcaatccgcgccctgcccctgcggcgtcgcgaggcgggaagcggtccgtcgcgacggacggcgcaaacgggacggaccttgagaacaacatcacctacgcctgcggcttcgtagactgcaagcccatacagagcggcggcgcgtgcttcagccccaacagcctgcaggcccatgcgtcgtacgtgatgaacgcctactaccaggccaacggccacaccgacttagcgtgcgacttcaagggcaccggcatcgtcacctccagcgaccccagttacgggggttgcaagtacgtctcctgacggtacgcagcaagccacggcagtacgagggcaggggggccagcctccagcccactaccatctccagctcggagccgcggtggcggcagcgacggaggactgctcatactgccgggcttgcgccatattcttctatactcgtgtctgacagccatgctgcttcttcctttctagtcatataaatatcaatcatcgcctcttagcttagcgcacacaggcggctgtagcgtgatgttgggccgtcttgcattgcatcgcattaatttatttttccgttctcttcgagagacgaatggttgcaatatcaagtgctgccctcccacccagaggtgctcccgagttgtcatcagcagtaccagcagataatttatccatgctagaaccaaatccggaaagagaaaagtttgttccaatcctggcaagagtagcccttaaagaagcttcgaaaactgaggtcctgctagttaagcaatcggcaactgtaagaacctgcaaagcaccctggacaattgaccattcttcctcttcagacacatccaccagtcgcggtgcttcctttttctctaaccctgcatcttttttcgaggcatcagtatgtgtggtattatccaacccacatacctcgtgcagggacttcaaagtttcttgtagattagatatgtattgcagcatgacatcatcaagagccagtaccagttcatctgcctctgatccaccagtgagactaatgcatctctcaacagctgcttcaagaagtactatcatctgtgggatggattcctccatcctacggacagtttcacttagctctataccttgtgcacctaaaccacgggagatggctccacggatatctataccggccatcgcagcagaaagcacagcgcgctccatctgcccatacctcatcttaaaggtttcatatggggaataaatagctttcaatgtactcagcacaactccaagatctgattctgaaaataagtgctgaatgttccgagcaaaagtgccagtcatgttgtgcaattcgattagtgcagcaagatgtttattctgcaatttgatgctttttggcaagtcacctgatataacatccagtacaccttttgcaacagatctggtttcaggaacagcatccccagttgctacattaacacgagagacaaagcttgaattcagctcactcatggtctccacaagtacttttgggaccagtgatctgtattcttcagggaatgcagtcaagcaccacttccattcttgttcaaggtaaagtagtgtctcatcatagaaacttggcagccagcttgagaatgagacactagtgatttcaccaccacgcttctccacctctgccctgctggccctttgctttaggtcaaaatcttcccagagtttcttcagaggcttgatatgaatcttagtgtattgcacctctagtgacttgaacctcccaatacgtgtcaatataccacgaagatcttgcacggcatcaatcttgcggttagaaagggcatccaataaacggggctgaaccatttcgtccgccttttcctgtc

SEQ ID NO: 32640 - DNA, 704 bp, Triticum aestivum
  Clone ID: PAT_TA_32640
ccttggtaaatatttcttttcggagtgagaatatacaatcaactcaactccaaaagaattagtttttatctgcaacggccacaaagcaaaattggccttatatacaaagaggaacacgttcggctctttcctttctctcccactctcttttacctccaacttgggcaaaaaacgagcgactgaccaacacttcttgatcgtcatcatcatcatcatcatcatcatccgtccatgcgtcgtgtaagcgaagtagcgtcatgtcaagctccctacttctctcttttctttcttgaagattagctgttcttcagtaggtaattagcacgagcgagaataaaacgttcgctcacgcacacgtggacgaggaccccacctgcctccgcttccacacgatcggagcgacgatcatccatatgtacgtgatcgccgccagccactcgttgccgacgcgcacccacgtgctcgcccagcccacgtcgatcgtccacctgaggatgaaatcagacaacgcgttaatcaattactcaatgttctcagatcaggaacattctgatcttgcagtcagtcagttcagtctgtcagcgtgttttttctctgtctgatcgtccacctggggatcagactggccgcgcactaatcaaccatcagtgttctcacatcgggaacatctagcgaccaaagtctgaacgttctgactgcaatct

SEQ ID NO: 32641 - DNA, 564 bp, Triticum aestivum
  unsure (1)..(564): unsure at all n locations
  Clone ID: PAT_TA_32641
cccacgcgtccgtcctccaacaccatggcccccactgtgatggcttcctcggccacctccgtcgcacccttccagggtctcaagtcgaccgccggcctgcccgtcagccgccgctccagcagcgccggcctcagcagcgtcagcaacggcggaaggatcaggtgcatgcaggtgtggccgattgagggcatcaagaagttcgagactctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctacgccaggtgcaagtgcgtcagctttattggcttcaggccacccgggttggagggntctnggaagggcctaaactacgagtt

SEQ ID NO: 32642 - DNA, 721 bp, Triticum aestivum
  unsure (1)..(721): unsure at all n locations
  Clone ID: PAT_TA_32642
gccggccgggtcccgacaccacatcccaaccagcagcgatccatccatcctccacaatcagagcaagcgagcgaccaagaaaccatcacagcgaccatcatcttctctgcctccatggcggcgcaccagcagcagcaaccgcagcaggcggtggggttcgaggactacctgccggtgatggcggagcggctgggggaggagggcctgatggaggagctggcggcggggttccgcctgctcatggacccggcgtcgggcctcatcaccttccacagcctccgccgcaacgcgccgctgctgggcctgggcgccatgtccgacgacgacctccgcgggatgctcgccgagggcgacttcgacggcgacggcgcgctgtcccagatggagttctgcgtcctcatggtcaggctcagccccgacctcatggaccagccccgccggtggctcgacgacgccgtcgcccaggcctcccacttcctcttcaccagctaggcggagcatctggtgtcgatcggataggaaattaatcttcttcttcgttgttgttttttcttctctcccccgctgttcatagagtcaggattcaagaaaagaaagggcactgtcgattggttgaaagattaagatgtgtgctctcccgctctctgatgtttcccatgggaatctgaattaatcgacataagcttctanattttaaaaaaaaaaaaaaaaaagcccctan

SEQ ID NO: 32643 - DNA, 775 bp, Triticum aestivum
  unsure (1)..(775): unsure at all n locations
  Clone ID: PAT_TA_32643
ccttacatattcgctcggcctcgcaccaaagataacgcctgtcgttaatacagcctttgcctctctaagccggccgggggcaacccaacaagcagagcaagcaagcaagaaaccttcacagcatccaagcaagcagcagacagtgatcatcatccatggcggcgcaccagcagcaaccgcagtcgcagtcgcagcagcaggcggtggggttcgaggactacctgccggtgatggcggagcggctgggggaggaggggctgatggaggagctggcggcggggttccggctgctcatggacccggcgtcgggcctcatcaccttcgacagcctccgccgcaacgcgccgctgctgggcctcgggggcatgtccgacgacgacctccgcgggatgctcgccgagggcgacttcgacggcgacggcgcgctctcccagatggagttctgcgtcctcatggtcaggctcagccccgacctcatggacgagccccgcaggtggctcgacgacgccgtcgcgcaggcatcccacttcctcttcaccagctaggctgctgctgtcgatccgataggaaaattaatcttcttcttccttgtcgtttcttcttctctcccccgctgttcatagagtcaggattcaagaaaagaaaaggcactgtcgattggttgaatgatctccatgtgtactgccgttcccgcacgggaatctctctgaattaatcgacataagcttctaccgtttcaaaaacaaaaaaaaaaaaaaacccctgagnaccattt

SEQ ID NO: 32644 - DNA, 632 bp, Triticum aestivum
  Clone ID: PAT_TA_32644
gtcgtcggccgcgaagacgacgcgcccggccccggcgccagccgcaagcgccgccgcgaggaggacaaaggtgatgatggagaagatattgactcatctcgtactgtgacgagtacaccggttttgcgagttgagactatttatgtcagcgcggcgattcttgctgcaaaaagtagtttcttttacaagcttttctcaaatggcatgaaagaatctggccagaggcaggcaacagtcagaattgctgattcagaggagaaagccttcatggagctgttacgctttatgtatagtggaaagttgacagcaacaactgagcccattcctctggttgatatattgatggctgctgacaaatttgaggtcgtttcctgcatgaagcgttgcattcagcgtctcatggtcctgcctatgactccagaatctgcactgatgtgccttgatctcccatgttccatttcaatggcagcagacctgacagaggcagccaagaaattccttgccgaaaggtacatggaattcctctcgacacagttccaagatgaacttatgagaatgcctcctgctgggattgaggccatcttatcaaggaatgacttccggggttgcttctgagggagcttgctatgact

SEQ ID NO: 32645 - DNA, 1058 bp, Triticum aestivum
  unsure (1)..(1058): unsure at all n locations
  Clone ID: PAT_TA_32645
gcagtccctttcccttctccctacgcctccagcccatctagctcgctcggattacggccgtcggcggcggcgcttccagaggtgagcggcatggcgggggcgggggcggaggaggcggtggtgggcgagagcttcgagttcgcctttgacaaggaggccttctccgacaagaagctgcgggtcgaggtcgtcggcagcgacgacgccgccacccgcaagcgccgccgcgaggacgacaaaagtgatgaaggagaatgtgtcgattcttcttctatagtgatggctgcaccaattttacgagttactaccatgaatatcaattcggcgattcttgctgtaaaaagtcctttctttttcaagcttttctcaaacggcatgaaagagtctgacaagggacaggcaacacttcgaatcgctgattcagaggaaaatgccttcatggagcttntgtactttatgtatagtggaaagttgactccaacaactgagcccactcatctggttgatatcttgatgggcgctgacaaatttgagggcgtttcttgcattaagctttgcggtcagcagctcacaagcttgcctatgaccccaggatctgcagtgctgtgcctagatctaccatactccatttcaatggcacctggcctggcaggcctactcaagaaattctttgctgaaagatacaaggatttcctgtcaacaaagttacaagcccaactgatgaggatccctctcgcagggatcctagccatcttatcaaggaatgccctcggagttttacctgaaaaaaccgtctatgactttgtgctcaggtgggctgatttccagtacccaaatccaaaagaaaaacgcaagatcttgagttcacagttacttcccctagtaccactagtgcgaagtagagtcagaaccattgtacttgattagccgtcttgcataatcaacttcagtctagagttgattatcttgtatgtgatagaccctgtagggctgtaggctggtgaaatacatagtctggtttgtgtgactagtgtaccgtgtttgtcctgctatgcagc

SEQ ID NO: 32646 - DNA, 1276 bp, Triticum aestivum
  Clone ID: PAT_TA_32646
ccagcccagtccgcaccaggccctttccctgctccccacccctccagcccatctagctcgctcggattacggccgtcggcgtcgctcgttccagaggtgagcggcatggcgggggcgggggcggaggaggcggtggtgggcgagagcttcgagttcgcctttgacaaggaggccttctccgacaagaagctgcgggtcgaggtcgtcggcagcgacgacgccgccagccgcaagcgccgccgcgaggacgacaaaagcgatgaaggagaagtgtgtcgattcttcttctataaatgtgatggctaccaattttacgagtcactaccaccaattttcggtcacttccatgcatatcaattcggcgattcttgctgcaaaaagtcctttctttttcaagcttttccatgaaagagtctgacaagggacaggcaacacttcgaatcgctgattcagaggaaaatgccttcatggagcttttgtactttatgtatagtggaaagcttgactccaactggaaactccactcatctggttgatatcttgatgtggccgctgacatttgaggtcgtttcttgcattaagctttgcggtcagttgctcacaagcttgcctatgaccccagaatctgcagtgctgtgcctagatctaccatattccatttcaatggcacctgccctggcagaggcagccaagaaattctttgctgaaagatacaaggatttcttgtcaacaaagttacaagacgaactgatgaggatccctcttgcagggatcgtagccatcttatcaaggaatgaccccggggttttacctgaagaagccgtctatgactttgtgctcaggtgggctgattcgcagtacccaaatccagaagaaagacgcaagatcttgagttcacagttacttccactagtaccactagtgcgaagtagggtcagaaccattgtactcgattagccgtcttgtataatcaacttcagtctagagttgattatcttgtgtgtgatagaccctgtagggctgtaggctggtgagatacatagtactgcttaagggtagttatgtgtgattcgtgtaccgtgttgttgccggttatgagctgttatgtttgcttgtttgtcctgctatgctgcaaagtcgctgaactgttaacgtctttgtcggaagttggctgatacctctgtaaatcgacggagtgtaatccttagaatctatattaggttattcatgataatctctggacattttagtacataaaaaaaaaaaaaaaaccaca

SEQ ID NO: 32647 - DNA, 731 bp, Triticum aestivum
  Clone ID: PAT_TA_32647
ccccggccggcccccccgcccacgaactctctcacgtcacacacgcctcctcctcctcctcctgcgactgcgagccagccactgggagagcccgcggaagcacagagcgggaggagggatcgcgagatggagtgcaaggatgtcgggatcctcgccatggacatgtatttccctcccacctgcgtccagcaggaagcgctggaggttcatgacggagccagcaaggggaagtacacaattggtcttgggcaagattgcatggccttctgcagcgaggtagaagatgtcatctcgatgagcttgacagttgtcaaatccctgctggagaagtaccacatagatccgaagctaattggccgcctggaggttggtagcgagacagtgatagacaaaagtaaatccatcaaaacatggctgatgcaaatttttgaggaaagtggtaatactgacattgagggagttgactcaagtaacgcatgttatggtgggacagctgccctgttgaattgtgtgaattgggtcgaaagtcgatgctgggatggacgctacggccttgtggtctgcacagatagcgcggtttacgcagagggaccagctcggcctacgggaggagctgctgcaattgctatgcttattggtccaaatgcacctatttctttcgaaagtaaatatagagcttctcacatggctcatgtttacgatttctacaagcctgatcttgcaagtgaata

SEQ ID NO: 32648 - DNA, 2433 bp, Triticum aestivum
  Clone ID: PAT_TA_32648
ggtatgtcgtttttttattgtaacattccttttagtttactgaatcattccaaatggtttatacgagcctttacaaaggggccgtcgaataccaggcgtttagtttctcttattaatcgacagaggaaagagagcacctggcctgagcagcaaacagagaagaagaattaggggaaaataaaatgacctgtgagtttggaataaatacagaaaattagtcaacctcctttaaacaattttttttacagagtatcagttttttttcctctctaggcaggcaaggcagagatggattccttcagcagctggaggagcagccctgtcctgaagccttgcctgaaagctgctgctgctgctgctgggaccagtaggcctgcgctgccagcacgcggtcgagcagcccctgcggcaccggctcgccccgcctctgctgcggcgatatgctcgccgtgtgcaccagggtcttccacttgtccttgagatcgacataagtcctatgatcagtattgtcgaacgcgagcattttaacgtccctccaccttcctgttccaagctgttcgacggcttccactagcgcctccacctcaggcaaggagaagggcctccttatgcgtctttgcccaatagcgggccgctttgacttgcaaacaggcacaatggctagagcctctgagcttggagaggcaaccggaacaatggcttgtgagctagctgatgcttcgtgagcggtcgtttcaaaaagagaatgaacagaaccatgttcgctctgaacacggtttggagaagcctgcacacgctgctggctgttataaccggcccttgccctcaggaaaagggctcttcacacttccccatggctaatggtcttcatggccatctgcaccatgaaaatccatttcctctggtattctgaccccgggggaagagttttgcccagcttcacattccagtgtgaagtctatgttttctagattttcaccgtggcaaattctagcttgacgaagtgtcttgttgtcatcttgaatactctttccttgaagaagaacaccgacccggaggccactttcaattatactagtaacaacgtccattacagttctcttcaatgaaccaactgttgcattttcagggatctcgatgaacagttccgggatggtgaatgacttgatccattagcttaacttcagttagaatccctttagcagaagatggtgtaaaatgacggcgcactggcttttgtctcttgaacattgctctttgtactctttggcgtgtggtggatatcttttttccacataaatttagcttgctacctttattggacatctctccacacatcttattacgagctgccttccttatcttggaggcaaacattttccttatcctgctatcgcctgtatactgtggcatatagctcttattatttcccgtggtgcatggatgagtgcacccggaagaattttcgtcatcatctctatctgcagcatgcctcgcttcagcatggcataagggggaggtggtgcggtccttttcatggatgcacaaaggcactcctgagctactgtcagagctaaccaaagcaggaggtctgccatccaaatccacagagctaaccaaactgtacaaggctgtggtgtcaccatccataggttgctgcacctgcacttgattagtagcctctagcgaccgtgaagatccacactctggaattccgccaacaccatgggcacggttacatgattttgtacaactaaacaccgagtccctaaccaacatatctggtttcacggttagtgactctaacactgggtcagtaccatttcgtgtcgacgagttttctgccaagcagatgttagattgcctaggagaggcacacacaccaccagaacccgctatacagttctccacggcaatgcttttgagcggcggagcgtcatcacactgctcagctttaactgatttccttttcctggcataggtcaaagctgctgcattgatgctaggagcattattagatgaattctcatgatccactaacagcgttcctgcgacggtcgcgagcaaatcaaacggggacatctcatctttctttctcctggctgagcgtttcccccgagcagagcttgggacgcgcggcatggcgggaacctggtggccgcgagatccataatccagcctcttccgcaccaccatgtcttgatctcactccaaaggacggctttcgcaggcggcaatcgggcacatatataagctttatctccaaggagcatctgaaacgagtcacccaagattgattatgagcacctgcccaggaatccttttcatcggtttccttgcggtttccgtcctggtcctggatcggcggaaccaactgcttcctccccccccctccccgtcctcccctccttctccctcgcctcgtgccgaatc

SEQ ID NO: 32649 - DNA, 699 bp, Triticum aestivum
  Clone ID: PAT_TA_32649
aaaatgctggagaaatacacaggaagccatgattttggaagatgaaactgcgtccgatcagtttcaaggtcatatggagggatcacagtcagcaacagctacatactatttgttaatgttgcatggcaaggaatttcacgcatttcctgctggttcctggtataacttcagtaaagttgcgcagtacaagcagctgactctggaagaggccgaggagaagatgaataagagaaagactagtgcaactggttatgaacgttggatgatgaaagcagctacaaatgggccagctgcctttggttcagatatgatgaaacttgagcctgctaacgatggggaaaaagaaagtgctcgtcataagaagggaaaagataatgagagggtaataattctgataaaggtgaggagaatgaagaagaggaagccgctcgtaaagataggctcgggctctctaaaaggggcatggatgacgatgaggaaggtggaaaagatctagattttgatttggatgatgacattgagaaaggtgatgactgggaacatgaagaaacattcaccgatgatgacgaggctgtggatatcgacccagaggagcgggcagatttagctcctgaaattcctgctccacctgaaattaagcaggatgatgaagagaatgaggaagaaaggtggcctgagcaagtcaggaaaggaataaag

SEQ ID NO: 32650 - DNA, 2232 bp, Triticum aestivum
  Clone ID: PAT_TA_32650
gcgggcgtccgcagcagggaaaggccgtgcatctggtgatggacggcggatgctgaacgaggctcaatttaggccagctgcctccctctccgagacgcggacccggaccggagcaccatccgtctccggcatcttaacccgccgtccgtgccccgtcgcccaccgctcatccccgccgcgatggggagcgtagacctggtgctgaagccagcgtgcgagggctgcggctccacgtcggacctctacggcactgggtgcaagcacaccacgctctgtagctcctgcggcaagtccatggcgctttcccgcgcccgatgtctcgtctgctctgcgcaaatcacgaacctcatccgggaatacaatgtgcaggcaaatgccagcacacataaggctttctctattggaaagctttgtccccggcttcctcaagaagtgcaagaatatcacctgtgagaaaggatgatatcaggattatgcatgttgtagaagcacctgtcacttcataagaatttagtctccagatttaagtctagactacgaggtccaagaggacaagaacgcctttgctgaaattctgaagaaaatttcgaagatacagaagactaatggccacaactatgttgtccttagagaggataagaaatgatgagctcaaaagtggcgatttccttcattgcaaagtatcctcttgtgtcttcctggggataatagttttgtactgtattatgttagacgaatttggtcttctgacaagtatatgccgaacttctacccttctactagaaatcaaataactagttagtgcctgttcggaacctctccagtcttgaaactccgctccgcatgatgagctcggtttgagccactccctgcaattgtgctacagctgcctccgctctgggagctgcagttgtggagcggagagcacccgaacagggccttagtatgttgtcatctcctggagttactctagaagaagttgggaattacaaggttatgatgatgtgtgagaagaggtatattgatgccaagacagtgttttccgtttgaccaggttctttaaacctatgaatccaaagagtaaaatctataacgatgctcctaatagttttgtactgtatgatagtattagacgaatttggtcttctgacaagtacgtgccgagcctctacccgtgctttactagaaatcaaataacttgttagttcctaaaatgaggatgccgatgatgatgatgaagaagatgatcaggatgatgagtcatctccagtgcttgctccaaagcagacggatcaaccaaaagatgaacctgttgataacagcccagccaaacctacaccttcatcaggacatgctcgtagtacacctcctgcatcgaaatccaagcaaaagaggaaatcaggtggtgatgatgccaaagcatctagcggtgcagcttcaaagaaagcaaaggatatacaaaaacatcaagtatcaaagaggagacaccatcttcctcaaaacctacaccaaaggcctctgcttcatcaagaagtgccaatgtatctcctgtgacagaggatgagatcaggactgttcttcttgcagtggctcctgtcactacacaagatttagtctccagatttaagtctagactacgaggtccagaggacaagaacgcctttgctgaaattctgaagaaaatttcgaaaatacagaagactaatggccacaactatgttgtccttagagaggataagaaatgatgagctcaaaagtggcgatttccttcattgcgaagtatcctcttgtgtcttcctgggggtaatagttttgtactgtattatattagacgaatttggtcttctgacaagtatatgccgaaattctacccttgcttctactagaaattaaataaccagttagtgcctgttctgaacctctccaatcttgaaactccgctccgcgtaatgagctcggtttgagccactccctgcaattgtgctacagcttcctccgctccgggagctgcagttatggagcggagagcatccgaacagggccttagtatgttgtcatctcctggagttattctagaagaagttgggaattgcaaggttatgatgatgtgtgagaagaggtatattgatgccaagacagtgttttccgtttgaccaggttctttaaacctatgaatcgaaagagtaaaatctataacgatgttcctaagagtaaagtttcattgtgtgactc

SEQ ID NO: 32651 - DNA, 247 bp, Triticum aestivum
  Clone ID: PAT_TA_32651
aaattaaagtcagggtaccatgaaggccacaaatttgcatccctgcctgtattgcttacacgccgtcacaaacataaaaggagaatttattttccttttgtccctttttgaaaaagaggcttaaacccccggcctctgcatcatgtgatgcacaccgccatagggatgaacttgagatgttatttgttcaggaaaatgtctaacttggataaaaaaaaaaaaaaaaaaaaaaaaaaaaaaaaaccac

SEQ ID NO: 32652 - DNA, 1380 bp, Triticum aestivum
  Clone ID: PAT_TA_32652
cgccagtccaccgccgcggtgccctagagctccgtcccgccgtgtcgccgcttagcgcacgcccgacccgccgcgtagcaggcgagcgcaggccgccccgtaccggaagcaggcgcggggcggccggttctgcatcttccagggcccccgtggtgatgtgcctgcatcttcgcagcggctagtggtgatgtgcagcttgtctagctggcggcattcgctcctctgcggcttatgtcgctgtccgccttcgctcctccgtgcctgacgttactggacgcaatgaaagcgagaaagatatggatcttgagaaaaacttaagaggagttttgagagctgtagttgataggttaagaggagtttttggcatagaagttgatgattctgtgacacgggatggcataatccgatatgagttgcggaatcttgctcgggcttcgggaataagatattgtgtgctcttttgtgatacagaagtggaccattgtagggattggaacgatacgcgtcaggagaaaggagaaccctcgtatgataacaatatattggaagatctggcctgaagatttgagaagccagatagacgtagccgtagggattctccgctttttgaaatgtttccatctagagaggaacttatggaatcttcccctgttattgctgaggctgtatcatatttgtctacgaaagtggattcgactacaagagatgtgaaagttctccagcctacaatagctactcagtctgtacggactactgagggtaattccctctacgagatggacaaagcaacacaggaggtggtcagtgcaattgtggaggcacagtctggtggtcttgggcttgccatgaataagatttctcttgggcccgacttgccaactattaatcttcgaagatcggttggcctgcccgagctacggagcctccgacgcacgttcatcaagctggcagggcagtacagcttgagcgggcgacccccaccaacagatgccgacagcgcgaagaggatgtttgttgactacttgaaccgagaaattggtgggtgattctctgatgagtagtcctgcctatgatgtactacttcccaggggacaaaatgcaggcgctggtagcgttttcccctgccatgctcctcatctggcttctttcggggcgtccaaggagattattttgcctcgcatgagcttcaccacaagtattcacaagtggcatgccgctgtgtaattctgtagctcctgtaccacccaaatagttttcgctggtgtttgcaacttgtaaactacacaatttggaaatatttaccgaattatttatgtaaaggctacaacttgttacaacatactagaaaaatggctccagattagcgttctttgttctgct

SEQ ID NO: 32653 - DNA, 1806 bp, Triticum aestivum
  Clone ID: PAT_TA_32653
gcgcctgccgcccgtcacatggatcggctatgagctggcacgtccggatgaagatcgcgctcgacacggccaggggattagagtatcttcatgagcactgcaatccaccggtcatccatagggatctgaaatcgtctaatatactcttggattcagacttcaatgctaagattgcagattttggccttgcagtgacaagtgggaatcttgacaaggggaacctgaagatctctgggaccttgggatatgtagctcccgagtacttattagatggtgcggcattccttttgtgctaaaattttacttctatcttgtgtctacgaaatttaagctctgagccggtcatctctcccgtgctcgcctcggtcgccaccatcatgatcttcctcaccaccttctacgcctggaccatgtggcgccggtctcgccggatctcccacggcaaggccgcccggcgaccagacaccaccaccacgaaagggatcacgctggtgccgatcctgagcaagttcaacacggtgaagatgagccagaaggggctggtggccatgatcgagtacccgtcgctggaggcggcgacgggcaagttcagcgagagcaacgtgctcggcgtcggcggcttcggctgcgtctacaaggcggcgttcgacggcggcgccaccgccgcggtgaagaggctcgaaggcggcgggccggactgcgagaaagaattcgagaatgagctggatttgcttggcaggatcaggcaccccaacatagtgtccctcctgggcttctgcgtccatggtggcaatcactacattgtttatgagctcatggagaagggatcattggagacacaactgcatgggccttcacatggatcggccatgagctggcacgtccggatgaagatcgcgctcgacacggccaggggattagagtatcttcatgagcactgcaatccatcggtcatccatagggatctgaaatcgtctaatatactcttggattcagacatcaatgctaagattgcagattttggccttgctgtgacaagtgggaatcttgacaaagggaacctgaagatctctgggaccttgggatatgtagctcctgagtacttattagatgggaagttgactgagaagagcgacgtctacgcgtttggcgtagtgcttctagagctcctgatgggaaggaagcctgttgagaagatgtcaccatctcagtgccaatcaattgtgtcatgggccatgcctcagctaaccgacagatcgaagctacccaacatcatcgacccagtgatcaaggacacaatggacccaaagcacttataccaagttgcggcggtggccgttctgtgcgtgcagcccgaaccgagttacagaccgctgataacagatgttctccactctcttgttcctctggtgcccgcggatcttgggggaacgctcagagttacagagccacattctccacaccaaatgtaccatccctcttgagaagtgatcctacaagtttcgtcgaaacgaggaaagggaattatacggtccagcgtagattgctgtttattttgtaacttatatcttacctgtccctgctgcttacccgaggatgagtgagagctccaacctgctgcttttgctggttgggcagagagaattctgctttggagagagttgtctcatatatgtcttttcatgcacaaagaaacgaaagcatttttcttttctgttctgtggatctggtcactgctgtgcagatccaaaattttccacacactgttgtctcgattgcgtttgagagagctgtgatttggactcc

SEQ ID NO: 32654 - DNA, 788 bp, Triticum aestivum
  unsure (1)..(788): unsure at all n locations
  Clone ID: PAT_TA_32654
gcacgaggggtgattcccgcttgccattgcgcggctagtcccccacatccccctccttcgccgccctcctcctccccctcagtgagggacggcgtgggcggtgggagaccgcccccatatcgctcggtaatctggggttactaccggccccccaaaccggcggtcgccgacgccaatcgtcaaaatggttttgcgccgacacgccctacccggaggtctgcgccgacatgatcgcgcgctacgacgagagcaaaggcgccgacgacaagaagctggcggggatggcggcactcaccaccgccaccctccttcttcaagcatccggggacgcgagcccgggcgttcagaagcagcgctacccagacctgaccaaggccgacgaggaatgctttgaaacctgctacaaggagctgaccaatggcggccaaaaactcgacaatttgtgcaccagcaaagagggctcggacgacatcggcatggcccagctccccgaaatccgcagcttcatcaaggagaacaacggggcgcatgcccagtggaattgcgataggtgtcgccctgcgaatgacaagaagacacccgacgatgtctccaagaagaacgatgccgagaaggccatggctgtcctcgaggtgctcgtcaacaaagtgaccaaataatgaaaaacaaacaaaccctcattgcatatatactactagctcttgttaaagttgtttgattgattattagtttccttgagtaagtacggtcaggttttgttttctcctnactttttggttattaaacaa

SEQ ID NO: 32655 - DNA, 612 bp, Triticum aestivum
  Clone ID: PAT_TA_32655
aggtggatattcaatggaaaaactgctcaacatgagtgtagcagctaacataaacctgataccgaagcatacaaatgacagcacatccttggagcagttttgcagggatacagtggtcaccatctggcattaccatggtggatgccatgtaggcaaggtggttgaccagcagtacaaagtgattgggacctcaggcctccgggtgattgacggatcaaccctatccaggtcgccaggaacaaacccacaagccacagtcatgatgatgggcaggtacaacccagaaatatgatatagtttgcattttggtaaattcatttcaactccagggtttgatctttctttcccgcgtttgacatgcagatacatgggagtgaagatcttaagggaaaggttaggacgagcggctggagtataataaatacttggacattattatcttgttccccatgtaagaatgtgacttaggagaaaagtaaatagtaatttttgaagagattcatcaacaaccattaaagaaagaagcgtcagttgtatcatctgtattcttaccattcatgtggaaatatatgtatatggcctaccaaaatattatgttacttttacatttcc

SEQ ID NO: 32656 - DNA, 1210 bp, Triticum aestivum
  Clone ID: PAT_TA_32656
cccacgcgtccgaaagcttttgcgcaaaacaatgcatcttgcacgagcaatctaaaaaaatatgcaccctaaaatgggctctttggagccaacttcccaagctttatctgttaagctttagtttgcaggtacccaagataagcatatagacaaatcagaaatatatactaacatgtaggtaagaatcaaattatgcagctgctacactcattcgcaactacctacattcctattcgtatcacatgataaaaattactgaattccttatcatcaatgttataaactagagttatctttcaaagttattgttgaaagttcaattgtacaatcagagtgaagtgtctcagaaaaacttaagcatatgtccacttccctttttagaaccatgacagttttcatgcttatgacattttggcattctaatgcagattgggcagttgtcgacaattcctccaaaggaaagaagtttagaagcagtccataagtatgtacgtaacaaaaagagcctgcccaaagaagtattccatggagggttcattctttcgaagattgatggcccactgtctactggcaatctagttcttgtggacactgatcccaacagcaatcctatcgtcaccttcaactacttcaaacatccacaggatctgagacgatgtgtttacgggatcaagaccatagagaaataattagtacaaacactttctctaatttcactcccaaagaaggtggatattcaatggaaaaactgctcaacatgagtgtagcagctaacataaacctgataccgaagcatacaaatgacagcacatccttggagcagttttgcagggatacagtggtcaccatctggcattaccatggtggatgccatgtaggcaaggtggttgaccagcagtacaaagtgattgggacctcaggcctccgggtgattgacggatcaaccctatccaggtcgccaggaacaaacccacaagccacagtcatgatgatgggcagatacatgggagtgaagatcttaagggaaaggttaggacgagcggctggagtataatagatacttggacattattatcttgttcaccatgtaagaatgtgacttaggagaaaagtaaatagtaatttttgaagagattcatcaacaaccaccaaagaaagaagcgtcagttgtatcatctgtattcttaccattcatgtgaaataatatatg

SEQ ID NO: 32657 - DNA, 655 bp, Triticum aestivum
  Clone ID: PAT_TA_32657
cccacgcgtccgcccacgcgtccgggcggcgcttgaggcgatcccggatcggaatgggggcgctcgaggacccggagaacggaggcgccagcggcaagttacatctcgatccctctttgtactagatctgattcatctttccctttctctcaagctagcacggaggagcaccgagccgacgaatagaatcagcaagccagccccgatttgatacatactactgatctgtgttaatccatgtcatacactactggtctccccttttatgtctgtttgatactagtactgagataatacaaaagcctatctatccacttctcatccttccatccaaacaacaaaatatggctcaactaatcccattcaaccaaacaatcagatgtggttatccctaaccaggtggctggggatatcaccagccaaccaacttcgccctcgaaccaaacggcccctaagctgccacagagcccgcactaggacgcgctggcctatcgcctggatccggcctaattaaccatgcggccattttttgatctctcggggagctgcagttcaggctatgcaggactctcttgggcgaggtggtagacggtgtcacagtggtggtgagccttaccgtcaatggttgttcttgggggggaccaccccgggcatg

SEQ ID NO: 32658 - DNA, 683 bp, Triticum aestivum
  Clone ID: PAT_TA_32658
atttcgccgcaaaggcctctagaagcaatcaggcgagcggcggctgcggcgcgatgggagagcaggccgtgacggagcgtatccagcggaagctggaggaggccaacgctaccgtccaacagcacctcgccggcatccaggaccacgtcaacttcaccatgcaggaacggttgaaccggtcattgatggtctgtcaagataagtttgaagctgccaagctccagaagatgaaaacagatgcaactcaggaactggaatcctgtgtcaacagatctatcgatgacagcatcagggccctcccatatgtggtgcagcagatgaagtccaccctcaatatcaattagaggcattattacctttagcatatgaaccagatatagtttgataatgtttcatattcacattcaaggcataagtctacattttcagtggaaaaacccttagaactatgcagagctcttaccgatatcgattgtttcgtagttttttgaattctgctcttaccagcgtcgacattttgaattctgctgagaccacagcttaggcattggaaggctggatgaacttgttctgctacatgtaccacaatatcttttatgtctcgtgatttttcacgttgcttctgtttcaatgcggtttatcttttgccgtagaagaataaactgtgcggggagcatttggtg

SEQ ID NO: 32659 - DNA, 1365 bp, Triticum aestivum
  unsure (1)..(1365): unsure at all n locations
  Clone ID: PAT_TA_32659
tcgacccacgctccgcttgcttgttgcatgtcaagtattctagtctcaagcaatccatacaattattactgatactggtcattttattagtaaagtagaaatgtcattagattgttacatcaaaacagaatagtagagaagatcgtgcatgaagtattttacaggacatcgtagaatgtaagcatgttgatctttctatgaagccatttttgtgatcatcaaaacagaatattagtagtgatatcactatcagaagaaaaaatgaacttcaatgctactcgtggtttcccagtttctaaagtttattacattgcttatctatgcgaacttcagaaatgttaacgatttgattattttgctagtggcaatggttaaattttcttaacctgttgttggttccccaggatattataataccacccgactacttgagagaattgttttgcatctagactgtgtgaacgggaagccttccatctgggaggagcttgtatcatgcttgcttcggcttttttctgatcgtactactgactacgaggattgtatttcatgtaatgttgaaggagatgcatcgattgatgcttttagtagtctttcttcagtcttctttgagcaacatacgagggaatcatggaagcaccgatgcaaatggtggatgaaccgtcatttcagccaaaacatctatatgtcagaaactgcaaaaggtgattgcaagctcctcgcttccaaggcatcttgtgcttctcacatgcttgggcctggattcccatatgtcaaagcagccaagagctatctttccaagcaagaggctaagcatgaatccggattcttgtccagtaacatggaaaattctgtcaagttattacaaagtttggagaaactaatgtgatgactccgtttagttcaatcttttctttttgatagggtagtttatgttgttgtataattttgacatatagttttagcgtcctttgcgaggttagtttctgtagagcgggagatctacatcagtgcatcccaatattttgtgtatctggcgattgtgagaaatatcaggatcgcgtcgagtcaaggaaaagcttcggcgaacacacacggaggaagaagcagcaggaacatatgtatatataaatatagtagttgcgcaaacgaagtgatttctggncagctgaaaaggatatcctccgagctcctgcaacttcgtcgtctctttcatcncagcctccacaagagcaactattatatttctttgcagagggagtnctactatattcttgttnaaattatgagaagcgctataacttggancnagttctctctccancaatgctgcagtgcctcagtacctgcatgttacccccgacc

SEQ ID NO: 32660 - DNA, 687 bp, Triticum aestivum
  Clone ID: PAT_TA_32660
cccacgcgtccgctgcctatgtgtgtgtactgaagttttcttcttttgaatatgtaggtaattagtgaaatgataagagggtcaattaatggtgttcaatttttccttcaagcaaacagtttgtacccaaatacaatactattcagtatcatcctgaaaccaatatctcaaagattcattctttatgaattcgagccttggcaaaccactcccattacaaggttccataaacatgctggattagtatgtcgatattcgaattaattgggcaaaaaatagatatatttactatgatgtttttacatattcaggtgaatagcatcctgtttttacttcaaataattaacaaaaaattaaagaccgtgattatgttgtttattaaattcctcttgcattatctttgatgaaaagtatattatctgtcagcaacgatatgttaatatgggcaaaggaaagtcaaaatatggtatctcaggccaatattctgaaattagtgaagccctatagtatttactggattgatcacgacactgctcatattttttggtactttgatatctgaaatattttttttaatcatgagctgaggtgatgatgggttgcaggcacacgccccgtccttttcttgttcaaaggtttgcgcggagcattaagtttggagagggaactaacatgaatgaccagtcg

SEQ ID NO: 32661 - DNA, 740 bp, Triticum aestivum
  Clone ID: PAT_TA_32661
gctacacgggacactctcgcactcgacggcagagtgacacttgccgcctctgccgcgacaccacgggccatgaagctggaggtgtcgccgaggcagaggacccaagaagcagagcagaacgagggcgtcgccgtggagccatggaagcacccgaagcagctctgcgctagcctgggctacggggaggaggaggcgtcacggctggtgccgccgctcaacttcggcatggtcgacgacggcgtcttccggtcggggttcccccacgcgtccgcccacgcgtccgcgcgaggcgctcaaagtcatccttgacgtgagaaaccacccggtgctcatccactgcaagagaggcaagcaccgtaccggctgcgtggtgggctgcctgaggaagctgcacaagtggcgcctgtcctccgtcttcgacgagtacctgcacttcgcggcggccaaggcgaggaaaaccgaccagcggttcatggagctcttcgacacgtcaagcctggtgcatctgctcgcctcgcagtgttgatgaaagcgagcgagcgtttttcctttctcttttagcctgtcccgatcctgccaccatgcggctgcgacgacctgtgtttctcccgcggtgattcacagagaataatgttactagaacaatcatgggccatatctatgagagatagaagaccaatgaaacatgtactccttgaatgatcaaaaatataaatttcaaggtgtgtgacacattatcc

SEQ ID NO: 32662 - DNA, 1449 bp, Triticum aestivum
  Clone ID: PAT_TA_32662
tccttgtccgtgcaccaccgcttcttctccacctacagcctccccccaccaccgcgcaagctttcttcgtccggcggctcgcacccacaccccgccgccgtcccctctccgcccgcgtccgcgtgcgcgcctccaactccgaccctccgcagcaggtcaacctctccgtcctgcgcttcaccctcgggatccccgggctggacgagtcgtacctcccgcggtggataggcctcggcttcggcgccctcgtcctcctcaaccacctcctctcgccgtccccaacccccgcgcagctcaggtcggaggctctggggctgtgcctggccgcgttctcagcggcgctgccgtacctcgggcgcttcctagagggtgctggtgcttccagccgtgtgccgctgcctgaaggaagcaggcaggtgtttgtgattcctgatgatctgtcaacggcgcagaaagaggatatggcctgggcgacatatgttctgctgcagaacacaaacaccacatcagggctcatagcaattggcaatgtgttgtgcattcgaggatactgggatcctcctgcagatatctctaaatatgcaatgattaattggttcaagagtcagatggaacaagctggactcaacaatctgagcagtgctttgtactttcctaatttttctgacacccagcttgggaatattctaccacaaggaattctttctgtgttagcacaaccaattgtgagcaaccctgatccagctaacggcgaatcaagagctgaaggtgtcgtcctgttggcctccaatgcaaattatgcatacagtgagaaagatatggtttggataagaacagttgcaaataaatttcgacttgtgtaaatcatcaacacccaagttggacaagaacggatgttacgattcgcttagtggatgggatgtctcaagtgtgtggtaaccaacagccatatgaagtctctgcttggaatgtgtactttgcaacagctggaggcagaggcggaacacgcaagcggcgccatggagcgacgaactattagttgatggacctctgcaatgccattacatgtttaactagcccaccaaccacccccatcttttccagctgaagctgtggtctgagctagagcgttgggtggttcctatcagccgtcctcaacgcctcatcatcatcctgtgatcttgatctgccttggcttcttgtggtttgaaatcacttggcctggaacattatcagttgggcatccttccaaagccttctcccaggagccctctgctgggctctctcacaagcttgagtgtgcacctactacctacgccgtctcatgcggtgttgtttaatgcatgccgtctgatatggttgaagcatcaagctgtattctgtactgtatggtaccatgttcgccgtgggctactgtcacgcggagatcgatcggttaaaggtccactc

SEQ ID NO: 32663 - DNA, 1029 bp, Triticum aestivum
  unsure (1)..(1029): unsure at all n locations
  Clone ID: PAT_TA_32663
ttcggcccgaaagtagaccaaccagcgggacgcgctgcagctatcctcgtgttgatgctctcgctcccggcggcggcccatctcgtcgccgccgacggcgttgacgcggacaccatccgcctccccagcgacggcggcgatggtcttgcaacgaacaagggaggcgaggagcagacgcctcctgacaaagtagtggcgccgacggaagagcgctggcggcgccctcgaagcagagaagccgtgggcgtgctgcaacaacaccgtgtgcaaggagtcgctcccgccggtgtgccgctgcctggacaaggtgaaggagtgcgccgccgcgtgcgaactgtgcgagccgtccggaatcaaccacgtctgcaacgactggtaccgtggcgacccagggcccatgtgcgcctaggaggagtggccgtgcacgtgctgcgaccggaccgtcggcaccaggacgttccctccgacgtgccgctgcctggacgaggttgaggtgtcaacgacttggtgcaatacacgatggattacaaggtttaataaaatggaaaacgtttaaaatctaccggatgatttctacaggcccatattttgctcaaaaaaaaaaaaggccggccgctcccggaccgccccttcgacgtgccgntnctggacnaggttgaggngtcaacgacttggtgcaatacacgatggattacaaggtttaataaaatggaaaacgttaaaatctaannnnnnnnnnnnnaaaactnnaggggggnccngnncccaantngncctatnngngnnnattanaatnantggccgnnntttaaaancnnnnnncttggnaaaacctggnnttncccaanttnannnnnttnnnnnnaantncccnttttnncnnnntngnnnaannnnnnaannggnccnnnnnnnnnnnncnttnnnaanannnnnnnnnnnnnnnaanggnnnangggnnaantnnnngnnnnnananttnnnnnaaaannnnnnnnaaanttnnnnnaaannnnnnnnntttttnnn

SEQ ID NO: 32664 - DNA, 1081 bp, Triticum aestivum
  Clone ID: PAT_TA_32664
ctgccctgggccttcgcggcccaccctcccgctctccgcccgcgtcccactcacgctcccgccggctctgcccaggaccccccccaccgcctgcacccccccccccggtcctacccgcaggtcccgcgccaccctcgccctgcccctgcccccccactgcaacgcggccacaccgccgcgtgcacgcccgggagaagtctgagggggcaatctcaaaggagaggaaactgacagcactgtgggaacgccgagctcgcgaatcgggttggcaggattctcgagccgcgaccgccgcacgatagcttggcaagcagtttgcttctgcaggtaaaagtatttgcagcagacgacatttttaccacaccgtcaccgagcaacgttagctgtaagggtccacgtgtaatgtttgccagtgtattatgagttgtcccaggtcgaagtatagttactctacccgcggctgccccccgacactcgccccccagtccaccgcgcctgggctcgtgaacttctctgtttcagcttgcggcacaaatgaccctgagcgtaccaagggagatggcgaagcagtttgttgatctcctcaacgaggaactcaagctgcagcaggttgtagctgaggagcacatccatcacatgaatgccacacttgtcgaggcaaaaaggcaggctaccctgtaccagcgagaggcggagaagtgtaacgcggccacagagacttgtgaggaagccagggagaagtctgagggggcaatctcaaaggagaggaaactgacagcactgtgggaacgtcgagctcgcgaattgggttggcaggattctcgagccgcgaccaccgcacgatagctttgcaagcagtttgcttctgcaggtaaaagtatttgcagcaggcggcattttaccacaccgagcaatgttagctgtatgggtccacgtgtaatgtttgccagtgtattatgagttgtcccagtagaagtatagttactctagacactgtagattccttataaatgtaactagtatacattgtttaaatatgaagctttattgtaacgtacgtatattgaagacattcaaaaaa

SEQ ID NO: 32665 - DNA, 1260 bp, Triticum aestivum
  Clone ID: PAT_TA_32665
ggaaaaacaagctggaagcttactcgaggatgcaggccagcggcaaccccacagccgaaggcgacaaggttgcgccagacatcaaagagaagtagcgcgctcgggcctgctaggagctccgggcttggtgggtgtggaccacgacattaccgaggagtattctttattggagagaccaagactgccgagaaagaaagaagccgatctggccccctgggacctgcgaccacagctggagagggcgtctcccccttgttgacggggtttggcgccggtgctcggtgcgccgtcttggccgtgctgggcggcgagtcagtggcgggcttggatccgatctgaagttggtggcatcaccatgcttgtcctcctttgttagctggtttgcgggcttcctccggacgtcctgctcggctggttggcggagcaatggcgatgcaagctctgggtcgggggaaacccttgaccggtggtgccggtcacgatgttggcggcgcttgcggcgccgttctccctctggtgagcaacatcgagaccctctcctcgccttccaccccatggtcccgggcgaaagcctaaaatctcttgattgggcggcgacagtgcgtcggcatcgttttcttcttgaagacgctgccttgggagtccaggatggccaggggctcagagcggtggtggtttgcctgttcttctaacgtgaccctgcttggcaatggcggtgggttccttggtcttggccgctgacgggcacgttgtatgggttcttatgaaaggtgaggtggccagggctcgtcctctccccaacaacatgttggccagtccatccgtgctcgggggtgagctattttgcctcctgccgggccggagtcctttgatttaggacgaaaaggcaggggtgccctcttcggaggcagaggctgaaggtaggcccccagggttggcccttgggagttgatggagcatgcccttcccccgggggtgaattgcccccttacccggttgcgtcgatggcatgatcggaggtcgtcgcttgttgttccaaagggtttggcccctgttgattttcggttcccttatttcccttctttgttggggtgagggctgtaatgtatggttgttgctttataaataaaccggagcgaaaccccttttcaataaagaaagaagccgaaaagagtttgattttgttgctcaaacaaaaaaaaaaaaaaaaaaaaaaaaaaaaaaaaaaaaaaaaaaaaaaaaaaaaaaacaccaacaccc

SEQ ID NO: 32666 - DNA, 635 bp, Triticum aestivum
  Clone ID: PAT_TA_32666
gggggggggggttttttttttttttttcgatgaagggtggactttattagcttaaaatggagcattaagataatacaaaacataatgagcacacacccggcctctacatagttaggatgcacatagccaacaccaacacacacacaaaaacacaccaacaaatagcaaagtcaaataagaccaaagctatacgtaggcgaggaaaaaagaaacacaaaggatcagatccgccattagcaaactacatcaatgaccatatctgcacccaggacatcacaggaatgacgagattcttcaacaataacgccttcaagaaggaaggagctcaagcttcgtcgtcaccggattcaaccactcaaggtcagaatctaggttttcaccctgaagaattagaccgagcatatccgagcaatgccttcaagaaggtaacgatgtaaaagcatcgccattgccaggtataaccaaccgggatcagacctaggcttccgccccggagctcgagactaggtgctcgggaagcaccaccaacgatgtcaattatgtgtttgtcgtgaccacttttccacgatcccagcagctgcatgcgatgtgagaccgcaaccaccgcacaaccatccctttgcatcaagccaccg

SEQ ID NO: 32667 - DNA, 118 bp, Triticum aestivum
  Clone ID: PAT_TA_32667
cggggaggtcagtgatcagataatttttaggctgcaggtgttggtgagatgagctgttgtgtgttatgaataacaaacagattaaacaaacccagaatgacagtggcaagattacttt

SEQ ID NO: 32668 - DNA, 1447 bp, Triticum aestivum
  unsure (1)..(1447): unsure at all n locations
  Clone ID: PAT_TA_32668
cgtgcggnggaagcaaagcacaaacgaacgcggccgtcgcagcagccgcagaggagcagcagcacacccgaccgcagccgtacgccgcagatccgccgccgcgcacgggatttcaggcgaaggggagaggggagatggacgtggtgaaggcggcgcagctgtcggggcggacgctggagatggtggtggtgcacccgctggtgctgctcagcatcgtcgacgactacaaccccgtcgcgcgggacaccaggaagcgcgtcgtcggcgtgctcctcggcgcctcctcccgcggcctcgtcgacgtcaccaactcctacgccgtgccgtttgaggaggatgacaaggacccgcggatctggcttcctcgaccataattaccatgagtctatgttctccatgttcaagaggatcaacgccaaggagcatgttgttggctggtacagcactggtccaaaactaaaggagaacgacttggatgttcatgcattgtttaccaactatgttcctaatcctgtcctggtgattattgatgttcaacccaaggagttgggaatacccaccaaagcatattatgctgtagaagaggttaaagagaatgctactcagaaaagtcagaaggtgttcgtccacgtgccatcagaaattgcagcccatgaagtcgaggaaattggagttgagcaccttctgagggatgtgaaagacacaacaataagcacacttgcaacagaggtcagcagcaagcttgcagccctgaaaggactcgatgcgaggcttacggagatccggggttatctagatcttgtaattgaagggaagctcccactgaaccatgagattctgtaccacttgcaggatgtgtttaatctgctccccaatctcaacgtaaatgagctcattaaagcctttgcagtgaaaacaaatgatatgatgctggtcatatacctgtcttctcttatccggagtgtcattgctctccacaatttgatcaacaacaagatgctaaacaaggaacacgagaaggccgaggatttgaagccagccgccgtacctactgcagccgggagctgaatgtccttgtttgcctcaacatggggatagcgatctatgacccagcatggggcaaaagaaactgtgacatgttagcattgtctcatttgtaccaagtgtcttgaccttcaatttacactttgatgtttacttcatgtacgacgaggtcaacgacaaaaccttacattctgtgagctctaggtctttttgaggtttataatctagatcttatactgtttcatctgccgtgtcatggtttgtgatgcggattatcttagtaaatgtatgcttcattagaaacatcactgccagtttacaatgttgtctaaaaaaaaaaaaaaaaaaaaaaaaaaaaaaaaaaaaaaaaaaaaaaaaaaaaaaaaaaaaccccccccccccc

SEQ ID NO: 32669 - DNA, 914 bp, Triticum aestivum
  unsure (1)..(914): unsure at all n locations
  Clone ID: PAT_TA_32669
gnaaaaaanacgattccgactaaaacctctcgccgccgacgaccaagctcggagacctattgacctagttcctgatgtcggacgccgatgattaccgttgcttcgttgggagtctgtcatggaacacaactgatgtggatctgaaggatgcgtttgggaaatttggtcgagttactgagaccaaggtggttcttgacaagttctctggccggtcacgtggctttggatttgtgacttttgatgacaagaaggccatggaagaagctgttgaggctatgaatggaattgatttggatggaaggaatattactgttgaaagagcacaacctcaaggttcaggcagggaccgtgatggagatcgagactatcgtggtggtggtgaccgctatggtggtggccgtgattttggtggcggtcgtggtggtggtcgtggtggcggcggtgattgctacaaatgtggcaagcctggtcattttgcaagggagtgcccttctggtgatggtggggacaggtatggtagcagggatgacaagtatggtggtagcaacggcagcagtcgctatgggcctgaccgtggtggtgatcgctattctggaagtcgtgatggaggaagccgcagcagtggtggcggtgatcgatacagccgtgacaggtctggaccgtatgatcgtcgcagccgagatgaatactgatcttgatggtggagattctgtctcaggtatgaaaggtattggataatactagtggtatgtttgctttatcacataaggcagcaaatggtttgctgttgtactctttatgagaagtttaatgcttttgttatccatgctgactagtgcttggtttaccaatggttcctacctggatttggcttnngtaaccggttccctgnggagtttncagtggattgcgtt

SEQ ID NO: 32670 - DNA, 1121 bp, Triticum aestivum
  Clone ID: PAT_TA_32670
tcgtccgcggacgcgtgggcgcaaaaggagagacagaagagagatcgattccgactaaaacctctcgccgccgacgaccaagctcggagacctattgacctagttcctgatgtcggacgccgatgattaccgttgcttcgttgggagcctgtcatggaacacaactgatgtggatctgaaggatgcgtttgggaaatttggtcgagttactgagaccaaggtggttcttgacaagttctctggccggtcacgtggctttggatttgtgacttttgatgacaagaaggccatggaagaagctgttgaggctatgaatggaattgatttggatggaaggaatattactgttgaaagagcacaacctcaaggttcaggcagggaccgtgatggagatcgagactatcgtggtggtggtgaccgctatggtggtggccgtgattttggtggcggtcgtggtggtggtcgtggtggtggcggtgattgctacaaatgtggcaagcctggtcattttgcaagggagtgcccttctggtgatggtggggacaggtatggtatggtagcagggatgacaggtatagtagcagggatgacaggtatagtagtagggatgacaggtatggtggcagggatggtggaagggatgacaagtatggtggtagcaacggcagcagtcgctatgggcctgaccgtggtggtgatcgctattctggaagtcgtgatggaggaagccgcagcagtggtggcggtgatcgatacagccgtgacaggtctggaccgtatgatcgtcgcagccgagatgaatactgatcttgatggtggagattctgtctcaggtatgaaaggtattggataatactagtggtatgtttgctttatcacataaggcagcaaatggtttgctgttgtactctttatgagaagtttaatgcttttgttatccatgctgactagtgcttggtttaccaatgttcctatctggatttggcttgtaaccggttccttgggagcttcagtggattgcgttattttgtctgagtaatatttgggatccatgtttctgcgttaaaaaaaaaaaaaaaaactcgacctcggccgcgaccacgctaatcactagtgaattc

SEQ ID NO: 32671 - DNA, 537 bp, Triticum aestivum
  Clone ID: PAT_TA_32671
gctttcagaagggaaagcagagagaaagaaagaagccagaaagcctcgagtgaagtgagcaagccatgggctcggcaacagtcctggaggtgatcctcgccatcatcctgcctcccgtcggcgtcttcctgcgctacaaactcggcgtggagttctggatctgtctcttgctgaccatactggggtacataccggggatcatctacgcggtgtatgtgctggtagtttaagcaacagcctctgctgcagggtccgggcttggacgagcgagtcgctgtgcacgagcaactgatgatgtctgtgttaagatagcatgtctttgtgtaagcttgtatgtattgaatattgcggatttcaattttttttgaaacttggtattgttgatgtcacgagtgtacgtagctcgagggctttagagcattcgtcggctccagtgtttgtgatcttaaatttaaagtacttcggaagcaatcgaagtgcgaggtcagtactgttgcaagtgtttcccaaacagagaaaaaaatgcatgcatgatgg

SEQ ID NO: 32672 - DNA, 1345 bp, Triticum aestivum
  unsure (1)..(1345): unsure at all n locations
  Clone ID: PAT_TA_32672
gnctagttctagatcggagcggccgcccgcgatctagaactagtcgcagaacctttttgctgaatgtttggtgccttgggcaaagtcttctttagtgggaacttggttcgagcagtactcgccatgctcgccgtcatgggcgcgtggttccaggccgagtacaccggcaccggccccatggacaatctcttcgctcacctcggcgaccccggccacgccaccatgactgctagcatggccaggcgggcattatcgatctccttggcgcggagctccttggccttctgcgtcgagacagcctatttctgggatcgcagcgccggccgtccgggaataatcatccaatcgccagtcgcctctttcagaagggaaagcagagagaaagaaaggagcgagcctcgagtgaagtgagcaagccagctcgaaggcaacggggcaagtgatgaacccagccaccctcctgcagtcctggaggtgatcctcgccatcatcctgcctcccgtcggcgtcttcctgcgctacaaactcggcgtggagttctggatctgtctcttgctgaccatactggggtacataccggggaagcatctacgcggtgtacgtgctagcaatgcatcaccgcgcgtgccgcggtgtccaacaaggatggtcgagctgctgagaaagaatgtcttatgctgtctgtgatatgatagattgtcttggtttcattttttgtgtttgatattgcggattttatttattgacggcgcttgtgattttcggtcttgccgtggcgcgagggttcgttcaggtgactttactgcagtaatcccggtatatttgtgagcttaagtgaaggtagtttaagcaacagcctctgctgcagggtccaggcttggacgagcgagtcgctgtgcaagagcaactgatgctgtctgtgttaagatagcatgtctttgtgtatgcttgtatgtattgaatattgtggatttcatttttttttggaactcggtattgttgatcctgtgatgtcacgagtgtacgtagctcgagggctttagggcattcgtcggctccagtgtttgtgatcttaaatttaaagtactctacttcggaagcaatcgaagtgggaggtcaaaaaaaaaaaaaaaaaaaaaaacccaaaacgcgtgcctctacgtcatgatctgcgccaagtaaacgtctggccaatcaaagtcgatgctctttacgaagcatagttaatgactggttcttctttataattccgacattcagtatatatataattagacaacctcctagtttaccgacaaggtagacttttgtacattgcaatacaagcacatacatttctcttcac

SEQ ID NO: 32673 - DNA, 772 bp, Triticum aestivum
  unsure (1)..(772): unsure at all n locations
  Clone ID: PAT_TA_32673
gccggccggccgggatctcatctcatctcatctcatctaatcacactcacactctcactctcaactctctcaaccaacaaacaactctcttcctcaaactcaacaccaaaaccaaccatcaccatgaagttctctgccctcgccgccgccgccgccgtcttcggctctgctgccgctgccaacaaggctgtcgtcatcaacgactgtgacactgccatctatgtccagtccgttcccttcaacggcggcgctcccggccccttgaccaccctcaagcctggccagcgattctctgaggacctccgcacctctggctctaccatcaagattgccgacacccgaactctcaacaagcctctcttctttggctactcctccgacgccaacaacgtctactacgagctcaacactcagtacggcaaccccttcgccagccagcacaacatcctcaaccctggtgatggctgccagaagttcgactgcaaggctggtgacgccaagtgctacagcacccccagcagcaagaagaactacagctgccctaaccccgtcaccctctacgccaagatctgcgccaagtaaacgtctggccaacaaaagtcgatgctctttacgaagcatagttaatgactggttcttctttataattccgacattcagtatatatataattagacaacatcaaagtttaccgacaaggtagccttttgtacattgcaatacaagcacatacatttctcttcaaaaaaaaaaaaaaaaaaagccctctann

SEQ ID NO: 32674 - DNA, 667 bp, Triticum aestivum
  Clone ID: PAT_TA_32674
cccgcccccagcgtcccccccccccccccggcgtccccgcggcccccccgccgggccggccccccccgggcccgggccccccaccccccgcccgccccgcccaggccccgccggccgggcccgcggtccgcgttcgcggcggcccgggcccgcacgcggcggcgcggggcggcgcggcgccgcccggggggcgccagcgccgccgcgccggccccgccgccgcccccccggccgcgccgcccgccgcgccgcggcggccccccccgggcccgcccgcgcccgcggcccgccacccccgtccggtccccgggctacccgtcccggcccccggcggccggtccctgtccccgctgctcggtcagtgtcggggcccctccttcgccgctgctgctcctaagttcttctatgtttttctggaaagaaccttgtattgtacacattattatatttgttaattcgttgttcgttatgagtaatatatatactcctaggtattaataaatcatgggaagataaaataaaaaaaaataaaaaaaataaacgtgccaaactctgtgtatccagtgtgtatcggtgtacgcatttgagacttccaaacgcgtagcacgtgtgaaagtaattgcatctatagccgacttcacaaaagaaataaaagaaaaaagacaaa

SEQ ID NO: 32675 - DNA, 633 bp, Triticum aestivum
  Clone ID: PAT_TA_32675
cgtgctcctctcgctcgccgccaccaccggcgcagccccagggcatcgatccggggtcgtctccaccttcagtggccctgggattgggctcggcttcggcgtcggctgcggattcggagtcggatgggggttcggaggaatgcctctgaacgtattcggcttgtgtatgggttgggcatcggtgggggatgcggagttggtcttggtttaggatggggctttggaaatgcttatggttgtcaatatcgatcttcaagggtccagtttcagggcattgagtttcagaaaaagtctgaaggagatgaagcaccaaagcttgttgaaaagtctcgtccttatggctagtatagctgcgatcatacaattggcacaggcaatgttaccattgcccccttgattgtagtcaattgtctacctggaaagttgtttgaaagcattttgatgttttgatgaacttggacgttttcatggtaacataatgaggataatccatggtacttttttcgtttcggacaaattacggtcttcatatttggctaatattgtccattaacattctcttggttgggtgcacccccacaagtgtttgttgttactcttgttaagtacctcggccgcgccctcgctaaaaaa

SEQ ID NO: 32676 - DNA, 5372 bp, Triticum aestivum
  Clone ID: PAT_TA_32676
cggcacgaggtttagtaggttccgggaaatggagatgtctctctggccacggagccccctgtgccctcggagcaggcagccgctcgtcgtcgtccggccggccggccgcggcggcctcacgcagccttttttgatgaatggcagatttactcgaagcaggacccttcgatgcatggtagcaagttcagatcctcctaataggaaatcaagaaggatggtaccacctcaggttaaagtcatttcttctagaggatatacgacaagactcattgttgaaccaagcaacgagaatacagaacacaataatcgggatgaagaaactcttgatacatacaatgcgctattaagtaccgagacagcagaatggacagataatagagaagccgagactgctaaagcggactcgtcgcaaaatgctttaagcagttctataattggggaagtggatgtggcggatgaagatatacttgcggctgatctgacagtgtattcattgagcagtgtaatgaagaaggaagtggatgcagcggacaaagctagagttaaagaagacgcatttgagctggatttgccagcaactacattgagaagtgtgatagtagatgtgatggatcataatgggactgtacaagagacattgagaagtgtgatagtagatgtgatggatcataatgggactgtacaagagacattgagaagtgtgatagtagatgtgatggatgatgcggcggacaaagctagagttgaagaagacgtatttgagctggatttgtcaggaaatatttcaagcagtgcgacgaccgtggaactagatgcggttgacgaagtcgggcctgttcaagacaaatttgaggcgacctcatcaggaaatgtttcaaacagtgcaacggtacgggaagtggatgcaagtgatgaagctgggaatgatcaaggcatatttagagcagatttgtcaggaaatgttttttcaagcagtacaacagtggaagtgggtgcagtggatgaagctgggtctataaaggacaggtttgagacggattcgtcaggaaatgtttcaacaagtgcgccgatgtgggatgcaattgatgaaaccgtggctgatcaagacacatttgaggcggatttgtcgggaaatgcttcaagctgcgcaacatacagagaagtggatgatgtggtggatgaaactagatcagaagaggaaacatttgcaatggatttgtttgcaagtgaatcaggccatgagaaacatatggcagtggattatgtgggtgaagctaccgatgaagaagagacttaccaacagcaatatccagtaccgtcttcattctctatgtgggacaaggctattgctaaaacaggtgtaagtttgaatcctgagctgcgacttgtcagggttgaagaacaaggcaaagtaaattttagtgataaaaaagacctgtcaattgatgatttaccaggacaaaaccaatcgatcattggttcctataaacaagataaatcaattgctgatgttgcgggaccgacccaatcaatttttggttctagtaaacaacaccggtcaattgttgctttccccaaacaaaaccagtcaattgttagtgtcactgagcaaaagcagtccatagttggattccgtagtcaagatctttcggctgttagtctccctaaacaaaacgtaccaattgttggtacgtcgagagagggtcaaacaaagcaagttcctgttgttgatagacaggatgcattgtatgtgaatggactggaagctaaggagggagatcacacatccgagaaaactgatgaggatgcgcttcatgtaaagtttaatgttgacaatgtgttgcggaagcatcaggcagatagaacccaagcagtggaaaagaaaacttggaagaaagttgatgaggaacatctttacatgactgaacatcagaaacgtgctgccgaaggacagatggtagttaacgaggatgagctttctataactgaaattggaatggggagaggtgataaaattcagcatgtgctttctgaggaagagctttcatggtctgaagatgaagtgcagttaattgaggatgatggacaatatgaagttgacgagacctctgtgtccgttaacgttgaacaagatatccaggggtcaccacaggatgttgtggatccgcaagcactaaaggtgatgctgcaagaactcgctgagaaaaattattcgatgaggaacaagctgtttgtttttccagaggtagtgaaagctgattcagttattgatctttatttaaatcgtgacctaacagctttggcgaatgaacccgatgtcgtcatcaaaggagcattcaatggttggaaatggaggcttttcactgaaagattgcacaagagtgaccttggaggggtttggtggtcttgcaaactgtacatacccaaggaggcctacagattagactttgtgttcttcaacggtcgcacggtctatgagaacaatggcaacaatgatttctgtataggaatagaaggcactatgaatgaagatctgtttgaggatttcttggttaaagaaaagcaaagggagcttgagaaacttgccatggaagaagctgaaaggaggacacagactgaagaacagcggcgaagaaaggaagcaagggctgcagatgaagctgtcagggcacaagcgaaggccgagatagagatcaagaagaaaaaattgcaaagtatgttgagtttggccagaacatgtgttgataatttgtggtacatagaggctagcacagatacaagaggagatactatcaggttatattataacagaaactcgaggccacttgcgcatagtactgagatttggatgcatggtggttacaacaattggacagatggactctctattgttgaaagctttgtcaagtgcaatgacaaagacggcgattggtggtatgcagatgttattccacctgaaaaggcacttgtgttggactgggtttttgctgatgggccagctgggaatgcaaggaactatgacaacaatgctcgacaagatttccatgctattcttccgaacaacaatgtaaccgaggaaggcttctgggcgcaagaggagcaaaacatctatacaaggcttctgcaagaaaggagagaaaaggaagaaaccatgaaaagaaaggctgagagaagtgcaaatatcaaagctgagatgaaggcaaaaactatgcgaaggtttctgctttcccagaaacacattgtttataccgaaccgcttgaaatacgtgccggaaccacagtggatgtgctatacaatccctctaacacagtgctaaatggaaagtcggagggttggtttagatgctcctttaacctttggatgcattcaagtggggcattgccaccccagaagatggtgaaatcaggggatgggccgctcttaaaagcaacagttgatgttccaccggatgcctatatgatggactttgttttctccgagtgggaagaagatgggatctatgacaacaggaatgggatggactatcatattcctgtttctgattcaattgaaacagagaattacatgcgtattatccacattgccgttgagatggcccccgttgcaaaggttggaggtcttggggatgttgttacaagtctttcacgtgccattcaagatctaggacatactgtcgaggttattctcccgaagtacgactgtttgaaccaaagcagtgtcaaggatttacatttatatcaaagtttttcttggggtggtacagaaataaaagtatgggttggacgagtcgaagacctgaccgtttacttcctggaacctcaaaatgggatgtttggcgttggatgtgtatatggaaggaatgatgaccgcagatttgggttcttctgtcattctgctctagagtttatcctccagaatgaattttctccacatataatacattgccatgattggtcaagtgctccggtcgcctggctatataaggaacactattcccaatccagaatggcaagcactcgggttgtatttaccatccacaatcttgaatttggagcacattatattggtaaagcaatgacatactgtgataaagccacaactgtttctcctacatattcaagggacgtggcaggccatggcgccattgctcctcatcgtgagaaattctacggcattctcaatggaattgatccagatatctgggatccgtacactgacaattttatcccggtcccttatacttgtgagaatgttgtcgaaggcaagagagctgcaaaaagggccttgcagcagaagtttggattacagcaaactgatgtccctattgtcggaatcatcacccgtctgacagcccagaagggaatccacctcatcaagcacgcaattcaccgaactctcgaaagcaacggacatgtggttttgcttggttcagctccagatcatcgaatacaaggcgatttttgcagattggccgatgctcttcatggtgtttaccatggtagggtgaagcttgttctaacctatgatgagcctctttctcacctgatatacgctggctcggacttcataattgttccttcaatcttcgaaccctgtggcttaacacaacttgttgccatgcgttatggatcgatccctatagttcggaaaactggaggacttcacgacacagtcttcgacgtagacaatgataaggaccgggctcggtctcttggtcttgaaccaaatgggttcagtttcgacggagccgacagcaatggcgtggattatgccctcaacagagcaatcggcgcttggttcgatgcccgtgattggttccactccctgtgtaagagggtcatggagcaagactggtcgtggaaccggcccgcactggactacattgaattgtaccatgccgctcgaaaattctgacacccaactgaaccaatgacaagaacaagcgcattgtgggatcgactagtcatacagggctgtgcagatcgtcttgcttcagttagtgccctcttcagttagttccaagcgcactacagtcgtacatagctgaggatcctcttgcctcctaccagggggaacaaagcagaaatgcatgagtgcattgggaagacttttatgtatattgttaaaaaaatttccttttcttttccttccctgcacctggaaatggttaagcgcatcgccgagataagaaccgcagtgacattctgtgagtagctttgtatattctctcatcttgtgaaaactaatgttcatgttaggctgtctgatcatgtggaagctttgttatatgttacttatggtatacatcaatgatatttacatttgtggaaaaaaaaaaaaaaaaatgtagttctctctctctccctcgtgc

SEQ ID NO: 32677 - DNA, 917 bp, Triticum aestivum
  Clone ID: PAT_TA_32677
cccacgcgtccgcccacgcgtcctctgctctctcccgctctcgacacctcctagctcggctagggttttactttcccctccgacaagctttcaccggcgacgagcgccaccatgacggccgccgagctgctccgcgcccagctcggggagcacaacatcgaggaagatgaccctatccttgaggatgatgaggatgcggatgaaatggatgacgatgatgttgagggaggtgatgctagtggaagatcaaggagtgagaagaagtgcaggaaagccatggagaagcttggcatgaaggccattactggtgtgagccgtgtaactatcaagcagagcaagaccgttacgtttgtcctctccaagccagacgtcttcaagagctcgcactcagaaacctatgtcatgttcggggtggtcaagatggaggacatggacgctcagctgctgacagaagcggcggggcagttcaaggcgccgggaccgagcagcgtcatctcaaagggtgagccgtccgtggcagcagcccaagacgacaaggaggtcgacgagacgggcgttgacaacaaggatgttgaggtcgtgatgatgcaggcctctgtgtcgaggtccagggctgtgaaggcgctcaaggctgcagatggtgatattgtcagcgccatcatggagttgacttactaggtgatgatagggtgaggggtcccaaatcagtcttggtcatgtcatcttgaatgttgcagttgtggaattggaggctctatgtctgttgaaactagtactggcatgtagggtttagaggcgtttaacatctggggaccagagaactgcttgctcttatgcgaaaatctgaatgggctgtgccaaattttgctacaaatgcatgtcactcggtgtttcagacaaaaaaaaaaaaaaaaaaa

SEQ ID NO: 32678 - DNA, 893 bp, Triticum aestivum
  Clone ID: PAT_TA_32678
cccacgcgtccgcacttttacacacggcagcacacggaacacgcacacacattgcttgtgcacctcctccgccggatcacgagccaaccgcacctcagccggcggggtaagagcgcgagacgatggctggccggagcagcagccgttccatggtgtccgcgcaccggctcttcgcgccggcgccggcgcgcaccctgcagcacgcggccgacccggccctggagctcgacgaggccgacatcatctggggcggcgcagcgctggcgtcgtccccgccggccgacgcgtacgggcgggccctgtccacgtccactccctccagggcctccaagccacgcgccgcggcgccacgagatgccgccggtggcggtggaggcgtcgggggcccggcgtcgctgcctgtcaacatccccgactggtccaagatcctggggtcagagtacggcgggggcagcgccggcgcggggcggtggccgtcggacgatcgcggggacgcgtacctggaccgcggcgaccggcagtgggtgccgccgcacgagcagctcatgtaccgggagcgcgccgcggcgtccttctccgtgcgcgagggcgccgggcgcacgctcaagggccgcgacctccgccgcgtccgcaacgccatctgggagaagaccggcttccaggactgatcctgatccggcccgcctacggcgatccatcgtccgtgcccttacgattaatttgatgagtttttcttttcttctacgagtagtttgtgatcggtgatgagaatgagatgcagcggatggtagtagagattggttaagcctctggttttggcagttttccccggagaggccggctggctcgatgtactaccactaaaacaaccagcgaatcgattgctccttaac

SEQ ID NO: 32679 - DNA, 811 bp, Triticum aestivum
  Clone ID: PAT_TA_32679
gattctgcaactggagggagtaaagatagcagggtgcgaacgagttcaggaacatttcttaaaagaggccaggacaaaattgttcgcaccattgagaaaagaatatcagatttcaccttcatacctgtagaaaacggagagggccttcaagttctccactatgaggttggacagaaatatgaacctcactttgattacttccatgatgatttcaacaccaaaaatgggggccagcgtatagccactgttcttatgtatctgtatgtactacaaagatatgcattttgttacatataacatgcaacatagatgatccaattgacttttcttttccaactgattaattagttcggatgttgaagagggcggtgagaccgtgtttccttctgctaaagttaatagcagctcaataccatttcataatgagctgtctgaatgtgcaaagcggggtatatcggtcaaaccgaaaatgggagatgcattgcttttttggagcatgaggcctgatggaaccctggatcccccaagcctccatggtggttgtccagtgataaaaggtgacaaatggtcatttacaaagtggatttgtgttcatgagtacaaagtttaggcataacagaaccaggcccttaaggtcatgcagcagttactaaatatgtggacgttacagcacatgatgaggtctccagttttccataaaggatcgccctacatttttttttttcccttaaccaaggcttggttttggtccccttgttgtacattaacttgttaatcaggcttatgaaccaatatgaaccatgatcgctcc

SEQ ID NO: 32680 - DNA, 1356 bp, Triticum aestivum
  Clone ID: PAT_TA_32680
gaccgacgactcgggtcacaccgcgagagagaaggagagacagaggacgacggcgacgacgaggcgctaaacccaccgcgtcggtgccgcgagaccggaggccaggccgcatcccgggcgggcgggcgggcgcgcgcgcgcgatggcgagcaggacggcggggcggggcgggaggccgctgctgggcggcggcgccgggggcgggaggcgcgggaagccgtccaaggcgatcctggccgcgctgctgctggcgtcggtggcgctgctgctcctcctggcgctcggcgcgctctcgctgccggccggctccggccgcggcgcggtcctctcgctcccgcgcccgcgcttccgcagatccgcgtccgagtcgaggctggagaagcgcggggagaaaggggagccctggacggaggttctgtcgtgggagccacgggcgttcatctaccacaacttcctctccaaggaagaatgtcagtatttaatttcattggcaaagcctcacatgaagaagtcgacagtggttgattctgcaactggagggagtaaagatagcagggtgcgaacgagttcaggaacatttcttaaaagaggccaggacaaaattgttcgcaccattgagaaaagaatatcagatttcaccttcatacctgtagaaaacggagagggccttcaagttctccactatgaggttggacagaaatatgaacctcactttgattacttccatgatgatttcaacaccaaaaatgggggccagcgtatagccactgttcttatgtatctttcggatgttgaagagggcggtgagaccgtgtttccttctgctaaagttaatagcagctcaataccatttcataatgagctgtctgaatgtgcaaagcggggtatatcggtcaaaccgaagatgggagatgcattgcttttctggagcatgaggcctgatggaaccctggatcccacaagcctccatggtggttgtccagtgataaaaggtgacaaatggtcatctacaaagtggattcgtgttcatgagtacaaagtttaggcataacagaaccaggcgcttaaggtcatgcacccgttactaaatatgtggacgttacagcacatgatgaggtctccagttttccatagaggatcgccctacatttttttctaccttaaccaaggcttgggtcttggtcaccttgttgtacattaacttgttaattaggcttatgaaccatgatcactcagagaagatgtatttgttgagtgtataaataaccattgccctcctaacgcaaatcgagatgagtccccgcggccccgatatctgtgaaagagcattcctgttcaaaaaaaaaaaaaaaaaaa

SEQ ID NO: 32681 - DNA, 727 bp, Triticum aestivum
  Clone ID: PAT_TA_32681
ttaataagggaaactggaccccaaaaaaccatacatggcatcggttaattaagggaaaccggcgaagagcgtgctagagagctattttaccggagaaacctctcaaatttatccatctaaggcacctgagattggaaataaccttttatccctgacgaaaaggaagtccgatgtccttgattttgcctccctcttggaggctgctcctttaatggaaaagctggagtttcatatgtggatggactgtgaatgtgtacgataccgcaagcttgatggcaagctaaggagcctacctccaaagccacactaccatctcaagttggtggacattacggggttttatggtgagaaagatcagctggagttggcactttatatcctcaggaattctgtcgcgcttgaggcaatgacaatagatccaaagccaacggtagctgctgagcagtgtcgtctgacatggaaaaaagacgggttttcttacgtggatggctacagagttgcgaagaaataccttctcagggcagaccaccgcggcgttgtcgacgttgtaaaagccgggcgtaaggatatcgaagctctgaggaacgctccgtataagatgcctgaagctacataagctttgttttaatcagttgtttaataccttttcatgtagctcgttttgtggacatttttttccatgcgcggactcgcactgctatgtttctttcagttcagttttgttccc

SEQ ID NO: 32682 - DNA, 1254 bp, Triticum aestivum
  Clone ID: PAT_TA_32682
atcgaacggcgccacgcacggcggcgacggtcacattgcacattgcacgctccgcccacgccgagggaggccatccatcggcctagcatatctcaaggtccgacggccgcggtcccagccccggccgtcggtgcgcattcgcctccgttcttggagaagctagctagcggcgagcgagcatggcgttgggactccgggaaggcggcgccggcgagctgcagggcaaggagggtagcggtgaggccacggcggcggctccggcgtaccgctacgccgcgaccgactcgttcgcctacgatgacatgccgccgctgccgcagcagatggaccggcagccgtccgtggtgctcggcggggaggggatgctcggcgacggccggatcccggcgtccgtgttcgagcgggacacgtcggagaccggcagggactggagcatgatgtccaccgagtcggtgttcgggctccaggtcgcgccctcctgcgacttcaccggctacttcctctcgcacccggagctcatggacatagccacgccgccccgcgacagctccgccgacgtcgcccgcccctccgccacgtccacgccgcggcagttcaacgccgtcccggagctcggcgacgccgccccgagctactccttcgccttccccaatctgatggaggacaggaggtacagctccaagaaatctcggcaatctatcgacatgccgccgacgccgagaacggcagagtcgggggagccggcagcggagacgacggcgccggagaaggcaagcagcaaaccggaagcggagccggaagcgccgaagggcggcatgttctcgtggatgccctgctgctcttgataaacaccgtcaatggatcgccggcggcaaaaaccggctaggagggacgctcatcgtgtccggaccgtcaccggcaacattagctcgagcagtcggaaatggcggccagagacaggaaaaggaagtgagaaattatggatcgattcgaaggacaaaaaacacaatcaaaaccagcttttaaatttttctttgccccagagtggtgtcttgtaatagattgcttccctttttggtcacaaatgtcgtccacaacgatgaatttgagatttctgtgaatcatccatttgacatttcagatcttctgaatgtatataaccagaggaaaaacaggttaaattcatgtaaggtactgtatctacctaactagatgcatgacatttatctatgcaaaagacaccccttccacaat

SEQ ID NO: 32683 - DNA, 886 bp, Triticum aestivum
  Clone ID: PAT_TA_32683
tctaaccctgcagccgccgccccgtccatgttctgatcggcttcgccacccacgtcgcgccgcgcgccgccgccgccgccctgcgctgtccgctgcatccccggctcgccgcgcggtacgactccggccccacgtgctctccgagagaaaccagtaacaatggtcgtccctccaccagacagggccgctaggatcgtcggttttctcaagccctaccttttgaggatgcatttctcgaacaagtatgtaactgcccaggtcatccataccccaacagcaaccgtcgcgtgttctgcaagctcgcaggagaagctgctgagaccgaacttggagtcgacccgcgacgtatctgccgccgcaaagattgggaagttgctgggggagcgcctgctgctcaaggggatacctgccgtgtccatccacatgaagagagagcagaagtaccacgggaaagtcaaggctgttatagattctgtcataagaatctggtgtcaagctgttgtgatggtgaaaacatagagctcggcttagcatttgcgcagtcttgagctgcatttctgatttttggtactgattgcaacttttgtgttcatgaatttggcaatgaacgaacgtttgtccgggactccaggtcaataaaaggactttgttgtaggagctcgacctgataatctgcagtagcactttttatttgaaacaaatctgctgtagcacttgatgacttgaggatcaacagcctgttatgtttctcctctccgaaatgcaacggagattattggggtggagatattcccagacgctcacctcttttgcgtgtggattaatgcatgatcgcgactgcgagttatcgtgccgttaaaaaaaataaaaaaaaaaaaaaaaaaaa

SEQ ID NO: 32684 - DNA, 1642 bp, Triticum aestivum
  Clone ID: PAT_TA_32684
gcgccacgcggacgatcccggcacccgcctcaaccgccgcccggccccccgccgtgcgtccgtgcgtcgaggggaggcaccaacgcgctcaaactgtgcgctcccccaccaacccacgagaccatggccgcgcccaccgtcgccaagtcgccgccggcgctcgtccctccggcggggcccaccccgggcggcgtgctcccgctgtcctctatcgacaagaccgccgccgtccgcgtctcggtcgacttcatccaggtcttccccccgtcctccgaccggggcggcgacgaccagttcacctcgatgggtactgtgttcgcgagggcgccgcggtcggaatcacccggagcagcaagactcacccgggaggcggcgcggcccgaagtggtcggcgtgatgcgagaggccaaggaggcgcttaaggtgaggttcacggactggatgcacggcggcgccaaggacgaccactacaatgtgccgctggattacggcaccgtcacggtgtcggactggagccgcgtcggcttcaacgaggtggactatggcttcggcgagcccggatacgtgttcacgctcaacgacgacgtcaacatcgtcgcgtcggtgatctacctcaagcccccggacgcccaagcgcgggatccggctcatgctccgctgcgtggaggagccacacgccgctgtgttcgccgacgagcttgccaagtacgcttagctggatggtgctgcttggccatggccgagtacatcttctcatacctgtaacaccttttcactgtactttttcttcacattggtggtgtccagtgttttcatttaggtcacattcgggtgctttgtgcaggtataaaccacattactacctctgctttctgttgatgtcttttcaatgtggaacaattgtacgctgtcaacatccaatatggcttcgccgccagcacgcgggcacctccttcagggcgtgctgccgtcagtggatggctactatggcaactgcgtgtacccggtcgggatcacccggagcagcaagaccatccgggaggcaccactgcccgaagtggtcggcgtaatgcgagaggccaaggaggcgcttaaggtgaggttcacggactggatgcacggcggcgccaaggatgaccactacaacgtgccgctggattacggcaccgtgacggtgtcggactggagccgcgttggcttcaacgaggtggactacggcttcggcgagcctggatatgtgttcacgctcaacgacgacgtcaacatcgttgcgtcggtgatctacctcaagcccccggcgcccaagcgcgggatccggctcatgctccgctgtgtggaggagccacacgccgctgtgttcgccgacgagcttgccaagtacgcttagctggatgctgcttcttggtcatggccgagtacatgttctcatacctgtaacaccttctcactgtactttttcttcacattggtgtgtatgcaatgttttcatttgtttaggtcacattctgatgctttgtgcaggtataaatcacactagtatctctgccatgtgttgatttcttttcaatgtggaacaattgtaagctgtcagccacaagaatgaataaaattcagtttatggtggggcaattcatcatgatta

SEQ ID NO: 32685 - DNA, 256 bp, Triticum aestivum
  Clone ID: PAT_TA_32685
ctgttgtgtttgttgttgtatgtacatttgtctcttttagccattgctgccgatttgccattcactatttgacagtgagcggtacataggaggggacaatctttatttttggttacatgctgattacagacagtgtactggttctgtcgaccgaactatggagcatgtctttgtcatgttcaattgatttttcttcttcattctgctgtattactgaccttgatattcaacctgaagtgggtgggtttattcctcc

SEQ ID NO: 32686 - DNA, 1729 bp, Triticum aestivum
  Clone ID: PAT_TA_32686
cggcccccgcctccggggaccgtgctggtcgcgctgctggttcactgggctgcctttcgtagggcgttattcccccgcagtcgtgcctgccaggccgtcaaaagcgctgccgtctccgggcttgtcggccttgctctctgtccggtgcttccctggccactcatgcttcttggtctgcccgctcgaccgggggccggccttacggtggtgctgggggccttcggtccgcgcgccctctggctttcttgaaggtacttctaagtaagttatctctggatgactcctgtttcagaaattctttgagcagccaagcgaaggatgtgcatatgtggagtttggctcttgctatagttgcctctctcaaccattgtatggatgatgatgtttctcgtagcagtgttgcgaacggtactgtcagcatcctttcaggacaagttccgctgatgtcctcttatctatctgcacaaagtgttaatacacatcagcaacaagaaaagggcggtgttgcaacagtcgcagacatcactttcagctctgagtttaactggagaatatcctctcacttctgtggtgttttagcaaaatatcattttccacgggacactggtatgatgcaagtagattcagaattaagagagattattatccacctgcttgcttttattagcagaggaagtgcaaggactggcgattcaccaaactggaacccatcattttgttgtcctcctattgctaaggaagaagtcgtgcttcatgaagatccaccactcatcaggagcaaacatggatggttcagatttgctgcaagcagtactcattcaactgcagctatttctgctccttccaatgcagcattatctctggtgatcagagacaaaagtagtggagattctggttctgtgaaacagactcgttttaccgagatggtagctgtgcagatttacagagtagccttccttattatgaaattcccccacgcgtccgcccacgcgtccgcccacgcgtccggagaattagaatttgttgatcttgcacattttcctgaacttcccatgccagatattcttcatggtctgcaggatcaagtggtttctatcgttacggaagtactgggggcaaatggatcgagtgccctcagcggggagaccgatagggtatgccgtcttctgttggtgaccctcgaggcatcactctacatggaactgtgcgtgtcccagtcttgcggcatcaggccagtgctgggccggttcgaagatttctccaagggaattaaggcgatgcttcacgctctggagaaacattccagtttgaaaccattggttaggtcacttgctcagattacgacactcctgtatcctgggcttgctcaaagcaacttcctcagcatgtaatcagtgtgtagattgtatctctgcgtctggtaaagtcttttgctatggttcatatagtggcaacaggttcagtaaaatcgacccgtttacagtggagacgatcgctccgagtttaatctgctgctatggttcatagatgaaatcgtttagtcaactaacatgtcacatagcgttcatgcatgtatatttctgtatgcttgcatgcatgtatgtacagtaggacaaactctatcaaggatttcaacccgctctgaacagggtccaacctcgcacgcatatatagggcaagatcgtttctcatcaaaaaataaataaatgaagggaacatgtcttgtatc

SEQ ID NO: 32687 - DNA, 641 bp, Triticum aestivum
  unsure (1)..(641): unsure at all n locations
  Clone ID: PAT_TA_32687
aaacaagaagacgcgaggcaactgatcagaacgctagctagtagctacactgttcgatctctcatcgttcatggagagcaaggcgatgcgcgtgcgtgtggggctggcggccctgctgctgggcggctgcctgctgatggcgggcctgcaggaggcccacgcgacggcggcggaggcgacccagccggagaccaccacggcgcgcgtgctcaaggtgacgggtgcgtatatgccggagcaggccaacccctactcgcgcggatgccacgccaaaaatggctgccgcggctgatatgcacgcgcgtttgtgcgtgggcgggcgggcgtcgcggcccggtgagtgcagtgcagatgcgcgcatgcatggcactcgtgtgtttgtgtcgtgtttcggcagccacggacgtacgtgccgtgccgtgtgtttgctgaccactcgtttccattcgatttgttcattccttacagcgtgagaattatgtatggtatggagtacgtacactttctccttctttgtaggatggactctttagtattttgtcaacagtattgacttggtgcctctaaaaaaaaaaaaaaaannnnnnnnnnnnnnnnnnnnnnnnnnnnnnnnnnnnnnnnnnnnnnnnnnnnnnnnnnnn

SEQ ID NO: 32688 - DNA, 550 bp, Triticum aestivum
  Clone ID: PAT_TA_32688
ccgtgaaggtcgccgctggagatgagcagcgcctgcttggagtcgctgatgcccatgcacagcgccacggcctcggcgctcatgacgtcgctcctcgccgccccggctcgcgttggttcctgctggatctccgaagatcattgagatcagtgaggatggaggtcacggatgaagatgcatgctatttttttaccactcgtatttcttttgctttatcaaatgcacatggctgagcaaatcctgtaacttggatccgtgtgatgttttgcctgataatgcaaattaacatccttagcttattacctgggatacgtacgatgattgttagccgcaataataccatgtatgctttttttttctagccaaaaatatttgtttgacacattttatatctctatagacttatgatgggtgaggacggaggtctgggatgaagagacgccctgtttattttcgccagtaacttttatgatgtgagttgaagagctggagcttagagtattcgtttctatttgtagccgtgaaaataaaaatagttaaaaaaaaaaaa

SEQ ID NO: 32689 - DNA, 562 bp, Triticum aestivum
  Clone ID: PAT_TA_32689
cattccaaaactaaaatgtttattaacccccggtattactccgaataaatcatcgccgtacaacacatatacgtaccctcgaaataacaaataagctagcggtaaaatcaggaaatcatatgtaggaacaacatgcttatcattagtccagctgacaatgcatcagtcgtggcggagatggatcttgtactccacggtggcatcgccggtcttggcgtcgaaccagtgggtccgcaactggcagtagccgcgcgcgaagcggaagacgccggtgccgccgacgacgggcatctccctgacggcccggtccgcctggttgggcccgatgatggcgatgctgctcccgttgtaggcgccgtcgacgaagacgaagttcatggccatgagcagcgacaagctgtccttgccggcgctgacgtacatgccttgcgcgcggccgaggagcctcgacgtcaggttgggcccctcggtgagcgggtcgtcgatgacgagcacggtgccgaagcccgtggcggaggcgttggaggacggcgcctgcgccacctgcaccacccttgcgttc

SEQ ID NO: 32690 - DNA, 787 bp, Triticum aestivum
  Clone ID: PAT_TA_32690
taggggcttttttttttttttttggtaaaatcaggaaatcatatattggaaatcaggaaatcatatatgggatcagaacaacgaattaacaatcacagcaccgaccgggcacgaaacaaggatgcatgcatcagtcgtggcgaagatggaccctatactcgacggtggcgtcgccggtattggcgtcaaaccagtgggtccgcaactggcagtagccgcgcgcgaaccggaagacgccggtgccgccgaccacggccatctccctgacggcccggttcaccgggttggggccgacgatggcgatgctgctcccgttgtaggcgccgtcgacgaagacgaagttcatggccatgagcaacgacaggctgtccttgccggagctgacgtagaggccctgcgcgcggccgaggagcctggggcccgtcaggctgggcccctcggtgagcgggtcgtcgatgacggagacgctgccgaagcccgtggcggaggcgttggaggacggcgcctgcgccacctgcgccaccgtggcgttcggcccgccgctcaccacgtcgtgccagtacacccgcagccgggtctccttctccgccgcgaacgccggcgccgcggcggctgcgaggagcaggagcgcggccaggcaagagagagcggtgctgctcgccattaggatcagctagctagctaagcccggaatggatggtggtggtttgatgcgagtgccgaattcttcttgctaggagtggagggttgtgcagtatgtgttgtgacggccggcccgccgcctcga

SEQ ID NO: 32691 - DNA, 1511 bp, Triticum aestivum
  Clone ID: PAT_TA_32691
tccgggtcgacggatagtactaataaaaaggctagtcacaataatggtgtccagcacaacccacccctcaaataaaactaagggggtgcttggatatgttttagtcccatgactaaaagtagtgggactaaaacatgctagcctcacccatgcttggatccgaatactaaaaaggctaaaatcaagttaatgagcatttattatcctccaaaccctccaatccataactcgcctgtgttaaaggagaggagttaaatgactagagagaggactaatccacattttactaggggtacccctgactaaatttttttagtctcaagactagttttagcccctctttagtcaggggtgcttggaactttagcctcttaaagagactatttttagtcagactaaaataagttttttggatccccccctgcgggtctcgggttttttttttttcattcccaaactaaaatgcttattaaccccccgtcttactccgaataaatcatcttcgtttaacatattttcttacttttttttttttttataatcttttttttttttttatttttaatctgaaatgtttattaaaatcgtattattccaaataatcacatccgtacgacacatgcacataccctcgaaatttaaaataagcttggttcaaatcaggaaaccatatgtgtaggaacaacaagtttattattagtccagctgacaatgcatcagtcgtggcggagatggatcttgtactcgacggtggcgtcgccggtcttggcgtcgaaccagtgggtccgcaactggcagtagccgcgcgcgaaccgaaagacgccggtgccgccgacgacgggcatctccctgacggcccggtccgcctgattgggcccgatgatggcgatgctgctcccgttgtaggcgccgtcgacgaagacgaagttcatggccatgagcagcgacaggctgtccttgccggcgctgatgtacatgccttgcgcgcggccgaggagcctcgacgtcaggttgggcccctcggtgagcgggtcgtcgatgacgagcacagtgccaaagcccgtggcggaggcgttggaggacggcgcctgcgccacctgcaccaccctcgcgttcggcccgccgctcacgacgtcgtgccagtacacccgcagccgggtctccttctccgccgccgacgcgggcgccgcggcggccgcgaggagcaggagcgcggccaggcaggagagagcggtgctgctcgccattaggatcagctagctagtaagctaggaatggattggtgatcggatgcgatgcgattgcttagctcttcctgaggagctctggtttgtgctgcttccgcagccgggtctccttctcggccgccgacgccggcgccgcggcggccgcgaggagcaggagcgcggccaggcaggagagagcggtgctgctcgccattgggatcagctagctagtaagctaggaatggatgttggtggtctgatgcgatgcgattgcttagctcttcc

SEQ ID NO: 32692 - DNA, 465 bp, Triticum aestivum
  Clone ID: PAT_TA_32692
ttattgcacatttaacaaaatggttgggtgtcaaaagctttggtccatctctggtgaaaagacaaatttcggccgattcagtaggaagcgggtcaaatttgaactgtagctgcctcatagtttgctatatattttttccaaaaatcatttctaggtacataagtatctatttaatagagaaacatcaaaatttttccaagattcaaccactagctaggaacggtcaagcccgccgttttgaccgcattttgaaacgggcataaaaaattcaaaaaaatcaaaaaattggaaaaccttcgcattgtgtcatcatatgtgaccaagtttccaggaaaaataataaacttgtaatacgggaattatttaaaaaaagtgttctcagaaacgagctataatttgtgaagattcatggctttcaagcgaaatgatcaatcttatggccacattcatggcatagtttgttca

SEQ ID NO: 32693 - DNA, 1073 bp, Triticum aestivum
  Clone ID: PAT_TA_32693
ttttttttttttttttttatgttgtttcaaccagcagcagacataatccatacaagcagatgttgatacacatacaatacaaatagtcagaagtctgatacacatacagtgcacaaatgcgtccagagttacacaaaccacatgccagaggcacacgaatatagttgggcaaaggatatcatagtacataacatccatgacaagaacaatcaaacatgtccttcaaagaggatatccatcttgttctgaacaagtcgggaccaagcaatagtaatttcaacctcagatgcaccaattagacatttacctttttctatgttgcaatgtttgggactgaaattgacaggatattgctggatatcaccagactctgtgtagacttgaatgacaaatttcaggatttcttccagttctacagaaacaacatgccttgacagatcaagataaccatctgagccccttggcatttctccaccatcagaatcaaccaacacaacttgcctggacaggggatccgtagcactgtgagtacccatgaccttatcagcctgtggtgtcgaggagctaataaccctgcctccatgatcaaagggccatggccccccttcaacaacacggacacccaaaatagtagcctggacagtttccgtaagtcgctcgaggctgaactcaactgtgcaaaggcagttggtaaagacaaaggaatctaaacctccctgataaccaccagagtaagtgaggcgacggctgatcaatgctctgtcgcagagacccttgttgtgccctttactttcagttggacttctaagtcaacatcgtccactgccacgatcgcacgagacgggccagtcaagtccaaggtaggtcgcgctggagctagtctttgccagtcttcccgtcgccgaaagtagagaacgttgcggttgtactccacggcgtctcgggcagcgacaatcccatacacatcgagtggccacttcaactctccatctcttccgccaatcttcatggagtagatctgcaaggtgcgctcagagccaccggccgccggggtcggtcgcggcgtgcaatgt

SEQ ID NO: 32694 - DNA, 2326 bp, Triticum aestivum
  Clone ID: PAT_TA_32694
gcacgtcgcatctccaccgccgcatgtgcccgccgtcgcgttgatcgatccgccgacgcagccggagagggagcgcatctatccgtatatacacaggaggagccggagagacgaggggacgatgacagccgggcccaagatgcgcgccggcgccgccaccgtggtgctggcgctggcgctgctcgccgtggcggtgcgcgccgaggacccctacctcttcttcgactggaaggtggcgtacgggaccaagtcccccatgggcacgcccccgaagatgatcctcatcaacggcgagttccccggccccaccatcaactgcacctccaacaacaacatcatcgtcaactgttttcaacgagatcgaccaggcgctcctcttcacctggcacgggatccacccagggaaggcattgtggcacgacggcatgccatgagagaacgcttgcatgcagcctgctgtcaacactacgtacgtgaaacggcaccaacaggaggagcaggagagtttctactacccttgcatcggcatgcagcgcgccgccgggacctacgggctcatcagcttccacagccgcccgctcatcccggtgcccttcgacccgagggccgacgaccgtcatgtgcgcgtcggcgatcggtacaacaaggaccatgccgtgcgagccaagaacctcgacaccggcaagggcatcggccgccccgcggggctcctcatcaacggcaagaacgagaaggacgcctccaacccgcccatgttcaacgtggaggaaggcaagacgtaccgcttccgcgtctgcaacgtcggcatcaagaccaccctcaacgtgcgcatccagggccacgtcctcaagctggtcgagatggagggctcccacaccgtgcagaacgagtacgactcaatggacgtccacatcggccagtgcctctccttcctcagcaccgccaaccagaagcccggggactacttcttcatcgcctccacccgcttcatcaagggggtcagcaccatcactgccgtgatgcgctacaaggggtccaacaccccgccggcggccaagctgcccgacgcgccggacggatgggcctggtccatcaaccagtggaggtccttccgctggaacctgacggccagcgccgccaggcccaacccgcaggggtcctaccactacggccagatcaacatcacccgcaccatcaagctctcccccagccgcggcaaggtcgacggcaaggagaggtacgccctcaacggcgtgtcccacaccgaccccgagacgccgctcaagctcgccgagtacttcaacgccaccaagggagtgttcgagtacaacctcgtcaccgacacgccgcccaaggagggcacgcccatcaaggtcgcccccagcgtcatcaccaccgagcaccgcacctacattgagattgtcttcgagaaccccgagaagagcatcgacaccttccacctcgacggctacgccttcttcgccgccggcatgggaccggggctatggacggtggagagcaggaagacatacaacctcctggacacggtgagccggcacacgatccaggtgtacccgaggtcgtggacggcggtgatgctgacgttcgacaacgccgggatgtggaacttgaggtccaatctgtgggagaggtactacctgggggagcagctgtacgtgagctgcacctcgccggccaggtcgctcagggacgagtacaacatgcccgacaactccctccgctgcggcaaggtcgtcggcatgccgctgccgccgccctacaccatcgcataaattactctcccccagctccattaattccactccactccactccatgagagaacgcttgcatggtgctgtacacactacgtacgtacaacgacaacaacaggaagagcaggagagttttttcgtttcttcttttttttcgtacgcccccacgtcgactgttcttcttgtcaggttcactctctcttttcgaggaaaataaaacaacaacaaaaagggggcctcatcgtcatgtgggcgccgcctgtcatcggaacgaggatgatgatttcagaacaagaagagagattggccggatacgagctcgatcgggacgccctctcgaatcgtttacgttgtaataggagttaattaattctatctgatgatcatcatttatccaataagtcctttgggcaaattggttattgtgtgtctataatcccatactatatatacgtacatttgcgcacctttgcggtttttattccatcttctgttttctctaacttcccttggatggaacttaattaaaatctggttcactgtaccgttgc

SEQ ID NO: 32695 - DNA, 655 bp, Triticum aestivum
  Clone ID: PAT_TA_32695
acgcatcccccccccacccaagccaccgcagcccccccgcgttgccgcccgcacccgcgcctcccccaggccggaccagcactgaagcagaccatactcctcctcggcaaccctatcccccccgccacagcatcttctagatcattgcatgagatcgactccaagtcaaagcctattaacggcaaggtggaaactggacagcagatggaaggcggcactcgtaacattaccaacgtgactgagaatgcggcatctgggtggagcattgtgaaggaggagctgacattttcagctggaagtgcccctttcagtagctgccatgcttccaccattgtagagattggggaagacaactttttggtggcttattttggtggatccaaggaaggtgctccggatgtcaaaatctggttgcagagatacagtgatggtcactggcatcctccagaagttgctgatgagcaagatgggttgcccatgtggaattgtgtacgatttcagcttcccgctcatgagctgctgctcttctacaagattggtcaggaagttcagaagtggactggtgcgatgaaacgattgctggatggtggcatatcctggtcagagcgagagcagctaccgcctggtattcttggccctattaagaacaagccct

SEQ ID NO: 32696 - DNA, 908 bp, Triticum aestivum
  Clone ID: PAT_TA_32696
accggcatccttatccatccacatgggtcatcttctccaattagcagccggtggatgaagatgtcaccgctagccatcaccgaactaattcccaagccattccgaatccacttctcgattcatttcttccaatttctcctcgttgaggtactgcggcagttgaccgtgtgtgcggagtgcgtggacgcgtttgtcgcgttctggaggatgtggatgctcgacgacgtcgtcgagtctggcagggtggccatggggaggagcagggaaaacacaaaagctacactgctcaacctcttggatggtcgatggctagagggccgtggctgaggtgttgtcgcttggcctcgtggaggagcctatcagggaaatcaccgaatcacccactgaggttgattgttggttctggaacatgaggtacgggacagaggctggccttgctgctattgtcctccgtgagatgctcgcctcctcattgttgttgctatcagactactaccaaataatggcggcacggggtaaaaatggcggcacgcaacaacagagaggccattgatttgcttatatcgggttctgctattaagttactgaagcaaggccagaagtgctttggcgtgacttcttccaacattgattggagcaattgggtgtggctttgttgggcgtcgggcgtgctttggcgtgacttcatcgggcgtcgagtgaagcggctgagcatggatttttgtggtagctctttcgacttcaatctgttcaagtcatggtgattgtcaacttctaattgcttggtgtgtgattgtgcggccggctgtacttgtttatatggttgaggtggctgggtttgagatcgccgagacatgcggaaatatgatcctaaccttgtcctatttttatattttggaattttcatc

SEQ ID NO: 32697 - DNA, 631 bp, Triticum aestivum
  Clone ID: PAT_TA_32697
ccaagatcaagagatgagatcacggatggaaatgtaagggaagataaatttgggagtatctattgaaagccaagaccaattgcaaattgggtatcttgcaaacaactagtagcaccattacatagcagttaccagtgattattaatacatcttcagacctaatggactgaaagcatcacaacacagtgatgagacgaagggcttcgggggcatctgcagactctgcaacctccctgttagcatgttaacaaccttcgtcatcgacggacggtttctcgggttccactggatacaccacagtgcaaccattgccagctgcctcaccttgtctttctcttcctgagtcgtttccaaaaaaacgcctgcagtcacatgcatgtacatgtgcaccccgtcggttgccttgttctcccggattcattcctgaaaataccttgctagcttgccgccccctctaaacctcatggtggctgctcaagcacaacggcaggggcagccatgcatgttaatcaagtgttgcataggaaattgtataataaataatgactgatgagttcccaattaattaaggtcagtagtgtttgatagacaaacttttgttttcccgcttgattaaaatttatttttgggg

SEQ ID NO: 32698 - DNA, 1215 bp, Triticum aestivum
  Clone ID: PAT_TA_32698
caccccgcctcctgcaccccctcgccgcgtcctcctcctctccgcctccgcccgaggagcggagccaaccgaccccgtcaagctcgccttcgcccgcgccgccgcctacaagaaggagagggctaatccgacgcccaagccaccgccaccgccaccgtcgcctccccctccgccgcagccttccgcgaaggagtccagcggcagcaaggaggccttcgagcgggcgctggagtacaggaacggcagcgggggaggactggacggcggctccccgcttctcaatccgtcgccggtccaccaccagagcacgtctcaaggaattgatcctttttcaaagaaaccgaggcccaaaaagggagggtatgcgtacgatgagaccgactttttgggcctcggtttctttgagaaaaaacgttatcaaggtccaccaccagggctgtctcaaggaattgatcctttttcaaatgaagattttcctgaggtggagatagtagttggcgaccctagtaaatttgggaagtctcgtcgttcaactgaaaatcaacctgtagatgctagcgagtctgaggaaacttcgcgttcaaaagacggcaaacaaaatgaagatagcaagcttgaggaaacaccgctttcaactgttactgaacctgaagatgatgaaaactcagagtcctacaaacccagggttacaacgtggggaatgtttccacggccacaaaatatttcaaaggcgtatggtggtggaagaaatataagccttggtggagagaccctaagtgctgaagagaaagcagctaaagataaacgtaccagagacgcgaccgctccatatattggtggaaaaaacaagacactcgatgcaaaaacaatggcagagtgcaccaaggcattgaaggaaggtgacgaacttatgaatgctggaaggctgaaacaagctttgccttattatgaaaaggtgatgcaggctgcggactttaagaccgaacttcatggattggctgcgctccagtggtccatctgtctggattcactctgcaggtccaaggaagccatgggcatgtatagcaagctgaaataccacccaaacgatcgagtcagcaagaaggcaaagatgttcatgttcagctttcaggcggcggacttcctgaaggtcgacggcgtgccgatgccgcgcgacacgggctacgaggggtacctgcccgggcggccgctcga

SEQ ID NO: 32699 - DNA, 1459 bp, Triticum aestivum
  Clone ID: PAT_TA_32699
ccagagttaaggaaagctctggtagtgaagaagccatcaaaagactgggcgaagcgcattcagcatgagtggaaagtcttagagaaagacttgccagataccatattcgtgagggcatacgaggatagaatggaccttcttagagctgtcattatgggtccagcaggcactccttaccatgacgggctctttttcttcgacatttacttcactcctcaatatccaaacacacctccacttgttaactaccgctctggtgggctgcggcttaatccaaacctgtatgcttgtgggaaggtgtgccttagcctgttaaacacctgggctggtagtggatgtgagaaatggaatccatccaattcaaccatgctgcaggttcttgtctccattcaggctctggttttgaatgccaaaccttatttcaatgagcctgggtatgctaattcagctaacacacctgccggggagaagagatccctaacttataaggactcgagacaccttcctgctgtcctgcaagacgatgttctattcttttcgaaatcctccaaagcattttgaggatttcgtggccggccatttccgcaagcacgggcgcaacgtcctggtggcctgcaaggcctacctggacggggcgcaggtcgggtgcctcgccgggaacggggtgcaggacgtggacgagggtgacgagagctgctcgctcgaagtcaggacctcgctctagaggctgttcgaggagctgctgatggagttcacggtgaagggagcggactgcagcaagttcctgtcggagaaggcgaagcagtcggccgcctccgccaccacctctagagggccgccggcagacaccaccctgaggctataagcggtggtcgccagccgagccgagccgagccaaaatggtagcaataattttggccatggaagcgattcgattctaggcttgcctagctataactcctcctgccctgacctcgtcggtcgataggaggcgccctacccgagcgagaggggaattaaacctgattgttttttgtgtaagtggtttatgtacatatgccctccccgcctagctcttccggtgaacataatccatccatccgtatgtttagggacaagtatcatcatcagcaccatcatcacctgtgagagagacactatgattaatgtcacccgtccctaggacttaatatatatctgacggaatctcgcccaaaaggctgagccggcggcgcctgtcgggcgtcaccgcctggcgtccgctctgcggcgagcccctgccgcgggaggcgctgctggcgggcgcctccgccgccggcgccccctctcccccgccgcccgctcccgccgcactgaggctgcaagtcctgcccgcctgccgggccgagcctcgccgtccctatctgctactacctccgtcccggtgtataagtcattcacttgcgagactcttatgatt

SEQ ID NO: 32700 - DNA, 688 bp, Triticum aestivum
  Clone ID: PAT_TA_32700
cgcttcttctcccacctccggccgccgccgcggccaggccatcgtggcggcgcgcttccgcgacctcgttgctccaccatcacccgcgccatccaccacccacaccatcatccatccatcacagcgccagccaccagtgcccacctcgcgcgacctctccctccagccggcgcgcccggccagacacaccgccgctgcttcttcttcccttcttccccgcttctctgaatctctgtctgctgctccttctcgcccgcgcccctgctgctgctcgtctacaactctccctgctgctatccttctccaagctcacctcctctctgaatccctactgctgctgctcttctactttcccctaccacgctgctgttctgctccttctccatctccaaactccaagtcgttgctgctactccatcttcctttgccccgctgctccttctccctcctctcaacgccccctgctactgcttcttctctctcaacctcctgctgttgccttctctctctctctctctgaaattctgtagtattgagagatgttcaagacttgtaaggttcagatttgaagagtacatgtaaactgctgtttgctctgtttagtacttgtataatatagtgtatgttttctgggatctgactagttgatgcatctatacaaataagttcgtgaatgttatatttgtcc

SEQ ID NO: 32701 - DNA, 1329 bp, Triticum aestivum
  Clone ID: PAT_TA_32701
gccggccggagggggccctcgcagtgccttccttcctgagtctctgggaaggagaaatacacacagcagacacatccatctgatctgcttagtttagttatcgtgctttgtacccgtgatcaggatggcagatgggctcttctccatggctcacccgtgggcctccgcctttggcatcctaggcaacatcatatccttcctggtgttcctcgcacccacgccgacgttcctgcgggtgtaccggaagaactagacgggggggttcagcgcggtgccgtacgtggtggcgctcttcagctgcatgctgtggatcttctacgcgctggtcaagaccaactccagcccgctgctcaccatcaacgccttcggctgcgtcgtcgagggcttctacatcctgctctacgtggtgtacgcgcccagggccgccaggcaccgcgccctcgccttcttcctcctcctcgacgtcgccgccttcgccctcattgtctccgtcaccgtgctcctcgtgccccagcccagccgcgtcaaggtcctcggcagcgtctgcctcgccttctccatggccgtcttcgtcgccccgctcagcgtcatcttcgtggtgatcaagaccaagagcgccgagtacatgcccttctcgctctccttcttcctcaccctcagcgccgtcgcctggttcttctacggcctcttcaccaaggacatctacgtcaccctcccgaacgtgggcggcttcttcttcggggtggcccagatgacgctctacttctgctaccgcaagccggacacgtcggccctggtgctgccgacggggatccacgacgtgtccacggaggcggcggcgcagcaggaggtggagctgccggagggcacccacccggcggtggccatgctaacggtgagcacgctgccgatgctggcggagctgcagaagatggagcaggagatcagctcgcccaccccgcgcaagggctacatcaaggctttctgatcgatcaagggctgatgcacgcacgggtgcatgcaggagatgaatcgctaacgattggcgaaccgaccgccaaaagaaatacttacgtttatatagttcttaatttcagtcgttcgtttgtaatggtctgtagtagtagtagcacattcgtgtgtgttgtcgtccaagggtctgatataccggccggccgggcaagtgactgatctaccattccacgtctgccctgggaaataaagttataaacagaagctcgcgttcgttgttgattcaaaaaaaaaacagcgaagtgatactgtactatgtgtgttatacatggattgtccttgtttattcgtaaaaaa

SEQ ID NO: 32702 - DNA, 1385 bp, Triticum aestivum
  Clone ID: PAT_TA_32702
ggctcgccggggtactcaccggggaccttgcgccgggccgcgccggggagcgggccgaggtggtgctccccggcgcgcccgtaccacggccggccggtcggcaccgccttccccgtggccgccgccgtgcgcatgggcacccgcgccgccccctacagcgcccccgacggcccctcctccaccgccgtccccgcggaggacgcgggccagggcgccatcgccctggtcgcctttgcgcgccggtcggggggtctccggccgtgtccggcgcgcggcctcgctacgggtggggctctcgctcgggccgcaggcgccccgggggccggtgccggtgcttggcgacctcgcgggggtcagcggggggcggcctcccctccctcagtcggctgcggcagctggaactgatgagaacactttgcggaaacgtcttgatcatggtattcattgcaaaaacagaatggtaacatctaatgtgcgacttgtaatctctattgccagagaatttgaaggtccagggttggagctttatgatcttattcaggaaggaatgcagggccttataagaggtgctgaaaagtttgatgcatcaaagggttttcggttctctacatattctcactggtggatcaaacaagctatgcgaaaatctgtctctgagcaaacccagatatttcgcttaccaacagtaggcatggatcttaccagacggctcacatggttgaggcaagttatcgtgtgaaggagtgcacaaaacgacttcgccgtaaacttaaaaggcgaccctctaatgaggaaatagcagtggacactggtatgccagtcaaacgtgtcgaagcagcagtgaacctcccgaagtatagtgtatcccttgatagcaaaattggaagcacagacatgacctaccaggaggtcacagctgatcccagcgccgagacagctgaagaaatgctgaatagaatgtcaatgaagaaagatgtgcatcaggcactggatactccgagcccacgtgagagacaagttgtcaagcttaggtttggaatcgatgatggtaggataagaactttgcaggagattggcaacatcatgggtgtcagcagggagaggattcggcagatcgaatcgggtgcatttcggaaactgagaggcaagaaaaaggtgaagtgtttgatggattatctggtgcctgtaggcaattggtgaactgtttgtctgcacaaagtatttttctttcagatttagttttgtttttgagaatccattacttgtaccatttacctagccaccccttatatagtgtaggtcaaatgaaaggaatcaataaattttggtgagcaatttaatttttaagatcggaaacattaaatatcagcatcccttgccgagcg

SEQ ID NO: 32703 - DNA, 684 bp, Triticum aestivum
  Clone ID: PAT_TA_32703
cccacgcgtccggtcgggttcagctacggcggattcgtggctttcgagatggccgcggcgtgcccaggcctcgtccgctccgttgtcgtctccggctgcaccgtcacctacacggacgccatgaaggacgccttgctggggaggcacgccggcgcccggtcgatcacggagctcatgctgccggagacggtggaacagctcaggttgctgttctcctccgccatgcacatgaagatgtggtttccccgtcgccttgtcaaggacttcctcaaggtgatgtgtaacaaccgaaaggagagagccgagatgctggacgatatggtgaacatgaggggcaaagaggcatcggcgcctgtttttcagcagaatatactcttgttgtggggcgagaatgacaacttcttccccgtaaggatggggagagtttgaaagaggagctaggcgagaaagcgacactgcaaacaataagcaaggcggggcatctagcccaactagagaggccgtgtgtctacaaccgctatcttaaaaagtttctggcagcacactctccttttgagttagtcaatacgtcatcataattgtatccagatatacgacgactcgtagacataacggaatttataacaataccctaaatgtgtcatgtttaataatttttcaaataatgtttgtacaacatcttgc

SEQ ID NO: 32704 - DNA, 729 bp, Triticum aestivum
  Clone ID: PAT_TA_32704
ctcccacccctctccgtcgacagccgccaccgcgctccacttcccccacttgcgctgcgttcttctcgcgtgtgaagtccaggaccaggacaaaggaatggcttcaaacaacacaaggggcaacggagaaagggctacgtccaggtgtactgatgctgatctatatggaggcgtcaatgtacttgctggagacggttttgagagccaggtttactcaaaagagatacacgctgatgctgtaaagctcagtgtaagaagggtccgaacaagctttgcccacacaaagatgccatgtccagggctgatgtcattaagaatgggagctatggtggcatgaaaattgtccacccgtcaccagctgtcactgaggatgtagcgcagaagtagatcaggaagacctcggggccactatgcacaatatttttatcaggtgttgtttccaatgacatctgaagttatttgctccggggtttcgtcatcacgcttgtttgcacggttccgagtactccagtttttgtactgaatgtatggtcttctatgagatgactatctgaaagtgaagtttttgtaatagtactataatgattcgtatggtcatctatgacctgactattgctatatatgtgctatatatatgactactgctgaaagcaataatgtcttttaccatggtgttgtgctgttcatgttgaatctttgattgtgagttcttgaattttgtatttgatt

SEQ ID NO: 32705 - DNA, 408 bp, Triticum aestivum
  Clone ID: PAT_TA_32705
tcgacgggagagaggaggagcttggaggtggttcatagcacggtgctcccctcccttgctctgcgttttcgttgtggtgaagatggcgatatcgatggagcgcaggaagatgaagcccgtccttgctctcgtgctgctgctgtcgtgccatcttcttcttccgctggtctcctccgtgcctgtgtcgagtaagtgtttgacctccaaccccatgcacgcatgcatggaccttacttaatatcagttcatcttctttcttggcatgtgtatgtgcatgcatgcatcttaattttgagccttgctctcggatgtaggaagcgtggccttgggaaatcatctagcctcagcttctagtctaactctggaggcggcgcctgttcaggtcaatctctcactctacctgatgcc

SEQ ID NO: 32706 - DNA, 572 bp, Triticum aestivum
  Clone ID: PAT_TA_32706
aaaagaagaaaaatgagattctttcaccattatttatttacacaatttgcatctcatcccccttagttttggcctgacttcctccgcaatcttgacaattgcgaagaacaggaccctgtacactaccaccatcccacaaaggaaggcaatgttgacccacttggagtaccccatctccacctgcagcttctcttgcagcacccgaaggccactgatggggacattcttctccaccagctggtcgcttgggaacgtctgccctatgaactcgttcttgtaaaacccctgcaccgcgtacttggggaaggagatgtagtagcaagggtacttccacactggctttgggagttcgttggggaggcggaaaaaaccgccattgagcatcatcaccccttgcaccccggccccaaaaatgatccccatcaggaagtctgggacgatgacggcgatgatcatcatcatgctctccaccagcagtgggcacatgcacaggttgacgacgaagtaggcgaagcggtcaggcccttttgttagcccggtaaggtagtacagcattgcgccggggatcacag

SEQ ID NO: 32707 - DNA, 874 bp, Triticum aestivum
  unsure (1)..(874): unsure at all n locations
  Clone ID: PAT_TA_32707
gaccgaaaaacatggtttgaggggggaaaggaacaatgtagtttggttcacacaacaaagaatgaagggaaataactgccatataaggaacgccttatgcgaaatcgccgatcacatatgcacttgttcatactattacatttattatgatcagcctgtaaaattatttatcgggttgcactattttatgagtaaacacaaactgatgcaatggtcacaccaagtaggcggggatgaattgaagtttcttggattgctaccatgagcctcccagtagtcacagacttacaatttcatgtctcactatgccgaagaacgacatgcttaatctgcgtccggttgtatgtgtatgtaatatgtacgagctcatccatggtctggattaccgcaggatatgagaactccatacctttggtgtcctctagtgtcattacttcgttccatgaatcaccgtcatccatggagactgcaatcttaagtgtgcccctggagaaagtgttgtaagcaactagtactcttccatccttcatcttaactccatcgatcccagaatttggattaggaagctcagtcttatgcgcgtaactccatgtcacaccaccatcggcagaatcggccaggcagacacggccaattgtctcaaaagatcgcaaaagcatccgaattgtcccattggcagtttggtatggaactggctgaatcaccccaagtgtttcaccttctatgtatataggaccgtgcttccgccatgtcctgccaccatcttttgtgacctccagccatgcaccccaagagttccagctttctactgaggacccacatagtaggcgaccatcttcaagcaggaaaggncttgttcttaatagggccaagc

SEQ ID NO: 32708 - DNA, 670 bp, Triticum aestivum
  unsure (1)..(670): unsure at all n locations
  Clone ID: PAT_TA_32708
gagcaaagcagatttattttattcaatcaccaggtagagacaggcagcttacaactcagcatatggtacaatgaatcagctcggttcaagtggacttttcatttcgcgagaaatatattaacattgaggttgccacaatcaatcaaaatctgcagtaactattcatctcaccgatctggcaatcgttgattagcacaatggcatcagcatggtacagtggttttggacccagaaaatgacaattagcgggagtatcacagcctcctccggtgctgggtcgcgccaccgaggagccaaccacagttatcaactgcgcaaaaacgtaggcaaacctctgtctgcatcgtctggcgatcagaagcccatggatccttcttcatagggaaccatccatcagacagactgctttgtgcgatgcaacgcagcggctgatacatacatacatgagggtactccgagcgcagtgattgttacatacacagggaccaaaattagatacatgtcgcagcattcacctcacttgacatgcaaaaccagcaagccaaggacagcaagtgcaactagtagtgatgttgctacaaaaagttgagggtgattgtagcgtgtaaaaattcagatctacttaatgttctcttgataagntcaggccagcaatacgtagtccttcctg

SEQ ID NO: 32709 - DNA, 1047 bp, Triticum aestivum
  unsure (1)..(1047): unsure at all n locations
  Clone ID: PAT_TA_32709
ggggtgaagattgctttatcacattttaaaataaaataagagtgcagacactcctccatccggttcctagtagtatgtcacgcccaatatgcgaccctatcctaaaggaactcgaaggtaccactaaggatagaagcgcatattgaagacgcttttgcaaggtggatatcattacaccgtaccatgttgtggatagataaaagtcaaacaaaaaacataacacatcagacatgagaacaacatccgactacgaatgaaccacaaacagcagccatcaaatcatccaccctgatagcccagcgagctgaacgaagcgacaaagaactactcgaaccccacgcagaccacgcacccgacccggaacctaacccctgatcgaagaagaagcagaggaagaactcaaaaaaaagcaagcatcgctctcacgtgtaagcatcactttagctgtacctgcaaccggtggctgtctctgaagtacccctagggggaagacgaaacccataaactagacgaccagagtagtcgagcggagcctggctggcgcgaaaaggctgggacgatctagcagaagcacaaccgggggcctggctccggtcgggggatgcgacggagataagcgggctgtggtctagcgggcaggccggcggtgacttgcagggccgcccaacagacccggacgcggcacgtacggcgcatgccatgcagccagccgggtggaatcgaccgggcggcatccggcccgcagggcgctgccgcggtccctccagcagtgaacccgaccgggtgcgctcaccggcgacgcctggcgcagcgctccgggctgaaatcccgctaggaagaagacagagtccacgaagaagacgaatgggcatagacgaaccaagcgtagtcgaacaaatcctcacgatcgcaacgaaacgggaacatgggctccaaggatacgacgtggaggccgggtacgcgacgacggaggcgtacaggaagaagcgctgatcgtggnaggtgttcgcgttccctgaagaagtcgagcagaggaagaagatgtca

SEQ ID NO: 32710 - DNA, 770 bp, Triticum aestivum
  Clone ID: PAT_TA_32710
cctgtttggtcgtcgtgtgttttgtggtttgttacgtacgtatatctgactttccttggttcagtttggagaccagctctaaatcacatgtaaaatacagtccttactggcttgttcatcgaactaatgaaacagccactacagactagcatttacacacaggatccaataaaccaaaagtcacatcatcttctccctgatacggaactaagggtcagataggctacggggcggctactccttggtggcggccgtcttcttcttgggagacttggcggtggtcttcttcttgggcgacttggcctccttctcggcggcggcaggggacttcttggggagcagcacggagttgatgttggggatcacgccgccgtgggcgatggtgacgccggcgagcagcttgccgagctcctggtcgttgcggacggcgagcagcaggtggcgcgggatgatgcgggtcttcttgttgtccttggccgcgttgccggcaagctccaggacctcggcggcgaggtactcgaggacggcggcgaggtagacgggggcgccggagccgacccgctgggcgtagcggcccttcttgaggtagcgcccgatgcggccgacggggaactggagcccagccttgacggacctggtcaccgccttcttcctgtcgccacccttccttccggccatcttgcttgctacctctccgtcgacgagatgctgtggtgttggcggcggcggtgctggatcggaacccgcagccctgccgcgacccggccggc

SEQ ID NO: 32711 - DNA, 661 bp, Triticum aestivum
  unsure (1)..(661): unsure at all n locations
  Clone ID: PAT_TA_32711
acaaaattcgacactagattagggttccacaaaagggagcaaacaagctctaacaatgttcaggggacacaaaatatgattgattgatgcttccaacatgtcatacatttgttcacaggaatctactttcttatttctgaatatacagtgcctagcatcttttagcatactgcaaaattgcaaggatactagacaggcttgctaaattcccccaaactgcatactgagtcagggcataaaccagattggtggggagccctctgaagtaaattttcgcggaaagcgccgcacactacgcgccctatttagtgttttgcgaccataaacacccatgtcagtactggaatacttactcccactgcttaacgccaaggatatgtcgaagctagtatcgtccaagtaatagatgctacccagttggagcctattgaactgagagacctcaacagccctagagcagcctcgaccaagcaagagcacccgaccaggaagcgagtggagctccacccaagaagcttcagagcccccagcgggagcaaccgcaaggttcatctcaaagattctgaacccatgcttgccacgcctggcaagccgcaggaccattagcaatttcccgcgggacttcaccagatagcnggacactgtgcgcgacttgcgcctg

SEQ ID NO: 32712 - DNA, 576 bp, Triticum aestivum
  Clone ID: PAT_TA_32712
ttttttgttgagagaagccaatcaagtgtgagtaatatcagtcagcgccaaagggctacgtacgtacaggagtttccccacacccaccactggcagcagcacaagccaagccaaccatcgatcatcatcatacacacgcgagggacgcacacgccctgccaacagccttagtcggtctgcggcgctgcggacggcagcggctcgcctcggaggaaggacgtgaaaagcgcgaacccccgctccggctggtcgacggtgaccatgtggccggcgccgcgcaccgtggccagcaccagccccttgtacgcgatcacgtacccggccacgtccttgcccggccccggcgaccacgcccgccagtccttttccacgcccagctgcagcttctccaccgaccgcctcgtcgccgtcaccggcaccatcgcgtcgaagtcgccgctgaatagccagatgcggatgccggtggtgaccagggccttgaggtgtggcagcatcgacgtcggcgagtccccgaagcgtttcaggttgtacgtccgggttctgcacccgacccacggatacttgagcgccgtgttg

SEQ ID NO: 32713 - DNA, 349 bp, Triticum aestivum
  Clone ID: PAT_TA_32713
tccacgggttctcctcatcaccgtattgtgcatgttttatgccttagatatttgaaaaataatctcatcttgagaagttcatatattactaccctggaaatccagaaacaaaaaaccaaagagttcacaaaactaacacctcaccggccacatctccttcatcggccgacgacgagcaactcgtgcggcggatctatgctgtgggatccagggcgcgggcaatctctttggcttttaaaataccccagtagcagaagttcaaaaatcttatcccgtaacaacaaaaaagtatgctctctaaagctgcttgtgtttatgccccacgtgatgtagggcaatggataaattt

SEQ ID NO: 32714 - DNA, 639 bp, Triticum aestivum
  Clone ID: PAT_TA_32714
cctccggaagtaccacaagaactaccagcgcgagacgtggggccgcgtgctgaacgtgctccgcgacgacggcgggatcacggtgaaggggcacgtgcagaagccggtgctcaaggagcggttcaagcagttcaacgcggccatggacgagatccagcggacgcagggcgcgtgggtggtgagcgacgagcagctgcagtcggagctccgggtatccatcaccgccgtcgtggtgccggcgtaccggtccttcctcggccgcttcgcgcagcacttcaccgcggggaggcagacggagaagtacatcaagttgagcgcggacgacctcgagggcatcatcgaggagctctttgagggcagcgccgggtccatgtcaaggagaagaaattaaccgacgaaccgaatccattcatcgggcagcggccgccctccgttctcgattccggcgacaaaatgtacccccactgctcttcttacgatcttgctctgctttttttcaccgcgtcgagtgatcaatcctcgcctcggtcgcggcggacagatagatgtgtgtgtgcgtgtgtatccgttgatcgatccgagcgttcatgcgtgttaattaattacctgtttatctatagtaaaaaaaaaaaaaaaaaa

SEQ ID NO: 32715 - DNA, 622 bp, Triticum aestivum
  unsure (1)..(622): unsure at all n locations
  Clone ID: PAT_TA_32715
agggccaaataacatagctgccaattttattccttgaatacattttgccccagagggcgagacaagtggtacaaacaaacaaacaaaatactgacttgcagcaggataaagcaacaaatttatgctgaaactgagccgacgctgggatattcagcatatggccaaacctgggtagcgacaaactgattggccggtttaaaacttcttctcacaaacctactgacggagttgacccggaattaattaaacgggggagggagctccgtacgggaaaggcagcaagaagtagggggttttccgggggaaggggaggcagccggcctggtccatgcaatatttctatgccttggtcccctccgttggagcccagtccaaaccaaatttcattttggccttaccgaacccaaatttattggacgccatctccatgcccgggcaacgtcacagcctccctctctttcaaaccgagaatggattcggtatcttctccttggaagggccgggcccttaacaggaattttactgcaagtggttggtttcaaagcgtttgttgcaacattcttaacccngatgtctagtttgatgccatatttggggntagtattctgtgttctttgcatgt

SEQ ID NO: 32716 - DNA, 1262 bp, Triticum aestivum
  unsure (1)..(1262): unsure at all n locations
  Clone ID: PAT_TA_32716
aactgcaaggtgttataaagccgcaacactggataattatgtaccaaatgatgacgagnggaaaatctaattatttagctgcagccaccaatgagttggacaggtttttcagcaaagataattttggagaaatgaaggttgttgggcagtttaatctcggttttatcatcggaaagctggaacaagacctatttattgtagatcagcatgctgctgatgagaagtacaactttgagagcctgtcacagtcaacaacgttaaacatacagcctcttcttcagccactgagacttgaactttcaccggaggaagaagttatcgtatctatgcacatgaacactatcagaaaaaatggttttgttttagcagaagatttgcatgcttctcctggcagtcattatcttttgaaagctgtgccatttagtaaaaatattacatttggtgttcaagatgtgaaggagctgatttgcatgctttctgacagtcaaggtgactgttcaataattagtagctataagatggataaaactgattctgtttgcccttcgagggttcgtgctatgtttgcttcgagggcttgccgaatgtctactatgattggcgatccactgacgaaaactgaaatgaagaagatactgaaaaatctaacaggactaaggtccccttggaattgcccgcacgggaggccaacaatgcggcatcttgcagatctgactagtataaggtccaaagaagcaaattgaagcggtgctgagaagtttcattgcgtaaaaggaagaaacatccattgacgctcatgaggattttatcggcaactccttgacttcacgggaatatcgcaggatctagggtgacgttttgacaattgttcaagtgactggccgtcgcgtggcttgttttccgctgctacggagagcccgcttggaatatcgttttccctccttaaaacattggctggttagaaaacgccgaggtggttggttcattgtattaggcctgtaatgtttacgcttgtatcctcgtttaggctcgtaatcagccgatttatggtacacacctaggatatcagttgtggctgctgttatacacctgtgagctaaatgcagttgtataaaattacaacagttccaagtggagcctgagggcgcgcttgggaacggtcaacggtgtaatcaaacggaggtgtttaacttacgcctgtatcataccggccactgagtaattttgagctggaaacagaaaaaaaaaaaaaaaaaaaaact

SEQ ID NO: 32717 - DNA, 403 bp, Triticum aestivum
  Clone ID: PAT_TA_32717
atggacaagggggcgtggagcgaggagagcaggaaaggctacaatctcgtggatgcagtcacgaggtgcacggtgcaggtgtatccgagagggtggacggcgatcttcatcgcgctggacaacgtggggatgtggaacgtgaggtcggaggattgggtgcgcaggtacctgggccagcagttctacctccgggtgtacacgccggcgcactccgtccgcgacgagctcaccgtgccgaccaacgcgatcctctgcggccgcgctgccaacaagagccgcctgccattctctcagtagtgagcactgagcagccgctggcagggaatgatccaattgtatcggagtattagtagtggtatatggtgtgcaagtcgaactgtcgaagacttagtttggctggtta

SEQ ID NO: 32718 - DNA, 1242 bp, Triticum aestivum
  Clone ID: PAT_TA_32718
ggtccgacgacgcggacacccccttcaccctggccgccgaccacgggctcagcggcctcggcaccaataaggatcccgggccagtccttgctcccggccgaggcggagcgatcgcacaccatggcaaagacaccgactcgtcgctcgacatccacctaggccactccgactcgttcctcgtgttggcggtcccgcccgcccacatctacaccaccgtcgacacgaggcgcctcgcccactccgtgctcctcgtcgacgcggtgggccagcacaccatgccgaacgccgtccccgcagccttgcctcccccccccgggcccaccgtcgacatcgtctggtctcaccagccagcccgggccttcaccttcatcgtgtcggcgagcgtccccaggccgaacctcaccggctccgacctgctccgccacggcaactcgaagggcgtcccggcgccggtcaccccgccgccgccccccacccgcgagctgcgctccgcgctgaacaacgcgaccttcatccggtgcgaccccacgccgagcggcccgggcctctaccaccagcgcggggtgttcacccgcgggagcatgcccgacgccccgtccggcggccccgcctaccgcctgacggccgtcatggcgtccaacatgcgggactacgtcgagggtcgtcttcgagaacgccgagggctccgtgcagtcctggcacatcgacggctacgccttctgggtcgtcgggatggacggaggggagtggacgccggcgagccgtcagaactacaacctgagggacgcgatcacccggtacacgttgcaggtgtatcctagagggtggacggcgatcttcatcgcgctggacaacgtggggatgtggaacgtgaggtcggaggattgggtgcgcaggtacctgggccagcagttctacctccgggtgtacacgccggcccactccgtccgggacgagctcaccgtgccgaccaacgcgatcctctgcggccgcgcctccggccgccggaccaggccgctctgaagtcggttttcgtgtcacgaaggggtgactgaatctgagaatcaggttgctgagctccaaattcttttgactgaaaacaggctttgagatggtttgtatttgtagcggcgtgccggtgctattcgtgattcttttcctggaaattgtaggcaaaatgttatgtatggcaagcatcttgcttgctcttgtagtttgaactgcaaaaatgccttatattta

SEQ ID NO: 32719 - DNA, 821 bp, Triticum aestivum
  unsure (1)..(821): unsure at all n locations
  Clone ID: PAT_TA_32719
catntcttaggattnggagaatgcttcaaatacngtttcgggaggcacagcttggggaacttcaatatngacgggcttgctaaataaatggcaattggcacatacaattcgtccagttgcttctcgtgggttttcataaccctgctgcgcaaaaatgggatatgcatttgaaatagatgtccgagttattacgtatatcatgatcgatacagaaatcgatcgagttatctgttcctttacccaagaaaaagtatttctattttccatgtccaatcgcagatcccagaatttctacaataaattagataggtagctaagctaatctagttccctatacacgaatctgttgtcattctactgcaacagttgtactgcaatgatgaataccttaaagtaggtataaatagaaagaattttgctaaaatggaaaagggctttctttctaaaaaaagatgcttgctaatttgattaatattaatatcgggagatcgaatgaatttatgcttcactaattgaatgataaatgactacaagcgaaggagatagacggtttaaacaaaaaaagacccaaaatttcaaacatgtatctagaattactggaaaactacaaacaaaaatagtgaaaataagctcgttaggagccatcaaaatcgttgtagacccaacgaattactagtccaaccacgggtggagtgaatccacaaaaaactcagtaactaaaagaataaaaaagtgtctgggcatttgttnttccggtccaggcctggatgaagtcccttccagaaaangacantngatgcancantatttgcagaatgaaa

SEQ ID NO: 32720 - DNA, 1795 bp, Triticum aestivum
  Clone ID: PAT_TA_32720
gggggccaggcccgtgttgagctatttgttgcatcgaacgaattcaaggagctgaatgtgggattggttcttgacgagggacttgcatccccgtagggagggagtaccgggtgttctatgcagaacgtagtccttggtggcttactattaaagcaaagggagcgccagggcatggtgcaaaattgtatgatggtagtgcaatggagaatttaatgaaaagtgtggaggctcttcggaggttcaggacagctcagtttgatttggttaagtccggagagaaagctgaaggggacgttgtatcggtgaattttgcgtacttgaaggctgggacacctacacccacgggttttgtgatgaatctacaaccatctgaagcagaggcaggaattgacattcgaatccctcctagtgtacatactggagcacgccagaagcggcctgctgaagaagggggcaccttcccctcgcaccttcacctcctagaccaaggaaatcgggtccgtactcgacacgttagggaagccagccatgacaattgctgacagctcgaacccatggaggcctttgtttgaagaatctgtgaagcgagctggtggcaaacttggcaagccggagatatttccggcttctactgatgctcgttatttccgggaaattggggataccagcttttggcttttcccctatggcgaacacaccagtactgctccatgatcagcacgagtccctgagcaaaggtaagtacctcaaaggaattgggatatatgagtccattataaaggcgctggccacacataaagatgacggcatcgactaggagtttagggcagaactgtgaggaaagttgatcttgtctagccacgccggatatcttgcctctctacgtgcagtcggaatgcagacgaagggtttggcaaatacatgttctgtttctgctccggcggccaaagcaaaaccacagatacggtccttgtacatctcgtgtaaattgacctgaaatatttcacggaagtacaactgtagtttcgaatcccaccttgtgatcattctcaacccttaatgatgagtctagtcagaagaatgggcaccttcttcacgcaacttgactttcgagttcaaacagaagggctctgtccttgacaagttagggaagccagccatgacaattgccaacagctcgaacccatggtggcctgtgtttgaagaatctgtgaagagagctggtggcaaacttggcaagccagagatatttccggcttctactgatgctcgttatttccgggaagttgggataccagctttcggcttttcgcctatggcgaacacaccaatactgctccatgatcataacgagttcctgagcaaagatgagtacctcaaaggaattgggatatacgagtccattataaaggcgctggccacacacaaagatgacggcatcgacgaggagtctagggcagagctgtgaggaaagatgatcttatcttgccacggcggatatcttgcctctttgacgtgcagttctagcgcagcagaaggtttggacagatacatggttctgtttctgctccggcagccaaagcaaaaccacagatacggtccttgtacatctctaataatttgacctgaaataattcacgatactgcatctgtagtttctccacatattgtgcgagtaatgacatttgtatacttaaataagtgatggcatttcatccgtcaaaaaaaaattaaaagccaaaagcgtcatttaaaatacaaaaaaaatcaaaactcttccaaaatgaaagataaa

SEQ ID NO: 32721 - DNA, 826 bp, Triticum aestivum
  Clone ID: PAT_TA_32721
cgaggcggacgaggaaggaggcaacgaagcgaggggattccgcggagttggtggaggcgagggtttggtgcggccatggagaacctggcgatgctgtgggggatcatcgggccgggcgtcgccggcgcgctcttcggcgccggctggtggttctgggtcgacgccgtcgtctgcagcgccgtccaggtctccttcatccactacctgcccgggatcttcgcgtcgctggccgcgctcatgttcaattgcgtcgacaaggatgccatcgggaacgactactactcgtcctacggggatgattccgagtggagggtgaagctttggctttttgtcgcctacgtcgtttcattcgtctgccttgcgggatcagtgggtttgttggtgcaagacgccctgacagacaagggcccttctgtgtggactggtgttgccggggttctgcaatgcgtttttgtgttgataagcgggttgacatactggacgtgccacaccgaggattaagggtcaaatatcaaatctcgcgaagacgtttagtctatacccgtgtgtggtcctgtgtaaaaaaaatatgttcattccagggcgggattacttggtgtccgtgtgtgcatagctgaccgcttcctgaaatggatccgtagcatcagtactacgtacgtacgtgtttattatcctaatttgttgtgagattgtggtgcttggtggcttgagaggttagcattgagattggatcacgagctgcctgcagcaagtcgttattactgacaaacctccataagaaaattcagttgactccattaaaaaaaagaggctcgcaaaaaaaaaa

SEQ ID NO: 32722 - DNA, 1429 bp, Triticum aestivum
  unsure (1)..(1429): unsure at all n locations
  Clone ID: PAT_TA_32722
agccgcagaaatatacgtagtagcaaaatcaggatgggtggtgcgggcggcgccaaggcttacggcgcggtggttctgatcagggtcatgtactccggcatgcatatcatgagcaagatagcgctggatcaaggcatgaaccccttcgtcttcgtcttctaccggcataccaccgccgccctggtgctcatccccattgcttttgctctggagaggcaaaagactaaacctgtgacgttgaagattgcagggaagatgttcgtacacgccttatatggggtaacagcatgtggcgtcttatttaaccttggtctcaactatgcgtccgcgacatcatcgtcggcgttgtacaacgttcaaccggtggttaccttcattctggcggtcataattgggatggagtctatgaagctgaagaagctccatggcaacctaaaagtggcaggcattctctgctgcgtcgccggcgtcacggtgctggccttctacgaggggccaatgttcagatctttcaaccatcaccggctcttccagcacggcagcagcagcagctcctccggagcaggcacctactccaagaaccagtgggtatttgggattttcctcatgacactctccaacattttagcaggcttgtggaccgtgcttcaggggccactgatagaggacacttccaagcttatgaataccacgctgcagatctcatgcgcgtccgtccaggccttcgtggtgtgtcgccgcagagagggatttctccaagtggaagatcggctggaatattagcctcgccgctatcatctacagtggcgtgatcgtcaccgcgctttcgtactacatgcaaatgtggacgatcgccaagagggggccggtgttcctcgccatgtccatgcctctcactctgatcttcacaatcatcatatcgtcgttcgttttaggagaggcagttagcctaggaagtataattgctgggatactactgatcggaggcctgtacaacgtcctgtgggggaaaagcatggagagaaaagacgacgacacgaacaagatgggtggcggtaaacctgcccaggagctgcaagacaaggagcaggcccgagtgccggatgatgcggcggcaaaggtctgagccaagcaagcagtgatcggcgatgggacagaaaagattgtgtcagggcatactactggttccggactgtgttggaaagcaacgcatgcatgcaccgtgaactggcggcaggccaggacgataagatgggcagtgcgccattgctgtacccactttctgcctgatggtttcctttcaagtagctagtaccagacgtctcccgtcgatgttgtatgtaccgaattaataaaacaagtttcagatgcttttagtgagctcctatgtgggtggcttcagcacgcaccanagcacaattttacattt

SEQ ID NO: 32723 - DNA, 731 bp, Triticum aestivum
  Clone ID: PAT_TA_32723
agtggaataacaaagagatacgtagctctcgtgagataccactttgcaagaggatttgagttcacggcttggtgcactctttagttagttagctgaatagctaattagggagattcagggcctgatgaggaaacggtgacatcttgaggaaaaggtgacatctttggttttctttgcaacccgttccctacgacaacatccatggagcccctttttgtcccctcaatgtgcctaatgaataatgaccctataatcacctcgtccatcgtcgtcgcccccttgtcgatcgtcgagatcttcatcaccatcatcatcatcatcatcatcatcgcacaccaccgtcatcatcaccgccaacagcagctatgatcggtcggttcgcgaggaggagggggtcctggcgaagctcttctggcccggggcgaggatcgccagcgggtcgtagcgggccttgcggtcgacgaagcgggcccacttgggtccgaagtggcgcgcccagtcggcttccgtgcggtagtgcgggaagtaggtcttgaagtcgtagccgctgctccggcaggcgtccacgatggcgccggccgctgccaccagcgcataaacccagcagccacaccaggtagggcacctcgcccgcaggcagcgcaggtgacgtacctcgccctccggcagcgccaccgacgtgttcgggtcccacttgctcttgagcatggggtagatgagcatgggcccgt

SEQ ID NO: 32724 - DNA, 719 bp, Triticum aestivum
  unsure (1)..(719): unsure at all n locations
  Clone ID: PAT_TA_32724
gccggccggcccagcaaaacggacgcaccgtgcactcacgctctcccaaaaaagcactttccatctcttctcgttgctggatcttcttgcaggggaggaaaaagggccggcgatggacggcgggaagaagagccgggacccgtacaagctgccgcaggagcgaagggaccgcaagtcaggctccgggatgagcggcgacgccaagaagggcggccgtggcggcaagttcacctgggagggcaccgacggctacaccgacgaggatcttgacctcatcggcaacaagggcaggggtaccggcgcctccgacaacaagaagtcctagggagatggcgacccctccgacgagtaggcgctacgtcatccggccctgcccgccggtcttcttcctgtccgaccgatcccaagcctgcacggtgtcaactttcgttagctttctcgtgtctgctcttaaataatacgatcgagtcgtgacctctttggcatgtacgtatatatgatctattttcagttatcgacttgctaatgccggatgaattgttctatctgcatctcgcacttgggatcaacctggtcttatgtttctgtgatcttgtttttcctgctccgttgatctcttctcaattccccgttccgaccgggtaaacaaaagccgacgttccttcaaaantccancnaatgnatggaccccttncganataaccgggggtgggtnaccn

SEQ ID NO: 32725 - DNA, 697 bp, Triticum aestivum
  Clone ID: PAT_TA_32725
caaccgagaagatggcctcctcctcgaggatgctcacggtggtggtgctggcggcgctgttcgccggcgcgatggccgtgaaagtgaagttgacggtgcagaaggggtccgacaaaaagaagttggcgctgaagatcgactacacaaggccaaacgacagcctgtcagaggtggagctccggcagcacggctcagaggagtggcagcccttgaccaagaagggcgacgtgtgggaggtctcgtgctccaagccgctggttggccccttcaacttccgcttcttgtccaagaatggcatgaagaacgtcttcgacgaggtcttctccaccgatttcaagatcggcaaaacctaccaaccggaatattgatccacaccggccaagtttcagttgatcaaaatcgtcgtaattaattaatacccatgtatgagtcgcgtaggaaatatgcgcctgcatgagtggatagctagtgaataatttaaatatattatgcacatgcatgcatatggtaggagaagcaacgacggatgtgttcccgttgctctcccatgcatgcatgcatccactgtcgatcgaggcagcacttttcttttgtgtaaccgaatatgctcaagattttatatatttgaatattttttgtcaaaaaaaaaaaaaaaaaaaaaaaaaaaaaaaaaaagggcgggcgctcgcgatctaga

SEQ ID NO: 32726 - DNA, 734 bp, Triticum aestivum
  unsure (1)..(734): unsure at all n locations
  Clone ID: PAT_TA_32726
agatcctccttcccatcactaagtaggctgttggtctcggagcatccgccaacccctattgttgccgcccgccacctgtctgcctcgtcacagacctcaaggtaagaaaatcaaaatgaggcacncagtagagcggacaggcgcccagctattgcatgctcgagagtgctgggatccagaccaacccggcgtacaggagggacgcgctgatgacgaggtcatagaccacataggagaaggacttgatcaacgagcactgaaagtagtgaggcgggattgcctccttgatctgggccagcgtgaatgccggcttgtccgtcggcgcatgctggaagatctcactggcgctagcgcgtccgagcagctcctgcttctcccgctcctccgtcattctgcaccgacacccatgatgtcgattttatgctatctggagccatgatcgccacaccaagaactcgcgggagacatggaggagcacgtcagaacaatgcccttgcagataactcacgacaccttcacgccaatgcatacaacctggatgccggagtgggaggggatcgccggatctgggcagccgtggcatggggaaaggaggagccagcgccccgaccatccatggcgtcccctgcatcgacctcctcatctccggcttcctcctttcccaacatcctcacccctcccctccatgggagatgagaggacgagcgcgtgggaggcggcaaagatgggcagag

SEQ ID NO: 32727 - DNA, 1923 bp, Triticum aestivum
  Clone ID: PAT_TA_32727
aaaagggaaaccaccctagggtaagttttattgtccatcatcacggggacacatgaaaatcctacaagttttttcatggcaaatggttacaaaacaagccctacccagcccaaacaacaaccgaaaaaaaacccagcccgaggggaaaaaacaaccgacgacttttaacgtggggggtagcgacaacacgggcgaaaaaactacaatgacgtcaaacaattgagtaaatacagtagagtagttttttttaagtcgactgagcctaaggcactcccaacaggtaatcatacataaaaagttgcccttccttcgacgatcagttattccgccataaacacgaaatggtctacaacaacatgacacggacggggggagatgacgccaatgcaatgacagacgcacacacaacacacgcggccatgtccacggccacggacaccaacgatgaccgccggccaaacctaagccgacgactagaacgcagagaaaaagtaaagacggaactgaccaaagtcacggacacgctactcttccttgcaccactcagctcttctagcattggcacggtaatagtagtcttcttttgtgcccaaatgccctctgctatctaaagactaaccatatggactgtaggtagatggatggaattacttggtaggatctcttctctgagttctttctccagcacagttgatggatcttggcggctagaacttgttgctgtaccagaagacccccttgcggtcctcgggctcgacgtagatgcactccttggcctcgcgccatgtggccttggcgacgggggtggggtcgaactggtagtactcgccaaggatgggcttgatcgccttggtggcctccatggcgtggtagtgcggcatggtggagaagaggtggtgcgccacgtgcgtgtccgtgatgttgtggaacacgcggttgaggatgccgtagtcgcggtccatggtggcgagcgccccgcgcagccagtcccactccgtcgagtcgtagtgcggcagcgccgggtgggtgtgctgcaggtaggtgatcaggaccagccacgcgttcacgatcagcagcggcacgccgtagacccgcaccacccaccagaacccgaacgacgacacgagcttcagcagagccagggacacggccagcactccgacgtccgagatgaaaatctgggctcgctcccggtcgttgtagatcgggccgtaggggtcgaagtggcaggcgaaccgcgggtacgggcggcctgaggcgttgagcgccaggtacagcggccacccgagggtgagctgcacgacgatgtgcaccagacggccgacggggttgttgtagatgtaaggggtgtaccacgccagcgcctccttctgcttggggacgaacacctcatcgcgctccagcgacccggtgttagcgtggtggcggcggtggctgtacttccacgagaagtaggggacgaacagccacgagtggagcaccaggccgaggatgttatcgagcagcaggtagtcggagaaggcgtggtggccgcactcgtgggcgagcacccagacgccggtcatgacgcagccctgcgcggcccagtagagcggccaggcgcccagctgttgcatggccgggagtgctgggatccagaccagcgcggcgtacaggagggaagcgatgatgacgaggtcgtagaccacataggagaaggacttgatcaccgagcgctggaagcagtgaggcgggattgccttcttgatctgggccagcgtgaacgccggcttgtccgtcggcgcgcgctggaagatctcaccggcgccggcgcggccgagcagctcctgcttctcccgctccttctccgtcatcctgcctccggcacccatgatgctgctgacaagtgacaacaacagaaagcctggtcccgaaccggccggc

SEQ ID NO: 32728 - DNA, 1154 bp, Triticum aestivum
  Clone ID: PAT_TA_32728
actggaatcagcaaaatgcagacaaggcgatcaaacctactgatctcataagaggtgccaggcataataagagcaggcttcagttggaagaaagaaaaaaaaaaagctatgatacaccgaacccataggcgttgccattagagagaaatctataggagggagaggggggaggggagtgggagaaacagagctaacattgttcctgcttgctgagcctgtgaggcgaaggaggggagcagatcgagcacaaccggctttcctgcgttgagctactgctggatctaagaacaccggggagggggataccgtgacagcatcaccgtgcgctcagcactaccagattgcctccagaaagataagaatgggcagcttggcggccagggcacccgcggccaccgaggaggaggacactgtggcggcggcggcttggtccttgacgacggtgtgcagcgcggcggtggggtgattgagagatcgagtcaaccaacctggatgcaagagtgggaggggatcgccggatctgggcagccgtggcacggggaaaggaggagccagcgccccgaccatccatggcgtcccctgcatcgacctcctcccctctgctctggcgatgaccagcccccgtgcggcccatgcttctctggcaaccccaaactccttctggcctcacgcatcctcacccgctcgtccaaccccctcctctgcgccccccggggagcccccctgcatggatccaaggcttcccccggcggcacggccccgcgtcataaacaaagaagctgtcggcgccctggaaccgaaccccccagatcggggcccggagtagccgctccggcttctgtcgactcgcgcccaggcaccaccgcttcacaactcgacgccgccatcggagcatctccgctgccgctgctcctctcgcgctgcggctgacgcagagatcaggaaggaggagttagctagaagagagaggaggagacgagtgggtgtggcggtggaagggatccgttaaggagtagggaggaggaagagaggaatggggtgtggcggctgtgagagggaggagggaggagtgcacggctgtggatcgggagctccggttggtgcggtcgtgcccaatgagactcctcgctccagccccaggccccacgcgtccg

SEQ ID NO: 32729 - DNA, 1088 bp, Triticum aestivum
  unsure (1)..(1088): unsure at all n locations
  Clone ID: PAT_TA_32729
ggtcactctggtagtcatcatgctaaaggggttaccttgaaaccttagcaaagcagcagtaatcaacggctcgagcaagcaccagaatcatcttgacaactttacattgcaataatctgacttcctccttttaattgtgatcaaacatactntaagggactgtctgttcgaaaaccaatgaacaagcctaaacatgaatagttccagtagacttgataactcattcaggcttaagtgaccttgaagcgctgctatctggagccatgatcgccacaccaataactcgcaggagatatggaggagcacgtcacaacaatgcccttgcagataactcacgacaccttcacgccaatgcctccaacctacgcccaatcataaatcgaatggtgatttccttctccttttccatttttgacattgaccaactcagttatcccaaaaagttcctaagccttgaggtacccgtggcttccttccatcttcaccggctggtactggacaaggggattccatcccgctaccgctagcctacagaccgtccctgctccttagcgttgaaggcaaaaattcgtggaaagaggtcagtggcgagaaggcatggcggcatcgttgacgtaggacagcggtggcatggggaaaggcggatccagccccccgaccatacatggcgtcccctgcatcgacctcctcccctctgctctggcgatgaccagcccccgtgcgggctgtgctcctccagcgatcccaaactccttctggcctcacgcctccacaccccctcctctgcgcccccggggaggccccctgcgtggatctaaggcttcccccggcggcacaccatggtggttccccgattaccgtggagacatcctcacgcggcttcctcacgacctgggaagatgagcacctcgggcagcaagggatgggggtgaactggggagacggtggagaaggtcgggcggaaggaaactggccacctgcatggacggagtcggtggacggaggagccgtagcggtggcggcagctgacgacggaggtcggatggaggaggggtagcgaccgctggatcgtaggaaagggggctagg

SEQ ID NO: 32730 - DNA, 497 bp, Triticum aestivum
  Clone ID: PAT_TA_32730
agctaataaactgtttgaagggaaccaaccattttagagtagtttattccacatctcattctcctcgaaaatgagcccaagtggctatcaacgaaaatacaattgttttgatacaacaacggtaagagaagtgagtaaccaccaaagaaacaaaacatttaaattagttttttctaaccatggaggagagttgcatgtgaactttataaaagaaggccaacatcaaggaacatcatgttgacatactcatcctgctctccgttcttgtcatcagtcccgacaatcagctcctgaccaacaccttaagcaacaaccacgacaatgccccttcttctttatccttgcatatacaggaactcaatcaggtcaagaaaaaaagatatgaatcaactctcaagatcaagtgagatgggtgccttccctgtctactaccgccaggctcaacaccaactccacatatcaagcacatgttgcctttccacaacatgacaaccggt

SEQ ID NO: 32731 - DNA, 850 bp, Triticum aestivum
  Clone ID: PAT_TA_32731
gccggccgggtcgtgatttaggtgacctatagaaggccggccgggccgggacacagatcgcagcagcaactacacacatacagacacacaacaatcaaatttcaaccagtcttcgaccaatcgagaagatggcctcctcctccaggatgctcacggtggtggtgctggcggcgctggtcgccggtgcgatgtgcgccgtgagggtgaagttgacggtggagaaggggtccgacaaaaagaagctggcgctcaagatcgactacacaaggccaggcgacagcctgtcagaggtggagctccggcagcacggctcagaggagtggcagccgttgaccaagaagggcgacgtgtgggaggtctcgtgctccaagccactggttggccccttcaacttccgcttcttgtccaagaatggcatgaagaacgtcttcgacgaggtcttctccaccgatttcaagatcggcaaaacctaccaaccagaatattgatcgataccgtccaagtttcagttggtcaagatcgtcgtaattaattaattcccatgtatgagtcgcgttggaaatatgcgcctgcatgagtggatagtgaatatttttttatgcacatacatgcatatggtaggagaagcaacgacggacatgtttgctctcccatgcatgcatcaactgtctttttttgtttttggattatctttggattagtttgaattgcttaccacatatgtcatgtggtacatgcatcaactgtcgatgcagcagttttcttttgtgtaaccgatatgctcgagattttgagatatttgaatatatagtttcccattcaccttggtaaaaaaaaaaaaaaggcccct

SEQ ID NO: 32732 - DNA, 751 bp, Triticum aestivum
  Clone ID: PAT_TA_32732
agctcgcaccaaggcagccgctatacacacaatagcaatcaaatctcttggatcaaccgagaagatggcctccgcctccaggatgctcacggtggcggtgctggcggcgctgttcgccggcgcgatggccgtgaaagtgaagttgacggtgcagaaggggtcggacaaaaagaagctggcgctgaagatcgactacacaaggccaaacgacagcctgtcagaggtggagctccggcagcacggctcagaggagtggcagcccttgaccaagaagggcgacgtgtgggaggtctcgtgctccaagccgctggttggccccttcaacttccgcttcttgtccaagaatggcatgaagaacgtcttcgacgaggtcttctccaccgatttcaagatcggcaaaacctacgaaccggaatattgatccacaccgtccaagtttcagttgatcaagatcgtcgtaattaattaatccccatgcatcagtcgcgttggaaatatgcgcctccatgagtggatagctagtgaataatttttatgcacatagtacatgcatatagtagtagtaggagaagcaacgacggatgtgtttgctctcccatgcatgcatccactctcgatcgatgcagcacttttcttttgtgtaaccgaatatgctcaagagttttgagatatttgaatatatttttccattcacctttatctttgatactccctccgtctcataatataagacattttttaattagtttgc

SEQ ID NO: 32733 - DNA, 1924 bp, Triticum aestivum
  unsure (1)..(1924): unsure at all n locations
  Clone ID: PAT_TA_32733
ctagtttacacatccacccacattctatttattcatctcaaatattttctctcctccacagaaacagtaattccgccaaaaacacgaaatggtcctacaagaagatgagcaggctaccgcggggagagagacgccaactgcaatgaccgacgcagaccaaagtgactcggacacggtccaccgagaggaggaccaacgcatgcccggagggcaaagctgacgtgacagaagggacgcaacgaaaacgaagctacggcgacagaccgaagtcaccaacgcagtccgcagcctgtcacaagtcgcgtcccctcaggatgggcaagaaaagtgcagtcgtcttcctatgaaggccggaatgccggactcatcgatctcaaagccacaacttggatacttggataggcaaatgttggcaaattatgtgctcaagatctctttttggcagctccttctccagctctttggacataaattagatgcatgaacttgatgatgaagctatgatctccgagttccagttcgaggaaatctacgtaattgaatcatttggccttaggggctaggttgggatggaaacggtggtgggcgcggattgttagtactttctcaatggcgtccttgatcgtcgtggtagtgcgaagggggggagtattgtatctgtattacgtgcatatactgggtttgttggatttcggggtttcggtggcgttagcttgcggtcattggtgcataagcgcaccgtggagccaggccgcacgtgtcttgtggtgttgtcgaacacgcggcttgagtatgctcgaggttggtggtctgtagcagctagcggctcacgaagcggccgcgcctccgccgagaccaagggcaacatcgccgagcggatcgaccacagggagctgaacagagccagccacgcgtgcagcatcaacatgggcacgcggtaaacccggactagcccccagacgccgtacggcaagacgtcgctggcgacagggcgggcgagcaggctagcgcgcctccctctcggctggaattctgcctacggctcccgtgctaggggcaggggccacccagggttgacatgctcgagcatgcgccgctacaggcggaccgggcggttgtagaggtagggcgcgtaccaagcctgcgcctgcttctgcttggggacgaacacctcatcacgctccagcgacccggtgttggagtggtggcgacggtggctgtacttccacgagaagtaggggacgagcagccacgagtggagcaccaggccgacggtgtcgtcgagcagcgagtagtcggagaaggcgtggtggccgcactcgtgggcgatgacccagacgccggtcatgacgcagccctgcacgatccagtagagcggccaggcgcccagctgcagcacggtcgggagggtagggatccaaaccagcgccgcgtacagcagggccgcgacgatgaccaggtcatggaccacgtaggagaaggacttgatgatcgagcgctggaagcagtgaggcgggattgccttcttgatctgacccagcgtgaacggcggcttgtccgtcggcgagcgctggtaggctgcgccgccgttggcgcggccgagctgctcctgcttctcccgctccttctccgtcatcctgccgccggcacccatgatgctgataggggtggtggtcgaggcggcgggagcagggcagatcgggccggcggacaccacacacgcgagcgcgcgcaccctcttccctctccggcgcctctgctcctcttgttgacgggacgaacgagtggtttgtgcgggggggaggagcctcgtgccgaaggcctgccccccgggccgtcctcccggcctagagcggccgccaccgcggtggagctccagcttttgttccctttagtagggttaatttcnaggaggtaacaacct

SEQ ID NO: 32734 - DNA, 748 bp, Triticum aestivum
  unsure (1)..(748): unsure at all n locations
  Clone ID: PAT_TA_32734
ttttttttttgaaaaaaaaagcatattcggacagagttgttattcacaaagcaatgatctaaaattcaacatccacttttcacataatcacttgttgattccttactagtcacaacttaacataaatgcaagttaagacagcagccaaggtaatgccaacactgccggagggatgccactgaaaatctgatcatcttatctccgcgactttgagctcttgccgcgcaccgaattcctttcttatcatattctttcaaacctttccccttccaactcttctattcctccccctaaatgctagcttggcctccagttgaatcttgttcttacatgactactgtgaaatcttnctcctcttcgtacacttgcacttgcaattcatctatcaaatggcgctgactggctcccctccaactctaacttgagctttgccccctccatgaaaatttatttggagcttgcaggattatccttgagcgcagggaatatcggcggccaaatcatcttaagaggatggatatcacccaaacacacttcttcttctgccatgatatacactttacgcaactgcatgcacttgacatctaattgcagtgcgcatcgacccatctccaagaaaatacactcagcatagtcacccacgtgctttatccgaagaggagcgtaggactcatcctcaaccctgtaacctggaatccacatattagcaaccatctcacgcaaacaaatggtgtccaccagaaaccag

SEQ ID NO: 32735 - DNA, 396 bp, Triticum aestivum
  Clone ID: PAT_TA_32735
acggactaagcaatttagagataacttagcatattagagccaacttaggtaaaatggagccaacctagctaattatgccatctttgagtgaactaagcatattagagctaacttatagctaacttatgtcattttggaagaagaagaagaagaagaagaagactataagcttattatgtaaacttggtcattttgtgctaacataagtaattttggagctaacctataggaaactaaacatagtagagataacttagcatattagagctaacataggtaactaagcatattagagctaactatatatagatcattttggagatctgacatacctgacattgttcagttctcattgttcttctccttctccttcctcagcctgatgcgccaagagcg

SEQ ID NO: 32736 - DNA, 1272 bp, Triticum aestivum
  Clone ID: PAT_TA_32736
atatggagcaacacgcattaaccagcaaaaccgtttgttcaatacaattccacacgattcaaacatagccttgaggcagccgagttcgttttccccttcaacatttaaacagttcgtttcgtccaggaaatcaccttgcgagacgaatatagtaatgacttcagcacgacagagggagcaaaagctacggaaactaatactatggagagactataataactattaagaacaacaccaaaaaaatcattgtcacactaccacacgatatcgggcctacgaggtgcccgagaaataaataagcaggagctgtcacgccgtcaagagcctggggtcgagcgaattcaacaaacttcggggtagagacgattggatcatagacccaacaagttaacgcctaataccaccgaccacaccaccaccaccacccgccccccctgcctgcccccttggacccttaaaacgagcaaactgcagccgcagcctaggtgagctgcggtcatgttcatcaaacttatagccttgcaaagcttccatggcaatagctgcttgagaagcattagtgaaatcaacaaaacagaggacgattgggtcaccaccaggatgtcttggttctttgtttacaagtctcacctcctgaaaaccaacaaatggtcgaaagatatgagaaacttctcggcgttcacaatcaggagggatgccttcaatgaacaaggtgtttgaggcatctgggggaaggggaggctctggcattccaccaccaaaaccaacattcctgccattcatacccccagcagccatccccggacgatcatcagcttggtagccaccagcactggctcccgcggtaggcctgacagatccaccagcaggtccagcgccataggactgaatttgcccagtacgcagaaaacgctcataggaagcattaagagcctgtgtatctctcacggcagcatatcctggcctttcttcatcacgagggtaatagcccgccatctcaggagcaccaggtccatcggcggagtagtcgccggggcgggggcgcttgaggggctgctgcctgcggcggcggccagcgacgactgcggggccccggcggaggggggcggcatatgctgctgctgctgctgctgctgctggcgctggaggtcggcgtacctccagtacgcgtccgccatggctgccgcgccggccggccgaaggttctggatgcgccggagatggagagagtgggggagggacgggagaggggagcccgggcgagcgtgccga

SEQ ID NO: 32737 - DNA, 701 bp, Triticum aestivum
  Clone ID: PAT_TA_32737
cacgcatgcagatttttccttttttgattgacagccaagcacacggtgcatggtaataataacattaccgattagattcgacagctaaggttactagaaggtgtaacctttaggtacatcttgcaggttctaccaacaggtaagcttaacagctgacagtccaggggtggggccgtggggggtgagtgacaacagctacaagtcactattcagtgctccccgggattaagtcactacacatacaacggtcccgtgctaagacaggaaaggaaggtctcacagatttacatactaggggctcgaggcccaacatagctcgataacatcatatcgagtggcatcgaggaggggtttggcaactctggtggccgtcgaagatcttcgccttggctattggagggaggatcttgtaaaggacatgatgtgtctcccaacaatgttgctgataggaagaggtccccaggcacgagaatcgcagctgttattgcggttatcacccatgacgaatacatggtcttcagggaggcgctgcaggacgatggattgttttagtatcagattgatccgggcataggtcgagcagataacagggatgggatgggagggagagatcatccaccatctgaggcccgtcatctcgaaagaataacagggcagtcaagaagtcaacaacacggagcagccatgccacttttggtcct

SEQ ID NO: 32738 - DNA, 968 bp, Triticum aestivum
  unsure (1)..(968): unsure at all n locations
  Clone ID: PAT_TA_32738
gcacgnnccgtacgtaagnncttggnatncctnnctagaagnncggcncgcncnncttttnnttttttnnnttttttntnnttttttnnntttttttttnnttttttttnccgccttttttttttttttagtttttttttttttttttttttttccgagcaaaaaaacggaccccgcttttgttttttttagaggttaaaataacttacatgtagcgttgattcctcactcaaccataatcttacgtacatacggatttaatctacatcgatcgaagctgcaggacgcggtgcatgaccagaacagtactgcttcagtgtgcaacgtagctagacagccatggccggatccttctacctacgcagtccttccatcgttccatctaggcatgcaatggcggcagtcatctttgtctcttgatgatgatgctagtagggctagctagctgaccaacttctgtacagtctcccttccgtgcgtgcatggacacgtgcatccatccatcctgtggtggatggattagcacgtacgtacgctacacgcgtgcataggcgatgtgcgatgcatgtcgtgctgaccggccactagacgcggatgggagcagggcggcggcggtcgcgctccatggcctgccgctgctctgactcctgccgctgcatgcgcaggtgctcgtgctgcctccggatgaagctctcggcgcggcgaaggagctcgtcctgcgccatccccagcacgtccctggtgcgccacccctgcctctccgccaccggggacgacgccgcggccgggtgcggcggggaaggcgggaccatcgtggccgacttacgcatctccctccgcgcgaccacggccttgtcggccgcgcgccgcatccgcggcagctcctcgccgccccacgtctcgctcttccgcacggccaccggccgcgccgcgccgctcctcacgatggactgccacgccgagtccat

SEQ ID NO: 32739 - DNA, 1081 bp, Triticum aestivum
  Clone ID: PAT_TA_32739
gccggcaaaagtcaaaaggtccctcgcaatttagagtataccttctcaaaagtcaaaaggttgcttgcacaagcacatggtcccaggctgcgatcgatcaaccaactccagacgctagcccgatttcatccgcccagcttgatgggcgccacttcgccggactccggcgacctcatcctggtcgagccggcgagcccggggtccaaggtcgccgtggtgaccatcaaccgccccgatgcgctgaacgcgctgacgcgctcgatgatgatctccctggcctcggcgttccggcggctggacgccgacgacggcgtggccgcggtggtgctcgcgggccgcggccgctccttctgcgcaggggtggacctcacggcggcggaggaggtcttcaagggcgacgtcaacgaccccgccgctaaccccgtcgcccagatggagctctgccggaagcccatcgtcggcgccgtcgccgggttcgccgtcaccgcgggcttcgagatcgccctcgcctgcgatctccttgtcgctggccgctccgccaaattcctcgacacccacgccaagtttgggatatttccttcttggggtctttcacagaagctctctcgtctcattgggccaaacagagcacgagaagtgtcactagcttgcatgcctgtcactgctgaaatggctgagaagtgggggcttgctaaccacattgtggatgatagtcaggtgctgagtaaggccatagaggtcgcggaggccattgcgaggaataaccgcaacttggtggtgctatacaagtcagttataaatgatgggcttcagctggacatgaaacatgcccgagctcttgaaaaggaaaggagctgtcaactattacaatggcatgacaaaggagcaatttgcaaatatgcagaagtttatacaaggccggagttctaaagcaccatcgaagttgtagatgcggtgctctgtgtgtatgtgcctttttattatatggctccttttattataaagcttgtggaaatgttaaattgttactcctattactggaagacccacgttgttttaaaaagaaaaaaaaaaaaaaaaa

SEQ ID NO: 32740 - DNA, 419 bp, Triticum aestivum
  Clone ID: PAT_TA_32740
cccacgcgtccggcgaggcgattcttttcggcgagtacaagcctggcgacacgatactggtggacaccgacagcaaggggaagccttgcttgagtcgtctgaaccaaccaccgatcgtccaagtgtctgactcaacacggacattctgaagtgaagctctctctcgtgtgggtagacttggtagagtagaggcctaattttctattctttcgatttcgagtaacgggataggagtaaggagtaattctttgataggtcgataccaaatatttggttatttctttatgtacataacattgagggaattcgtcccagcatggtcttattcggcaagtatatatccaactgtatattgtcctccggtttataaaaaaaaaaaaaaaaaaaaaaaaaacaaaaaaaaaaaaaaaaggccccta

SEQ ID NO: 32741 - DNA, 1526 bp, Triticum aestivum
  Clone ID: PAT_TA_32741
gcggccgcccgggcaggtctcgaattgaatcatatcaagagagctaggcccggctgtcttccgttctcttatcgcaaatttttgaagatgggcagctggcagactcacagggtcgcagagtttcgttcaagaacacattgattgtcatgtcttctccggttgggaatacgccactgtctgcgagtgttaacactgaagggccacatcaggataaggctgagtcaacaattgaggagcctattgtagttggaacagaagaaattgcaagagtcgcctcattatggtcgggtattccagtccagcagctgactgctgatgataaaaagatcttagtaggactggatgatgagcttagaaagcgtgttattggtcaagatgacgctgttgcggcgatatcgcgggcagtgaagagatcacgtgtaggcctcagtgacccgtgacagagcctatagctacgatgctcttttgtggtcctacaggggttggtaaaaccgagcttaccaaagctcttgcggcgagctactttggatcggaatctgctatgcttagactagacatgagtgaatacatggagaggcacacagtgagcaaactgataggctctcctccagggtacattggatatggtgaaaccggtactttgacagaagcagtcaggagaaaaccattcaccgtggtactgcttgatgagatagagaaagctcaccctgatattttcaatatccttctccaaatttttgaagatgggcatctggcagactcacagggtcgcagagtttcgttcaagaatacattgattgtcatgacatcaaacgttggttctacatcaatttcaaacggacgacggagcatgggtttctcaacagatgacaccgaatcaagcagatatgtcgcggtgaaatccctcgtgatggaagagctgaagggattcttccgtccagaattgctcaacagaatcgatgagacggttgtgttccgtcctctggaacagactcagatgctagcaattctcgatatcctcctagaggaactgaagggtaagctcttggccgtcgggatcggcctggaggtctccgacgcgatgaaggagctgatctgccgagaaggctacgacaagaactacggcgcgcggccgctgaggagagccatcacccaactgatggaggatgtcatcagcgaagcgattcttttcggcgagtacctgcccggccgcccgctccagcgggccgccgtcagcaaggggaagccttgcttgagtcgcctgaaccaaccaccgatcgtccaagtgtctgactcaacacggacattctgaagtgaagctctctctcgtgtggtagactggtagagtagaggcctaatttcctattctttcgatttcgagtaacgagataagtagtaattctttgatagatagatagataggccaaatatttggttatttctttatgtacataacattgagggagttcgtcccagcatggtcttattcggcaagtatatatccaactgtatattgtcctccggtt

SEQ ID NO: 32742 - DNA, 963 bp, Triticum aestivum
  unsure (1)..(963): unsure at all n locations
  Clone ID: PAT_TA_32742
cggacgcgtgggtcctggtgcacctgttcagcgacgggcgggagggcgtcacggtgcggcgcgagccggcctcggcggaggcctggcccgacgtgcggcgccgctggggcccgggcggccagcgccggcccgacggcatcatcctggtcgagcaggtggccgccgcggcggtggaggacggcgccgaggcggcgcgccaggtgtggggcctggtggtgcaggcccgcgggatggagtgcgccgcctgctacgtcctcgacacctgccgcgtgcgctcggccgaggggcgtagaagaacctccccccgccaccattgatgcaactccctccggcttctgcacccacttctgcctcgcccgcgcgcagtgcttcggcgagcccctcgagctccagctccgcaacgcctggctcaaccgcctctccggcaaccaccgacgatagccgccgcctccgccaccgatgtaccactactagcaagcaggaacctccccccccgccgcaggtgtacccctccgggccgacaagaacctccgccccccaccattgatgcaactgcctccggttcggctgggaagaacggaccgaagattcatcgggaagcaagcaagaaccccattgatcgatgattctttcttgccttcacgctctagcttttcccctgcgcgcgagatgggcgtatcgtgatcgagtaattggaatcacgaatcccgcccgcgtttgaacctgtacagattactgattgtattgcttgattatgaattgaaaaccaactgttgatcatgaacaaaaacccaatggatcgatgatcctttcctggctttccgctccaacttttccccttcggcgccagatgggcctatcctgatcgagtaattcgcatcacgacccccccccgcgttcgttcctgtacctcggccgcgtcctcgctttnaaaaggatatggtcatgaatctaaaaaaaaag

SEQ ID NO: 32743 - DNA, 1168 bp, Triticum aestivum
  unsure (1)..(1168): unsure at all n locations
  Clone ID: PAT_TA_32743
attcggcacgaggggagggggaggacgtgggtctgggcgccgtgccggtggtcgtcgcggtgctagccaagcccggcgcgtcagcggccgcgctcgtccatgcggcggccgcggcggggagctttgcttgcggcatagaggatggcgcgtgggccgtgcttgctgctggcgccgtggggcaccttacgcggctccccgcccacccgcacggcaagattatatatcaacaaccaggaactaccatacaatcttcatatcacacaatccacctatgagtatgaagatccgtgacaaggcaagagcaatcatgaggccttatatgcttatctatctcatccattgatgatctctttcaaggaacagaaggacttcttgttcatttagagaggatcaatcttttgattttggtacttaataaactaaatcttgagcattggaggaggtagcccctggactggtgaagaggcaaatggggacacaaggaggttcatggtggttccaggctcatctcttcggtgagcagcagtgcgctacgttggacagttaccaaggctggacggaggtgtgcccgtgcggccggacggtgtcgtcctggtcgagcagatcaccgtaccaaggctgcctgccggactccaattccctaccgctgtcaagctctagatcaagctccacatggacctgtctatccgtgcgatactgtgtttcctctggtggccgtctgttccgcttggcgtttcgtctggatctgagaggagaaggcctcaagcagggagatgaggaggttcatggaaccatagaagttttcagatgagattagttgaaagaaaagggtaatttcgcatgctgccatgcgagagtcagaggtgggtgagttccctgatccccggctgtagcaacattggccaccactctatgcgcatctgtgccgccaaaatcagatttcatgcgtatcaagcagattgtgaagaaaatgtacctgacggtgcgtcctcaacatgagaatncgattaacattgtcttcaagaattaaggcanattgtttgtatgtcattaatcctctcctgtgaagattcagaatcataaagatagtattcaggtacagatggacaggcttcatgttcagcaatttgcacacacggtggagatttaatggactaactactttttt

SEQ ID NO: 32744 - DNA, 2286 bp, Triticum aestivum
  Clone ID: PAT_TA_32744
aggaattcggacgaggatcctgacgaacctgggctagaaatcctcttcagcagagagtcacacaagcccccgttcacagtgcggtgccatgccgggagcaccgagcgcccagccagctcccgcctccggctacgcccccggggcgcaccgcgaggcgctcgacttcatcgagcacgtcacggcgaacgccgggaaggtgcagcagcgcgtcctcgccgagatcctggcgcagaacgcgacggccgagtacctgcgccggtacggcgtctccgccagcagcagccccctcgatcccgtagacgccttccgccgctgcgtcccgctcgtgacctacgaggacctccagcctgacatactccgcatcgccaacggtgactcctcgccgatcctgtccggcaagcccatctccgagttcctcacaagctcgggcacttccggaggggagagaaagctcatgccgaccatcgccgacgagctggacaggcggtcactgctgtacagtctactgatgccggtgatgagccagtcgctgcccgggctggacaaaggcaaggcgatgtacctgctcttcgtgaaggccgagtcgcggacgccgggagggctcgccgcgcggccggtgttaactagctactaccggagccggcagttcctcgaccggccgcacgacccgtcgtccgcgtacacgagccccaacaaggccattctgtgcgtggactcctaccagagcatgtacgcccagctgctctgcggcctcgtgcaccggacggacgtgctgcgcgtcggcgcggtgttcgcgtcgggcttacttcgcgccatacgcttcctcgagaagcactggcctctcctgtgccacgacatccgcaccggcgagctcgacccggagatcaccgaccacgcggtgcgcgacgccgtcgggaggttgctccacgccaacccagccctcgccagcgagatcgaggccgagtgttcgaagccgtcgtgggagggcatcatccgacgcctgtggccccgcaccaagtacatcgacgtgatcgtgaccggcgccatgtcgcagtacatccagaccctcgagttctacggcggcggactgccgctcatctgcaccatgtacgcttcttcggagtgctatttcggcctgaacctcaaccccatgtgtaagcccggcgacgtcgcgtacaccctcatccccaccatgtgccacttcgagttcctccccgtccattgcagcaacgccaatgccgagccgagccaccgcgacctcgtcgatctagttgatgtgaagctcggtcacgactacgagctcgtggtaaccaccttctcaggtttgtgccggtatcgtgtgggcgacgtactgagggtagcagggttcaagaacgaggcgccgatgttcagcttcgtgcgacggcggaacgtggcgctgagcatcgactcggacaagacggacgagacggagctgcacacggcggtgagcagcgcggtgcagcacctggcgccgttcggcgcatcgctggtggagtacaccagctacgccgacacagccgccatcccaggccactacgtgctgttctgggagctgcgcgagggcagcacggcggtgccggcctccgtgttcgaggagtgctgcctgtccgtggaggaggccctcaacagcgtgtaccggcagtgccgcgcctgcgacaggtccatcggccccctcgagatccgcgtggtgtcggagggcaccttcgagaagctcatggactacgcgctcagccagggcgcgtccatcaaccagtacaaggcgccgcggtgcgtgcgccccgggccggtcgtcgagcttctggacgcgaggatgcaggccagctacttcagccccaagtgcccaaaatggagccccggaaacaagcaatggaacacctccaaggagctgctgagcatcggagacgcctagcttgcttgctagatagccagctcacgggttggaggaggatgacaatgcatgacatgcatcatgatcaatgcgttactgtaggggctacgatatctcgtactatttcaacttctggggcagtgaggaatagttatcaaaattatgacttagttagctagggttcctacgtatgtctgctattatttttgtaatcttctctatttcggccgcattttatgtagaactacctgtcaattacttttattaaaccaccacgtacctcaagctgcattccaaagatagtttatcccaatgttgtatggacttctagtctctatgggaaaggactcagttatctacataatgcaaaaaaaaaa

SEQ ID NO: 32745 - DNA, 547 bp, Triticum aestivum
  Clone ID: PAT_TA_32745
gccggccgggctggcaaaaagcggctctccctcccggcggctacggcggcggcggcggctacggcggtggtggcggctacggcggccagcgcggcggtggcggcggcgactccggcggccagtggaggaactgagcctcgaatctcccagttatcgatctatctaccgtgtcgtcgtcgtcgtcgtcgtcttcgtcagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgtcactatctttcagtcggtcggtcggtcagtcggtgatgcagcaatccccttctgtcatggattgggatgtgatgttggaatatcctatgtttgaacaagtttaaatggatgaagaaaatgcaagtcatagctgcgaaaaaaaaaaaaaaaaaaaaaaaaaaaaaaaaaaaaaaaaaaaaaaaaaaggaaaaaaaaaaaaaaaaaaggccccta

SEQ ID NO: 32746 - DNA, 634 bp, Triticum aestivum
  Clone ID: PAT_TA_32746
gcacgaggccgcatacacgagacaagacaaggagcagagtacctacgtaggcgaagatggcacgcaccggcgcgacgacgacagctgctgcggcggtgctcctgctggcgctggtggccaccagcgccgccgcggtcgacgcggccgctggtggctacgagatgaatgctgctgccgctggcggcggtcgccgcagcgtccgggcccagccggcggggctgacgcagtgcatgggcgggtgcgggacgaaggtcgcatcgtgcctcctcgactgctacaacacgtccaccggagggaccatgcccatctgctacctcggatgcaccaacaacgccgtcttctgcgccaccgactgctccaccaaggggctctgattcccgatcaatccatccggctaaacgatgaagcatacatatatatatatatatatatatatatatagcttcgatctgtatcagcgtatacgcacaccatgcataatgcattcacacgcaaccgtacaagtatatgcacacttcaatcaccccggacaagtacggaccctctcacgtatgaataagatcaacagtacttcgtccaagtcgacccgtgtgactaggcatgagcttgtacggtgaattgatgaatatacaca

SEQ ID NO: 32747 - DNA, 756 bp, Triticum aestivum
  Clone ID: PAT_TA_32747
tcgcggccgcgtcgacccacaccatatgtatcatcatcctactccttgtacttcatgctctcgagcgagaacccgggcatgtcaaaggagagggcaaacttctcgacctcgaccttgaggttctcgatgtccttgttgttcaccaggcccttggagaagtccttgagcagcttcccgtgctccttctggatgttcaggcagatggtcacagcctggtggggaatcgccccttcgggggctttccccgagcatgaaacagtcgactcagaactggtacggacaaggggaatccgactgtttaattaaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccgttcaacgggccccgtggtggcaaccgcgcctaggttcctccgcatcgtcgtcgtacccctatattatgctttatgtcatttagatctgttacttgtggcaagtaatgttttgaactcagagcttaagttcgaggtgttttgatctgcgtatggtggacatgatctgtttatctcaccgtttatctgaagtgattcgataaaaaaaaaaaaaaaaaaaaaaaaaaaaa

SEQ ID NO: 32748 - DNA, 769 bp, Triticum aestivum
  Clone ID: PAT_TA_32748
cttctcctccccttccggctcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggtggcggcggctactgcggccagcgcggcggtagcggaggctacggtggcggcggtggtggctactgcggtcagggcggtggcggctacggtcagggcggtggtggcttcggcggccagcgcggtggcggcggttacggcggcgggcggcgtggctacggcggtagtggtggtgtcttcagatttccaccttgtgtgtgtcatcttcctcggtcattggaggaacttggcggcggggccctttcagcaatccctcccattttatccctttcacttcgccttcctcacgcacgactctctgcaaattctctcgtgtattgcctatatcttggttctgctctgtttcgtgtctatcgccggtctttttggtgcgcttccgttctgctcctcc

SEQ ID NO: 32749 - DNA, 644 bp, Triticum aestivum
  unsure (1)..(644): unsure at all n locations
  Clone ID: PAT_TA_32749
gcacgaggcttctcctctcgcgcgcgttgcctcgaaccggaaggaacagcgtccattccattacagtagagcttggtgtttgagagacgatcaatccgtcgtcgaccaatggatccatgggtcagcagccagccttcgctgagccttgacctgcacgtcggcctcccgccgatggggcacccgcacagccaccaccaggcggcgccgatggtcgcgctggccaagcccaagatcctcgtcgaggagaacttcatgcagctcaagaaggaccctgaggtaggcacacacgtccatacagaaacaaatcaagaacgccatgattttgattctgcttgcttgggtttatctgcgagcttgaactgaatgtttttgtcggtatataggttgcggttcttgagtcggagctacagcgggtcagcgaggagaaccggcggctgggcgagatgctcagggaggtggcctccaagtacgagaccctgcagggccagttcaccgacatggtcacggccggcgcccacgccggcggcaataaccactacaacaaccagccgtcctccgcgtcggagngncnggtcggtgtcgccgtcgaggaagcgcaagagcgnnnagagcaacggcacgccaccnnngtcgcaccagcagca

SEQ ID NO: 32750 - DNA, 591 bp, Triticum aestivum
  unsure (1)..(591): unsure at all n locations
  Clone ID: PAT_TA_32750
ggcctgtaaggatggcagcatttgtcggtctgagatcggtacatagcttctcagccatgcgctcgtccaacttcaggtcaacagttgcatcttacagattctctagacagggaaggcgtgcttcttttgtaaccagagcaatgttcgagaggtttactgagaaagctataaaggtcataatgcttgcgcaagaggaagcgaggcgcctgggccacaactttgtcggaaccgagcaagttctattgggtctggttggagaaggcactggtattgcggcaaaggtgcttaagtccatgggtataaatctgaaggatgcccgtgtggaagtggagaagatcattgggaggggcaatggttttgttgctgtcgaaataccattcacaccacgtgcaaaacgtgttttagagctttcattggaggaagctcgccagctaggtatgtcagtcaagaggtctttctatagtttggtccattttatttgatttttttattttatttctatggttcctaggttacttccagacaaactgaaacctaacaaagggatagttacatctctgttactggaacgattgatgcccnnnaaaaaaa

SEQ ID NO: 32751 - DNA, 769 bp, Triticum aestivum
  Clone ID: PAT_TA_32751
ttccccgagcatgaaacagtcgactcagaactggtacggacaaggggaatccgactgtttaattaaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtacactgtcaggtcgttcggtatcaggcgtaatgagaagatcgcctgctatgtgactatcaggggtgagaaggcgatgcagctgctggagagtggcctgaaggtgaaggagtacgagctgctcaggaggaacttcagcgacaccggatgctttggcttcggtatccaggagcacatcgatctcggcatgaagtacgatccatctaccggcatctacggtatggacttcctttgtgggtgctccgagcgtgctgggtaccgcgtctcccgcccgccgcaagtgcaaggcccgcgtcggtatccaccagagggtcaccaaggaggacgccatgaagtggttccaggtcaagtacgagggtgtcatcctcaacaatcccaatgcgagcttaagaaggacttactcccctttagaccttgagttaatgaagttcacctggttgctggatatgtatgttacctagaaaccgaaatgctttgtcagttttgcctgtactcaagctggatgatttctgtttgatctgcactttcgtctaagaggctcactactgttttatcctctttcaacaatagagtat

SEQ ID NO: 32752 - DNA, 502 bp, Triticum aestivum
  unsure (1)..(502): unsure at all n locations
  Clone ID: PAT_TA_32752
gccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcctcgccactgggacgcaagatcatttgggcgccaccaaccccctggcctctgagccccggcaccatcccgttggtgactttgccgtccgacatcggcaggaacgtcatcccatgggaagcgaccaagttttagagtgccaagaaggagattgccctgtggtccccttgaaggaatgcagatggaggagcaancaacacaactggtntatgaagcctaaattgtcatgatggttnaatgcaagttcaattaagcatctaacaaactatccttggtgtttacnnttttagattgtaccttgggaactgtttgtgttgaacggaattaccct

SEQ ID NO: 32753 - DNA, 591 bp, Triticum aestivum
  Clone ID: PAT_TA_32753
cctcctcctccccgttgctcgccgccgtccctctccgcctccgcgcacccagggtaagcgagccctctccctccctcctccgtgcacccgtgaatccacacgcacgagcgcacgccgggcctcccccctagatccgtgcaccaccggatcggctgtcccgcgcgctttgaatgactatctgtgttggttatcagtcgtaggatcgatcgcccggccaccgccggcgggtatcgtcctcggcccgtgtcccgtaggcagcgccggtaggcggcgcggcggagagctcggctgctctgtttgcagaaagatggcgtcccacattgtcggatacccgcgcatgggccccaagagggagctcaagtttgccctggagtctttctgggatggcaagagcagcgccgaggatttggagaaggttgccaccgacctcagggccagcatctggaagcagatggctgatgctgggatcaagtacatccccagcaacaccttctcctactatgatcaggttcttgacaccaccgccatgctcggtgccgtcccagaccgttactcatggaccgggtggggaaatcaatttgagcacctact

SEQ ID NO: 32754 - DNA, 507 bp, Triticum aestivum
  unsure (1)..(507): unsure at all n locations
  Clone ID: PAT_TA_32754
ccagatcccgccgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcaccggtgttctccaaggcgaggtacactgtcaggtccgttcgggtatcaggcgtaatgagaagatcgcctgctatgtgactatcaagggtgagaaggcgatgcagctgctgggagaagtggcctgaaggtgaaaggagtaccaagctgctcaggaggaacttcagcgacaccgggatgctttggctttcggtatccaaggagcaacatcnantctcggcaatgaaagtacgaattccatcctaccggcatctacggtatgggacttcttttgtggtgcctccaacccgttgcttgggtaaccggcgttctccccgcccgccggcaanggtgncaaanggccccgccgttcgggtg

SEQ ID NO: 32755 - DNA, 532 bp, Triticum aestivum
  unsure (1)..(532): unsure at all n locations
  Clone ID: PAT_TA_32755
tgccgctccgcaaggctgagcatgcattctacttggactgggctgtccactccttcagaattaccaactgcgagatccaggacaccacccagatccacacccacatgtgctactccaacttcaacgacatcatccactccgatcatcgacatggacgcggacgtgatcaccattggagaatccgcggccgacgagaagctgctctccgtgttccgcgagggcgtcaaagtacggcgccgggatccggcccggtgtctacgacatccactcccccaggatcccgtcggctgaggagattcgcccgaccgcatccgacaagatgctgggcggtgctgggcaccacatcctcctggggtgaacccccgactgcggctcaaagacccgcaagtacacggaggtcaagcccgccctggaccaacatggctccgccgctaagtcatccgcaccagtcgccaacgcaagtgagnacttttttttgccttttcgttccgaggaggcgtcntccatgcaattggttcaataaacaggctgg

SEQ ID NO: 32756 - DNA, 423 bp, Triticum aestivum
  Clone ID: PAT_TA_32756
taggcggcgaagttggcggggacccgagtagggttgcacgttgacgccccaggacgcggcgtcaaggtggaaggcagcgagcgcggcgtgaccggcagagttctcgatctcgtcgatgacgtcgttgccgccgtagtagcgggcgccgggcatgccctcggagtacttgttagtgagcgcggagccgagcgcctccatgacggcgaaggaggtgaagttctcggaggcgatgagctcgatgccgcgacgctggcgccgcttctcgcgctccaggaggtcgtagatctccgggtcggcgcccgcgagcggggttagcccccatgtggcgacggggtccatggcggctgcgtcggcgcgggaagaggtgacaggagtggtggcagcgaggagtgggcgtgggcgggggcgggggcggaggcggag

SEQ ID NO: 32757 - DNA, 515 bp, Triticum aestivum
  Clone ID: PAT_TA_32757
cccaatcagaaatctcaagcttagcacagaagcaaaacaatggcggagcagaccttcatcatgatcaagcccgacggcgtccagaggggcctcatcggcgaggtcatcagccgcttcgagaagaagggcttctacctcaaaggtttgaagctccagaacgtggagaagtcgttcgccgagcagcactacgccgatctgtcctccaagcccttcttcgctgggctcgtggagtacatcgtctccggcccggtcgtcgctatggtctgggagggcaagagcgtcgtctccactgggacgcaagatcattggcgccaccaaccccctggcctctggagcccggcaccatccgtggtgacttcgccgtcgacatcggcaggaacgtcatccatggaagcgactcagttgagagtgccaggaaggagatcgccctgtggttccctgagggcattgccgagtggaggagcaaccagcacaactggatttacgaaggctaaaatgtgtcatgaatgggtgag

SEQ ID NO: 32758 - DNA, 472 bp, Triticum aestivum
  unsure (1)..(472): unsure at all n locations
  Clone ID: PAT_TA_32758
tcgcagtccaaacccaatcagaaatctcaagcttagcacagaagcaaaacaatggcggagcagaccttcatcatgatcaagcccgacggcgtccagaggggcctcatcggcgaggtcatcagccgcttcgagaagaagggcttctacctcaaaggtttgaagctccagaacgtggagaaagtcgttcgccgagcagcactacgccgatctgtcctccaagcccttcttcgctggggtcgtgggagtacatccgtctccggccggtccgtccgctatggcctgggaagggcaagagcgtccgtctccactgggacgcaagatcattgggcgccaccaacccctgggctctggagcccggcacatccgtgggtgacttcgcgtccgacatcggcaggactcatccatggnaacgatcaatttagaatgcaagaaggagntccctgtggtcccngaaggatgccgatggaggaca

SEQ ID NO: 32759 - DNA, 606 bp, Triticum aestivum
  unsure (1)..(606): unsure at all n locations
  Clone ID: PAT_TA_32759
ggtttgagacttgctaccagattgctcttgcaatcaagaaggaggttgaggatcttgaggcaggcggtattcaggtaggcactgttgtatttgttatttaagcaacatgttccattgtacaacatgagtgtacttagatttttttctaattggattcttgcaggtcatccaaattgacgaggctgctttgagagagggtctgccactccgcaagtctgagcacgctttctacttggactgggccgtgcactccttcaggatcaccaactgcggtgtccaggacaccacccaggtaaaaatctgcttcaagtgggagccttgcaggaacctacctttcttcctggatcattgcattgcaactggacacattctctctttatagatccacacccacatgtgctactccaacttcaacgacatcatccaagtccatcatcaacatgggacgctgatgtgatcaccaatggagaaccgcggtccgaccaagaagctctctccgtcttccgcnaaggtgtgggtgtacggtgcaagcattggcccgggtgtgtacgacatccactcccccaagattccgtcaaggaggaaatgccgaccgtgtcacaagat

SEQ ID NO: 32760 - DNA, 419 bp, Triticum aestivum
  Clone ID: PAT_TA_32760
agggaggctgctgatgaagtccaggctcgccggatgcggttttggctcgagccgcctccgcttgttggctgcctcaccgtccatctcaaccggccgtgacgctggtgtacacgtgtgctggtctgtgttgtgtgctggcctgctgggtgtgcgcgagtgcgtccttctgtgcatgccgccgcgtagtggtgaattgtgcgcgagtgcgtccttcacgcggaagaagtgtgtcctcaatgcaccctcagtttactagcgtgcggggtgctaccccgagtggtttcaactttgtttacttcaccgcatgtcaaatgggcctctagtttacttatttttcacccactcccacatgggccagcacacgaagatagagaacacgagctgacaaggcagcatgtggactgtgagcgtataaacaa

SEQ ID NO: 32761 - DNA, 641 bp, Triticum aestivum
  Clone ID: PAT_TA_32761
ataaaacagcacttctctcaaaactaatacaccttacattctgagacagagggggtgtaaaacagctaacttgacttcctcctttttctagggtccaaacaaaacggattccattataaactgcaaactctcactacagatccatttccgctgtcgtttggttgtacatataaataaatccatgctcccattacatttcacccagtaacaaaactgaaacgcggaaaaatctatcctatcacatagcgtcgagcccatcattctgtgggggggtcgtttcgcagagccggtgcattttgccgccccttcccaaatttgttggcgacggcgggttctgacagcgtgttccagaccttcagtttgcctttcgatcctccgcacgctaacaggaaggggttgtcgttcgaaaacgacaccgagaatatagctccgagcttaggattcagcgacgagacgcacgaaggctggttgttcgatagatcccagagcttcaccattttgtcagttgaaccagtcgcaagaaagttaggggtagatggggcgaaggatatggaagaaacggcctttcgtgtgcatgcagagtaaaaattggctgtccaggattgatttgagaagctgtccgaatacaaacgcttgaacca

SEQ ID NO: 32762 - DNA, 422 bp, Triticum aestivum
  Clone ID: PAT_TA_32762
tgtgaggcatgatccaattgaaaattaaaatcatgatgacaagtttcatggttataattattctttatagcatacatgtcatcacaataatcatcatagataggaactttattctcatagtctattggaacctcttccgaaatagtggattcatcactaaataaagtcatgacctctccaaatccacttccataattatcacaacaagattcaacacccttcaaaatagtgggatcattacttcctaaagttgacactcttgcaaacccactttcatcaacaaaatcatcataaataggaggcatgctttcatcataacaaatattctcatcaaaacttgggggacaaaaaatatgataatcatcaaacatagaatccccaagcttgtagctttgcatattattagcatcatgggtacccgt

SEQ ID NO: 32763 - DNA, 790 bp, Triticum aestivum
  Clone ID: PAT_TA_32763
tgtcacttagatacttcaatgtcaccacaattatccgcgggtttgattatgcgatatgcatcacacaatctcagattcatctattcaaaccaacacaaagtacttcaaagagtggcccaaagtttctaccgaagagtcaagaagaaaatgtgtgccaacccctatgcataagttcacaaggtcacagaacccgcaagttgatcaccaaaacatacatcaagtagatcacatgaataccccattgtcaccacagataagcacatgcaagacatacataaagtgttctcaaatccttaaagactcaatccgataagataacttcaaagggaaaactcaatccattagaagaaggtagagggggagaaacatcataagatccaagtataatagcaaagctcgcgatacatcaagatcgtgccacatcaagaacacgagagagagagagagatcaaacacatagctactgcgacataccctcagccccgagggtgaactactccctcctcgtcatggagagcgccgggatgatgaagatggccaccggtgagggttcccctcccccggcagggtgccggaacagggtcccgattggtttttggtggctacagaggtttgcggcggcggaactcctgatctaggtttctttctggaagtttctgtatatgtaaggggttttggcaccgagaacaagtcaggtgggtctccgggctgtccacgaggcagggggcgcgccccccaccctcgtgggcagcccgggactcttctggcccaactcttttcttctgggggg

SEQ ID NO: 32764 - DNA, 648 bp, Triticum aestivum
  unsure (1)..(648): unsure at all n locations
  Clone ID: PAT_TA_32764
gaggctgctgatgaagtccaggctcgccggatgcggttttggctcgagcggcctccgcttgttggctgcctcgccgtccatctcaaccggcagagacgccggtgtacacgtgtgctagtgtgtgttgtgtgctgggtgtgcgtgagtgcgtccttctgtgcatgccgccgcacagtggtgaattgtgcgcgagtgcgtccttagcgcgcaagaagtttgtcctcaatgcgccctcaatttactagcatgcggggtgctaccccgagtggtttcaactttgtttccttcaccgcgtgtcagatgggcctctagtttacttattttcacccactgccacatgggccagcacacgaagatacagaacatgagctgacaaggcagcatgtggattggttgaccggttaactgaacaatatatggagctatacgctgacacagtgagcgtataatccgttggtatagagtgttcgagttagaggggaggcccgtgagagatagcagagagaganagaaagagctactccctccgttcgataatgtagttccaacatttttttaaaagtcaaacttttgaaacttcgaccaagttaataaagaaattacttatatctacaataccaaagataaatgatagtatgaagtaagtac

SEQ ID NO: 32765 - DNA, 584 bp, Triticum aestivum
  Clone ID: PAT_TA_32765
aaaaaaaaacattttatttatgccagaattttgttgatttacaacggaaacctgttgattcacaagtgtcagaaaaatgaaggggtccgccgcgtttgtcatctcctcacggaagcaggtgttgtcctagtagcagaacattgttttcttctttctctgagccctggcaatctccttgctgtcgatgttcgcgagcagttcctcttgcctgataagagcctcgtgcaaagccttctttgttacaattagttcagcttccaatgcatccacacgacgcacagcagcgttaagcaactcttctttctcgcaaggcatttcagaaggcttttcttgaagcatctggaccttctcttcaagctctcccagcctttgcaagaccacggcgaataggtcggcttcagcgaacccagggaatggcgaaggaggacggaattcctctttctggacggagtccgggtacaatgtacagtagctttcttctgacccgcctttagatgacaatctcattgtggcaagatctttgattgatcgaaccaacattacaatagccataagacaagccatcagatttgcagcgatcttat

SEQ ID NO: 32766 - DNA, 614 bp, Triticum aestivum
  unsure (1)..(614): unsure at all n locations
  Clone ID: PAT_TA_32766
gcacgaggcgcacacccgagacaagacaagaagcacgcacgcacggacgcagacgcaagtatggcacgcaccggcgccacgaccacgacgggagctgccgcggtgctgctcctgctggcgctggtggccacgggcgccgccgcggtcgacgcggccgctggtggctacgagatgaccgcggctgctgccggcggtcgccgcggcggccgggcccagccagcggggctgacgcagtgcatgggcgggtgcgggacgaaggtcgcctcgtgcctcctcgactgctacaacacgtccaccggagggaccgtgcccatctgctacctcggatgcaccaacaacgccgtcttctgcgccaccgactgcaccacccaggggctctgattcccgatcagtccatcgaccaatccatccggctagcgatgtatcaacgcatacgcaccgcatccaagtatacacgttccaccccggaccctctcacgtatgaataagatcagttgtactgtacttcgtttcagtcgacacgtgcgactagacacgagcttgtatgctgaagtggtgaatatacacagcttgctaaaaaaaaccggaaacaacntactaggcgccggggatga

SEQ ID NO: 32767 - DNA, 345 bp, Triticum aestivum
  unsure (1)..(345): unsure at all n locations
  Clone ID: PAT_TA_32767
catctccatgaactggccagatgacgaggggcacaggactggatccagctttgacacatcactcactgcagcagcagcaagcaagctcgcagcattcaggttcttcntgcttcgtccttgacgtactcactcctggatctcgacagaactccatgtggcgctggagcgatttgaggcggccgtagaggtcgtcgtcgtcctcggccgcggcggaggaggaggcgcagtgggcggcggtggcggggtaggagggcgggggcgccgacgggagggccgcgggagggtttgctgcggtcgccatggctagggtttggtggctggaggcagggtcgggctttttttaac

SEQ ID NO: 32768 - DNA, 366 bp, Triticum aestivum
  Clone ID: PAT_TA_32768
gccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgcaggaggaggagcgggagcgccgcatggacttcgtcccggagaagtcagcgctcgaggtcgaagagatccgcgtcgacaaggagaccatggagatgctcgcggcacttggcatggccgatctcccgggcgt

SEQ ID NO: 32769 - DNA, 607 bp, Triticum aestivum
  unsure (1)..(607): unsure at all n locations
  Clone ID: PAT_TA_32769
cgtccgattttttctaaatggttccctttgcaggtcatccaaattgacgaggctgctttgagagagggtctgccactccgcaagtctgagcatgctttctacttggactgggccgtgcactccttcaggatcaccaactgcggtgtgcaggacaccacccagatccacacccacatgtgctactccaacttcaacgacatcatccagtccatcatcaacatggacgctgatgtgatcaccatcgagaactcgcggtccgacgagaagcttctgtccgtcttccgcgagggtgtggtgtacggtgctggcattggcccgggtgtgtacgacatccactcccccaggatcccgtccaaggaggagattgccgaccgtgtcaacaagatgctccgcggtcctgggacaccaacacctgtgggtgaacctgactgcggctcaagacccgcaagtacgcccgaggtcaagctgnccttcacaaacatggttgaggccgccaagcaattcgtggccgactcnccaaggcgcagtaagccgtgctcgtatagcaaagccccttttaattgcaangaggatgtcacaacatagcgtgtttactttgnataactgg

SEQ ID NO: 32770 - DNA, 627 bp, Triticum aestivum
  Clone ID: PAT_TA_32770
cagataaaccctcccatcttccgcttcctctccaccggcggcctccccggtcagatcaccatgtcgacggagaagaagcagttgaaccccatgcgggagatcaaggtgcagaagctcgtcctcaatatctccgtcggcgagagcggcgatcgcctcactcgcgctgccaaggtgttggagcagctcagcgggcagtcgccagttttctccaaggcgaggtacactgttaggtcttttggcattcgtcgtaatgagaagatcgcctgctacgtgacgatcaggggcgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaactggcatctacggtatggacttctttgtcgtactggagcgagctggataccgtgtctcccgccggcgccgatgcaaggcacgtgttgggatccaccaaagggtgaccaaggaagatgccatgaagtggttccaggtcaagtatgagggtgtcatcctcaacaagtcccacgccagctagtaaccttccgagtgattgagttgt

SEQ ID NO: 32771 - DNA, 939 bp, Triticum aestivum
  Clone ID: PAT_TA_32771
cccacgcgtccggcctcaaatccgtcaatggcgtccacgccctccctcaccctcctcctcgctcttgtgctgcccctcatccctctcgccgtcgcagctccggagaagcacctcgtgacccacctcccgggcttcgacggcgccctcccgtccaaacactacgccgggtacataaccgtggacgagagcaatggcaggaggctgttctactacctggtactgtcggagcgtgatccggccgccgacccggtcgtgctctggctcaacggcggccccggctgctccagcttcgacggattcgtctacgagaacggtcccttcaactttgagcgtggaagcactcccggagggctgcccaagctgcacctcaatccctatagttggtcaaaggtttcaagcatgatatacctggactcccctgccggtgttgggatgtcatactcattgaacaaatcggattacacaacaggtgacctgaaaaccgcagccgatgggcataccttccttttgaagtggttcgagttatacccagagtttcagtcgaacccattctacatttccggagagtcatatgcagggatatacattcctacactagctgatgaagttgtcaaaggggcacagaaggctctgaagccaagaatcaatttgaagggctatctaattggtaatggagtaaccgacttagactacgatttaaactcttttgtgccgtttgcacatgggatgggtctcatatcaaccgacctgtttgaggatgtcagtgctgcttgccatggcacattctggggaaaagtaaatgatgtgtgccaagaaaagatagatagagtccgttgggaactgaaagatctgaataagtacaacattcttgcaccatgctaccaccaccctgaagtccaagagacagcgttcgtgaacagcagcttgccatcaagcttc

SEQ ID NO: 32772 - DNA, 1279 bp, Triticum aestivum
  Clone ID: PAT_TA_32772
cggcacgagggtgccatgcctcttaatgtgtcatcagctggaagtgtcaacgatagcttcaagcaaacatttagtgtagatacccctgatctacaatcaactgcaacctcacaggccaagtggcaaaaaattgaggtatgttattaagattatctgttgagaaacaagagaacgttatttttatccagtagttatacttgaagcagtggttatttatttatttactttttctatagaagggaagggaatgtagttcctttgactggtaattgttggctaccttgcattttcactggcatttggtccatgtttgtgcaggtaactcatgctctcttggaggagatccaggagataaaccaacagctcatagacacggagctccatgtatgtgaggacgatgctgagtcattcgctggtacatgtgaaggagctgaagggacagtcatcaaatgcacatttactgctgtggctgttagtccgagcttgaagtccatttttgcatctgcacagatgagcccaattatgccgttgaggttgcttgttcctgctagctaccctaaatgctccccggtgctcctcgacaagtctccggatgaacaaagaaactcggaagacctgtctatgaaagcaaagtcgaagtttagcatattactgcggggtctagctgagcccatgtcgctgcgagaaatcgcaaggacatgggacgcttgtgcacgcaaaaccattgcagagtatgctcagaagactggcggaggaagtttcagttcgagttatggttgctgggaaagttgtgtaggtgcttgatccgtctattatgttttgtggtggcgtcaaacttcattttacgtgctcaagtgcagttccgatcccttggtggttatagttgcctttatactccctccgtcccaaaattcttgtcttaaatttgtccaaatacggatgtaacaaatcacgttttagtattagatacatccgtatctagataaatataagacaataatttagggatggagggagtacaacagttgagcaaatacacgtgtgctgtatttgtgattgtatttatacaaactcactgttggcttgatagttagaggcccttttgtgctatattattcatatttgttatgagtagttgtgagcaactatattagtagtaaatggaaaatataaatgatgaacgttacccttattagaggtattctcgacctctttgctctcaggatatttttcatctaaaaagtaggtggtgaggtgaactggtaacctcaactgaact

SEQ ID NO: 32773 - DNA, 678 bp, Triticum aestivum
  Clone ID: PAT_TA_32773
ctcgacgccaatatcatcaacgaccgcgagtcggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacggccagggcggcggtggcggctacggccagcgcggcggcgactccggcggccagtggaggaactgagcggcggggccctccagttatcgatctatctaccatctcgtcgtcttcgtcatcaagttatcttcagtgtcgtcgtcgtcgtgttcctgtgtcagtcagtcttgagtcgtgtgtgtcgttcggtcctgtggtgtttttgatcgcgagctcgagtgtcgctctgtccggggttaattagagctggttacgcgaggaagaaacaacatgtgttatctttcagtcggtcggtcggtcgtgttcgtcggtgatgcaacaatcccttctgtcatggattgggatgtgatgttggaatcctatgtttgaactcagtttaaatggatgaagaaaatgcaagtgatagctgcg

SEQ ID NO: 32774 - DNA, 545 bp, Triticum aestivum
  unsure (1)..(545): unsure at all n locations
  Clone ID: PAT_TA_32774
catcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatgggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtgggttgacaccaactaccacttattgtccctgaattgggcccaaacacaagtctcctaatgcttctcacaagctgttaacgaatataaggagctaagggctcggtgttgatacctgccaatactgttggacatctcgtactttgtctcaaagctgcaagggngtggg

SEQ ID NO: 32775 - DNA, 813 bp, Triticum aestivum
  unsure (1)..(813): unsure at all n locations
  Clone ID: PAT_TA_32775
acgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaagaccttttcttgaccttgtaagacccaacaatgtcatgctttctcccacactcttcatcttcttgttccacctcctcttcctttccatgtttcttttcacccctctctcttccatctttcttccatctatccctccggagctacgtttttttaaagttgcatttcttatattcaatgtattgggaacaagatgatacatggagtgacaagtgaaggagattctatctcccttgtcatacgctgctgtgtgtagattcatcatttccatgttgtattttccttcttttgtagagagtacagttgatgagatacaaaagcacggtccttgttgccgtaatgctcatgcacgtggagtaggagcctacatgtaattgagcatgtttatgtatgccaaccttgtaataagtttgccattcctgctncaatagaaacatt

SEQ ID NO: 32776 - DNA, 775 bp, Triticum aestivum
  Clone ID: PAT_TA_32776
tttttatttttgcattatttttttttttttgagggatcgaatacacaactcttatctagtgctacaagtagtctgtagttcatattgataataatgaacaaggctttgccgttggcattgaggagaggaggaaaaagaattagtgtcacaaattacagacctatctatgtactactaacagcagtggttctgtcttaccagccatatacaggattctgtacctgagggggcagcaggtgcatgtccacgctatgttgcttattgtagttcagggtcccgggcaccgccccagtcgacagccggaggagctcgctgcccgtgaagcagtagtgggcaaatgctaggcccccatccacgatgtccgacatgtttggcaatgaggctgatttcttcatcctcctatcgacgctgcttccagaggtgctggcagaatcaccattgctgctcaggaccttgtccagttctgagtgctccatgaacctctgggtcgcagcctcccacgaaaggttgtaccgctgctcaggtgtgaggggctggggatcgcgggtcattgcttccttcactttggcaacaaaatcctctgacgtcgtgtacgtcaggcagtttgggaatgatttgaaggaatcaatggaatgggtgatccgcacagaccacaaacttgcccatggctagtgcctcagcagtggcggtgcagaggacatcactaatgctcgggtttacaaaaaccttgtacccatgaagagaatcgtctgcatgatctcggcctttatggagt

SEQ ID NO: 32777 - DNA, 789 bp, Triticum aestivum
  Clone ID: PAT_TA_32777
gttggacttgatacagtccaaatctgttgatttcaagacaatggaggaatctcctttggacagattcacgtgcgctctttaatagggaaatagaaggcccacttgatttcaaaatcttgcgaaattcagatttccgtgaagttacgctggaggtggagggcagtcctgttttgaagtttgccctttgttacgggttcagaaacctacagaacattgttaggaaggttaagatgggaaaatgtgaataccagtttattgaagtcatggcttgcccttcaggttgtctgaatgggggaggccaaataaaacctgctaaaggccaatctcccaaggatctcatccaacaactagagggtgtgtacatgcaagatgtatcaatatccaaccccttcgataacccgatcgcgaaaagattatacgatgattggctcgtccaacccggttcagacagtgcaaagaggtacttgcacacgcagtatcaccccgtggtgaaaagcgtcacttcgcagcttcaaaactggtgatgccggcaaagatcggttcgttgcgtcgagaattcatcgtcatatgttctcctaagaaaccaagaggcacactgccgaaacaatggcaacactagagggtacaggcatcattaccaagggtgttttgcttgagggcaaaaactgagttttgctaggccataggttttccacctgcttttcttggtgatcttgtgtaatattgccccacagagagataaacaaacagtgacagatagtaaattgtacctcggccgcgaccacgcta

SEQ ID NO: 32778 - DNA, 620 bp, Triticum aestivum
  unsure (1)..(620): unsure at all n locations
  Clone ID: PAT_TA_32778
ggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgatcccgttagtagcggcgagccgaaatggggagcagctaaaccgttgaaaacgggtttgtgggaagagcaatacaagcgttgtgctgctaagcgaagcggttgaatgccgcaccctaagatggctaaanccaagttacccgaaacatcactactttacctcctgacccgantagcatgggnaacgtggatcccgttttgatcaagcaaggacaccttgccaagntaatactcctgggttgaccgatacgaattatacgtttaggaaaagggaaaaagaccccatgggtantgaataaactnnaactnctgacnccaacatnggaagggaatgattcgaccccttctgtnaaaataacgggaacataggattgcttgttaggaacgancacggnccttcaaacatctaaggcatntcngttggccactggtttt

SEQ ID NO: 32779 - DNA, 664 bp, Triticum aestivum
  Clone ID: PAT_TA_32779
gcggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcacctctgccgctgcgccctaccgccagcccttcaacggaccccgcggtggcaatcgcgcctaggttcctccgcatcgtcgtcgtcgtacccctatcatctttacatgttttattattagatctgttacttgtggcaagtgatgttttgaactcagagcttaagttcgaggtattttgatctgcgtatggtgaacatgatctgtttatctcatcgtttatctgaagtgattcgatatattactgttgagctttgaagtttatgctcgttactcgatgattgattgatttatgagctatctatctattgttaattaaaaaaaaaaaaaaaaaaaaactcgagac

SEQ ID NO: 32780 - DNA, 520 bp, Triticum aestivum
  Clone ID: PAT_TA_32780
gctccacctcgctcgctccgcctgcctcacctcgccgagtgcagtcagggcctcgccgccgtaggagccgccgccatcgtcctccgcacgcctcgagaccctgctcagaagacgcgtcgccgtacgctacttcctctacgcccaggaacgcgagctggggagccctccggcggccagtggaggaactgagcctcgaatctcccagttatcgatctatctaccgtgtcgtcgtcgtcgtcttcgttagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgtcactatctttcagtcggtcggtcggtcagtcggtgatgcagcaatccccttctgtcatggattgggatgtgatgttggaatatcctatgtttgaacaagtttaaatggatgaaaaaaaaaaaaaaaaaaggccccta

SEQ ID NO: 32781 - DNA, 770 bp, Triticum aestivum
  Clone ID: PAT_TA_32781
caaggaaggcagcaggcgcgcaaattacccaatcctgacacggggaggtagtgacaataaataacaataccgggcgcattagtgtctggtaattggaatgagtacaatctaaatcccttaacgaggatccattggagggcaagtctggtgccagcagccgcagccatgggtcgcgtccgcaccaagaccgtgaagaagacctcccgccaggtcatcgagaagtactactctcggatgaccctcgacttccacaccaacaagaaggtgctagaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggctgacctccccggcgttgagcgcgcccccgaaaccacctctgccggcgacccctaccggcagcccttcaacggaccccgcggtggcaaccgcgcctagggttctccgcatcgtcatcgtacccctatattatgctttatgtcttttaagatctgtaacttgtggcaagtaatgttttgaactcaaggcttaaattcaaggtgttttgatctgcgtatggagggccatgatctggttatctaaccggttattctgaagggattcgtaatatt

SEQ ID NO: 32782 - DNA, 856 bp, Triticum aestivum
  Clone ID: PAT_TA_32782
gagagagagagaactagtctcgagttttttttttttttttttagaaaaccaaggctaggaaatatcatctccatgctatggcataccttcaatgattattcatgagtcatatcattttcaaccataaattcatacatcacgcttagcgcacagcaatcaaccccttaagggcaccaatttgctgctacaagaaaacgatctgcatggtaccacagcctaatccttgtatttcatgtctgacacccggaagccaggcatctcaaatgaaatggcaaacttctccacctctgccctgagctccgcgatgtcctcgttcttctccaagtcaacggtgaaatcattgtaacgcttacctcgctgcttctggacattcaagcagatgaccacagcctgatgaaggtactcagcaatcttcacaaagtccttctcgaccaaacctctcgaggtcatggcaggtgtaccaattcggacaccaccaggtgccaatgcactgctgtcaccaaagacggcatttttgttgagtgtaatgctgctcagatcgcatactttctcaactttgttgccagacaagccaagagggcgaagatcccagagaacaaggtggttctcttgttccatccgtaacccaacttgtagcccttcctcatcagctggtttccaagggcaacagcattggccttgacctgctgaatatatgctttgaatccaggtgacattgcctgcttcaggccaactgccagggcagcaatctggtggttgtgagggccaccctggagtgacggaaacactgcaaagttgatcttgtcctcataatcgtaaagagcaccctcgggctggccttttttggtaggcttcg

SEQ ID NO: 32783 - DNA, 635 bp, Triticum aestivum
  Clone ID: PAT_TA_32783
agcaagtcctccactcccgatggcccgcacgaagcagacggcgaggaagtccaccggcggccaaggcgccgcggaagcagctggccaccaaggcggcgcgcaagtccgccccggccaccggcggcgtgaagaagccccaccgcttccgccccggcaccgtcgcgctccgggagatccgcaagtaccagaagagcaccgagctgctcatccgcaagctgcccttccagcgcctggtgcgggagatcgcacaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctgctccccagtgtctgatctggtgttgaggtgtagagttgtgttagtttcttattagcccgtgtctgtggtagtaaggctcgtggacggttgtgttatggtgtgatgtatgtgatggcatcatcttgttatcatcatcaatggaagttagcaatctgattttaaacatgcctgcttgtttgtctgaaaaaaaaaa

SEQ ID NO: 32784 - DNA, 793 bp, Triticum aestivum
  Clone ID: PAT_TA_32784
tcaagaagaaggtgcagaggagcgccgaggacaagaccatactcgtggcgacgtacgagggcgagcacaaccacagccagcccccgtcgtcgcagccgcagcagcagaacgacggctccggcgcgggcaagaacgccgggaagccaccccaggcgccggccacgcctcaccacccgcagcagcatcagcagcagcacaagcaggaagcgccagcggtagccgtcagcggcgagtccgccgccgcggaatccgagatgatccgtcggaacctggcggagcagatggccatgacgctgacgagggaccccagcttcaaggcggcgctcgtcaccgccctctccggccggatcctcgagctatcgccgaccagggacataaattaatccccgcattagaagacactgcgcggctcaaattttcttgcggtggtcgattacttcctccggcattgctgccttcctgcccctgccgcctccgtcaaaccacgcagaaaaaccagcgagaaccggaacgcctgaccaacgacgaagacgcgatcggttccggcgagccgggaacggagccgctgctcctgctgctcgtgtaaatacatcgccaacacgagggcggcgagggagggtgtagcatgtaatgtactctagtagatgcagtcagtcattcaggaacacgcgaaagtgtgcaatcctttttttttcctcactaggcgaaatattcgttccataatttccatggaactcgattcgattcaatgagaaaatcgaagtcaccgtacattctcagttcaaaaaaaaaa

SEQ ID NO: 32785 - DNA, 810 bp, Triticum aestivum
  Clone ID: PAT_TA_32785
ccacggttcacggccagatcccggccaactccggccagtccctgccctgccgacctttgtcgccaccccctccttcccttacctccgtccagcccgtttacccgccaattcgcagcccccaacaaaccctgggcaccgtcgacactcacaaatgccaactttctcgccgcggattgcatagaggaaggagaaaatgcgatttttgcggtggtgcggcaacgcgtggtggcgatgcacggagaacggctgccgatgtggccgtccaggaggccgaggttctcgcggacgacggcgagcaggccgcgggtccacggacgacggacgcaggaggcctgctgtcgccgagcaccgcttctactcttgcgaggagcgcgtccgggtgctcgatctggagtgcatggcgacggcctcatccctggtcgccgtgccggggggaggtggcgacggcctcatccctggtcgccgcgccggggggaggtggcggtggcacagtaactcgagctccccttcctcgacccagcccccgagcccgatgtctcgtctaccctcaggcgtcgtcatgttcatgtgtcagtctgggtcgtgcgtcgtgtcgttgagtcctgtggtgtttttgatcgcgagctcgagtgtctctttgtctggggttaattagagctggttacgcgaggaagaaacaacatgttatctttcagtcggtcggtcatcggtgatgcagcaatcccttctgtcatggattgggatgtcatgttggaatcctatgtttgaactcagtttaaatggaagaagaaaatgtaagtcatagctgcg

SEQ ID NO: 32786 - DNA, 639 bp, Triticum aestivum
  Clone ID: PAT_TA_32786
gccagagacgaggaagggcgtagcaaggcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagacctgctgctagaggacgagggtcgatgagatgcatgattcctatgcttctcttgagacagccatgatgggaacacgattcatatgctttagttatctatttcaactgatccatggttatagttgtacactgtatgggctaacttcttcaaattcggcttttttttcctgaagtgacgagagatcttagttatataggagtaaatgcgccttttggcgagtacaatttaaagctttattctttgctgatcatatagactatttaatacaacaacttgatgtcttctaaaagcaatataagcccattattcttcgcagaaaaaagagagcagactgcaagttgtatagccatgtatatcagtattctgtatgtaattgctatattaacaaagt

SEQ ID NO: 32787 - DNA, 771 bp, Triticum aestivum
  unsure (1)..(771): unsure at all n locations
  Clone ID: PAT_TA_32787
cccctcctccgtctccatttcttttgtcctctctctctctctctctctctctctctcggtgttaaaacgcggccgccgnacgcgcattgcctccttccttccgagcagtcgctggctcgcttcgattcttctccttctctcctcttgccggggcgttcttggagggggactgtagctagcctagcagtgttcttggagctgctgccggtggaggtctgcaatggggaggagcggccatgcctgctccgttcttggatcgctgctgctgctgctgctgctgctgccgggcccggccgctgcgcagaagggctcgacctggaagacgctgagtggcgatgctccagcagtcatagctaagggtggtttctcgggcctatttcccgactccagtgaccctgcttattcgtttgctgccagcaatcaggattcagcccagtggtgcgatgttcggttaaccaaggatggcgttggcatctgccttccagacataaaaatggataactgcacaaccatatccgatcttttcccaaagggaaagaagacctaccttgtcaacggtgtgtccacgacggggtggttctctgtggactataacagcattgacctgaccaatgtaactttgctgcgagcaatcttgtctcgtacaaataggtttgatggaagcttcacgctagttcaagttgaagttgcactgtcgcaatataaggcccctgcttggttgaatgttcagcatgacagtttctacagccagtttaatctgagcatgagaag

SEQ ID NO: 32788 - DNA, 620 bp, Triticum aestivum
  Clone ID: PAT_TA_32788
agagcccattatgccgttgaggttgcttgttcctgctagctaccctaaatgctccccggtgctcctcgacaagtttccggatgaacaaagaaactcggaagacctgtctatgaaagcaaagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggctgacctccccggcgtcgagcgcgcccccgaaaccacctctgccgccgccccctaccgccagcccttcaacggaccccgcggtggcaaccgcgcctaggctcctccgcatcgtcatcgtacccctatattatgctttatgtcttttagatctgttacttgtggcaagtaatgttttgaactcaaggcttaagttcgaggtgttttgatctgcgtatggtgcacatgatctgtttatctccccgtttatctgaagtgattcggatatattactgttcccccccccccccccc

SEQ ID NO: 32789 - DNA, 678 bp, Triticum aestivum
  Clone ID: PAT_TA_32789
gaggcggaaatagttctccatcccaaccttctcttctcccctctcttctctcccgcgcgttgcctcgaaccggaagcgagctctacatccgttacagcgcttggtgtttgagagacgatcagtccatcgtcgaccaatggatccatgggtcagcagccagccttcgctgagcctcgatctgcacgtcggcctcccgccgatggggcaccaccaggcggcgccgatggtggcgctggccaagcccaaggtcctcgtcgaggagaacttcatgcagctcaagaaggaccctgaggttgcggttcttgagtcggagctacagcgtgtgagcgaggagaaccgccgcctgggcgagatgctcagggaggtggcctccaagtacgaggccctgcagggccagttcaccgacatggtcacggccggcgcccacgccggcggcaacaacagccactacaacaaccagccgtcctccgcgtcggagggcgggtcggtgtcgccgtcgaggaagcgcaagagcgaggagagcctcggcacgccgccgcggccgtcgcagcaccagcagcagcactacgccgggcggcctcgcgtacgcggcggcgccggaccaggcggagtgcacgtcgggcgagccgtgcaagcgcatccgggaggagtgcaagcccgtcgtctccaagcgctacg

SEQ ID NO: 32790 - DNA, 1250 bp, Triticum aestivum
  unsure (1)..(1250): unsure at all n locations
  Clone ID: PAT_TA_32790
ccgggtcgacccacgcgtccggcaattcaccgcacaatacatcttctctagatcaaaatcaagaaatctatcaagattaaaatttggaataccctcagttatatgtttcatttcttcataacacaaaagaaggctaagctctttatgatgctcaagggtaatcaaattatcacaatatttggaaacgacttgatcatgaaacaaatagcattggagctttaaatgaccatgttcattgcaaagttcacaaggggtactataaatattgaatctttcagcacattcatctagctcttcttgcaacaatttggtttctaagtacttatgcctcttgcaatatctatcttccctatttggtgtgtacttacaaacccaatgcactccacaaaaattgacatgtttatgggagatattttcatcataactagtgcaatcatcattagcatcctggatattcaaggaattcatactaacaacattgcaatcatgctcatcattcaaatatttagtatcaagcattttaatgcattcttcttctagcacttgagcacaattttcctttccatcatactcacgaaagatattaaaaagacgaagcgtatgagacaaacttaactccattttttggtagttttcttttataaactaaattagtgataaaacaagaagtataaagatttgattgcaagttctaaagatataccttcaagcactcacctccccggcaacggcgccagaaaatagcttgatgtctactacacaaccttcttcttgtagacgttgttgggcctgcaagtgcacatgtttgtaggacagtagcaaattccctcaaagtgggatgacctaaggttatcaacccgttaggaggcgtaagatgaagatggctctctcaaaacaacctgcaaccaaataacaaagatctccttgtgtccccaaacacaccccaataagaatgggaaattggtataagtgcactaattccggcgaaagaatggtgatacaagggcaatatggatgggtaataaagttttggtatcctgaaaatataaaaacacaagnnactaatgataaaatgagcntaacgtattgcatgggaaggaacaagggataaggtcatattccactaangcaattcntcaacatataacatagatngtcattacaatcccaacatcaacaaagatcctcaaagcactatacgngaanaacanaattangaggncaacccccaattaccttttgtnacatca

SEQ ID NO: 32791 - DNA, 415 bp, Triticum aestivum
  Clone ID: PAT_TA_32791
aaaaaaatcatcacattcaatcatatgatgcaaatatgatcatgtaccatggaacaacgacaactccaacacatcatatataccgtggtgatttcaggatcctcagcctcagtagtccgcagcccaatatacaaacagatatacagctagccttcttttcccatacacaaattacatgcatttacactcacgacatatacataaatatgtacgaagggttagctctgcgcacggagagcatgatcgtggcgaccaatcaattccagtatttacgcaccaacagctccgccgatgaagtgcctccctccccccatcgtcgtctaagctcctcagaagcagagtttcttcttgcggaacttgagcatgtcttgcttgtcgatgaatgcgagcagctcgtcctgacgcatcagcgcct

SEQ ID NO: 32792 - DNA, 982 bp, Triticum aestivum
  Clone ID: PAT_TA_32792
caaaaaagaaagtaacacatatatttttcccatatgcagaacgcacacaaaaataatatggaagattattggcaaatactcaacattccatgatcccacgtgaacaattcctacaaagaaatatgatggaatgtggactgcaaacagagcacaaaggtgggacacgtttacaaaactatccagggctccagggcgagcagacaaatctcatagaagcacagcatggtggcattgcgcggcggccaagaaggcttagaagcgcgaggcgtatggacgattagcggagacaaccacgacatatgtatcatcatcctactccttgtacttcatgctctcgagcgagaagccgggcatgtcgaaggagagggcaaacttctcgacctcgaccttgaggttctcgatgtccttgttgctcaccaggcccttggagaagtccttgagcagcttgccgtgctccttctggatgttcaggcagatggtcacagcctggtggaggaactcggcgatctgctcgaagtccttctcgaccagacccctggaagtcatcgccggagcaccaatgcggacaccaccaggggacaatgcactgctgtcaccgaagactgcattcttgttcaatgtaatgctacaaaggtcgcacatcttttcaaccttgtttccagtcaagccaagagggcggagatcccatagaacaagatggttgtcagttccatcggtcaccatcttgtaacccttgctcatgagatattttccaacggcaacggcgttggccttgacctgctttgcgtaggccttgaatccaggagtcaaagtttgcttcagggcaactgcaagggcagcaatctggtggttgtgaggaccaccctggagcgatgggaacaccgcaaagttgatcttgtcctcatagtcatacacagcaccctcaggctggcccttcttcgcaggcttagggcctttcctgtagaagatcataccagccctc

SEQ ID NO: 32793 - DNA, 1129 bp, Triticum aestivum
  Clone ID: PAT_TA_32793
gtgcagtagaaggcctctggctcgcttaccttaaagtcattgcgaacaacacagcgcgagtctcttaatgctgcagttagcgacattcgatctgttgtcagcatgattgacaggattgctgggtcagcacctggtaatggctcgagagctgccgttggtgaagatttagttgctatgacaaagtgccggttacaagccaggaattttataacaaatgatggaagtggtgcatcgaagaaaatgaagcgtgatacaagtgccatgcctcttaatgtgtcatcagctggaagtgtcaacgatagcttcaagcaaacatttagtgtagatacccctgatctacaatcaactgcaacctcacaggccaagtggcaaaaaattgaggtaaatcatgctctcttggaggagatccaggagataaaccaacagctcatagacacggagctccatgtatgtgaggacgatgctgagtcattcgctggtacatgtgaaggagctgaagggacagtcatcaaatgcacatttactgctgtggctgttagtccgagcttgaagtccatttttgcatctgcacagatgagcccaattatgccgttgaggttgcttgttcctgctagctaccctaaatgctccccggtgctcctcgacaagtttccggatgaacaaagaaactcggaagacctgtctatgaaagcaaagtcgaagtttagcatattactgcggggtctagctgagcccatgtcgctgcgagaaatcgcaaggacatgggacgcttgtgcacgcaaaaccattgcagagtatgctcagaagactggcggaggaagtttcagttcgagttatggttgctgggaaaattgtgtaggtgcttgatccgtctcttatgttttgtggtggcgtcaaacttcattttacgtgctcaagtgcagttccgatcccttggtggttatagttacctttatacaacagttgagcaaatacacgtgtgctgtatttgtgattgtatttatacaagctcactgttggcttgatagttagaggcccttttgtgctatattattcataagtatttgttatgagtagttgtgagtaaatatattagtagtaaacggaaaatctaaatgatgaacgttac

SEQ ID NO: 32794 - DNA, 642 bp, Triticum aestivum
  Clone ID: PAT_TA_32794
ctgctgcaatcctgtattcataagacaggcaggctgaaacgggtagaattcagcgcaaaaacacatttatttatgttaggattttctgtccatttacaaacccatgtatgtctttttcacatttgtcaggaaaacgaacggatcaaccgtttacatcatctcaaacgccatctccggcatctcagaaaaaagaaaactgaaccaagggggtctctctcctcgtccgtcctagtagcaagacatcggcttcttcttctttttctgggccttggcaattgtcttcctgtcaacgtaagcaaggagttcctcctgcctgataagagcctcgtgcagagccttctttgttacgatgagctcggcttctagtgcatccacgcggcggacagcggcattaagcagctcttctttctcgcaaggcatttcagaaggtttttcttcaagcgcatgaaccttcgcttcaagctctgccagcctttgcaagactaacgagaacaggtcagattcagcaaacccaggacctggtgacgggggccggaactcctcttttggaatgcagtcttgatatactgcagaactttgttcgtctgactcatttttatctgccaatctcttcgtggcaacatctttaactgaccgaagcag

SEQ ID NO: 32795 - DNA, 622 bp, Triticum aestivum
  Clone ID: PAT_TA_32795
ggcaatcctctctccgcgcccacgaagcaagctctccactcccgatggcccgcacgaagcagacggcgaggaagtccaccggcggcaaggcgccgcgcaagcagctggccaccaaggcggcgcgcaagtccgccccggccaccggcggcgtgaagaagccccaccgcttccgccccggcaccgtcgcgctccgggagatccgcaagtaccagaagagcaccgagctgctcatccgcaagctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggcctcgaggtgtagagatgcgttagtttcttattagcccgtgtctgtggtagtaaggctcgttgacggttgtgttatggtgtgtgtgtgatgtatgtgatggtaccatcttgttatcatcattagtgggaagttagcaaatctgattttaaacatgcctgcttgtttgtctgatctcaaaaaaaaaa

SEQ ID NO: 32796 - DNA, 788 bp, Triticum aestivum
  Clone ID: PAT_TA_32796
ccatgtaccaaaaaatcatcacacattcaatcatatgatgcaatttgatcatgtacatggaacaacgacaactccaacacatcatataccgtggtgatttcaggatcctcagcctcagcagtccgcagccccaatatacaaacagatatacagcacgccttcttttcccatacacaaattacatgcatttacgcccatgacatatacataaatatgtacgaagggtcagctctgcgcacggagagcatgatcgtccgatcgattccagtatttacgcaccaacagctccgccgatgaagtgtctccctccccctcatcgtcgtttaagctcctcaaaagcagaatttcttcttgcggaacttgagcatgtcttgcttgtcgatgaatgcgagcagctcgtcctgacgcatcagcgcctcgtagagggccttctttgtagaaatcaagtcggcttccaaggcgtccacgcggcgggcggacgcattgagcagctcttccttctcgaatggcatctcggatggctttttttcaagcgcctgcaccttctcctccagctcacctagccgtcttaccagagttgaaaggatatccttctctgtgtaggccggggcaggagacggaggtcggaactcctccttgtactcttgctcttgagggcagtccacgtaatagtggtcgtgatcattggattggttcgagagccttttggccattctgctcgggatacttcgaagcatggcgaaaagggtcacgatgaagactgtcagccatgcgacagccaaggtccg

SEQ ID NO: 32797 - DNA, 1640 bp, Triticum aestivum
  unsure (1)..(1640): unsure at all n locations
  Clone ID: PAT_TA_32797
ggggcctcaaatacgtcaatggcgtccacgccctccctcaccctcctcctcgctcttctgctgcccctcatccctctcgccgtcgcagctccggagaagcacctcgtgacccacctcccgggcttcggcggcgccctcccatccaaacactacgccgggtacataaccgtggacgagagcaatggcaggagtctgttctactacctggtgctgtcggagcgtgacccggccatcgaccccgtcgtgctctggctcaacggcggccccggctgctccagcttcgacggattcgtctacgagaacggtcccttcaacttcgagcgcggaagcactcccggagggctgcccaagctgcagctcaatccctacagttggtcaaaggtttcaagcatgatgtacctggactcccctgctggtgttgggatgtcatactcattgaacaaatcggattacaaaacaggtgacttgaaaaccgcagccgatgcgcatatcttccttttgaagtggttcgagttatacccggagtttcagttgaacccattctacatttccggagagtcatacgcagggatatacattcctacactagctgatgaagttgttaaagggatacagatggctctgaagccaagaatcaatttgaagggctatctaattggtaatggagcaaccgacgcagactacgatttaaactcttttgtgccgtttgcacatggaatgggtctcatatcaactgacttgtttgaggatgtcagtgctgcttgccacggcacattctggggaaaagttaatgatgtgtgccaagaaaatatagatagagtccgctgggaactgaaagacctgaacacgtacaacattcttgcaccatgctaccaccaccctgaagtccaagagacagcgttcgtgaacagcagcttgccatcaagcttcagaaagctaggtgaaacagagaggcctttcccagtgaggaagaggatggcggggctttcatggcctctcggtcttcctgtgagcagcggacatgtcacgttgtggcccgagcttggcggtagatcacttccatgcacgagtgatgaacttgctactatatggctggatgatgaagatgtaagagctgccattcacgccaaagcgaaaagcttaattggatcatgggaattgaatactgcaagaatagactacactcatgatacaggcagcatggtggagtatcacaaaaaattcacagccatgggatatcgcgtacttatttacagtggagatcatgatctgtgtatccctttcactggaacggagcatgggtcagatcattaggctaccgagttgtcgattcatggcgcccatggcactttgggggtcaagttgctggatatacacaaggctatgatcacaatctcaccttcctcaccataaagggatctggacacactgttcctgagtacaagcctaaagaatcgctggcattctacacccactggctgtttggagaaaagatctaaaattgatctaaatgaaacaatcaaattttgtagacatgcatcttatttttttttcctagctgtttttattgtagattttgataaagactgtacctgtacctgtacctgttttcagtgtgaaacacaataaacaanccaagg

SEQ ID NO: 32798 - DNA, 1302 bp, Triticum aestivum
  unsure (1)..(1302): unsure at all n locations
  Clone ID: PAT_TA_32798
agagaggcctcaggcgctgctctccactctcagctctcagtatttacatttcactacattatgtacagtcacccaacagttgctaggcgcccaattttgcccgcacgcaccaacagcacgatcctatctcatccttgcacctcccggcagaagccatctccattctgccgccaccactgccacccccaccaccacgacccccctttcctttgcgtggactggcacacttcctgcagatgaatttttcagggacttcttcaaaatcactgattcctgagcatcttgtgtgctgccacactccacacgcatcacacgccatcatcctctcaccgtcatcgtccttggcaccacaggtgcagtccaccgtccagttctccaagcccctctccatcctgaactgcacaattctcctgtgatccccagtgcaccgtcctctcaccctaacaagctggcttgggccaagcacgtgcttcacaggggttgtgtcacttaagtttgggaattcagggagctgttcagcctggaagctatggaacatgaggtacgtttcttgaaagacccttgcggccagcattttcagttcacccagggtagcggttgctggtaaaagtacaagttccaccggaggtgcagtgtagtcctttgggtgatcaagcagttcaatggagcacctcacagcaagcaggattgggttcgggggagattctggagcactctcatcgtagtgtttgatgaactgcttgcagtcaagtatgccttgcagctgcattgtgtgctgatgcacccaccacctctggttgcgaagacagcattctttctgggttcagcagagcatcatagaggaagcgaagatcatgtgcaagatgctctacagagggtccaaacacagttgcatcaactggggactgattggaatatgtttccagcctgttttggcatgaaataagggtcaaagacaaggcctgatgaagttctgcaaattggagcaacatactggagacaaagtttaacctgtattcaattgcgcttgtctcagtattgcagcggacagcaatgaaatggccatcgtccatcagtttcccccgcagacctcgaagagagtaatccancagctcctgtgaatcaacagcctttgatgcagctcccctgagtgcacgccaggacacccagcgttcancttggacagcccggaggacctttaacattgcgcttntctcngncgatatcttcatttgtcacatgcaaaacacgtttgaatcaacttnttcatgcccattcatnggtggttttgacaattttaac

SEQ ID NO: 32799 - DNA, 946 bp, Triticum aestivum
  Clone ID: PAT_TA_32799
gccgcgcgaaatcaatgtaacattgagttgattgatcagactacatagcaccacagttttctcactcaaaaaagaaacaacacatatttttttcccatgtgcatagtgtacacaaaaataatatggaagattattggcaaatattcaacattccatgatcccacgcgaacaattcctacaaagaaatatgatggaatgtggacggcaaacagagcataaatgtgggacgcgtttacgaaactatccagggctccagggcgagcagataaatctcatacaagcacaaggcggcattgcgcggcggccaagaaggcttagaagcgcgaggcctatggacgattagcggagacaaccacgacatatgtatcatcatcctactccttgtacttcatgctctcgagcgagaacccgggcatgtcaaaggagagggcaaacttctcgacctcgaccttgaggttctcgatgtccttgttgttcaccaggcccttggagaagtccttgagcagcttgccgtgctccttctggatgttcaggcagatggtcacagcctggtggaggaactcggcgatctgctcgaagtccttctcgaccagacccctggaagtcatcgcgggagcaccaatgcggacaccacctggggacaatgcactgctgtcaccgaagacagcattcttgttcaatgtaatgctgcaaaggtcacacatcttttcgaccttgtttccagtcaagccaagagggcggagatcccatagaacaagatggttgtcagttccatcggtcaccatcttgtaacccttgctcatgagatattttccaacggcaacagcgttggccttgacctgctttgcgtaggccttgaatccaggagtcaaagtttgcttcagggcaactgcaagggcagcaatctggtggttgtgaggaccacctggagcgatgggaacaccga

SEQ ID NO: 32800 - DNA, 937 bp, Triticum aestivum
  Clone ID: PAT_TA_32800
tgatggacaggattgctgggtcagcacctggtaatggttcgagaactgctgttggtgaagatttagttgctatgacaaagtgccggttacaagccaggaatttcataacaaatgatggaagtggtgcatcgaagaaaatgaagcgtgatataagtgccatgcctcttaacgtgtcatcagctggaagtgtcgacgatagcttcaagcaaacatttagtgtagatacccctgatctacagtcaaccgcaacctcgcgtgccaagcggcgaaaaattgaggtaaatcatgctctcttggaggagatcgaggagataaaccaagggctcatagatacgacgctccgtgtatgcgaggatgatgatgagtcactcgctgtcacatctgaagggacagtcatcaaatgcacatatactgctgtggctgttagtccgagcttgaagtccatgttggcgtctgcacagacgagtccgattatgccgctgaggttgcttgtccctgctggctaccctaaatgctccccggtgctcctcgacaagtttctggacgaacaaagaaactcggacgacctgtctagcaaagcgaagtcaaaatttggcgtattgctgcggggcctagatgagcccatgtcactgcgagaaatcgcaaggacgtgggatgcttgcgcgcgcggagccattgcggagtatgcccagaagagtggtggaggaagcttcagttcgagttatggtcgctgggagacctgtgtagtgtaggtgtttgatctgtctcttatggtttgtccttgagttatgtaaattatatatgtcccggctgtagacatgaacatgctcagatggcaactttcaccaaaataaaaaaaatgatgacctgatcaaaataaataaacgttgtatgaacgaaactttggttagatgttcttatagactgatgcttatgg

SEQ ID NO: 32801 - DNA, 663 bp, Triticum aestivum
  Clone ID: PAT_TA_32801
cacatcccctcacgagccagtcccgcgctccgcgtgggcgcgcgcgtctacgcgccagcgcgcggtggcggaggtctacggcggcgtgcggtggcggctacggcggccagggcggcggcggctacggccagggcggcggtggcggctacggccagggcggtggtggctacggcggccagcgtggtggcggcagctacggcggcggcggcggcggctacggcggcggcggtggcggctacggcggccagcgcggcggcgactccggcggccagtggaggaactgagcggcggggccctccagttatcgatctatctaccatctcgtcgtcttcgtcagcaagttatcttcagtgtcgtcgtcgtcgtgttcctgtgtcagtcagtcttgagtcgtgtgtgtcgttcggtcctgtggtgtttttgatcgcgagctcgagtgtcgctctgtccggggttaattagagctggttacgcgaggaagaaacaacatgtgttatctttcggtcggtcggtcggtcgtgttcgtcggtgatgcagcaatcccttctgtcatggattgggatgtgatgttggaatcctatgtttgaactcagtttaaatggatgaagaaaatgcaagtgatagctgcgaaataaaaaaaaaaaaaagtcgacgcggccgcga

SEQ ID NO: 32802 - DNA, 882 bp, Triticum aestivum
  Clone ID: PAT_TA_32802
ttttttttttttttttttttttttttcggcgcaaaaacacattttatttatgtcaggattttctgtccatttacaaacccatatgtctgtcatcttcacatttgtcaggaaaacgaagggatcaaccgtttccggcatctcagagaaaagaaaactgaaccaaggggggtctctctctcctcgtcctagtagcaagacatcggcttcttcttctttttctgggccttggcaattgtcttcctgtcaacgtaagcaagtagttcctcttgcctgatgagagcctcgtgcagagccttctttgttacgatgagctcggcttctagtgcatccacgcggcggacagcggcattaagcagctcttctttctcgcaaggcatttcagaaggtttttcttcaagcgcatgaaccttcgcttcaagctctgccagcctttgcaagactagcgagaacaggtcagattcagcaaacccaggacctggtgacgggggccggaactcctcttttggaatgcagtcttgatatactgcagaactttgttcgtctgactcatttttatctgccaatctcttcgtggcaacatctttaactgaccgaagcagcgttacaatagcaatcacaaaagccatcagagctggaataatctgatccaaagacctgttggatgcctttgtggcggtagccaaagaagagtctacattcaagaaatagcaaaaatatcaggttttgtcagtatcagaaaacatccttcaaatcctgcaataaagtgacaaacaaatacctttgggcgggacaggcaccttccaaggcagttctctcttccatgttgcatccactgctttgtcaacaacaggaacatcatattcaggcatacgggtagaaaag

SEQ ID NO: 32803 - DNA, 813 bp, Triticum aestivum
  Clone ID: PAT_TA_32803
ccgaggtggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgcaagaaggacaagctgcgttatcggtacccacgtggggagtcttaccttgatgtgattcagaggttggagcctgttatcatcgagctcgaacgccagcgagcaccagtggtcgttatatcccaccaggccgtattacgagcgctgtactcgtattttgcggacaggcctttgagggaagttccagacatggagatgccactccataccataatcgagatacaaatgggcgtcaccggcgtcgaggagaagaggtacaagctcatggattgagaatctgagatgcaggtaggctcagcacaacagcaagttccggattgtctgttccagatacaaccatacagacagtatatacatacagttaactcaatacagtaaccagctattcatctctcctctccggacggcgtggaagtaagactaacccccccggtgtaaaatattcgaccaaaaacacctattggtcactgtaaaagaaaacatatagtaccgctaataagtaactgtaaaaagatactgtaccagaagatgtaactgctggtaatgataagaaaaatgcaggttcatcttgaaaaaaaaaaaaaaaaaactcgagactagtctctctctctctacctgcccgggcggccgctcgaaatcactagtgaattc

SEQ ID NO: 32804 - DNA, 845 bp, Triticum aestivum
  Clone ID: PAT_TA_32804
ttaagaacgaaaagggggtactcgattctcctttggaagacaaatcacagcctccaaaagcgcaaaatggtcaagcgaaactttaggaaggaattgtacagacaagtagcttaacaacactggtgagactgaacgtgcaaactacacgagcacggggatacaacgatattagtatcaggcgactatccacaaattcatctagagtgttaatcatgtcgcctgtaggaaataaagcatcctctttaaaagtttgctgcctcatttgtagaagtcaaagtctgactcaggcttcttgacgttggttcggtaacccttctcgaagtccttggggaggataacataccgatttttgcggacagcatgcatgccagcttcctggcaaatagcagtgatatcagcagcactgattttatcaggtctggagacataatcttccaaatcaacctcgtcactcaagttcatcttagcagtacaaacttggaaaacaagcctcttctgcctccggtccggcagggggaactcgattttcctgtccagtcttcctggacgcaacagagcaggatctagagtatctgcccgattggttgccattataaccttcacattcactgtttgatcaaatccatccatctgattcagtagctccatcagaatacgctgaacttctcggtcagccccggtctgagcatcgaatcgagcagtggctatagcatcaacctcatcaatgaatattatagccggggcattctctttagctaagcggaatacatctcgaaccatccttgggccctcacccaagtacttctgcacaaactctgaaccaaccactctgataaaagcagcac

SEQ ID NO: 32805 - DNA, 1299 bp, Triticum aestivum
  Clone ID: PAT_TA_32805
ctagtctcgagttttttttttttttttttaaaacagctaacttgacttcctttttctaggtccaaataaaacggattccatgacaaactgcgaactctcactacagatccatttctgctgtcgtttggttgtacatataaaaataaatccatgctcccattacatttcacccagtaacaaaactgaaacgcggaaaaatctatcctatcacatagcgtcgagcccatcattctgcgggggggtcgtttcgcagagctggtgcattttgccgccccttcccaaatttgttcgccactgcgggttccgacagcgtgttccagaccttcagtttgcctttcgatcctccacacgctaacaggaaggggttgtcgatcgaaaacgacaccgagaatatagctccaagcttaggattcagcgacgagacgcacgaaagctggtttgttcgataggatcccagagcctcaaccattttgtccagttgacccagtcggcaagaagttaggggtagaaggtgcggaaagatatggaagaaacggccttttcgtgtgcatgcagagtaaaaatcggctgtccaggatttgaatttgatgaagctgtccgaatatcaaatgcttgaaccatcccattttcaagactaaccacaaaggagtgttcattgtgtggatcacaaactaagctctctacatctgcttcgacaggccatttatgacaacattgtccactgtctttcatatctgtcatggcaattgttctatcaaaagatccactgagaagaacttcaggtgacctccaggcaactgattgaaccttgtcatcatgatgttgcagtgtgactaaacatttaccagcacttaagtcccaaactttcacagttttgtctgcacttgcactagctagagcattcctcaccaccgtgttccacgcaagaccaagcacagaacttctatggctacccttcttatatgtttttccctttttccccttaactttcttcttcttttttgaaactcctcctagcacataatgtggttcgacctcgtcgacgacatccaagttccatatttcaattgtaggatccatggtgccaacagctatgaaatttcctttctgttcgccatcctgacggttaaaatccatccaagccgtgcagagtggaaaatcagagagagggacctcatggtgcacaaacatattaggatccccatcctccagttcttccactatactgacctggagagaattgaattcatccttgttatgagcgcaaacaatcactatatcagtagatttgatagtcat

SEQ ID NO: 32806 - DNA, 723 bp, Triticum aestivum
  Clone ID: PAT_TA_32806
ttttttttttttcaaaatttcactgtcatattgaatctttattcatttccttgcgccaacactagtttcaacgaccacgtgacacatgtggtaagcaatccaaacaattcaaaaacactagtttcaacgactttaaccaaaaaaagtggaggaactttttgtacacccttccggactgccaccagaagagggccacacatgcatgatttcactgaatttacaggaacatatctcatgagaacaacatcacaccacccaactcaggtggaagcacgttttgcgaggaaaaaaataaaatcccaaagttgtcccacagtagaggagttaatgaccaaaattgtatccatcttattttccttgtgaaaaatgtgaccatagatgatcttgggagaaaaaaatatgaacagttaatttgttcagaagcctcctcatttcgagctgaacttgccacgcactgtctcgtaggctggtacattgataactgcacaacacagggggctgaattagaaacagtgcattcatacacattacgttatagatgactcgctcaccgtttccatgagatgccattgtcaatggtgacgagatgatcttctcagcaacacttgatacatctgccagtgttataccatcaacagccttaagaagctgctccacgggtttcctttcaccaaatgccaatgcttggcgccccatgtcttcagttgttgatgcctttgattc

SEQ ID NO: 32807 - DNA, 651 bp, Triticum aestivum
  Clone ID: PAT_TA_32807
gcacgaggcaccgcacacacgagacaagacaagaagcagagaccctacgcacgcacgcacgcacgcagacgcgaggatggcacgcaccggcgccacgaccacgacggcagctgctgcggcgctgctcctgctggcgctggtggccaccggcgccgccgcggtcgacgcggccgctggcggccatgagatgactgctgccggcggtcgccgcggcgtccgggcccagccggcggggctgacgcagtgcatgggcgggtgcgggacgaaggtcgcatcgtgcctccttgactgctacaacacggccaccggaggggaccatgcccatctgctacctcggatgcaccaaccacgccgtcttctgcgccaaccgactgcaccaacccaggggctctgattcccaatcaatccatccggctagcgatgaactatacatggcctcgaaatgtatgacatcatatggagtatcaacgcatacgcaccgcatgtataatccgttcaccgcgcacattccaccccggaccctctcacgtatgaataagatcggttgtaagtacttcgtttcagtcgacctgtgcgactagacacgagcctgtatgctgaagtggtgaatatacacagcttgctactatatatatgcttaaaaaaaaaaaa

SEQ ID NO: 32808 - DNA, 1041 bp, Triticum aestivum
  Clone ID: PAT_TA_32808
gaaaaatgcgtgaggtagtcgagctccccatgcttcacccggaaaatttgtgaagcttggtatcgatcctcctaaaggtgttctttgctacggccctcctggcactggcaagactcttcttgctagagctgttgccaatcgcacggatgcttgttttatccgtgtgattggaagtgaattggtccaaaagtatgttggtgagggtgctaggatggttagggagttatttcagatggcccgctcgaaaaaagcatgcatcatattttttgatgaagttgacgccattggtggcgctcgctttgatgatggagctgggggtgataatgaggtacagcgtactatgcttgaaatcgtcaatcagcttgacggttttgatgctaggggcaatatcaaggttctcatggccaccaacaggcctgatacacttgatcctgcacttctgcgtcctggtcgtttggacagaaaggtggaatttgggctacctgacttggaaggccgtacccagatattcaaaatacatacgcgcaccatgaactgtgagcgtgatatacgcttcgagctactggcgcgactctgccccaacgccactggcgccgacatcaggagtgtctgcacagaagctggcatgtacgccatccgcgcccgcaggaagactgtgactgagaaggatttcctcgactcggtcaacaaggtcatcaaggggtaccagaaattcagcgcaaccccgaaatacatggtgtacaattgagcaagcaggcttccttttgtttctgtgcatgtttgcatccatgccgtagcagtagtgctttggttttcacatcctttctgtgtgcccgtgatggttgtaagcagcacggtggtgtttcggttcatgtatgtcactgtaatctggtaaacccagtgaaatcactctagcttttcttaaagcttcgttgaaacacagttttcagcttgtccgctaatcagaattaattgcatgcattttatttggagataagtctctcttgttagaactttgtatgtacctgcctgggcggccgc

SEQ ID NO: 32809 - DNA, 781 bp, Triticum aestivum
  Clone ID: PAT_TA_32809
gcggacgcgtgggcggacgcgtgggtgtacagtttataattttgaccggaactccaattgttggattcccaaagatacaatggcgtgctcttgatgagatcaattctggtgtatgtgatgggatgacgtatgaagagataaagaaaattatgcctgaggaatatgagtcacgtaagaaggacaagctgcgttatcggtacccgcgtggggagtcttaccttgacgtgattcagaggttggagcctgttatcatcgagctcgaacgccagcgagcaccagtagttgttatatcccaccaggctgtattgcgagcgttgtactcgtatttcgccgacaggcctttgagggaagttccagacatggagatgccactccataccataatcgagatacaaatgggcgtcaccggcgtcgaggagaagaggtacaagctcatggactgagaatctgagatacaggtaggctcagcacaacagcaagctccggactggctgctccagatacaaccatacagacagtatatacatacagttaactcaatacagtaaccagctattcatctctcctctccggacggcgtgaaagtaaaactaaccccctccggtgtaaaatattcgaccgaaaacacctactggtcattgtaaaaaaacatatagtactagtaccgctaataaggaactgtaaaaagatactgtaccagaagatgtaactgctggtaatgataagaaaaatgcagattcatctgggaagtaacaagtcaaaaaaaaaaaaaaaaaaactc

SEQ ID NO: 32810 - DNA, 1559 bp, Triticum aestivum
  Clone ID: PAT_TA_32810
cgtccgaggaactgcagtgaaacctggaatttatcaacagcacttgggccaacgcagtaactactatcatccgcagttgaaacagggtggtgctttcccaatttcgtcaccacaaaacctccaacaatcatctccacaaatttcacaccattctcctcaggttgatcagcacaacctgttgccatctcaagtcaagactgggacaccattgaattcagctaactcaccatatgttccatcgccatccccatctgtcgccccctctcctataccagtggattcagacaaacaacactccaatatatcatcacttactaatactgggcagactggacatcagcaaacctccctagcgccccagacacaatcgattgctgtgaatacaccagggatatcagcatcacccttactagcagaatttacaagtggggatggaagtcaggctaacatgccaactcaagttccaaccaaatcaaatgcagcagaaaggcctatggaccgcttacttaatgcattgcgaacaacacagcgcgagtctcttaatgccgcagttggcgacattcgatctgttgtaagcatgatggacaggattgctgggtcagcacccggtaatggttcgagaactgctgttggtgaagatttagttgctatgacaaagtgccggctacaagccaggaatttcataacaaatgatggaagtggtgcatcgaagaaaatgaagcgtgatataagtgccatgcctctcaacgtgtcatcagctggaagtgtcgacgatagcttcaagcaaacatttggtgtagatacccctgatctacagtcaaccgcaacctcgcgtgccaagcggcgaaaaactgaggtaaatcatgctctcttggaggagattgaggagataaaccaagggctcatagacacggagctccgtgtatgtgaggatgatgatgagtcactcgctgccacttctgaagggacagtcatcaaatgcacatatactgctgtggctgttagtccgagcttgaagtccatgttggcgtctgcacagacgagtccgattatgccgttgaggttgcttgtccctgctggctaccctaaatgctccccggtgctcctcgacaagtttctggacgaacaaagaaactcggatgacctgtcgagcaaagcgaagtcgaagtttggcgtattgctgcggggcctagacgagcccatgtcgctgcgagaaatcgcaaggacgtgggatgcttgtgcgcgcggagccattgcggagtatgcccagaagagtggtggaggaagcttcagttctagttatggtcgctgggagacctgtgtagtgtaggtgcttgatccgtctcttatggtttgttctggagttatgtaaattatatatgtcccgtcccgactggagacatgaagatgctcagacggcaactttccccaaaataaaaaaattgatgacctgatcaaaataaataaacgttgtatgaacgaaactttggttagatgttcttacagactgatgcttatggaagattcccattgttgaatttgaggctaaaaaaaaaaaa

SEQ ID NO: 32811 - DNA, 777 bp, Triticum aestivum
  Clone ID: PAT_TA_32811
tttttttcgacccaagcgcgcaatggtcacgcgaaacttagacagacaagtagcttacaacattcgtgagatcgaacatgcacgccctttatacttttccaactagaaacacaaaataagatagttgaatctgatcaaatagattgggcatgcaggatacaaggatattaacgtcacatagaggctgactatccacaaattcatctctaacacttcgttgcctcacttgtagaagtcaaaatctgtatcaggcttcttcacgttggttcggtaacccttctcgaagtccttggggagaataacataccgatttttccgaacagcatgcatgccagcttcctgacaaatagcggttatatctgccgcactgattttatccggtctggagacataatcttccaagtcaacctcgtcactcaaattcattttagaagtacaaacttggaaaacaagcctcttctgcctccggtctggcagagggaactcaattttcctgtccagtcttcctggacgcagaagagcaggatctagagtatctgcccgattggtcgccattataaccttcacattcactgtttgatcaaatccgtccatctgattgagcagctccatcaaaatacgctgaacttctcggtcagccccagtctgagcatcgaatcgggcagttgctatagcgtcaacctcatcaatgaatattatagccggggcattctctttagctaagcggaatacatctcgaaccatccttgggccctcacccaagacctgcccgggcgg

SEQ ID NO: 32812 - DNA, 887 bp, Triticum aestivum
  Clone ID: PAT_TA_32812
actttgctakggtcctccaggaactgaaagactcttcttgccagggcagtggccaatcggaccgatgcatgttttatccgcgtgataggcagtgagttggtccagdagtatgttggtgaaggggcaaggatggttcgtgagctcttccagatggctcggtcaaagaaggcatgcattgtcttctttgacgaggttgatgccattggtggtgctcgctttgacgacggtgctgggggtgacaatgaggtccagcgcaccatgctcgagattgtcaatcagctcgatgggtttgatgcgagaggaaacatcaaggtcctcatggccacaaacaggcctgatacgttggacccggcactgttgcgtcctgggcggctggacaggaaggttgagtttggcttgccagacctggagggccgcaccccagatcttcaagatccacacacgcgcgatgaactgtgagcgggacatccggtttgagctgcttgctcgcctctgccccaactccactggtgccgatatccggagtgtgtgcacagaggcgggaatgtacgccatccgtgcgcgcaggaagaccgtcacggagaaggacttccttgatgctgtcaacaaggtcatcaagggttaccaaaagtttagcgccaccccgaagtatatggtgtataattagatagcgcgacgttagctccctgtgtgtgtgtgccactcgggccctcttctacgggattgttgtttgttgctgccttctttccttgtccagtagaaacttttgaggcgttttctgcatcacatgttactgtggattgtaccttcagaatgttgaagtgtcaaactggaagtaaggatggtgatgatgatgatgccattttcttctcccgcatgaacgtttg

SEQ ID NO: 32813 - DNA, 612 bp, Triticum aestivum
  unsure (1)..(612): unsure at all n locations
  Clone ID: PAT_TA_32813
tcaccacccgcagcagcagcacaagcaggaagcggcagcggccgccgtcagcggcgagtcggccgtggcggcgtnccgagctgatccggcgcaacctggcggagcagatggccatgacgctgacgagggaccccagcttcaaggcggcgctcgtctccgcgctctccggccggatcctcgagctatcgccgaccagggacatcaattaatccccacatcggaagacaccgcgcggctcaaattttcttgcggtggtcgaccaccgtactttcctccggcattgctgccttcctgcctctgccgcctccgtcaaaacctcacagaaaaaccagcgggaaccggaccgcctgaccaacgacgaggacgcgaccggctccggcgagccgggaacggagccgccgccgccgctgctcgtgtaaatacatacatcgccaacacgagggcggcgagggaggtcgtaacatgtaggggctgtttggttcctagccatttgtcacatctaaccttaggcaagtttgatcaagttaggtaggtgtttggttctagccacacttgaggcaaggaattttttatgagcagtgaaccccaaatgtcatagacgcaaaaaaaaaa

SEQ ID NO: 32814 - DNA, 255 bp, Triticum aestivum
  Clone ID: PAT_TA_32814
gaattcactagtgattagcgtggtcgcggccgaggtgaactagtctcgagttttttttttttttttttttcgaccacaagcgcgcaatggtcacgcgaaacttagacagacaagtagcttacaacattcgtgagatcgaacatgcacgccctttatacttttccaactagaaacacaaaataagatagttgaatctgatcaaatagattgggcatgcaggacctgcccgggcggccgctcgaaatcgaattcccg

SEQ ID NO: 32815 - DNA, 526 bp, Triticum aestivum
  Clone ID: PAT_TA_32815
ggaatttcgcaaagtatataaagtacaaccctgaggatgtggagaaccaggtctcagatttctttgaagggaaaaaattgaatgcttgatcaaactgtctatgtttgaagggatgttcatatcaatgttggtggttacaaatccctggcaaaatttattcaggcagtgtgctagtaacctgccctaccatcatgcttgtggggttcgaagatggagaaatcaattttgactgctgctggagcagaaatattgtgaatgcaaggcaccctggctggaatactttgcgtgtcatctttgactctttttaaggggagtgctgacattggcgcttccacatgggatttaggacactgcggtgagctgtgtaactgtcattattacagtttacccttcttttgttgattattgactattgttggatggtcggtggttggcatcttatgtacaatttatacagcggttatgttcactttccccttgttgcaaaaaaacctcggccgcgaccacgctaatcattagtgaattc

SEQ ID NO: 32816 - DNA, 1550 bp, Triticum aestivum
  Clone ID: PAT_TA_32816
ggaaccaaccttttctccccccgaaaccagtaggtggaactttgaaggacgaacctcccgagccgcacgcgcgggcggctccggaggccccaaaccctagcgccagaaaccctcccttcccgagatcccccagccgtcgctgccgccggcgccggcggtagtggcggcgcccggccgtcaaaggcggcgggcatggcgagcgcgccccgacgggcctccctcgcgcgagggagcggcgtcagcgggcggcgtgggtggatttctccggtgcggtggtccacggcgaggggcgcagcggcggggcggagcacggccggatcttgcacaggaggcgcgggagggtgtttccgttcgggaggcgccggcgtaggagagtggtggcggcgcggttcggccatggtggtggcggcgcggctcggccatggtggaggcggcgctcgtcctggtgtgcggcggcagcgcggatcgtcttggaggaggcggcactcgtcctggtgtgcggcggcggcctcctggtggcggcgcccagccgtggtggttggtggcctcctggtggcatttctggatctggggtaggcccttggccgcgaccgctgtgttgctgccggatgctgcctggagtgggtgtgtttggctgctgcatgtggtgcggcggtccttggctgtgccgatagcggtggatgatctggagctgcgggatcttgctgtgcgggaggaggaagaagggctgcgtatcttcggctgtgcggggtgtcggtgttccgcgacattttcatcacattggcgaggtgctgcggtggtggcggagtgagtcaacatggacagcggcctcattcaggtgggcagggatggtggtgtgcgacgacacggatgaaaatcccgcccgtctttggtcggtgctagcggcgatggcgcctgtgggtgtcgttcccctccttggaggcgtcgcggaggtgtgtcggcatcccccctttcctacttgggtggttgtctccgggtgaaagcccagattcgttctcggatcggcgatggcggcgtctttgcggcgttactctgttgggagcatcgtgtggggagacatggctgggaggtttcatgttgcggttcttcggtgctcaccgctggtccaagtacatcttcttcggcgctatgtacgccgtcgatggagagtcaaagacgatggctttgtagggatcaatcgagtcccgccacccactcgccatctccttttaggcattcaaaggtggttggtgcgtcgacaagggagatccgggtttagctattgctcttcgaggtgaccgtcgtcggtagagacgcggcttagatgttttgtcgtcggtagagacgcggcttagatgtttttgcttagggcaggctccgtgcgttgtgttgtaacgtgtgcagggttaatcttcggatgtgcgttgtgttgtaacgtgtgcagggttaatcttcggattagtccggtgtgtgctacttttgttgttcgcaacaagaagtagagtcttgtaattgttttctgccttctataaaaatatgatacgccgtgg

SEQ ID NO: 32817 - DNA, 910 bp, Triticum aestivum
  Clone ID: PAT_TA_32817
ttttttttaatatggaagattattgcaaatactcaacattcaatgactccaagcgaacagttcctacaaagaaatatgatggaatgtggatggcaaacaaaacacatgaagcggggggcgttcatgaaactatccagggctccagggcgagcagacaaatctcgtacaagcacaaggcggcgtcgcgcggcggccaataaggcttagaagagcgaggcctatggatgattagcggagacaaccacaccatatgtatcatcatcctactccttgtacttcatgctctcgagcgagaagccaggcatgtcaaaggagagggcaaacttctcgacctcgaccttgaggttctcgatgtccttgttgttcaccaggcccttggagaagtccttgagcagcttgccgtgctccttctggatgttcaggcagatggtcacagcctggtggaggaactcagcgatctgctcaaagtccttctcgaccagacccctggaagtcatcgccggagcaccaatgcggacaccacccggggacaatgcactgctgtcaccgaagacggcattcttgttcaatgtaatgctacaaaggtcacacatcttttcaaccttgtttccagtcaagccaagagggcggagatcccatagaacaagatggttggtcagttccatcagtcaccatcttgtaacccttgctcatgagatattttccaacggcaacagcgttggccttgacctgctttgcgtaggccttgaatccaggagtcaaagtttgcttcagggcaactgcaagggcagcaatctggtggttgtgcggaccgccctggagcgatgggaacaccgcaaagttgatcttgtcctcatagtcatacacagcaccctcaggctggccctaagcctgcgaagaagcctcgtgc

SEQ ID NO: 32818 - DNA, 1439 bp, Triticum aestivum
  Clone ID: PAT_TA_32818
tctgcagattttttccgccctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtgcgcctgaaaattcagcaaagccctgattatgctgaccagccagattatgaagctggattgcaggacttccttgaacgtttgacaaattatgaaaaggtctacgagccagtgcaggaaggctcatatatcaaaatgattgatatggtaaaaggggagggtggccagttacaggtgaacaatatcagtggctatctccctgggcgtattgtctttttcttggtgaattctcatcttgctcctcggcctattttgcttaccaggcatggtgagagtttacacaatgttagaggaagagttggtggtgacacggtgctaagtgaagacggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgtaagaaggacaagctgcgttatcggtacccgcgtggggagtcttaccttgacgtgattcagaggttggagcctgttatcatcgagctcgaacgccagcgagcaccagtggtcgttatatcccaccaggtaaattgctaccgttgatgaaactctcttgtgcagaagcgctgatcttaaaatgtctgtcttatttataggccgtattgcgagcgctgtactcgtattttgccgacaggcctttgagggaagttccagacatggagatgccactccataccataatcgagatacaaatgggcgtcaccggtgtcgaggagaagaggtacaagctcatggattgagaatctgagatacaggtaggctcagcacaacagcaagttccggactggctgctccagatacaaccatacagacagtatatacatacagttaactcaatacagtaaccagctattcatctctcctctccggacggcgtgaaagtaaaactaacccctccggtgtaaaatattcgaccgaaaacacctactggtcattgtaaaaaaacatatagtactagtaccgctaataaggaactgtaaaaagatactgtaccagaagatgtaactgctggtaatgataagaaaaatgcagattcatctggg

SEQ ID NO: 32819 - DNA, 880 bp, Triticum aestivum
  Clone ID: PAT_TA_32819
actcttcactcggaaatagttctccatcccaagcttctcttctcccttctcttctcctctcgcgcgcgttgcctcgaaccggaaggaacagcgtccattccattacagtagagcttggtgtttgagagacgatcaatccgtcgtcgaccaatggatccatgggtcagcagccagccttcgctgagccttgacctgcacgtcggcctcccgccgatggggcacccgcacagccaccaccaggcggcgccgatggtcgcgctggccaagcccaagatcctcgtcgaggagaacttcatgcagctcaagaaggaccctgaggttgcggttcttgagtcggagctacagcgggtcagcgaggagaaccggcggctgggcgagatgctcagggaggtggcctccaagtacgagaccctgcagggccagttcaccgacatggtcacggccggcgcccacgccggcggcaataaccactacaacaaccagccgtcctccgcgtcggagggcgggtcggtgtcgccgtcgaggaagcgcaagagcgaggagagcaacggcacgccaccgccgtcgcaccagcagcagcagcagcactacgccggcggcctcgcgtacgcggcggcgccggaccaggcggagtgcacgtccggcgagccgtgcaagcgcatccgggaggagtgcaaacccgtcatctccaagcgctacgtccacgccgacccgccgactaagctgtggtgagggagggtcaatgggcaagacggcagatgtgaccaggcaccctgcccaagctacttcgagctctctccccggtgcccgcaaaaaagtcaagactgcgagaaagacttcttctagacttcagggaagctacacagcagcccgtttgatg

SEQ ID NO: 32820 - DNA, 814 bp, Triticum aestivum
  Clone ID: PAT_TA_32820
ttttttttttttttttttttgaacgtgcacgccctttatacttttccaactagaaacacaaaataaaacagtagttgaatctgatcaaatagattgggggcatgcaggatacaaggatattaacgtcgcatagaggctgactatccacaaattcatctctaacacttcgttgcctcacttgtagaagtcaaaatctgtatcaggcttcttgacgttggttcggtaacccttctcgaagtccttggggagaataacataccgatttttccgaacagcatgcatgccagcttcctgacaaatagcggttatatctgcagcgctgattttatccggtcttgagacataatcttccaaatcaacctcgtcactcaaattcattttagaagtacaaacttggaaaacaagcctcttctgcctccggtctggcagagggaactcaattttcctgtccagtcttcctggacgcagaagagcaggatctagagtatctgcccgattggtcgccattataaccttcacattcaccgtctgatcaaatccgtccatctgattgagcagctccatcaaaatacgctgaacttctcggtcagccccagtctgagcatcgaatcgggcagttgctatagcgtcaacctcatcaatgaatattatagccggcgcattttctttagctaagcggaatacatctcgaaccatccttgggccctcacccaagtacttctgcacgaactctgaaccaaccactctgataaaagcagcagtagtgtgatgtgccacagctttagcaagcatggtcttgcggacgcgtgggtcg

SEQ ID NO: 32821 - DNA, 623 bp, Triticum aestivum
  unsure (1)..(623): unsure at all n locations
  Clone ID: PAT_TA_32821
gcaccaaccagcgcccagccgccgccggagaaggagacggagcagccccagccatgggtcgcgtccgcaccaagaccgtgaagaagacctcccgccaggtcatcgagaagtactactctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttccgtgccggagaagtcggcgctcgaggtcgacgagatccgcgtcgacaaggagaccatggacatgctggcgttcctccggcatggccgacctccccgggcgttgagcgcgcccccgagggcaactttggcgctgccccctacgccagccttcaacggacccgcggtggcaatcgcgcctaggtctcgnatctcgtcgtcgtaccctatatcttaatgtttatataatcgtactggggaatattttgaatagnctaantcaggattgtcgctanggantatngntaccacgtactatgtcaattangtaaaaaaaaaaaa

SEQ ID NO: 32822 - DNA, 1245 bp, Triticum aestivum
  Clone ID: PAT_TA_32822
tgtcatcatggactggtattccagtggagaaagtctcgactgacgaatctgataaacttcttaagatggaagagacattgcataagcgtgtcatcggccaagacgaggctgtgaaagcaataagtcggtctgttcgccgtgctcgtgtgggcctcaagagccccaacagaccaattgcgagcttcatttttgcaggtcccactggtgttgggaaatcagagcttgcaaagactctggcatcatattacttcggctctgaagaagccatgatccggctggatatgagtgagttcatggagaggcacactgtgtccaagttgatcggttcaccaccaggctatgtgggatacactgaaggtgggcagctgacggaggcggttcgacggcggccatacagcgttgtgctttttgatgagattgagaaggcacatccggatgtgttcaacatgatgctccagatcctggaagacggaaggttaaccgacagcaaggggagaacagtggacttcaagaacacgctcctgataatgacatcaaatgttgggagcagcgtgattgagaagggggggaggaagatcgggttcgacctcgactcggacgagaaggacagcagctatggcaggatcaagagcttggtgatcgaggagatgaagcagtacttccgaccagagtttctcaaccgtctggacgagatgatcgtcttcagacagctgaccaagctggaagtcaaagagatcgcggacataatgctgcaggaggttttcaccaggctcaagaccaaggacatcaacctgcaggtgacggagaagttcaaggagcgggtcgtggacgaagggtacaaccctagctacggagcgcggccgctgaggagggccatcatgaggctcctggaggacagcctcgcggagaagattttgggcggggaggtcaaggagggcgactctgtcatcgttgatgtggacccggaggggaaagtcattgtgctgaatggcgagagcggactgccggagcttccaaccccgggcggtcgctgtttagttgttggtactgtatagaatacgtagaagattgttaagcatatatatacaatacagcgttttcatttccttccagcacatatctcttcataggtgcggcagtcaggtcaggtgtatataattctataactgtatgtataaaatatacagtaatatgcatatataatttaaggggaatggaaaccttgttggccaaaaaaaaaaaaaa

SEQ ID NO: 32823 - DNA, 846 bp, Triticum aestivum
  Clone ID: PAT_TA_32823
tgcacgaggcccggtctgatcaccatgtcgacggagaagaagcagttgaacacgatgcgggagatcaaggtgcagaagctcgtgctcaacatctccgtcggcgagagcggcgatcgcctcactcgagctgccagggtgttggagcagctgagcgggcagtcgccagttttctccaaggcgaggtacactgtcaggtctttcggcattcggcgtaatgagaagattgcctgctacgtgacaatcaggggtgagaaggcaatgcagcttctcgagagtgggctgaaggtgaaggagtacgagctcctgaggaggaacttcagtgacactggttgctttgggtttggtattcaggagcacattgatcttggcatgaagtaagataacctttcctgtactctgttctgcttgcattttatatatccgaattatgtatatacttaggactgtaaatttggttcactggataacttgattgtgagattggtttgcaacataaagtttcttgtgacatacatgcattactgactgtggatgccggttctataaaagtttcttgtgtgacatacacacattgtgcaagtatcacagtggaatcctgatgtccatgttgtcataatcttaacgcaaaatggtggaacttttatcatcacaagtattttgtaatgcactgtctttaaaagtttgcaatacataataattataaatactttagtatgcattgctattgctgcctacgtttttgtttatcattgcaagtcactttagtaagtgttgccccagtctgaaattatttttctgtgatggatatgaagcactggtcctgatgtgttggacaatgtgtttctc

SEQ ID NO: 32824 - DNA, 882 bp, Triticum aestivum
  Clone ID: PAT_TA_32824
cggaggcggttcgacggcggccatacagcgttgtgctttttgatgagattgagaaggcgcatccggatgtgttcaacatgatgctccagatcctggaagacggaaggttaactgacagcaaggggagaacagtggacttcaagaacacgctcctgataatgacatcaaatgttgggagcagcgtgattgagaagggggggaggaagatcgggttcgacctcgactccgacgagaaggacagcagctatggcaggatcaagagcttggtgatcgaggagatgaagcagtacttccgaccggagtttctcaaccgtctggacgagatgatcgtcttcagacagctgaccaagctggaagtcaaagagatcgcggacataatgctgcaggaggttttcgccaggctcaagaccaaggacatcaacctgcaggtgacggagaagttcaaggagcgggtcgtggacgaagggtacaaccctagctacggagcgcggccgctgaggagggccatcatgaggctcctggaggacagcctcgcggagaagattttggggggggaggtcaagggagggcgactctgtcatccgttgatgtggacccgggaggggaaagtcattgtgctgaatgggcaaaacgggcctgccggaacttccagcccccggcggtccgctgtatagttgttggtatagatatatactcgtagattgttaagcatatatacaatacagcgttttcatttccttccagcacatatctcttcataggtgcagcagtcaggtcaggtgtatatatttgtataactgtatgtataaaatatacagtaatatgcatatataatttaaggggaaaggaaacattgctggctttggctctaaaaaaaaaaaa

SEQ ID NO: 32825 - DNA, 1041 bp, Triticum aestivum
  Clone ID: PAT_TA_32825
ttttttttttctaaaatttcacgtcatattgaatctttattcatttctgtgccccgacactggtttcatcgactttaacccaaaaagtggaggaacattttgtacacccttccggactgccactgaaagagggccacccatatatgatttcactgaatttacaggaacatatctcttgagaacatcacaccaacaaattcaggtggatacatgttttgcaggaaaaaaaaataagatcccaaagttatcccacagtagaggagttaataaccaaaattgtatgcatcttatttttcttgtgaaaaatgtgaccaggtcttggagaaaaataaatatgaacagttaacttgttcagaagcctcctcatttcgagctgaacttgccacgcactgtctcgtaggctggtacattgagaacatttccatgagatgccattgtcaatggtgacgagatgatcttctcagcaacagttgatacatctgccagagttatagcatcaacagccttaagaagctgctccacaggtttcctttcaccaaatgccaatgcttggcgccccatgtcttcagttgttgatgcctttgattccaggttcttcaagatagctgattttgcaaatgctttagcacgttccagttgggtttggtcaacttgaccaggagtagcaagggaagtgagttctctggctgccaagtcaataactttaggaacaaatgctgcttcagtcgatgtatgaattccaaaaatgccagtgttactgtgaacatttttgaaagcggagatcgatttgatttggtcaaattcatttacgaggggatttagacgtgaatgcaagccttttccaggtctttccccaggtaaacacgccaccaccacccagaagtgcctgaagaacagatgcagtagcaaattctttttctttcagccatccacctgggagctcaaatgccaaagcaagatctgtgttcgatgaatctgctgcccgtctatattctccaccaacatagacagattttggctttcctgttccagttgcagtgg

SEQ ID NO: 32826 - DNA, 748 bp, Triticum aestivum
  unsure (1)..(748): unsure at all n locations
  Clone ID: PAT_TA_32826
agcgtggtcgcggccgaggtctccccccccgccgccgctccccagatcccgccgccatgtcgacggagaagaagcagctgaaccccatgcgggatatcaaggtgcagaagctcgtcctcaacatctccgtcggtgagagcggagatcgcctcacccgcgcctccaaggtgctggagcagctgagcggacagtcaccagtgttctccaaggctaggtacactgtcaggtcgttcggtatcaggcgtaatgagaagattgcgtgctacgtgactatcaggggtgagaaggcgatgcagctgctggagagtggcctgaaggtgaaggagtacgagctgcctcaagaggaacttcagcgacaccgggctgctttgggcttcggtatccaagaagcacatccgatctcggcatgaaagttatgattcatctaaccggcatcctacggtatgggacttctttgtggtgctcgagcgtgctgggtaccgcgtctcccgcccgccgcaagtgcaaggccgcgtcggtatcaacaaaaggtcacaaggaggacgcatgaagtggtccaagtcaagtacaaggtgtcatcctcaacaatccatcaactaagaagntgtactctgtagacctgagttattagtcactgttcngtagttgttncnnaacaaaccttgcantttgctgaccagcngtaatcggttnttgacttccaaaggcaaangttnacccttanaaanttgnttttaaaaaaaaaaaa

SEQ ID NO: 32827 - DNA, 1088 bp, Triticum aestivum
  unsure (1)..(1088): unsure at all n locations
  Clone ID: PAT_TA_32827
ttcacattcactgccaatggctgggtgcaatcttatggatccaggtgcgtcaagccaccgattatctatggtgacgtgagccgccccanccccatgactgtgttctggtccaagatggcacagagcatgactgctcgcccaatgaagggaatgttgacaggccctgtcacaatccttaactggtcttttgtcagaaatgaccaaccgaggtttgagacttgctaccagattgctcttgcaatcaagaaggaggtcgaggaccttgaggctggtggtattcaggttatccaaatcgatgaggctgctttgagagagggtctgccactccgcaagtcggagcacgctttctacttggactgggccgtgcactccttcaggatcaccaactgcggtgtccaggacaccacccagatccacacccacatgtgctactccaacttcaacgacatcatccagtccatcatcaacatggacgccgatgtgatcaccatcgagaactcgcggtccgacgagaagcttctctccgtcttccgcgagggcgtggtgtacggcgccggcattggcccgggcgtgtacgacatccactcccccaggatcccgtccaaggaggagatcgccgaccgtgtcaacaagatgctcgcggtgctcgacaccaacatcctgtgggtgaaccccgactgcggtctcaagacccgcaagtacgccgaggtcaagcccgccctcaccaacatggtcgaggccgccaagcagatccgcgccgagctcgccaaggcgcagtaagccgtatagcagctcccccattttaattgcaaggaggatgtcgccaccatagccgtgtttactttgaataatctgggtctctgtatccacctgttggttaggctagtttgtttctcggcgcggcgcggcgcggcgtcatgtgctcatccctttgatttggtggtttttgaggcggttgtcggtgtgtattgtaaactgagtggcgaattgttcatcatctaagtcttgagtttgttacgttacgttttcaaattacaaaatttctccggaaaaaaaaaaaaaaaaaaaactcgagactagttctctcc

SEQ ID NO: 32828 - DNA, 1595 bp, Triticum aestivum
  Clone ID: PAT_TA_32828
cgaacccgcagtctcgcctctcgcacacgcagccgagccagactccgccagcgcttctcctctctcctccctcctccctcgcgcccgccgcccgccggagaggacgccatggcgccggagccggaggacgacatcatggcggagaagaacccgcgccccctcgacgaggacgacatcgccctccttaagacctacgggcttgggccatactccacgagcatcaagacggccgagaaggagatcaaggagttggccaagaggatcaatgacctatgtgggataaaggagtctgatactgggctggctccacctagccagtgggatctggtgtcagataagcaaatgatgcaagaggagcagccattacaagtagcaaggtgcaccaagattataaaccctaataccgatgatgccaagtacatgattaatgtaaaacaaattgcaaagtttgtggttggattgggggataaggtttcgccaactgatatcgaggaagggatgagagtcggtgtcgatcggaacaagtatcagatacagattccattgccaccaaagattgatcccagcgtcaccatgatgactgttgaggaaaaaccagatgtcacgtataatgatgttggcgggtgcaaggagcagattgaaaaaatgcgtgaggtagtcgagctccccatgcttcacccggaaaagtttgtgaagcttggtatcgatcctccgaaaggtgttctttgctacggccctcctggcactggcaagactcttcttgctagagctgttgccaatcgcacggatgcttgttttatccgtgtgattggaagtgaattggtccaaaagtatgttggtgagggcgctcggatggttagggagttatttcagatggcccgctcgaaaaaagcatgcatcatattttttgatgaagttgatgctattggtggcgctcgcttcgatgatggagctgggggagataacgaggtgcagcgtactatgcttgaaatcgtcaatcagcttgacggttttgatgctagggggaatatcaaggttctcatggccaccaacaggcctgatacacttgatcctgcgcttctgcgtcctggtcgtttggacagaaaggtggaatttgggctacctgacttggaaggccgtacccagatattcaaaatacatacgcgcaccatgaactgtgagcgtgatatacgcttcgagctactggcgcgactctgccccaacgccactggcgccgacatcaggagtgtctgcacagaagctggcatgtacgcaatccgtgcccgtaggaaaaccgtgacagagaaggacttcctcgactctgtcaacaaggttataaagggctaccagaaattcagcgcaacacctaagtatatggtgtacaattgagcaaacaggcttcccttcgattctgtgcatgtttgcatccatgctgtagcagtgcactggttttcacaccccttctgtgtgcgcgtgatgattgtaaacagcagcatggtggtgtttcggtacatgtatgtcactgtaagctggtgaccccagtgaatcactctttagcttttcataaagctttgttgaaacacagtttgatttac

SEQ ID NO: 32829 - DNA, 692 bp, Triticum aestivum
  Clone ID: PAT_TA_32829
ggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggaagagcaatacaagcgttgtgctgctaggcgaagcggttgagtgccgcaccctagatggctaaagtccagtagcccgaaagcatcactagcttacgctctgacccgagtagcatggggcacgtggaatcccgtgtgaatcagcaagttatcttcagttcctgtgtcagtcagtctgagtcgtcgtgtgtgtcgttgagtcctgtggtgtttttgatcgccgagctcgagtgtcgctctgtccggggttaattagagctggttacgcgaggaagaaacaacatgtgttatctttcagtcttggtcggtccggtcgtcggtgatgcagcaatcccttctgtcatggattgggatgtgatgttggaatatcctatgtttgaactcggtttaaatggaagaaaatgcaatccgtcatagctgcgaaaaaaaaagggggggc

SEQ ID NO: 32830 - DNA, 1470 bp, Triticum aestivum
  Clone ID: PAT_TA_32830
gacgctgctgatgaagtccaggctcgccggatgcggttttggctcaagctgcctccgcttgttggctgccttgccatccatctcaaccggcggtgacgcggtgtacacatgtgctggtgtgtgttgtgtgctgagtgtgcgcgagtgcgtccttctgtgcatgccactgcgcagtgctgaattgtgtgcgagtgcatccttcacgcggaagaagtgtgtcctcaatgcgccctcaatttactaacgtgcacggtgatatctactacgcaaccttctccttgtagacgttgttgggcctccaagtgcagaggtttgtaggacggtagcaaatttccctcaagtggatgtcctaaggttatcaatctgtgggaggcgtaggatgaagatggtctctctcaaacaaccctgcaaccaaatagcaaagagtctcttgtgtccccaacacacccaatacaatggtaaattgtataggttcactagttcggccaagagatggtgatacaagtgcaatatggatggtagatataggtttttgtaatctgaaaatataaaaacagcaaggtaactaatgataaaagtgagcgaaaacggtattgcaatgctttgaaacaaggcctagggttcatactttcactagtgcaagttctctcaacaataataacatagatagatcatataacaatccctcaacatgcaacaaagagtcactccaaagtcactaatagcggagaacaaacgaatagattatggtagggtacgaaaccacctcaaagttatccgttttgatcgatctattgaagagttcgtagtaaaataacaccttaaagacacaaatcaaccaaaaccctaatgtcacctagatactccattgtcacctcaaagtatccgttgggcatgattatacgatatgcatcacacaatctcaagttcatctattcaaaccaacacaaagtacttcaaagagtgccccaaagtttctaccggagagtcaagacgaacacgtgtgccaacccctatgcataggtcccaatgtcacgaaacccgcaagttgatcaccaaagacatacatcaagtgttctcaaatctttaaagacttaatccgataagataacttcaaaggggaaactcaatccattacaagagagtagagggggaggagaaacataagatccaactataatagcaaagctcgcgatacatcaagatcgtgccaaatcaagaacatgagagagagagagagagatcaaacacatagctactggtacataccctcagccccgagggagaactactcactcctcatcatggagagcaccgggatgatgaagatggccaccggagagggattgccccctccggcagggtgccggaacgggtctagatgggctttcggtggctacgatgcttctggcggctgaacccccgatctattgtgttccccgatgtttttacggtagatggagatatata

SEQ ID NO: 32831 - DNA, 941 bp, Triticum aestivum
  Clone ID: PAT_TA_32831
aaatgggcataggattctcattgctactgtaccagccatacaaagatgtgagcgtcccagtgaaaatggccatcaaaactcaaagggatcgaatacacaactcttatctagtgctacaagcagtctgtagttcgtattgataataatgaacaaggctttgccgttggcatcagggagaggaggaaaaagaattagtgtcacaaattacaggcctatctatgtactactaacagcagtggttctgtcttaccagccatatacaggattctgtacctgagggggcagcaggtgcatgtccacgctatgttgcttgttgtagttcagggtcccgggcaccgccccagtcgacagccggaggagctcgctgcctgtgaagcagtagtgggcaaatgctaggccgccatccacaatgtccgacatgtttggcaacgaggctgatttcttcatcctcctgtcgacgctgtttccagaggtgctggcacaatcaccattgctgctcaggaccttgtccagctccgagtgctccatgaacctctgggttgcagcctcccacgaaaggttgtaccgctgctcaggtgtgaggggctggggatcacgtgtcattgcttccttcactttggcaacgaaatcctctgacgttgtgtacaccaggcagtttgggaatgatctgaagaaatcgttggatgcctcgtgccgaattcggcacgagggtcattaagggttaccaaaagttcagtgccacgccaaagtacatggtctataactagatagcctgacgttagccccctgtgtatctttgccgctcgggctttcttctacggggtggttgtttgttgctctgctttctttccctgtccaatagaaactgcatcatatgttactgtggactataccgtcggaatattggaatgtcaaaaggaaggaaggatgatgatgatgat

SEQ ID NO: 32832 - DNA, 750 bp, Triticum aestivum
  Clone ID: PAT_TA_32832
tcgcggccgcgtcgacctgtctcaggcttcttgacgttggttcggtaacccttctcgaagtccttggggagaataacatagcgatttttgcggacagcatgcatgccagcttcctggcaaatagcagtgatatcaggaatccgactgtttaattaaaacaaagcattgcgatggtcctcgcggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtggggagccctcacgggcgcaagtgaaataccacttttaattgcaaggaggatgtcaccaccatagccgtgtttacttttgaataatctgggtctcgtatccacttgttggttaggctagtttgtttctaggtgcggcgcgatgtgctcatcccttgatttggtggtttttgaggcggttgtcggtgtgtattgtaaactgagtggcgaattgttcatctaagtctgagtttgttacgttatgtttcaaaaaaaaaaaaaaaaaacctcgtgccg

SEQ ID NO: 32833 - DNA, 2376 bp, Triticum aestivum
  Clone ID: PAT_TA_32833
tatcatgtgaggcataatccaattgaaaactaaaatcatgatgaaaatattcatggatataattattctttatagcatacaagtcatcacaataatcatcatagatagcaactttgttctcataatcaattggaacctcttccggaatagtggaatcattactaaataaagtcatgacctctccaaatccactttttcaatataatcatcataaataggaggcatgctttcatcataataaatttgctcatcaaaacttgggggacaaaaaatatcatattcatcaaacatagcttccccaagcttgtggctttgcatatcattagcatcatggatattcaaggaatttatactaacaacattgcaatcatgctcatcgttcacatatttgattccaagcattctatgtaattcttcttctaccacttgagcacaattttcctttccatcattctcacgaaagatattaaaaagatgaagcgtatgagacaagcttaactccattttttgtagttttcttttataaactaaactagtgataaaacaagaaacaaaaagactcgattgcaagatctaaagatataccttcaagcactcacctccccggcaacggcgcaaaaaaagagcttagttgacgaggtgtgagtgagtgccctttacctagcctccccggcaacggtgccagaaaagagcttgatgtctactacacaaccttcttcttgtagacgttgttgggcctgcaagtgcacaggtttgtaggacagtagcaaatttccctcaagtggatgacctaaggtttatcaatccgtaggaggcgtaggatgaagatggtctctctcaagcaaccctgcaaccaaataacaaagagtctcttgtgtccccaacacacccgatacaatggtaaattgtatagatgcactagttcggcgaagagatggtaaaacaagtggtatatggatagtggataaaggtatttgtaatctgaaattataaaaacagcaaggtaactaataataaaagtgagcgtaaacggtattgcaatgcgtggaaataaggcctagggttcatactttcactagtgcaagtcctctcaacaataataacatagatagatcatataacaatccctcaacatgcaacaaagagtcactccaaagccactaatagcggaaaacaaacgtagagatcatggtagggtacgaaaccacctcaaagttgctctttttgatctatctattcaagagttcgtagtaaaataacaccttaagacacaaatcaaccaaaaccctaatgtcacctagatactccaatgtcacctcaagtatccgtgggcatgattatacgatatgcatcacacaatctcagattcatctattcaaccaacacataggacctcaaagagtgccccaaagtttctaccggagaatcacgacgaaaacgtgtgccaacccatatgcataggttcatggggcggaacccacaagttgatcaccaaaacatacattaagtgaatcacgtgatatcccattgtcaccatagatatccacggcaagacatacatcaagtgttctcaaatccttaaagactcaattcgataagataacttcaaagggaaaactcaatccattacaagagagtagagggcgagaaacatcataagatccaattataatagcaaagctcgcggtacatcaagatcgtaccacctcaagaacacgagagagagtgatcaaacacatagctactggtacataccctcagccccgagggtgaactactccctcctcgtcatgtagaccgccagggtgatgaagatggcttccggtgatgattttcctcttcggcagggtgccaaaacaggcctctgatggagattgctttggtatagaggcttgtggcggcggaacaactcatctaggtttcttttgggggtttcctcaacatataggaatatttggcgttggaataatgtcagggggtccacaaggaagtgacaagctcaaggggcgcaacctagtgggagggtgcgcccccaggcttgtcatgccctcatggctcttctggcccttcctcaaaacttcatgggtctctttttgtccataaaaaatcaccgtaaattttcagcctattccgagaacttttatttctgcacaaaaaacaacaccatggtagttctactgtaaacaacatcagtccgggttagttccattcaaatcataccaaaactatataaaattattgtaaacatggcatgaatacttcgtaaactagatgataccccacgcgttgctgcagtaatttatagatgaatttcaacaatataaaagtatatgacataaacaaaatgagtatatagtattaaaattgataggtcat

SEQ ID NO: 32834 - DNA, 660 bp, Triticum aestivum
  Clone ID: PAT_TA_32834
ctcccgagcaatcctctctccgcgcccacgaagcaagctctccactcccgatggcccgcacgaagcagacggcgaggaagtccaccggcggcaaggcgccgcgcaagcagctggcgaccaaggcggcgcgcaagtccgccccggccaccggcggcgtgaagaagccccaccgcttccgccccggcaccgtcgcgctccgggagatccgcaagtaccagaagagcaccgagctgctcatccgcaagctccccttccagcgcctggtgcgggagatcgcgcaggactttaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctaggctgcttcctagaatcctagtgtctgatctggtctcgaggtgtagagatgcgttactagtttcttattagcccttgtctgtggtagtaaggttcctcgacagttgtgttatggtgtgatgtactgtatgtgatggtaccatcttgttatcatcatcaatgagaagttagcaatctgattttaaaaaaaaaaaaaaaaaa

SEQ ID NO: 32835 - DNA, 1633 bp, Triticum aestivum
  Clone ID: PAT_TA_32835
cgaacccgagtctctcgcacacgcagacgagccagataccgccagcgcagcgcctctcctccctctcgcctcgcgcccgccgcccgccgcccgccggagaggacgccatggcgccggagccggaggacgacatcatggcggagaagaacccgcgccccctcgacgaagacgacatcgccctcctcaagacctacgggcttgggccatactccacgagcatcaagacggccgagaaggagatcaaggagttggccaagaggatcaatgacctttgtgggataaaggagtctgatactgggctggctccacctagccagtgggatctggtgtcagacaaacagatgatgcaggaagagcagcctttacaagtagcaaggtgcaccaagattataaaccctaataccgacgatgccaagtacatgattaatgtaaaacaaattgcaaagtttgtggttggattgggtgataaagtttcgccaactgatattgaggaagggatgagagtcggtgtcgatcggaacaagtatcagatacagattccattgccaccaaagattgatcccagcgtcaccatgatgactgttgaggaaaaaccagatgtcacgtataatgatgttggcgggtgcaaggagcagattgaaaaaatgcgtgaggtagtcgagctccccatgcttcacccggaaaagtttgtgaagcttggtatcgaccctccgaaaggtgtcctttgctacggtcctcctggcactggcaagactcttcttgctagagctgttgctaatcgcacggatgcttgtttcatccgtgtaattggtagcgaactagttcagaagtacgttggtgagggcgctcggatggttagggagttatttcagatggcccgctcgaagaaagcatgcatcatattttttgatgaagttgacgccattggtggcgctcgctttgatgatggagctgggggtgataatgaggtgcagcgtactatgcttgaaatcgtcaatcagcttgatggttttgatgctagggggaatatcaaggttctcatggccaccaacaggcctgatacacttgatcctgcacttctgcgtcctggtcgtttggacagaaaggtggaattcgggctacctgacttggaaggccgtacccagatattcaaaatacatacgcgcaccatgaactgtgagcgtgatatacgcttcgagctactggcgcgactctgccccaacgccactggtgccgacatcaggagtgtctgcacagaagccggcatgtacgcaatccgcgcccggaggaaaactgtgacagagaaggacttcctcgactcagtcaacaaggtgataaaggggtatcagaaattcagtgcaaccccgaagtacatggtgtacaattgagcaagcaggcttctcttcgattctgtgcatgtttgcatccatgccgtagcagcagtgctttttgttttcacatcctttctgtgtgcccctgatggttgtaaacagcacatcggtgtgtcggttcatgtatgtcactgtaatctggtaaccccagtgaaatcactctagcttttcataaagctttgtcgaaacacaattttcagcttgtctgctaatcagaattaattgcatacaaaaaaaaaaaa

SEQ ID NO: 32836 - DNA, 1612 bp, Triticum aestivum
  Clone ID: PAT_TA_32836
cgcgtgggcggaaatagttctccatctcaaccttctcttctcccttctcttctctcccgcgcgttacctcgaaccggaagcgaactctacatccatcctcgaccgatggatccatgggtcagcagccagccttcccttagcctcgacctgcacgtcggcctcccgccgatggggcacccgcaccaccaccaggcggcgcccatggtcgcgctggccaagcccaaggtcctcgtcgaggagaacttcatgcagctcaagaaggaccctgaggttgcggttcttgagtctgagctacagcgggtgagcgaggagaaccggcggctgggcgagatgctcagggaggtggcctccaagtacgaggccctgcagggccagttcaccgacatggtcacggccggcgcccacgccggcggcaacaacaacaactacaacaaccagccgtcctccgcgtcggagggcgggtcggtgtcgccgtcgaggaagcgcaagagcgaggagagcctcggcacgccgccgccctcgcaccagcagcactacgccgccggcctcgcgtacgcggcggcgccggaccaggcggagtgcacgtccggcgagccgtgcaagcgcatccgggaggagtgcaagcccgtcgtctccaagcgctacgtccacgcggaccccgccgacctcagcctggtggtcaaggacgggtaccaatggcgcaagtacgggcagaaggtgaccaaggacaacccctgccccagagcctacttccggtgctccttcgcccccggctgccccgtcaagaagaaggtgcagaggagcgccgaggacaagaccatactcgtggcgacgtacgagggcgagcacaaccactcccagcccccgccgtcgcagccgcagcagcagaacgacggctccggcgcgggcaagaactccgggaagccgccccaggcgccgaccacgcctcaccacccgcagcagcacaagcaggaagcggcagcggccgccgtcagcggcgagtcggccgcggcggcgtccgagcttatccggcgcaacctggcggagcagatggccatgacgctgacgagggaccccagcttcaaggcggcgctcgtctccgcgctctccggccggatcctcgagctatcgccgaccagggacatcaattaatccccacatcagaagacactgcgcggctcaaattttcttgcggtggtcgattacttcgttcggcattgctgccttcctctgccgcctccgtcaaaacctcaaagaaaaaccagcgaggaccggactgcctgaccgacgacggagacgcgatcggttccggcgagccaggaacggagccaccgccgctgctgctcgtgtaaatacatcgccaacacgaggacggcgtgggaggtcgtaacatgtaatgtactctagtagctaggataatgcagtcagtcattcaggaacacgcgaaagtgtgcaatccttttttcttttccttattactaggcgaaatgttcgttccataatttccatggaactcgattcgattcaatgagaaaaatcaaagtcaccgcacattctcagttcaaagctgaagagcgcggagcaagtggtggccgacgcgacgaccaacacc

SEQ ID NO: 32837 - DNA, 1800 bp, Triticum aestivum
  Clone ID: PAT_TA_32837
aggaaataccatctccatgttatggcatgccttcaatgattattcatgagtcatatcattctcaaccataatcatacatcacgaatagagcacagcaatcagccccttaagggcaccaatttgctgctacaagaaaacgatctgcatggtaccacagcctaatccttgtatttcatgtctgacacccggaagccaggcatctcaaatgcaatggcaaacttctcgacctctgccctgagctccgcgatgtcctcgttcttctccaagtcaacgatgaaatcattgtaacgcttacctcgctgcttctggacattcaagcagatgactacagcctgatgaaggtactcagcaatcttcacaaagtccttctcgaccaaacctctcgaggtcatggcaggtgtaccaattcgcacaccaccaggtgccagtgcactgctgtcaccaaagacggcatttttgttgagtgtaatgctgctcagatcacatactttctcaactttgttaccagacaagccaagagggcgaagatcccagagaacaaggtggttctctgttccgtcagtaaccatcttgtagcccttactcatcagatggtttccaagggcaacagcattggccttgacctgctgaatatatgccttgaatccaggtgacattgcctgcttcaggccaactgccagggcagcaatctggtggttgtgagggccgccctggagtgatggaaacactgcaaagttgatcttgtcctcgtaatcgtaaagagcaccctcgggctggcctttttttgggaggcttcgggcccttcctgtagaatatcataccagaccttggccctcggagactcttgtgggtggtggtggtaaccacatcagaatactcaaacggattcgtagcctcctgagcggcaacgagaccgctgatatgagccatgtcacacagcaacatggccccgcacttgtccgcgatggccctaagcctggcataatcccagtcccgtgggtacgcgctcccgccacagataatgagcttggggcggaaatccatggccttctcctccagcctatcatagtcgacgtacccggtgtcggagctcaccttgtagggcaagctcgaaaagtagatggaggtggccgaaatcttcttgcccccggccgtgtagtacccatgagtgaggtgtcctccggacggcaaatcgagccccatgatgcgctcgtggggttggagcagcccagtgtaggcggcgaagttggcgggggagccggagtagggctgcacgttgacgccccaggaagcggggtcgaggtggaacgccttgagggcgcgggcgcggcagagctcctcgaccttcgtcgatgacctcgttcccgccgtagtagcgcgccccgggcatgccctcggagtacttgttggtgagcggggagccgagcgcctccatgacggcgagcgaggtgaagttctcggacgcgattagctcgatgcccgtgcgctggcgcagcttctcgcgctcgatgaggtcgtacacctccgggtcggcctccgcgagcggggtgagcccccagtcggccacggcgtccatcgcggcggcggcggtggcaggggcaggggcggcatcggtggagacagcgtagaggcggacgggccggacggcggcgcggtggagggggaggcggagaggggaggagctctgcgcggtggtggggtgagcgaataaagcggcgcgcccgacgggtggctgcgagtgcgagacgtggggcgcagccatggccatgcgcgtcctgtgctcgacgaaatgcggctgcg

SEQ ID NO: 32838 - DNA, 2386 bp, Triticum aestivum
  Clone ID: PAT_TA_32838
atttatgtcaggattttctgtcctttacaaacccatatgtctgtccttttcacatttgtcaggaaaacgaacgggatcaaccgtttacatcatctcaaacgccatctccggcatctcagagaaaagaaaactggaaccaaagggggctctctctctctctccttgtgtcctagtagcaagacatcggcttcttcttctttttctgggccttggcaattgtcttcctgtccacataagcaagtagttcctcttgcctgataagagcctcatgcaggggccttctttgttacaatgagttcggcttccagtgcatccacgcggcggacagcggcattaagcagctcttctttctcgcaaggcatttcagaaggttttgcttcaagcgcatgaaccttcgcttcaagctctgccagcctttgcaagactaacgagaacaggtcagattcagcaaacccaggacctggtgacggggggcggaactcctcttttggaatgcagtcttgatatactgcagaactttgttcgtctgactcgtttttatctggcaatctctttgtcgcaacatctttaactgaccgaagcagcgttacaatagcaatcacaaaagccatcagagctggaataatctgatccaaagacctgttggatgcctttgtggtggtagccaaagaagagtctttgggcgggacaggcgccttccgaggcagttctctcttccatgtagcatccacggccttgtcaacaacaggtacatcatattcagggacacgagtagaaaagctagtagccctgaccattttgacctcttcacgaactggggtcaacttaggatgtgatatgtaacttctgagagctttgggggacacagcatcatcagcttctgaaccagactcagcagttgatgtgtcactccctctcattgcgtggcgcttcggtttggcgtaagtaataaatttttccgtcccattggaaatagttacaatttgacgagcacaatgaaccccaccactttggactatcttaagtatgtttgggtccttccacggtccctttcagcctaaggcaacctccgtattcaggacaggtacaagtgccaccaagaaattctggcaattcactagcatcaattatttcaagcagtttactttgacacttgttcccaagtacctgacaaaacacaatagcacatgtatcttggaagtggtttttgggtcgaggaaagatttcacagtgctccatagcatccgaaagcccgggccagcattgactataaacatttggtgtaaagtctcagggtagttatcgttgtcaactttctgcagtcgcataatcaattcacgtgcagttttgctgaaatttttcaaacccacaccctgaacatccagaattgtggtgctcgaattgatgtgtcttttagccgcaagagagcatgctggaaatttgatcaagaagctcctctcaaattccttcacatggtaccttacatatctgtccatagttgttacattaataagcttgttagggtcaacctttccaagcctttcgatataaacaggtctcccctctttgtcaacgccatgatatccatgaggatagtattccagaacagtgtccagctcagtgtaatcaaaatcctcaacaattgtatcagtaccatattccttcctccattgaagcatgtcagtccacatttgctttgctttctcaatgtcaaatttccttgcctttaagaatctcagcagcatatgatagtcatcatgccttgaaggcaacaattcgtccaaaattagcgcctgtctaaatgcttctacctcttccagttcccatagatcacgcacatcttcaatagacacagagagaacccgactgccactcttcctcctgttctttttctttaaggaatgcctaagcttactcgatgcatctatagctttcttcttcaaagagcccattcttgtcttcttttcatcttcagagatttcaaaatctgatctcctctcatatgatctcctgtcatcgtgacttgaacaaccttcaaaacctgagactgggcgcgcgaggcgatcgaggtggcccgacatgggcgccggatcctccgctcctcctccgggggccaaacctccgaatcatgagaaacgccgggggtcggggagctcgccggcgatcggggcgggccgcgtggtccgaggcgggaatccgagggatttttttccgcctggggagtggcgctgcgtgggggaggcgggactgcgggggaggggatgggtgggaagtgggtggggagtggtggtggtgaagggagcaggggaatagagaggggaaggaggaggggaaagagacgacgatggtgtggagagagagcgagagatagagaaaggcgccctcg

SEQ ID NO: 32839 - DNA, 1827 bp, Triticum aestivum
  Clone ID: PAT_TA_32839
tggccggcgactcgcgactcgtcgctggcaaccacagcccacagtaccaccgtccgtcgaagcctcgcacgtgcgatggccggcgggcgccgctccggcttcgccgccgcggccctgctcctcctcgtcttcaccgccggctgcggcgcggcgccgcagggcgcggaggtgacggggctgccgggcttcgacggcgcgctgccgtcaaagcactacgccgggtacgtgacggtggacgagaagcacgggcggaacctgttctactacgcggtggagtcggagcgcgacccggccaaggaccccgtcgtgctctggctcaacggcgggcccggctgctccagcttcgacggcttcgtctacgagcacgggccattcaacttcgaatcgggcgggtcggttaaaagcctgccaaagcttcatctcaacccttacagctggtccaaggtgtctaccatgatatacctggactcccctgctggtgtggggctgtcatactcaaacaatgtttcagattatgaaacgggagacctcaaaaccgccgctgattcgcacactttccttctgaagtggtttcaattgcaccctgagttcctgagcaacccgttctacatagctggggagtcgtatgccggggtttatgtccctactctttcgcatgaagttgtcaaagggatacaaggaggagctaagccaactataaacttcaagggctacatggtggggaatggcgtctgcgacactgtttttgatggtaatgctcttgtgccatttgcacatggaatgggtctaatatcagaagaaatataccagcaagcttttacgacgtgcgacggaaattactggaatgccagcgagggtaaatgtgaaagcgcgttagtgaaaatcgactcgttaatcagcgaactgaacatttacgacattcttgagccatgctaccacggcagaagcatcaaagaagcaaacccgcagaatagcaaattgcctaaaagtttcaaagatcttggtacgactaacaagccctttcctgtaagaacaagaatgcttgggcgtgcttggcctctgagagctcctgtaaaagccggacgtgttccattatggcaggaagttgcaagtggtgttccatgcatgagcgacgaagtggcaacagcatggctggacaacgatggcgtcagatctgcaatccatgcgcaatcagtaagttcaattgggccatggctcttatgcacagataaaattgatttcaaccatgatgctggcagtatgatcagttatcacaagaacctcacaagccagggttatcgtgccatcatattcagtggtgaccatgatatgtgtgtgccatacaccgggagtgaagcatggacaaaatctatggggtatggagttgttgactcatggcgaccatggttcacaaacgaccaagtttccgggtacaccgaaggctatgagcatggtctcacttttgctactattaagggcgctggacacaccgttcctgaatacaaaccacaggaagcattggctttctacagccgttggctcaatggttcaaagttgtgaggcttgggcccagctgcaaataatgggggaatatacttctgcatacagtcaagaatgaacaaatgttgatttgaagaaagagatgagctacatgccatatagatagttacatactcaaatttcaaaaatagcaattggaacactgcgtgttgtattcattcatgaaatgttatttggtcgatgcagctttgatattattgctcctcatgatttgtccactgtgtgatcatgacttctgaatttcagttgatatggagagtatatcat

SEQ ID NO: 32840 - DNA, 1809 bp, Triticum aestivum
  Clone ID: PAT_TA_32840
tagctgtatcagattgcagggactattgaacggtgggccatagtgttctttggcatcagttgtgcaacttcaagctctctacaaggacaatgccaacctgctcatccttcaattgtgccaagtggagcaacaacaacctaggcctacgctcccgaaggtagcagaattgctcagccattacaagagtgtctacgaggaacccatagggctgccacctaaacgagcttgtgatcactgcaacccgctgctgctgggggtgaagccatttgccatcaggccatatcgctaccctcctgcattgaaaacagagattgagaaacaggtggccgatcttttgcgtaggggaatcatctagctcagtcatagccctttttcatcacctgtggtgctggttcgtaagaaagacctcacctggaggctgtgtgtggattaccggcacctcaacgcgttaacgtgtgatgtctactacacaaccttcttcgtgtagacgttgttgggcctccaagtgtagaggtttgtaggacggtagcaaatttccctcaagtggatgacctaaggtttatcaatccgtaggaggcgtaggatgaagatggtctctctcaaacaaccctgcaaccaaataacaaagagtctcttgtgtccccaacacacccaatacaatggtaaattgtataggtgcactagttcggcgaagagatggtgatacaagtggtatatggatggtagatataggtttttgtaatctgaaaatataaaaacagcaaggtaacaagcgataaaagtgagcacaaacgatattgcaatgcattgaaacaaggcctagggttcataatttcactagtgcaagtcctctcaacaataataacataattggatcacataactatccctcaacatgcaacaaagagtcactccaaagtaaataatagcggagaacaaatgaagagattatggtagggtacgaaaccacctcaaagttattctttccaatcaatccgttggggtattcctataagtgtcataaacagccctaaagttcgtactaaaataacaccttaagacacaaatcaaccaaaaccctaatgtcacctagatactccaatgtcacctcaagtatccgtgggtatgattatacgatatgcgtcacacaatctcagattcatctattcaaccaacacatagaacctcaaagagtgccccaaagttcctacaggagaatcatgacgaaaacatgtgccaacccctatgcattggttcattgtcggaacccgcaagttgatcaccaaaacatacatcaagtgaatcacgtggtatcccattgtcaccacagatacgcacggcaagacatacatcaagtgttctcaaatctttaaaagactcaatccgataagataacttcaaaggggaaactcatttcattacaagagagtagagggggagaaacatcataagatccaactataatagcaaagctcgggatatatcaagatcgtgccatagagggaacacgagagagaacacgagagagagagagagagagatcaaacacatagctactggtacataccctcagccccgagggtgaactactccctcctcgtcatggagagcgccgggatgatgaagatggccaccggtgagggatccccccttcggcagggtgccggaacagggtcccgattggtttttggtggctacagaggattgcggcggcggaactcccgatctaggttattttctggaagtttgggtatatataagaggtgtttgcgtcgggaacaagtcaggggggtcttcgaggcggccacg

SEQ ID NO: 32841 - DNA, 698 bp, Triticum aestivum
  Clone ID: PAT_TA_32841
ccccgcgtccgcccaaatctcccgagcaatcctctctccgcgcccacgcagcaagccctccactcccgatggcccgcacgaagcagacggcgaggaagtccaccggcggcaaggcgccgcgcaagcagctggccaccaaggcggctcgcaagtccgccccggccaccggcggcgtgaagaagccgcaccgcttccgccccggcaccgtcgcgctccgggagatccgcaagtaccagaagagcaccgagctgctcatccgcaagctgcccttccagcgcctggtgcgggagatcgcgcaggacttcaagaccgacctccgcttccagagctccgccgtctccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcctagtatgcttcctagaatcctagtgtctgatctgttctcgaggtgtagagatgtgttagtttcttatcagcccgtgtctgtggtagtaaggttccttgatggttgcgttatggtgtggtgtatgtgatggtaccatcttgttatcatcatcaatgagaagttagcaatctgatttcaaacatgcctgcttgttcgtctggtttatcgatggatttagccctc

SEQ ID NO: 32842 - DNA, 786 bp, Triticum aestivum
  Clone ID: PAT_TA_32842
gtcgccgtccaaacccaatcagaaatctcaagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgcaagataattggcgccaccaaccccctggcctctgagcccggcaccatccgtggtgactttgccgtcgacatcggcaggaacgtcatccatggaagcgactcagttgagagtgcgaggaaggagatcgccctgtggttccctgagggcattgcagagtggaggagcagccagcacaactggatctatgaggcctaagatgtgtcatgagtggttgagtgcaggtttcattaagcatctaccaaactagtctttggttgtttacagttttgagatttgtatcttgggaaccttgtttgtgtgaactgaagttatctccttgtgcttgggcatccaagcggtatctgctgctctatatttgatatatggtattgctttgatatgagttgcatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggccgtttttaaaggatcaaattttacttccccgggcttgcaaagtaatattttttttttagg

SEQ ID NO: 32843 - DNA, 1750 bp, Triticum aestivum
  Clone ID: PAT_TA_32843
cccgaacccgcagtctcgcctctcgcacacgcagccgagcgagccagacaccaccagcgcagcgcagcgcctcccctccctctcggcctcgcgcccgccgcccgccgcccgccggagaggacgccatggcgccggagccggaggacgacatcatggccgagaagaacccgcgccctctcgacgaggacgacatcgccctcctcaagacctacgggcttgggccatactccacgagcatcaagacggccgagaaggagatcaaggaactggccaagaggatcaatgacctatgtgggataaaggagtctgatactgggctggctccacctagccagtgggatctggtgtcagataagcaaatgatgcaagaggagcagccattacaagtagcaaggtgcaccaagattataaaccctaataccgacgatgccaagtacatgattaatgtaaaacaaattgcaaagtttgtggttggattgggggataaagtttcgccaactgatatcgaggaagggatgagagtcggtgtcgatcggaacaagtatcagatacaaattccattgccaccaaagattgatcccagcgtcaccatgatgactgttgaggaaaaaccagatgtcacgtataatgatgttggcgggtgcaaggagcagattgaaaaaatgcgtgaggtagttgagctccccatgcttcacccggaaaagtttgtgaagcttggtatcgaccctccgaaaggtgtcctttgctacggtcctcctggcactggcaagactcttcttgctagagctgttgctaatcgcacggatgcttgtttcatccgtgtaattggtagtgaattagttcagaagtatgttggtgagggcgctcggatggttagggagttatttcagatggctcggtcgaagaaagcatgcatcatattcttcgatgaagttgatgcaattggtggtgctcgttttgatgatggagctgggggcgataacgaagtacagcgtactatgcttgaaatcgtcaatcagcttgatggttttgatgctagggggaatatcaaggttctcatggccaccaacaggcctgatacacttgatcctgcacttctgcgtcctggtcgtttggacagaaaggtggaatttgggttacctgacttggaaggccgtacccagatattcaaaatacatacgcgcaccatgaactgtgagcgtgatatacgcttcgagctactgggcgcgactctgccccaacgccactgggcgccgacatcaggagtgtctgcacagaagctggcatgtacgccatccgcgcccgcaggaagactgtgactgaaaaggatttcctcgactcggtcaacaaggtcatcaaggggtaccaagaaattcagcgcaaccccaaaatacatggtgtacaattgagcaagcaggcttccatttgtttctgtgcatgttcgcatccatgccgtagcagtagtgctttggttttcacatcctttctgtgtgcccgtgatggttgtaagcagcacggtggtgtttcggttcatgtatgtcactgtaatctggtaaacccagtgaaatcactctagctttttttaaagcttcgttgaaacccagttttcagcttgtccgctaatcagaattaattgcatgcattttatttggagataagtctctcttgttagaactttgtatgtcccccctgaacatatgggtaatgcccgttgagaacaaaactagttttgtactagtagaccatcccc

SEQ ID NO: 32844 - DNA, 734 bp, Triticum aestivum
  Clone ID: PAT_TA_32844
cgtccgcggacgcgtgggcgccgccgccccctgcaccaaccagcgccctgccgccgccgccgccgccggagaaggagaggaagcagccgcagccatgggtcgcgtccgcaccaagaccgtgaagaagacctcccgccaggtcatcgagaagtactattctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggccgacctccctggcgtcgagcgcgcccccgaggtcacctcctccgccgccccctaccgtcagccgttcaacgggccccgtggtggcaaccgcgcctaggttcctccgcatcgtcgtcgtacccctatattatgctttatgtcatttagatctgttacttgtggcaagtaatgttttgaactcagagcttaagttcgaggtgttttgatctgcgtatggtggacatgatctgtttatcgcaccgtttatctgaagtgattcgatatattactgttgatctttgaaaaaaaaaaaaaaaaaggcccct

SEQ ID NO: 32845 - DNA, 1584 bp, Triticum aestivum
  Clone ID: PAT_TA_32845
taggggcctttttttttttttttttacctggggaagacaatcacaacatcgacaacaaacacgcaatggtcaagcgaaacttgacaaacaagtagcttacaacactcgtgagattgaacgtgcatgccctttatacttttccaactagaaacacaaaataaaatagtagttgaatctgatcaaatagattaggcgcatgcaggatacaaagatattaatgtcacatagaggctgactatccacacattcatccctaacacttcgttgcctcacttgtagaagtcaaaatctgtatcaggcttcttgacgttggtccggtaacccttctcgaagtccttggggagaataacataccgatttttccgaacagcatgcatgccagcttcctggcaaatagcagttatatctgcagcgctgattttatctggtctggagacataatcttccaaatcaacctcgtcacttaaattcattttagaagtacaaacttggaaaacaagcctcttctgcctccggtctggcagagggaactcaattttcctgtccagtcttcctggacgcagcagagcaggatctagagtatctgcccgattggtcgccattataaccttcacattcactgtctgatcaaatccgtccatctgattgagcaactccatcaaaatacgctgaacttctcggtcagctccagtctgagcatcaaatcgggcagttgctatagcgtcaacctcatcaatgaatattatagccggggcattctctttagctaagcggaatacatcccgaaccatccttgggccctcacccaagtacttctgcacaaactctgaaccaaccactctgataaaagcagcagtagtgtgatgtgccacagctttagcaagcatggtcttgccagtgcctggaggaccatagagaagcacccctcttggaggatcaataccaatctgcttgtacaactcatggtgtgtcaatggtagctcaactgcctcccgaatttcctgtttttgaatatcacatcctccaatgtccgaatacaggacgttgggcttctccgacgaagcgagcagcgagatgctggagtcggcctcgggcggcagcacgtcgacgagcgcgttggagtggcggtgcagggcgacggacgccgacggcttgagcagctcgcggttgatggtgctgaggatccgcacgtagtagttgctgccggtggtggacccgacgatgccgttgttgccgtcgaccatctccatgaactggccgatgacgaggggcacggactggatccgcttgacctcctcctgcgcgcgcagcagctcgcgcttcaggttcttctgctcgtccttgacgtactcctcctggatctcgacgaactccatgtggcgctggagcgatttgaggcggccgtagaggtcgtcgtcatcctcggccgcggcggaggaggaggacgcgcagtgggcggcggtggcggggtacgagggcgggggcgccgacgggagggccgcgggagggtttgttacggccgccatggctagggtttggtgtccgctggaggcagggtcgggcttttttaacacgagactgcga

SEQ ID NO: 32846 - DNA, 850 bp, Triticum aestivum
  unsure (1)..(850): unsure at all n locations
  Clone ID: PAT_TA_32846
aacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagggcggcggcggctacggccagggcggcggtggcggctacggccagggcggcggtggctacggcggccagcgtggtggcggcggctacggcggctacggcggtggctacggcggcggcggtggcggctacggcggccagcgcggcggcgactccggcggccagtggaggaactgagcggcgggggccctcccagttatcgatctatctaccatctcgtcgtcttcgtcagcaagttatcttcagtgtcgtcgtcgtcgtgttcctgtgtcagtcagtcttgagtcgtgtgtgtcgttcggtcctgtggtgtttttgatcgcgagctcgagtgtcgctctgtccggggttaattagagctggttacgcgaggaagaaacaacatgtgttatctttcagtcggtcgtgttcgtcggtgatgcagcaatcccttctgtcatggattgggatgtgatgttggaatcctatgtttgaagtcagtttaaatggatgaagaaaatgcaagtgaaaaaaaaaaaaaaaaaaactcgatggctttgggcctttcctgcgcagcttaggtggaaggcgaagaaggcccccttccgggggggcccgagccatcagtgagataccactctggaagagctcggattntaaccttgtgtcagacccgcggnccaagggacagtctcaggtaaaaaaaaaaaaaaaaaaaaaactngag

SEQ ID NO: 32847 - DNA, 2412 bp, Triticum aestivum
  Clone ID: PAT_TA_32847
acacggaaaaatcatcacacattcaatcatatgatgcaaatttgatcatgtaccatggaacaacgacaactccaacacatcatatataccgtggtgatttcaggatcctcagcctcagtagtccgcagcccaatatacaaacagatatacaacacgccttctttcccatacacaaactacatgcatttacactcacgacatatacataaatatgtacgaagggttagctctgcgcacggagagcatgatcgtggcgaccgatcaattccagtatttacgcaccaacagctccgctgatgaagtgcctccctcccccctcatcgtcgtcaaagctcctcagaagcagaatttcttcttgcggaacttgagcatgtcttgcttgtcgatgaatgcgagcagctcgtcctgacgcatcagcgcctcgtagagggccttctttgtagaaatcaagtcggcttccaaggcgtccacacggcgggcggacgcattgagcagctcctccttctcgaatggcatctcggatggctttttttcaagcgcctgcaccttctcctccagctcacctagccgtcttaccagagttgaaaggatttccttctccgtgtaggccggggcaggagacggaggtcggaactcctccttgtactcttgctcttgagggcagtccacgtaatagtggtcgtgatcattggattggttcgagagccttttggccattctgctcgggatacttcgaagcatggcgaaaagggtcacgatgaagactgtcagccatgcgacaaccaaggtccgaattccttcgaatgtggtcggtagatttctcaaggataatgaacctgaggaagaggacactggactagctctggggctgctccatccgtcgtccacaaccttgtcaacaacagggatgctttcttcaatagtggggcgagcagcagacgtggatgcatgtgctgcaaattttgactcctcatgaacaggggtcaaagaaggattcgttatgagggtctttggtgcaataggagatgtaacatcttccacttcagacccagactcagcagatgcatcactgccctttccctgatttgggcgctgcggcctagcataaccgatgatcttgccatcagtgcctgatatggtcacgatttgtctgtcgtagtttgcctcaccattcaggaccctctttattgtggtgggatccttccaaggacctttatctgatctctgacaacctccatgttcttcacacttgcatttgccaccaagaaattctggcaattcactagcatcaattatttcaagtagcttattttggtacttggttccaagaacatgaatctttgaagcagttttcggatcaagaaaagactttattgtgccccataacatcttgaagccttggccagcattaattatgtacatccggcataatgtctctgggtagttgtcactgtcaatcttctgcagtcgggtgattagttcccttgcacatttcgagaagttcttcaatcccacgccttgcacatccagaatagttgtgcatgagtccaggtgccgttttgcagcaattgagcaagctggaaatctcatctggaaacatttctcaaactccttgacatgatatttcacatatcggtctatagttgttacttgcagcaccttgttggcatcaacttttcctattaactccacatagacaggtcttccatctttatccaccccatggtaaaactgtggataatacttcataacttcgtttaactcagcgtaatcaaattcctctatattgtcggtcccaaattcctttctccatgtaagcatatcagaccacataagctttgccttctcaacatcaaacttccgtgccttcaggaacctcagcatcatgtggtaatcatcatgttgttgtggcaacaagtcctcatcaagcaagcattgtcgaaatgcttcaacggcctgtagatcttgaacatgtcttatgtcctcgatggaaatctgattgtcattcttctttttgcttctcctccttagggaatgtctgaatttgttccctgcgttaattgcctttttcttgaaggaggctattttagtcttcttctctccttctgagttgtctgcatccgatctgctctctttctttccatcattatgtgtaaatccttcaaaagatggcctggctaatcggtcgaggggccctgacatcccctccggctccgggatcgatctcaccagcgaagctccaggcccgaaatccgttgcaggcaggcacgtacgaggcgaagtatcggggaatttcgttcccggcggagatttttcacctctcggtttcggaattcgggtgcggatttcggggcgggaggaggagcagcaggagaagcttctccttctcccaccgttttaatggggcgggcg

SEQ ID NO: 32848 - DNA, 1700 bp, Triticum aestivum
  Clone ID: PAT_TA_32848
cccgataaataacttggtatattaagtgttaatatttaatataaagtttgtcaaatatgggaaagtttaaaattcaaaaaattaatgcactttgaattttaagaacgaaaagggggtactcggttctcctttggaagacaattacagcctccacaagcacaaactggtcaagcgaaactttaggaaggaattgtacagacaagtagcttaacaacactggtgagactgaacgtgcaaactacaggagcaccgagatacaaggatattactatcaggcgactatccacaaattcatctagagtgttaatcatgtcgcccgtaggaaataaagcatcctcttaacagtttgttgcctcatttgtagaagtcaaagtctgtctcaggcttcttgacgttggttcggtaacccttttcgaagtccttggggaggataacatagcgatttttgcggacagcatgcatgccagcttcctggcaaatagcagtgatatcagcagcactgattttatcaggtctggagacataatcttccaaatcaacctcgtcactcaagttcatcttagcagtacaaacttggaaaacaagcctcttctgcctccggtccggcagggggaactcgattttcctgtccagtcttcctggacgcaacagagcaggatctagagtatctgcccgattggttgccattataaccttcacattcactgtttgatcaaatccatccatctgattcagtagctccatcagaatacgctgaacttctcggtcagccccggtctgagcatcgaatcgagcagtggctatagcatcaacctcatcaatgaatattatagccggggcattctctttagctaagcggaatacatctcgaaccatccttgggccctcacccaagtacttctgcacaaactctgaaccaaccactctgataaaagcagcagtagtgtgatgtgccacagctttagcaagcatggtcttgccagtgcctggaggaccatagagcagcacccctcttggtggatcaataccaatctgcttgtacaattcgtggtgtgtcaatggtagctcaactgcctcccgaatttcttgtttttggatatcatatcctccaatgtccgaatagaggacgttgggcttctcggacgaggcgaggagggagatgctggagtcggcctcggggggcaggacgtcgacgagcgcgttggagtggcggtgcagggcgacggaggcggagggcttgagcagctcgcggttgatggtgctgaggatgcgcacgtagtagttgctgccggtggtggagccgacgatgccgttgttgccgtcgaccatctccatgaactggccgatgacgagcggcaccgactggatccgcttgacctcctcctgcgcgcgcagcagctcgcgcttcaggttcttctgctcgtccttgacgtactcctcctggatctcgacgaactccatgtggcgctggagggacttgaggcggccgtagaggtcgtcgtcgtcctcggcggagggggcggggggcgccgcggggtaggacggcgggggcgccgacgggagcggcgccggtgggctcggcgcgacggccgcggccgacatcgcgggcggcggggcggggggctagggtttggtggcgggggcgggtctgcggttccgatccgtcgactgtggcggagcggtgtgcggaggaacctgag

SEQ ID NO: 32849 - DNA, 737 bp, Triticum aestivum
  Clone ID: PAT_TA_32849
gtcccgcgggttcggcttcgtcacgttcggcagcgaggagtcgatgcgccaggccatcgaggagatgaacggcaaggagctcgacgggcgcaacatcaccgtcaacgaggcccagtcccgccgctcgggcggagggggcggcggcggcggcggcggctacggcggccagcgcggcggtggcggaggttacggcggcggcggcggctacggaggcggcggcggcggctacggcggccagggcggtggcggctacggcggccagcgcggtggcggcggcggctacggcggcggcggcggctacggcggtggtggcggctacggcggccagcgcggcggtggcggcggcgactccggcggccagtggaggaactgagcctcgaatctcccagttatcgatctatctaccgtgtcgtcgtcgtcgtcgtcttcgtcagcaagttatcttcggtgtcgtcgtgttcctgtgtcagtctgagtcgtcgtgtgtgtggtgtttttgatcgcgagctcgagtgtcgctctgtccggggttaattagagctggttacgcgaggaagaaacaacatgtgttactatctttcagtcggtcggtcggtcggtcagtcggtgatgcagcaatccccttctgtcatggattgggatgtgatgttggaatatcctatgtttgaacaagtttaaatggatgaagaaaatgcaagtcatagctgcgaaaaaaaaaaaaaaaaaatcgcctcgtg

SEQ ID NO: 32850 - DNA, 798 bp, Triticum aestivum
  Clone ID: PAT_TA_32850
gccggccgggccgggaaaaccctccagacctgccgccgccgccccctgcaccaaccagcgccctgccgccgccgccgccggagaaggagagggagcagccgcagccatgggtcgcgtccgcaccaagaccgtgaagaagacctcccgccaggtcatcgagaagtactattctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggccgacctccccggcgtcgagcgcgcccccgaagtcacctcctccgccgccccctaccgccagccgttcaacgggccccgtggtggcaaccgcgcctaggttcctccgcatcgtcgtcgtacccctatattatgctttatgtcatttagatctgttacttgtggcaagtaatgttttgaactcagagcttaagttcgaggtgttttgatctgcgtatggtggacatgatctgtttatctcaccgtttatctgaagtgattcgatatattactgtttttctttgaagtttatgctcgttactagatgattgattgatttatgatctatctacatattgggtaatatatatatggatatcc

SEQ ID NO: 32851 - DNA, 789 bp, Triticum aestivum
  Clone ID: PAT_TA_32851
ctcgtgccgaattcggcacgaggcggtggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggaagagcaatacaagcgttgtgctgctaggcgaagcggttgagtgccgcaccctaagatggctaaagtccagtagcccgaaagcatcactagcttacgctcctgacccgagtagcatggggcaccgtggaatcccgtgtgaatcagcaaggaccaccttgcaagggctaaatactcctggggtgacccgatagcgaagtagtaccgtgagggaaaggtgaaaaagaacccccagtgggtagtgaaatagaacgtgaaaccgtgctgagctcccaagcagtgggaggggaaagtcattgtgctgaatggcgagagcggactgccggagcttccaaccccggcggtcgctgtttagttgttggtactgtatagaatacgtagaagattgttaagcatatatatacaatacagcgttttcatttccttccagcacatatctcttcataggtgcggcagtcaggtcaggtgtatataattctataactgtatgtataaaatatacagtaata

SEQ ID NO: 32852 - DNA, 3226 bp, Triticum aestivum
  unsure (1)..(3226): unsure at all n locations
  Clone ID: PAT_TA_32852
caagcgactcttctcttctcccttcttatctccttctccttggaggagaaacaaacagggccgcgctcctttctctccctctctcggtctctcatcgcaggtttgggacaacttacttttgaccatggcagggaccttagtcctgccggttgctcttgagataacttttgcaggccgtacaggcggtcggcactgcaagtctcatggaaccaggaggactccctcaatgttggcaatgtcattgaaccgtcctgtaaggatggcagcatttgtcggtctgagatcggtacatagcttctcagccatgcgctcgtccaacttcaggtcaacagttgcatcttacagattctctagacagggaaggcgtgcttcttttgtaaccagagcaatgttcgagaggtttactgagaaagctataaaggtcataatgcttgcgcaagaggaagcgaggcgcctgggccacaactttgtcggaaccgagcaagttctattgggtctggttggagaaggcactggtattgcggcaaaggtgcttaagtccatgggtataaatctgaaggatgcccgtgtggaagtggagaagatcattgggaggggcaatggttttgttgctgtcgaaataccattcacaccacgtgcaaaacgtgttttagagctttcattggaggaagctcgccagctaggacacaactatattgggtccgagcacttgcttcttggattgcttcgtgagggggaaggggtggcagctcgcgtacttgagtctcttggtgctgaccccagcaatattcgtacccaggttgtccggatgattggtgagacaacagaagctgttggtgctggagttgggggagggaacagtggtaacaagatgccgacacttgaggagtatgggactaatttaacaaaattagccgaggagggaaagctagatcctgttgttgggagggaaccacagattgaacgtgtcgtacaaattttgggcagaagaaccaagaacaatccctgcttaattggagaacctggtgttgggaaaacagctattgcagaagggcttgctcaacgcatttctagtggcgatgtgcctgagacgatagaggggaagaaggtcattacccttgatatgggacttcttgttgctggtacgaaataccgtggagaatttgaagaacggttgaagaaactgatggaagaaatcaaacagagcgatgagataattctcttcatcgatgaagttcacaccctcataggagcaggagccgccgaaggtgctattgatgctgctaatattttaaagccagcattagcaagaggagaactacagtgtattggagccaccacgcttgatgaatacaggaagcatgttgagaaagatccagcattggaaaagacgtttccagccagtaaaggtgccggaaccatcagttgatgagaccatagaaattctcagagggctccgggagcgatatgagatccatcataaacttcgttacactgatgattctttgattgcagctgctaagctatcttatcaatatatcagtgatcgtttcctcccagataaagcaattgatttgattgatgaagcaggttcacgtgttaggcttcgacatgcccaggttcctgaggaagccagagagcttgacaaggagcttaagcaaataacgaaagataaaaatgaagctgtccgtggccaggattttgagaaggctggagagttgcgagatcgtgaaatggaattgaaggcccagataacagccctgattgacaagagcaaggagatgaacaaagcagagactgagtcgggagagacggggccgatggtgcatgaatcagatatccagcacgttgtgtcatcatggactggcattccagtggagaaagtctcgacagacgaatctgataaacttcttaagatggaagagacattgcataagcgtgtcatcggccaagatgaggctgtgaaagcaataagccggtccgttcgccgtgctcgtgtgggcctcaagagccccaacagaccaattgcgagcttcatttttgcaggtcccactggtgttgggaaatcagagcttgcaaagacgctggcatcatattacttcggctctgaagaagccatgatccggctggatatgagtgagttcatggagaggcacactgtgtccaagttgatcggttcaccaccaggctatgtgggatacactgaaggtgggcaactgacggaggcggttcgacggcggccatacagcgttgtgctttttgatgagattgagaaggcgcatccggatgtgttcaacatgatgctccagatcctggaagacggaaggttaaccgacagcaaggggagaacggtggacttcaagaacacgctcctgataatgacatcaaatgttgggagcagcgtgattgagaagggagggaggaagatcgggttcgatcttgactccgacgagaaggacagcagctatggcaggatcaagagcttggtgatcgaggagatgaagcagtacttccgaccggagtttctcaaccgtctggacgagatgatcgtcttcagacagctgaccaagctggaagtcaaagagatcgcgaacataatgctgcaggaggttttcaccaggctcaagaccaaggacatcaacctgcaggtgacggagaagttcaaggagcgggtcgtggacgaagggtataaccctagctacggagcgcggccgctgaggagggccatcatgaggctcctggaggacagcctcgcggagaagattttgggcggggaggtcaaagagggcgactctgtcatcgttgatgtggacccggaggggaaagtcattgtgctgaatggcgagagcggactgccggagcttccaaccccggcggtccgctgtatagttgttgggtacctgtatagaatacgtagaagattgttaagcatatatacaatacagcgttttcatttccttccagcacatatcataggtgcagcagtcaggtcaggtgtatataattctataactgtatgtataaaatacacagtaatatgcatatataatttaaggggaaaaaaaaaaaaaaaaactcgagactagttcttcacctcggccgcgaccacgcctaatcgaattccccgcgggccgccaatggnngggccgggaacatgcnaacgtccggggcccaaattccgccctaaaagngnggtncggttttaanaantcacctggggcccgtc

SEQ ID NO: 32853 - DNA, 2037 bp, Triticum aestivum
  Clone ID: PAT_TA_32853
ttttttttttttaaaaaaaaagagcaaagcgagttcaaaatttcatcgtcatatataatttttattcatttccgtgcccccaacactagtttcaacgacttcaaccaaaaaaaaagtggaggaacattttgtacacccttccggactgccaccggaagagggccacccatgcatgattcactgaatttacaggaacatatctcatgagaacaacatcaaaccacccaactcaggtggatacacgtttctgcgaggaaaaaaacaagatcccaaagtggtccggcagtaggagttaatgaccaaaattgtatgcatcttattttccttgtgaaaaatgtgaccatagatgatcttgggagagaaaaaaatatgaacagttaacttgttcagaagcctcctcatttcgagctgaacttgccacgcaccgtctcgtaggctggtacattgagaacgtttccgtgagatgccattgtcaatggtgacgagatgatcttctcagcaacagttgatacatctgccagagttataccatcaacagccttaagaagctgctccacgggtttcctttcaccaaatgcccaatgcttggcgcccgatgtcttcagttgttgatgcctttgattccaggttcttcaagatagctgattttgcagatgctttagcacggtcccagttgggcttggtcaacttgacccaggagtagcgagggaagtgagttctcttggctgccaagtcaataactttaggaacaaatgctgcttcagtcgatgtatgaattccaaaaatgccagtgttactgtgaacatttttgaaagcggagatcgatttgatttggtcaaattcatttacgaggggatttaggcgtgaatgcaagccttttccaggtcttccccaggtaaacacgccaccaccacccagaagtgcctgaagaacagatgcagtagcaaattctttttctttcagccatccacctgggagctcaaatgccaaagcaagatctgtgttcgatgaatctgctgcccgtctatattctccccaccaacatagacagattttggctttcctgttcccagttgcagtgggaatgtcagacaggagtggttcagcaattgatacaagttcattgtggtccacaccagacgcagctagaacaattcgcggggaagtgtagttcaaagcaagaaattcttccagaacatctgtatttaatctgctaattgaagcctctgaggcaatcaatgggtttgccaaggcaccagaatagccactggaatgaagagcatccaaaaggaaagcttccggattacttgaagcttctgcaagctctgcctttagtttcattatctcttccttgacttcccaatcaagtaaagcaggatttctcacacaatcaactagcacttccaccatttcaggcatgtaagtcttaagggctccataactgtagctcatgagctcacggttggctgatgctttcgcactgccacctattgcaccaatttcacgaacaacacgcaactggctcctgtttctagtggttgtgaaggccaacttctttaataactgagtggcacccagtgtctcaggtgtttcatatacagacccacagtgaacataaactccaacagaacatgctgatcctggagatgtttcagaggcaatttttacaacatttgaaagtgttgtgatttttgtcttgccgggctccacatgatcagctagtggaggaggaatagtgactcctgggagtgcgaaatctggagggggtagtgcatttgaacgtgcacctgtcagccaacccaagaagccgcccgatgacctctgtgcaacacttgtgctagcagacctaaccgcgatattcaacagttgggtatccgccccatgctgcttgagggcgccgaggccggaggcggctcggtacatgatgaagggcgccggtggagatctgtcgacggggtcgtcgccggcggcgcggcggaagcggcggagggggagatggggacggaggacgtgagctcgtgccgaattcggcacgag

SEQ ID NO: 32854 - DNA, 762 bp, Triticum aestivum
  Clone ID: PAT_TA_32854
gccggcttgttcccaaacctactcctcctgccctcgcgccgccgcaccccgcaccaaccagcgcccagccgccgccggagaaggagacggagcagccgcagccatgggtcgcgtccgcaccaagaccgtgaagaagacctcccgccaggtcatcgagaagtactactctcggatgaccctcgacttccacaccaacaagaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggccgacctccccggcgttgagcgcgcccccgaggccacctctgccgctgcgccctaccgccagcccttcaacggaccccgcggtggcaatcgcgcctaggttcctccgcatcgtcgtcgtcgtacccctatcatctttacatgttttattattagatctgttacttgtggcaagtgatgttttgaactcagagcttaagttcgaggtattttgatctgcgtatggtgaacatgatctgtttatctcatcgtttatctgaagtgattcgatatattactgctgagctttgaagtttatgctcgttaaaaaaaaaaaaaaaaaaaaaa

SEQ ID NO: 32855 - DNA, 1023 bp, Triticum aestivum
  Clone ID: PAT_TA_32855
gccggccggttccgaatcgctctcggggttggcttctcctccccttccggttcgggttctggttcggttcgggttcggttcgagagagaggccgagtagctagcctagtctagggtttcggtagagaggaagggagatccatggcggagacggagtaccgctgcttcgtgggcggcctcgcctgggccaccgacgacaacaacctccagcaggccttcagccagtacggcgagatcctcgacgccaagatcatcaacgaccgcgagacggggaggtcccgtgggttcggcttcgtcacgttcggcagcgaggagtcgatgcgccaggccatcgaggagatgaacggcaaggagctcgacgggcgcaacatcaccgtcaacgaggcccagtcccgccgctccggcggtgggggcggcggcggcggctacggcggccagcgcggcggtggcggaggctacggcggcggcggtggcggctacggcggccagcgcggcggtggctacggcggccagcgcggcggtggcggctacggccagggcggcggtggctacggcggccagcgtggtggcggcggcggtggtggcggcggcggcggccagcgcggcggtggcggcggcgactccggcggccagtggaggaactgagcggcggggccctccagttatcgatctatctaccgtgtcgtcgtcgtcgtcatcaagttatcttcagtgtcgtcgtcgtcgtgttcctgtgtcagtcgtgttcctgtgtcgtgtgtgtcgttcggtcctgtggtgtttttgatcgcgagctcgagtgtcgctctgtccggggttaattagagctggttacgcgaggaagaaacaacatgtgttatctttcagtcggtcggtcggtcgtgttcgtcggtgatgcagcaatcccttctgtcatggattgggatgtgatgttggaatcctatgtttgaactcagtttaaatggatgaagaaaatgcaagtgatagctgcgaaataaaaaaaaaaaaaaaaaaaggcccctag

SEQ ID NO: 32856 - DNA, 846 bp, Triticum aestivum
  Clone ID: PAT_TA_32856
gtggatcccccgggctgcaggcagccacacccagaaccagctaaaccctaccatcttcggattcctctccaccggcggcctcccccgtcagatcaccatggtgagtcgacggagaagaagcagttgaacccgatgcgggagatcaaggtgcagaagcttgtcctcaacatctccgtcggggagagcggcgatcgcctcactcgcgctgccaaggtgttggagcagctgagcgggcagtcgccagttttctccaaggcgaggtacactgtcaggtcttttggcattcgtcgtaatgagaagattgcctgctatgtgacgatcaggggtgagaaggcaatgcagcttctcgagagtgggctgaaggtgaaggagtacgagctcctgaggaggaacttcagtgacactggttgctttgggtttggtattcaggagcacattgatcttggcatgaagtatgacccatcaaccggcatctacggcatggacttctttgttgttctggagcgagctggataccgtgtctcccgccggcgccgatgcaaggcccgtgttgggatccaccaaagggtgaccaaggaagacgccatgaagtggttccaggtcaagtatgagggtgtcatcctgaacaagtcccacgctagctagaaaggcttttgagtggaatcttatgtttattggatacaaagtttgcactatcaattttgcctgttccgttgggctgacctgcatctataattccaccaaatcttttcatggtttcatatttgaagttgaacatttcatcaacttttttcctactatatactattgtctatcattctctcatttagccagcaaagcaactgc

SEQ ID NO: 32857 - DNA, 852 bp, Triticum aestivum
  Clone ID: PAT_TA_32857
cccacgcgtccgcccacgcgtccgcccacgcgtccgcccacgcgtccgcccagatccgctgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcacctgtgttctccaaggcgaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttcttcgtggtgctcgagcgtgctgggtaccgcgtctcccgccgccgcaggtgcaaggcccgtgtcggtatccaccagagggtcaccaaggaggacgccatgaagtggttccaggtcaagtatgagggtgtcatcctcaacaagtcccatgcgagctaagaaggacgtagctctctttagaccttgagttaattaagttcacctggttgctggatatgtatgttacctagaaaccaaaaatgctttgtcagttttgcctgtactcaagctggatgatttctgtttgatgcgcactttcgtctaagaggctctcttctgttttatcctctctgaacaatagagtatatgtttgtcttatgatagactgccttttgtatggccactctcaaaaaaaaaaaaaaaaaa

SEQ ID NO: 32858 - DNA, 992 bp, Triticum aestivum
  Clone ID: PAT_TA_32858
ctaaagggaacaaaagctggagctccacccgcggtggcggccgctctagaactagtggatcccccgggctgcaggaattcggcaccagccgccgctccccagatcctgccaccatgtcgacggggaagaagcagctgaaccccatgcgggatatcaaggtgcagaagctcgtcctcaacatctccgtcggtgagagcggagatcgcctcacccgcgcctccaaggtgctggagcagctgagcggacagtcaccagtgttctccaaggctaggtacactgtcaggtcgttcggtatcaggcgtaatgagaagattgcgtgctacgtgactatcaggggtgagaaggcgatgcagctgctggagagtggcctgaaggtgaaggagtacgagctgctcaggaggaacttcagcgacaccggctgctttggcttcggtatccaggagcacatcgatctcggcatgaagtatgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggatgtagctctcgttagaccttgagttaattaagttcacctggttgctggatatgtatgttacctagaaaccaaatcctttgtcagttttgcctgtactcaagctggatgatttctgtttgatctgcactttcgtctaagaggctcactactgttttatcctctttgaacaatagatgtttggcttatgtgatgacctgccttttgtttggtcactctcgaatctgctctaagtttttggctcgtccacctgaattttggtgcgccctacgcgatgaccattgtatctttcaagttgccactgcttccttatatttgtctataaaaaaaaaa

SEQ ID NO: 32859 - DNA, 815 bp, Triticum aestivum
  Clone ID: PAT_TA_32859
gccggccggttcagggccgccgcagccacacccagaaccagctaaaccctaccatcttccgcttcctctccaccggcggcctccccggtcagatcaccatgtcgacggagaagaaacagttgaacacgatgcgggagatcaaggtgcagaagctcgtcctcaacatctccgtcggcgagagcggcgatcgcctcactcgagctgccaaggtgttggagcagctgagcgggcagtcgccagttttctccaaggcgaggtacactgtcaggtctttcggcattcgtcgtaatgagaagattgcctgctatgtgacgatcaggggtgagaaggcaatgcagcttctcgagagtgggctgaaggtgaaggagtacgagctcttgaggaggaacttcagtgacactggttgctttgggtttggtattcaggagcacattgatcttggcatgaagtatgacccatcaaccggcatctatggtatggacttcttcgtggttctggagcgagctggataccgcgtctcccgccggcgccgatgcaaggcccgtgttgggatccaccaaagggtgaccaaggaagacgccatgaagtggttccaggtcaagtatgagggtgtcatcctgaacaagtcccacgctagctagtaacctttcgagtgattgagttgtcgttagagctttaagtcagtcaagcttaatctggatcatggaatcgtatgtttattgaatacaaagttgcactatcaattttgccttgtctgctgggctgacctgcatctataattccatcaaatcttcatggtttcatattagttgaac

SEQ ID NO: 32860 - DNA, 855 bp, Triticum aestivum
  unsure (1)..(855): unsure at all n locations
  Clone ID: PAT_TA_32860
gccggccgggttcgggaccctacccctccagccctcgcgccgccgcaccaccaaccagcgccgtcgccgccgccgccgccggagaaggagagggagcagccgcagccatgggtcgcgtccgcaccaagaccgtgaagaagacctcccgccaggtcatcgagaagtactactctcggatgaccctcgacttccacaccaacaagaaggtgctagaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagatccgcgtcgacaaggagaccatggacatgctggcgttcctcggcatggctgacctccccggcgtcgagcgcgcccccgaaaccacctctgccgccgccccctaccgccagcccttcaacggaccccgcggtggcaaccgcgcctaggttcctccgcatcgtcatcgtacccctatattatgctttatgtcttttagatctgttacttgtggcaagtaatgttttgaactcaaggcttaagttcgaggtgttttgatctgcgtatggtggacatgatctgtttatctcaccgtttatctgaagtgattcgatatattaaaaaaaaaaaaaaactcgagactagttctctggtgccgaattcctgcagcccgggggatccactagttctagagcggccgccaccgcggtggagctccagcttttgttccctttagtgngggttaatttcgagctnanggntcat

SEQ ID NO: 32861 - DNA, 2683 bp, Triticum aestivum
  Clone ID: PAT_TA_32861
cgaattcgcggccgcgtcgaccctcctcctctccccctatcgtcttcctccccatctccggcgccgctccgcgactcctccgctccaaggaaagatggcgtcccacattgttggataccctcgcatgggccccaagagggagctcaagtttgccttggagtctttctgggatgggaagagcagcgctgaggatttggagaaggttgccgccgacctcagggccagcatctggaagcagatgtcagaggctgggattaagtacattcccagcaacaccttctcatactatgaccaggtgcttgacacaacggccatgcttggtgccgtcccggaccgctactcatggactggcggagagattggccacagcacctacttctcaatggccaggggcaatgccactgtccctgctatggagatgaccaagtggtttgacaccaactaccacttcattgtgcctgaattgagcccagcaaccaagttctcatatgcttcacacaaggctgtctctgaatacaaggaggcaaaggcgctcggtgttgacactgttccagtgcttgttggaccagtctcatacttgctgctctccaaggcagcgaagggtgtggagaaatcattctctcttctttcacttcttgatagcattcttcccatctacaaggaagttgtggctgagctgaaggcagctggtgcttcatggattcagtttgatgagcccacccttgttaaggaccttgctgttcacgaattggccgcgttctcttcagcatatgctgaactcgaatcggcactctctggattgaatgtgcttattgagacatactttgccgatgttcctgctgaatcttacaagaccctcacatcattgagtggcgtgactgcctatggttttgatcttgttcgtggaactaagacacttgaacttatcaagagcgctggtatcccatctgggaagtacttatttgctggtgttgtagatggaaggaacatctgggctgatgatctcgctgcatctctcagcactcttcagtctcttgaggctgttgttggcaaggacaagcttgtggtgtccacctcctgctctctgatgcacactgctgttgatcttgtgaacgagactaagcttgacagtgagatcaagtcatggctcgcatttgctgcccaaaaggtggttgaggtgaatgcacttggcaaggctttggctggtctcaaggatgaggcctactttgccgccaatgccgctgctcaggcctcaaggaggtcgtcacccagagtgaacaatgaggaggttcagaaggctgcggctgctttgaagggctctgaccaccgccgtgctacccctgtttctgctagactggacgctcagcagaagaagctcaaccttcctatcctcccaactacaacaatcggttcattccctcagacaatggacctcaggagggtccgccgtgagtacaaggcgaagaagatctctgaggaggagtatgtcagtgctatcaaggaagaaattagcaaggttgtcaagatccaagaggagcttgacatcgatgtgctcgtccatggaagagcctgagagaaatgacatggttgagtactttggcgagcaattatctggttttgcatttactgccaaatgggatgggtgcaatcctatggatcacgttgccgttaaaccaccgatcatctatggtgatgtcagccgccccaaccccatgacagtcttctggtccaagatggctcaggacatgacccctcgcccaatgaagggaatgctgactggccctgtcacaatcctcaactggtcttttgtcaggaacgaccagccaaggtttgagacatgctaccagattgctcttgccattaagaaggaggttgaggatcttgaagctggtggtattcaggtgatccagattgacgaggctgctctaagagagggtctgccacttcgcaagtcggagcatgctttctacttggactgggctgtccactcattcagaatcaccaactgcgggtgtgcaagacaccactcagattcacactcacatgtgctactccaacttcaacgatatcatccactccatcatcaacatggacgccgacgtcatcaccattgagaactcccgctccgacgagaagctcctgtcggtcttccgtgagggcgtgacctacggagccggcattggcccaggcgtctatgacatccactcccccaggatcccctccacggaggagattgccgaccgcgtcaacaagatgctcgcggtcctcgacaccaacatcctgtgggtgaaccctgactgcggcctcaagacccgcaagtacacggaggtgaagcccgccctgaccaacatggttgccgcggccaagctcatccgcacccagctcgccagcacaaagtgaggagccacggaagcgagcagcctgatactactgcctattgttttgtggggacagagtgccaaatgatccacatttgtttcgaataatccgattctttatcgtaccgccggtgtttcgctaggctagtcttgctacggtaaactgttatgtgttgacatgttgtatctatgtttggtggctgtgcggtcttgagcttgtgtctcgttgcggttataaagggagttgaaaattgttgtgcatcaaaaaaaaaaaaaaaactcgagacctcggccgcgaccacgct

SEQ ID NO: 32862 - DNA, 923 bp, Triticum aestivum
  unsure (1)..(923): unsure at all n locations
  Clone ID: PAT_TA_32862
attcggcacgaggctcctcccctcccccgccgccgctccccagatcccgccgccatgtcgacggagaagaagcagctgaaccccatgcgggacatcaaggtgcagaagctcgtcctcaacatctccgtcggcgagagcggagatcgcctcacccgcgcctccaaggtgctggagcagctgagcggacagtcaccggtgttctccaaggcgaggtacactgtcaggtcgttcggtatcaggcgtaatgagaagatcgcctgctatgtgactatcaggggtgagaaggcgatgcagctgctggagagtggcctgaaggtgaaggagtacgagctgctcaggaggaacttcagcgacaccggatgctttggcttcggtatccaggagcacatcgatctcggcatgaagtacgatccatctaccggcatctacggtatggacttctttgtggtgctcgagcgtgctgggtaccgcgtctcccgccgccgcaggtgcaaggcccgcgtcggtatccaccagagggtcaccaaggaggacgccatgaagtggttccaggtcaagtacgagggtgtcatcctcaacaagtcccatgcgagctaagaaggacgtagctctctttagaccttgagttaatgaagttcacctggttgctggatatgtatgttacctagaaaccgaaatgctttgtcagttttgcctgtactcaagctggatgatttctgtttgatctgcactttcgtctaagaggctcactactgttttatcctctttcaacaatagagtatatgtctggcttatgtgatgacctgccttttgtttggttactctcgaatcttctctaattttttggttcgtccacccgaatttcgtgcgccctacgtgatgaccattgtatcttccaagttgcaacctcttnccttatattt

SEQ ID NO: 32863 - DNA, 1462 bp, Triticum aestivum
  Clone ID: PAT_TA_32863
aaccaaacaaaaggcaggtcatcacataagccagacatatactctattgttgaaagaggataaaacagtagtgagcctcttagacgaaagtgcagatcaaacagaaatcatccagcttgagtacaggcaaaactgacaaagcatttcggtttctaggtaacatacatatccagcaaccaggtgaacttcattaactcaaggtctaaagagagctacgtccttcttagctcgcatgggacttgttgaggatgacaccctcgtacttgacctggaaccacttcatggcgtcctccttggtgaccctctggtggataccgacgcgggccttgcacctgcggcggcgggagacgcggtacccagcacgctcgagcaccacaaagaagtccataccgtagatgccggtagatggatcgtacttcatgccgagatcgatcggacgcgtgggcggacgcgtgggcagacgcgtgggcggacgcgtgagcggacgcgtgggcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggctacggcggcggcggcggtggctacggcggccagggcggtggcggctacggccagggaggcggtggcggctacggccagggcggtggtggctacggcggccagcgcggtggcggcggctacggcggcggcggcggcggctacggcggcggcggtggtggctacggcggccagcgtggtggcggtgactccggcggccagtggaggaactgagcggcggggccctccagttatcgatctatctaccatctcgtcgtcttcgtcagcaagttatcttcagttcctgtgtcagtcagtctgagtcgtcgtgtgtgtcgttgagtcctgtggtgtttttgatcgcgagctcgagtgtcgctctgtccggggttaattagagctggttacgcgaggaagaaacaacatgtgttatctttcagtcttggtcggtcggtcgtcggtgatgcagcaatcccttctgtcatggattgggatgtgatgttggaatatcctatgtttgaactcggtttaaatggaagaaaatgcaagtcgtcatagctgcgaaataaaaaaaaaaaaaaaaaaaaaaaaaaaaaaaaaaaaaaaaaac

SEQ ID NO: 32864 - DNA, 722 bp, Triticum aestivum
  Clone ID: PAT_TA_32864
ttcggcacgaggaccccaatcagaaatctcaagcttagcacagcaccaatggcgtcggagcagaccttcatcatgatcaagcctgatggcgtccagaggggcctcatcggtgaggtcatcagccgcttcgagaagaagggcttctacctcaaaggtctgaagctccagaacgtggagaagtcgttcgccgagcagcactacgccgatctgtcctccaagcccttcttcgctgggctcgtggagtacatcgtctccggccctgtcgtcgctatggtctgggagggcaagagcgtcgtctccactggacgcaagataattggcgccaccaaccccctggcctctgagcccggcaccatccgtggtgactttgccgtcgacatcggcaggaacgtcatccatggaagcgactcagttgagagtgcgaggaaggagatcgccctgtggttccctgagggcattgcagagtggaggagcagccagcacaactggatctatgaggcctaagatgtgtcatgagtggttgagtgcaggtttcattaagcatctaccaaactagtctttggttgtttacagttttgagatttgtatcttgggaaccttgtttgtgtgaactgaagttatctccttgtgcttgggcatccaagcggtatctgctgctctatatttgatatatggtattgctttgatatgagttgcatttaaaaagaaaaaaaaaaaaaaaa

SEQ ID NO: 32865 - DNA, 2676 bp, Triticum aestivum
  Clone ID: PAT_TA_32865
ccccgcgtccggcctcccctcctcctcctcctccccgttgctcgccgccgtccccctccgcctccgcgcacccaggaaagatggcgtcccacattgtcggatacccgcgcatgggccccaagagggagctcaagtttgccctggagtctttctgggatggcaagagcagcgctgaggatttggagaaggttgccaccgacctcagggccagcatctggaagcagatggctgatgctgggatcaagtacatccccagcaacaccttctcctactatgatcaggttcttgacaccaccgccatgctcggtgccgtcccagaccgttactcatggaccggtggggagatcaatttgagcacctacttctcgatggctaggggtaacgccaccgtccctgctatggagatgaccaagtggttcgacaccaactaccactttatcgtccctgaattggctcctagcaccaagttctcctactcttctcacaaggctatcaatgagtacaaggaggctaaggcgcttggcgttgataccgtcccagtacttgtcggaccagtctcatacttgttgctctcaaaggccgccaagggtgtagagaaatcattctctcccctttcccttcttagcagcatccttcccgtctacaaggaggttattgctgagttgaaggcagctggcgcttcatggattcagtttgatgagcccacccttgttaaggaccttgaatcccaccaattgtctgcattctctgcagcttacgcagaacttgagtccgcactttctggattgaacgttcttgttgagacctacttcgctgatgttcccgcagactcgtacaagactcttacatcattgagcagtgtgactgcttatggttttgaccttgaacgtggaaccaagactcttgagcttgtcaagagtggtttccctgctggaaagtacctctttgctggtgtcgtagatggacgcaacatttgggctgatgaccttgctgcatctctcgccactcttcagtctcttgaggctgttgttgggaaggacaagcttgtcgtatcgacttcctgctcactcatgcacactgctgtggaccttgtaaatgagaccaagcttgatgatgagattaagtcatggctcgcatttgccgcccaaaaggtcgttgaggtgaacgcccttgccaaggcattggctggtcaaaaggatgaggcttactttgcagcaaatgctgctgctctggcctcaagaaggtcgtcaccacgtgtcacaaatgaggaggtccagaaggctgctactgccctcaagggctctgatcaccgccgtgctaccaccgttagcgctaggttggatgcgcagcagaagaagctcaaccttccggtccttcccacgaccaccattggatcattcccacagaccgtggagctcaggagagtccgccgtgagtacaaggcaaagaagatctctgaggaggagtacaccaatgccatcaaggaggaaattagcaaggttgttaagatccaagaagagcttgacattgatgtgcttgtgcacggagagccagagaggaacgatatggttgagtacttcggtgagcagctctctggtttcacattcactgccaatggctgggtgcaatcttatggatcaaggtgtgtcaagccaccgattatctacggtgatgtgagccgccccaaccccatgactgtgttctggtccaagatggcacagagcatgactgctcgcccaatgaagggaatgttgacaggccctgtcacaatccttaactggtcttttgttagaaatgaccaaccgaggtttgagacttgctaccagattgctcttgcaatcaagaaggaggtcgaggaccttgaggctggtggtattcaggtcatccaaattgacgaggctgctttgagagagggtctgccactccgcaagtctgagcatgctttctacttggactgggccgtgcactccttcaggatcaccaactgcggtgtgcaggacaccacccagatccacacccacatgtgctactccaacttcaacgacatcatccagtccatcatcaacatggacgctgatgtgatcaccatcgagaactcgcggtccgacgagaagcttctgtccgtcttccgcgagggtgtggtgtacggtgctggcattggcccgggtgtgtacgacatccactcccccaggatcccgtccaaggaggagattgccgaccgtgtcaacaagatgctcgcggtcctggacaccaacatcctgtgggtgaaccctgactgcggtctcaagacccgcaagtacgccgaggtcaagcctgccctcaccaacatggttgaggccgccaagcagatccgtgccgagctcgccaaggcgcagtaagccgtgctcgtatagcagagccccccttttaattgcaaggaggatgtcaccaccatagccgtgtttactttgaataatctgggtctcgtatccacttgttggctaggctagtttgtttctcggcgccatgtgctcatcccttgatttggtggtttttgaggcggtttgtcggtgtgtattgtaaactgagtggcgaattgttcatctaagtcttgagtttgttacgttatgtttcaaattacaaaatttctccagatgttctgccttagtctcacatggttcgttgttaaaaaaaaaa

SEQ ID NO: 32866 - DNA, 862 bp, Triticum aestivum
  Clone ID: PAT_TA_32866
ctcgtgccgaattcggcacgagcaaaaccgaatcagaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcgtcgccactggacgcaagatcattggcgccaccaaccccctggcctctgagcccggcaccatccgtggtgactttgccgtcgacatcggcaggaacgtcatccatggaagcgactcagttgagagtgccaggaaggagatcgccctgtggttccctgagggcattgcagagtggaggagcagccagcacaactggatctatgaggcctaagatgtgtcatgagtggtttgagtgcaggtttcattaagcatctaccaaactagtctttggttgtttacagttttgagatttgtatcttgggaaccttgtttgtgtgaactgaagttatctccttgtgcttgagcatgcaagcgttatctgctgctctatatttgatatatggtattgagttgcatttcatgtttttgccgtgctttgattatttctttgccctatttttttgtgggttagtagcagaattgtactcatgatactatagaattgtagtgcttaattttgttgatgcacactcgatactatagaattgtttaacatcgttaaaaaaaaaaaaaaaaaaaa

SEQ ID NO: 32867 - DNA, 2800 bp, Triticum aestivum
  Clone ID: PAT_TA_32867
aattcggcacgaggctctcctcctccccgttgctcgccgccgtccccctccgcctccgcgcacccaggaaagatggcgtcccacattgtcggatacccgcgcatgggccccaagagggagctcaagtttgccctggagtctttctgggatggcaagagcagcgccgaggatttggagaaggttgccaccgacctcagggccagcatctggaagcagatggctgatgctgggatcaagtacatccccagcaacaccttctcctactatgatcaggttcttgacaccaccgccatgctcggtgccgtcccagaccgttactcatggaccggtggggagatcaatttgagcacctacttctcgatggctaggggcaacgccaccgtccctgctatggagatgaccaagtggttcgacaccaactaccactttatcgtccctgaattggctcctagcaccaagttctcctactcttctcacaaggctatcaatgagtacaaggaggctaaggcgcttggcgttgataccgtcccagtacttgtcggaccagtctcatacttgttgctctcaaaggccgccaagggtgtagagaaatcattctctcccctttcccttcttagcagcatccttcccgtctacaaggaggttattgctcagctgaaggcagctggcgcttcatggattcagtttgatgagcccacccttgttaaggatcttgaatcccaccaactgtctgcattctctgcagcttactcagaacttgagtcggcactttctggattgaacgttcttgttgagacctacttcgctgacgtccctgcagactcatacaagattcttacatcattgagcagtgtgactgcttatggttttgaccttgaacgtggaaccaagactcttgagcttgtcaagagtggtttccccgctggaaagtacctctttgctggtgtcgtagatggacgcaacatttgggctgatgaccttgctgcatctctcgccactcttcagtctcttgaggctgttgttgggaaggacaagcttgtcatatcgacttcctgctcactcatgcacactgctgtggaccttgtaaatgagaccaagcttgatgatgagattaagtcatggctcgcatttgccgcccaaaaggtcgttgaggtgaacgcccttgccaaggcattggctggtcaaaaggatgaggcttacttctctgcaaatgctgctgctctggcctcaagaaggtcgtcaccacgtgtcacaaatgaggaggtccagaaggctgccaccgccctcaagggctctgatcaccgccgcgctaccaccgttagcgctaggttggatgcgcagcaaaagaagctcaaccttccgatccttcccacgaccaccattggttcattcccacagacagtggagctcaggagagtccgccgtgagtacaaggcaaagaagatctctgaggaggagtacaccaatgccatcaaggaggagattagcaaggttgttaagatccaagaagagcttgacattgatgtgcttgtgcacggagagcctgagaggaacgatatggttgagtatttcggtgagcagctctctggtttcacgttcactgccaatggttgggtgcaatcttacggatcaaggtgcgtcaagccaccgatcatctatggtgatgtgagccgccccaaccccatgaccgtcttctggtccaagatggcgcagagcatgactgctcgcccaatgaagggtatgctgacaggccctgtcacaatccttaactggtcttttgtcagaaatgaccaaccgaggtttgagacttgctaccagattgctcttgcaatcaagaaggaggtcgaggaccttgaggctggtggtattcaggttatccaaatcgatgaggctgctttgagagagggtctgccactccgcaagtcggagcatgctttctacttggactgggccgtgcactccttcaggatcaccaactgcggtgtccaggacaccacccagatccacacccacatgtgctactccaacttcaacgacatcatccagtccatcatcaacatggacgccgatgtgatcaccatcgagaactcgcggtccgacgagaagcttctctccgtcttccgcgagggcgtggtgtacggcgccggcattggcccgggcgtgtacgacatccactcccccaggatcccgtccaaggaggagatcgccgaccgtgtcaacaagatgctcgcggtgctcgacaccaacatcctgtgggtgaaccccgactgcggtctcaagacccgcaagtatgccgaggtcaagcccgccctcaccaacatggtcgaggccgccaagcagatccgcgccgagctcgccaaggcgcagtaagccgtatagcagctcccccattttaattgcaaggaggatgtcgccaccatagccgtgtttactttgaataatctgggtctctgtatccacctgttggttaggctagtttgtttctcggcgcggcgcggcgccatgtgctcatccctttgatttggtggtttttgaggcggttgtcggtgtgtattgtaaactgagtggcgaattgttcatcatctaagtcttgagtttgttacgttacgttttcaaattacaaaatttctccggatgttcccccgtcggccgtgttggtgtaacgccttcaggttcagtccagcagttaactgaaccctgaagcgtacagcgaggcactcagtgcaattgtagtgttgggccgcggccatgtaagcgtgtgtgtgcaagtgtggccttgggccagttttaagtaaaacca

SEQ ID NO: 32868 - DNA, 2657 bp, Triticum aestivum
  Clone ID: PAT_TA_32868
cgtccgcggacgcgtgggctctcctcctcctcctccccgttgctcgccgccgtccctctccgcctccgcgcacccaggaaagatggcgtcccacattgtcggatacccgcgcatgggccccaagagggagctcaagtttgccctggagtctttctgggatggcaagagcagcgccgaggatttggagaaggttgccaccgacctcagggccagcatctggaagcagatggctgatgctgggatcaagtacatccccagcaacaccttctcctactatgatcaggttcttgacaccaccgccatgctcggtgccgtcccagaccgttactcatggaccggtggggagatcaatttgagcacctacttctcgatggctaggggtaacgccaccgtccctgctatggagatgaccaagtggtttgacaccaactaccacttcatcgtccctgaattggctcctagcaccaagttctcctactcttctcacaaggctatcaatgagtacaaggaggctaaggcgcttggcgttgataccgtccccgtacttgtcggaccagtctcatacttgttactctcaaaggccgccaagggcgtagagaaatcattctctcccctttcccttcttagcagcatccttcccgtctacaaggaggttattgctgagttgaaggcagctggcgcttcatggattcagtttgatgagcccacccttgttaaggaccttgaatcccaccaattgtctgcattctctgcagcttacgcagaacttgagtccgcactttctggattgaacgttcttgttgagacctacttcgctgacgttcccgcagactcgtacaagactcttacatcattgagcagtgtaactgcttatggttttgaccttgaacgtggaaccaagactcttgagcttgtcaagagtggtttccctgctggaaagtacctctttgctggtgtcgtagatggacgcaacatttgggctgatgaccttgctgcatctctcgccactcttcagtctctcgaggctgttgttgggaaggacaagcttgtcgtatcgacttcgtgctcactcatgcacactgctgtggaccttgtaaatgagaccaagcttgatgatgagattaagtcatggctcgcatttgccgcccaaaaggtcgttgaggtgaacgcccttgccaaggcattggctggtcaaaaggatgaggcttacttcgcagcaaatgctgctgctctggcctcaagaaggtcgtcaccacgtgtcacaaatgaggaggtccagaaggctgctactgctctcaagggctctgatcaccgccgtgctaccaccgttagcgctaggttggatgcgcagcagaagaagctcaaccttccggtccttcccacgaccaccattggatcattcccacagaccgtggagctcaggagagttcgccgtgagtacaaggcaaagaagatctctgaggaggagtacaccaacgccatcaaggaggaaattagcaaggttgttaagatccaagaagagcttgacattgatgtgcttgtgcacggagagccagagaggaacgatatggttgagtacttcggtgagcagctctctggtttcacattcactgccaatggctgggtgcaatcttatggatccaggtgcgtcaagccaccgattatctatggtgacgtgagccgccccaaccccatgactgtgttctggtccaagatggcacagagcatgactgctcgcccaatgaagggaatgttgacaggccctgtcacaatccttaactggtcttttgtcagaaatgaccaaccgaggtttgagacttgctaccagattgctcttgcaatcaagaaggaggttgaggatcttgaggcaggcggtattcaggtcatccaaattgacgaggctgctttgagagagggtctgccactccgcaagtctgagcacgctttctacttggactgggccgtgcactccttcaggatcaccaactgcggtgtccaggacaccacccagatccacacccacatgtgctactccaacttcaacgacatcatccagtccatcatcaacatggacgctgatgtgatcaccattgagaactcgcggtctgacgagaagcttctctccgtcttccgcgagggtgtggtgtacggtgcaggcattggcccgggtgtgtacgacatccactcccccaggatcccgtccaaggaggagattgccgaccgtgtcaacaagatgctcgcggtgctcgacaccaacatcctgtgggtgaaccctgactgcggtctcaagacccgcaagtacgccgaggtcaagcctgcgctcaccaacatggttgaggccgccaagcagatccgcgccgagctcgccaaggcgcagtaagccgtgcttgtatagcagctccccacttttaattgcaaggaggatgtcaccaccatagccgtgtttacttttgaataatctgggtctcgtatccacttgttggttaggctagtttgtttctcggtgcggcgcgatgtgctcatcccttgatttggtggtttttgaggcggttgtcggtgtgtattgtaaactgagtggcgaattgttcatctaagtctgagtttgttacgttatgtttcaaattacaaaatttctccagatgttctgtcttagtctc

SEQ ID NO: 32869 - DNA, 1957 bp, Triticum aestivum
  Clone ID: PAT_TA_32869
cccacgcgtccgccaccacccacctccgacgtgcacacgcgccgcactcctctctatatatccccacgcctccaatcgccaccactcgccgcccacctccccctctccactccccccctccgccgacgaccaccactccccccttcctcctcctcctccgccgccgccgcagcaatggactccgtcgcgtcgtgggggctgaccccgctggcggacgcggacccggacgtcttctacctcatcgagcgggagaagcggcgccagcggagcgggatcgagctcatcgcctcggagaacttcacctccttcgccgtcatcgaggcgctgggctcggccctcaccaacaagtactccgagggcatgccgggggcgcgctactacggcggcaacgacgtcatcgacgagatcgagaacctctgccgcgaccgcgccctcgccgccttccgcctcgacgccgcctcctggggcgtcaacgtgcagccctactccggctcgcccgccaacttcgccgcatacaccgcgctcctcaacccgcacaactggatcatggggctcgacctcccctcaggcggccacctcacccacggctactacaccgccgggggggaagaagatctccgccacctccatctacttcgagagcctgccctacaaggtcagcgccgccaacggctacatcgactacgacaagctcgaggagaaggccatggacttccgccccaagctcatcatctgcggaggcagcgcctaccccagggactgggactacgccaggctcagggccgtcgccgacaaggtcggggccatgctcctctgcgacatggcgcacatcagcggactggtcgccgcgcaggaagctgcaaatccttttgagttctgtgatgtggttaccactacaacacacaagtctctccggggaccgagggctggcatgatcttctacaggaaaggccctaagcctgcgaagaagggccagcctgagggtgctgtgtatgactatgaggacaagatcaactttgcggtgttcccatcgctccagggtggtcctcacaaccaccagattgctgcccttgcagttgccctgaagcaaactttgactcctggattcaaggcctacgcaaagcaggtcaaggccaacgctgttgccgttggaaaatatctcatgagcaagggttacaagatggtgaccgatggaactgacaaccatcttgttctatgggatctccgccctcttggcttgactggaaacaaggtcgaaaagatgtgtgacctttgcagcattacattgaacaagaatgctgtcttcggtgacagcagtgcattgtccccgggtggtgtccgcattggtgctcccgcgatgacttccaggggtctggtcgagaaggacttcgagcagatcgccgagttcctccaccaggctgtgaccatctgcctgaacatccagaaggagcacggcaagctgctcaaggacttctccaagggcctggtgaacaacaaggacatcgagaacctcaaggttgaggtcgagaagtttgccctctccttcgacatgcctgggttctcgctcgagagcatgaagtacaaggagtaggatgatgatacatatggtgtggttgtctccgctaatcgtccatacgcctcgcgcttctaagccttcttggccgccgcgcaatgccacagtgctgtgcttctatgagatttgtctgctcgccctggagccctggatagttctgtaaacgcgtcccacctttatgctctgtttgccgtccacattccatcatatttctttctaggaattgttcgcctgggatcatggaatgtcgagtatttgccaataatcttccatattatttttgtgtatgctctgcatatgggaaaaatatatgtgttattttctttgttgagaaagaaaactgtggtgctacatagtctgatcaatcaactcaacgttacactg

SEQ ID NO: 32870 - DNA, 1159 bp, Triticum aestivum
  Clone ID: PAT_TA_32870
gaagaagctgggccacaccttctcccgcttcgtctcctccaaacacccattcaacctcgtccgcggctgccccttcgtcaccgtcgccaccgccgaggccgccggccccgtcgacgtctccgtcgcctccgtccacgccttcctcgaggccgcgccctgcgacgacgcgcgcaccaagtggcgcctccgcatgaacagcggccagaccttcctcctctacgcctccgcgccgatcagcctgtcgcagtccagcgtcacgcagctcgcggcgccggggttctccggcgtcatccggatcgcctacctgccggacccggccatggaggcggtcctcgaccagtacagccgctgctacccgacggccggggaggccgcgctgaacaggcccttctgcatcgactacacatggcgcaagcaggggtggggggatctgctcatgctcgccaacccgctccacctccggctgctctccgacgactgctccgttcgggtgctcgacgacttcaagtaccggagcatcgacggggacctggtcggcgtcgtcggcgactcctgggtcctgaagaccgaccccttgtccccaacatggcattccacccggggcgtcaacgacgacggggtcgacgaggtcgtggccgcgctgcgcaaggacgttgacagccttgcttccagccccatcacgaccacctcctcctacttctacggcaaggccattgccagggcggcgaggctggcgctgatcgccgaggaggtcgggtgccccgacgtcatccccgcggtgcatcggttcttgaaggccaccgtcacgccgtggctggacggcagcttccaggggaatggcttcctgtatgatcccaaatggggcggccttgtcaccaagcaggggctgcaggactccggcgcagactttggcttcgggatctacaacgatcaccactaccatttgggctacttcctgtatgccattgctgtgcttgccaagatcgagggatcctggggaaggaagttcatgtctcaggcctactccatggttgccgatttcatgacattgtcccgcaagtgcggtgcgagctacaccaggctgaggacttttgatctctggaagctgcattcctgggccggaggactgacagagttcggcgatgggcgcaaccaggag

SEQ ID NO: 32871 - DNA, 781 bp, Triticum aestivum
  Clone ID: PAT_TA_32871
ccgcccccagcgccgtgacgccgccgaaaccccttcgccggcgtcccggaaagcggcctctgctcctccccctgccgaagcacggccactctaccgcgccggtgtcctcgtcgtctctaccctccaccggactcgcgtggggttaagacgcatccaggcgcccatgcagtccgccgccgctccgacgagggcagggagccgcctctgcacgcgctgcggcgagcggaaggccgcgctcaagcggcccaaaaccctagaacagatatgtagggaatgcttctatattgtcttcgaggacgagattcatcaaactattgttgacaataatttgtttaaagccggtgaacgtgtggcaattggagcttctggtggaaaagattcaaccgtgcttgcgtatgtgttatcagagttaaacaaacgtcataaatatggtctcgatttgttccttttatctattgacgaaggaatcacaggctatagagacgactccctagaaactgttaaaaggaatgaactacagtatggcctaccactgaaaatagtttcctataaggatctctatgactggacaatggatgatattgtgaaagcaattggcctgaagaacaattgtactttctgtgggtgtttttcgacgtcaggcgctagaccgaggtgctgctctcttgaaggttgataagattgtaactgggcataatgcagatgacattgcagagactgtcttgctgaatttttacgtggtgatattgcaggggtaagtcgatgcactttcataactact

SEQ ID NO: 32872 - DNA, 996 bp, Triticum aestivum
  unsure (1)..(996): unsure at all n locations
  Clone ID: PAT_TA_32872
tcgtcgggagaacaacgcgggaagcgacggcgacgatttacaacattacaggagccattgagaggatgcagaacatatcgaagctatacaacattagtagccaatcctttgatcatctgaactccacagtaaaggcactgaactctgaagctgtggaaattcaggcgaaggccggggaggacatgcgcttggtcagcaaaggcatcaacacattagaacttgtcatcattttaaccgtgacgctgaatcttgtcgtggtccttgtcttgctagtgggaagacctctgaggctacagaagttgtactatatgtgcatagccttgtgctgggtactgacagtcctcttctggatgtacttcgggctgtactacttcctcgacaagttcgccggcgacacgtgtgcggccctcgaggagtaccagctgaaccccaagaacagcacgctgggcgccatcataccctgcagcgagaagatgtccgggagcgtcatcctgcacgatgttggtgcaggcatacatgacatcatagaccaggtgaattcgaacatttacatgatcaagtcggagtacaccgtgaagcagctggactacatctgcaacccgttcgccgggccgccggggtaccggtaccggccggagaactgcgcttccggcgccgccaccattggtgacatccctcagatcctgaggaggctgacgtgctcggagttgggcggtggcgccaactgcgcgccggccgacctctcgtcggcgatcgactacgacaaggtgcagacctacacgagctccatccagaacgtgctggacatcttcccgggcacggagcggctggtgagctgcgagctggtgaaggccggcttcgcggacatcgtgggcaaccagtgcgcgccgctgcgccgcggcgcgcgggcgacgtgggccgcgctcgccgncctgtcgatggccatggcactgctcgtgctcnnctcggcggcgtgcggcggcgtcggaaggtcgc

SEQ ID NO: 32873 - DNA, 1195 bp, Triticum aestivum
  Clone ID: PAT_TA_32873
cccacgcgtccgcaaacgcgtattgcctcctacgcccccggatccgctgctccaccccccaactccgttgccacacgcccttgcacaagcgagcgagcaaccatgtcgccggcggagcagacgcgagacgagagcgtctacatggccaagcttgcggagcaggccgagcgctacgaggagatggtggagttcatggagcgcgtcgcgaaggccaccggcggggcagggcccggggaggagctatccgtcgaggagcgcaacctgctctctgtggcttacaagaatgtcatcggggcccggcgcgcgtcctggaggatcatctcctccatcgagcagaaggaggaaggtcggggcaacgacgcgcacgccgctaccatccgctcctaccgcagcaagatcgaggccgagctcgcaaagatctgcgacggcatcctcgccctgcttgattcccacctcgtgccatccgccggagctgccgagtccaaagtcttctatctcaagatgaagggcgactaccacaggtaccttgcagagtttaagtccggtgaggagaggaaggaagccgccgagagcaccatgaacgcgtacaaagctgctcaggatatcgccctagcagatttggctccaacccaccccatcaggcttgggcttgcactcaacttttctgtgttctactatgagatcttgaactcccctgaccgcgcctgcaaccttgcgaaacaagcctttgatgaggctatatcagagctggacagtttaggcgaggaatcctacaaggacagcactttaatcatgcagctcctgcgtgacaatttgactctatggacatccgacaccaatgaggatgacgttgatgagattaaggaagccccagttccaaaagaatctggagacggacagtgaggtgaatgaaaacaacagtctgtgcattgttgggggcaatggaagtcggtcttggttctagtgctcatactgttgtcatcactacctctgtttaattatgcacttaagaagtttcttggctatgtttttctggtgctgataaatgctggctggattcgtgttttcttgttcaaatctggccacaagcaaaagacctgccctttttcaccattagaatgtttgctatatctaccatgtttggcgagacttgatgcaactagtactattttgctgaaattgaggtatcctgttc

SEQ ID NO: 32874 - DNA, 1488 bp, Triticum aestivum
  unsure (1)..(1488): unsure at all n locations
  Clone ID: PAT_TA_32874
cctccagccgcccaacccgcggccccacaaacgcgtattgcctcctacgccccgcgacccgctgctccgccccacctcccagttgccacgcgcccctgcacaacccagccaacaacgatgtccacaccaccgccgcagaaagacgcgagccgtcatcttgcccaggagtgcggacgcgggccgagcgcgtcgacaaggcggagctggtggagcaggccgagcgctacgaggagatgcggggcagggcggggcgcggcgcgaagcgtcccggcggggcagcgcctctcggtggcttacccgtatatgatcgcaacctggtccccgtgcctgacaagaatgtcctccggccccggcgagcagcatggtaggggcatcgcctccaacgcgcacaccgaggacgcccgcggcaacgacacccaggccgagaccgtccgctcctaccgcagcaacatcgacctcgagctcgcaaagatcttccacggcaccctcgccgtggttgcctaccacctctgtgtccatccgcaggagctgctacgtcaaaaaccttctatctcaaaagtgaagggcgagtagcggaaggtacctggcggagtctcagtgcaacgaggaagaggagtaagccggctagagcaccatgaacgtggacaaagctgctccggatcacgccctagctgatttggctcctaatccacccttccagtattggatcttgaactcaacttttctctgttgcaactcttgcaacataagctccctggacgggcgctagaacacttggctgaaacaagcttttggtgaggggaaatcctacaacggcaccactttaatcaagcagctccatgagtgaccaactctattattatggaacacccacagcgaaagattgagacgttgaagagatgacggaagccccagctccgaagaggatgtggagacggacagtgaggagtatcaaaaacatcagtctgtggattgttgggggcaatggaagtcggtctctggtctattgttcagactgttgtaatccctacttcttgtttaattatgtactgaagtagtttctgcgctttgtttttttgggtgctgaaaaaggtctgtgtggatgtgttttctcgttttaattctcgccacaagcaaaagacctgttctttttcaccattagaatgtttgctatatctcaccatgtttggcgagacttgatgcaactagtactattttgctgagcgagacttaatatgtccatgtttggctggattacattaagataagacggtttgcgctggctgcttgaatgaatcacaaaacaaaaaaaatcactgcacttgggaaacacgagcatgctggctgcggcttccctgtggggcgcgccctcatgccactggttctcgtctgcggctctctgcgttgccgcttaactggantctcacttccnaggggggccggtncaatncnccaaangagcttaagccctaaggcgngttaaagtng

SEQ ID NO: 32875 - DNA, 1118 bp, Triticum aestivum
  unsure (1)..(1118): unsure at all n locations
  Clone ID: PAT_TA_32875
gctcccgcccccccttgcccccgcctccccgccaaccgcgtcatcttatctccctcccagcacggccgccccccccgcctcctcctcctccccccgtcctttcccgctgctcgcctcggcgcacgcgtcctcgctcggcgctcggccggaggtgaccgatactgttcgtgaatgatcagggcgagggcggctggttttcacgcctgagcgacctcgggggaagcggtgatccatgcatggatggcaaagacctcatcgcaccgtccgacctgccgccattctacggccagcagcagccgcagcagcacctccgcatgctcggcggcaccggcggcggcggggggcagcatagcccgtcctcgctcgccgggatgcactccgtcatccgccccatgcccaacatgagcatgagccccaccgccatcctccagtccatcggcggcggcggcgcctcctccctcgccgccatgcagttcagcatggacaacgccacatccccttcctccatgctgcagcacaacagcatgggcggcggctccgtctccggctcgggggggacgatgccggtcgccagcccgccgccggagcccgtcaagcggaagcggggcaggccgcgcaagtacgggcccgacggcgccatgaagcaccacatgtcctcgtcgtcggcgcaacagcagcagcatcagcatcatcagatgatgggcgcgccgcagcagaggatggggtcgatggccggacagggcatgtcgggcggaatcgacgacgcggcccagaagaagaagcgcggccgaccgccgggcaccgggaagaagctctcctcccccagtagtaaacccaccggcaatgctttccctgggttcagctggaacgagcttcactccccacatcatcacagcatctccttcagaggacgtcgcggggaaaatcgcaacattcgcaaagcaattcgccgaagggcggtgtgcgtnttcccggnnatggggntcanttccaaggctgtcttcgcaanccggcaagttaacctcccttcctanaaanatcctggcaattnacgagggattgtatgaaacccncaagtttnccggttcttanaatctgaacgagggcaagaaatcanc

SEQ ID NO: 32876 - DNA, 1189 bp, Triticum aestivum
  Clone ID: PAT_TA_32876
ggccagaggcgttcgtccccttcccggatcatcgttactttgtaatgatctggccacggttctggaattttcaccagtgacagagggccctctatggttgctttgaataagagtatgaactatcactgacttggtgagcagtattattatggggggagaaaagctccatgagcagccctctggtcatctgattgaatcccttaaaatggagagggttaggaccattctcactcatggatacccatacccacatgagcattcgagacatttcatggttaggaagactatcgagacaaactattcaaactttagtcgttggtactttgcatggatatttttggcagcattataccatctccctagttttcctctccagttttcttgatcgtcttccacatcatatttcttggactctggtatttggatcctgtttctcgcatggcagagaaaggctagagatgcttactatatccaaaattgtgctgtgataagtatagcttgctgcgtgttctacagtcactttggtaacaggactctttcaagggataaatctattgatcatagaactgctagctgggttgcattttcactgtggagaaagcaaattgaggacaacacactgatttcaaagctattgcgtatgcataagtttaaaaccagatttgctcgtcctggtttgctccggttggctctgccagtgattacccacttctctcgaaatgggccatttatggagaacttccaatggatccgaacactccaacatcatttcacctgtctactctttgtgggctacattcattggtctttacatggccaattatgtcgtggagcggtcaactggatgggctctaactcatcctttaacaatttcggagtatgagaatctgaagaaactgttgaaaccggattttgaggacatggttccttggtactctgggtccgctccagatctattcataaccgctttcgaccccctggttcctgtgacactcgctgactatttgtcgatatatttgcttaaaactgttttcaacctgatgatatcagtcacactttttgttggtcgattggacatgcgtatgatgcaggtacatgcctgtgatttcaaggcttgagtcctcatgttggtctagttttttgtttccttgcagtctttccttgtctcagaataccctccttcctagaa

SEQ ID NO: 32877 - DNA, 1444 bp, Triticum aestivum
  Clone ID: PAT_TA_32877
ggctccgccggcctcccccgtctcctttccgaccgccccgccccccccgtcctgcccgcccctccagcaccttctccactcctccaagccacgacccggctcgcccgcatcggcggcgcaccggctcggcgatggcgacccacacgggggcctccgagaagcgaacgagagagcccgcaggggcatggcgatggcgacgcacacgggggtcgccgcctccaaggtcctcatcctcgtcggcgcaggcctgacgggatcgatcgtgcttcggaatggccgcctgtcggatgtattggcggtagtctccaggagctcatgaagggcgtaaatcaaggaggaagtgctctagcgcaatatgacatggctcttatccaagctcaggattcggcatttagaggccaagaagtcagagatttaactttggtcaaaggcccattaccatattgagtggcaaatcggactcggggaggcagttcaaacgtccttacatactaccagcacaatgcagttggagcattagatatattgtctatatgtggtggaagggatggtccttgtcagatgtcatgtttgtcacaaaacgcaatatggccagtgctgttgatagcatgtcgaagcaattggagcaagtttcgtcagcactagcagcaacgaaaagacatctaacaaaacgccttgagaatttggatggaaaaatggacgaacaagtggaggtctccaaacaaatccggaatgaggtcacggatgttaaaactgatctgtctcaaattggctttgacgttgaagcaattcaacagatggtagctggactggaagagaagattgagttgcttgacaataaacaggatgcggctaatgctggtatatggtatctctgccgaatggcaggaggtataaaagagggaataaatgccaagtttttccaagaagcggatgaaaaactcaagctcttggacctggctcatactgaaaagaagccggtgaagggtctggagttgtttctggagagcaccaaggaagccaaggcactcgactccaagcctaagaccatcgtgcagaacgatgccaagaaaccgatgaaggcgttcgacgtgcctgtgaagagtgctgcggtgcacaggtcaaacaggttcttaattcgcaaggaaggcctcgcgctgtgatcagcgcctgaccgtgttgctcgtgatgtacattgcgttattggttgctttgtttgatagaaaatatagaagaagaataacctgcatcccgagtggtgattttccaggatagacaggtttatacgtctttacgacaatttgtattggtttctttgtatttttttttgagtcatttcatgttctggtatgaagttgttcgcttgtaaacaagtgaaggaataaataattaaaacacgttttgcattcttaaaaaaaaaaaaaaaaaaaactcgctcgtgccg

SEQ ID NO: 32878 - DNA, 414 bp, Triticum aestivum
  Clone ID: PAT_TA_32878
gacgggaggccggagtcctgtcaggatgggcggcgaggtcgtggcttagaggggagaatgttaggaataagccaagcatgagtatgtgctcatgtgtgtgatctgcatgcatggatggattagttagctagctatggagccggcgcagctgagtcgcgtggcagttctgcgtggaggaagaataggaagcaatagttgaggcttggtcctatacgtgtgtatccaaagattctggagacttggctgttacccaagcgtgtgtagctagcccgtggagtactaatcggatcaagcaaccgtgggcttgaccatgcatgcgtgtgtgcgtggggttagtgggtgtgtgtgagtcttgtacttggctatataagttgagtaaatgaatgagaaaagcggccgtgagggctggataca

SEQ ID NO: 32879 - DNA, 725 bp, Triticum aestivum
  Clone ID: PAT_TA_32879
cccacgcgtccggctggctccgagagagacccacctcgcctcctcttcctccctctggtccccgctcccggggagcaccccttttagtgcaagattcaatctgctcctgccccgctcctcctcgccccgcagattcgcctccctcctcctcctcgcgcggcggttcttgatccgctccggtccggtcctgccgtgcgccgctgctccgggtccggccaaaggctgctgcttgcttgcggggtccgtggcggcgggcggctggctgcgttccggcggcggcggctcgatctgcgccggggctcagatttgatcggcgtggcgcgctcctggagcccggggttccgattcggccgcgctccgggtgtgctgctgccgctgccccaattccccgactttgatgaggctctcgcactgtgagacctactgcgtcgcccccctctgctacatcccctgcctccccaaatccaaagatgcaccaccacccgccgccgccgacgccgtcgcagcggtcccctgcccggacgaggacaagccgccccaggtccagaagattgaggtcgtcgcgccggcggcggtcgacaaggatgaagacgacaaggagcacgagcacggtgacaagacggggccggcggcactacccaagagcaacctgtaggagggcaactgttgtctaggacggcgttctggccccccaagggcaatgggaagtggcctcgattggctgg

SEQ ID NO: 32880 - DNA, 872 bp, Triticum aestivum
  unsure (1)..(872): unsure at all n locations
  Clone ID: PAT_TA_32880
cccacgcgtccgcccacgcgtccgcccacgcgtccgcacgttgagttttctggagattttaacgtgtccctcccgtctccccctcagctaccaactcgcccgtcatcttcgtctccctcatcacgcgaaatccaaatccaaacgaaagaaaatccccaaatcctaagtcttctccgaacctgatcctcccgcgccgcccgattcgatccggcgccgggccgccgatcccctgcggcggcatggagggggccgatcgcctgtacccctcggtcgagccgtacgacctcgagcccccgcagctcgacgacgccgccgccgccgccgtcggcactggcgaggctagggtttgcgacccgccggtgaggtgggacgaggagcccaaggagggaacccatgtatgcgagcaaggggcgaaagataatcctgacagagatgacatggaagaccaccttagtgttgtcaatatttatgagagcgatgacgaaatggccaccttcaagggatcaggagaaaacatccattctgattgcccacttcgtcaacaaactggcatctgggtacctccttctgttccaccgatgacaaagcatgatcatgaggagtggcaaaagggctttgtctcaaatgctggatacttcatagaagacgaatataagtgggatatggatgaagacattagggagatgacaatgtngggatgtgtttgctgagatggctgttgcaggaaaagataaattattatctgttgcatcatatgattttgggaggcatagcatgtctctagtttcacacttccttcttcaagcggctttggaggataactctcaaaccttgcagagggccagtgttggttctgaacatgccctgcttga

SEQ ID NO: 32881 - DNA, 1733 bp, Triticum aestivum
  Clone ID: PAT_TA_32881
ggcgggtcggcgctcccaccaagcagcagtggacaccggcggtttgcgcggcgcggcggcggggagcggcggcagaccggccgtgcggcggcaggccatcgggctccgtcaaggttgctaaaatggataagctcaagggctctgcgcgtcttatgattgtttcagatctcgatcacacaatggttgatcatcatgacgaagagaacttgtctttgcttaggtttggggccctttgggagtctgtttactgtcaggattctcttcttgtcttttcaacaggaagatcacctactctgtataaggaattgaggaaagagaagcctatgctaactccagacatcactattttgtctgtgggctctgagataacttatggtgaagccatggtccctgatcatggctgggaggaatatttgaacaataagtgggacaggaatattgttcttgaggagacagctaagttttctgagctgaagcttcaggtagagacagaacagcgtccacataaggtcagctttttggttgacaagaagaatgctcaaggagtgatcaagtctctctccgagacgtttgagaaacgtggggtagatgcgaaaataatctacagtggtggccaggatcttgacatattagctcaaggggctggaaagggtcaagcacttgcatatttgctcaagaagttaggttcatgcggaaaaacacccaacaatactcttgcttgtggtgactctggtaatgatgcagaattattcagtatccctggtgtacatggtgtcatggttagcaatgcccaagaggaactactccagtggcatgcagaaaatgcgaaggataatcctaagataattcatgcaactgagaggtgtgctgctggtattattcaagctattgggcacttcaagctaggacctaatgtttctccaagagacgttgagtttccttacatcaaggaggaccctttcaagcctacagtggccattgtgaagttctatgttctgtacgaaaagtggcgtagagctgatgttccaaaggctgattcagttatacagtacttcaaaaacatcacagatgcaaatggagttattattcatccgtctggggtcgaactttcgatccattcatccattgatgagctggcttcatgttatggtgacaaacaagggaaaaagtaccgatcatgggtggacagactagttatcttgcagactgcttctgacagttggcttgtgagattcgacttgtgggaggcagaaggtgctgcgtgggtgtgctgttttacaacccttgcgctgaatgtaaagcctgaaacccctgggggttttgtggtaacacacatccacaagacgtggcgtaaagaatatcccggggtcgagcagtcatccaaactctagactggacggcgcacgggaaggagtttttcttcttcttgaggatcaaataagaaatcgtagcgaaagcatgagaatttcttttacttgttcataatgttaataataagtgctcccagacacatatactgggctggatgatgtctacggaggtctcttgatgcctttggctaatgcttactgtcatgagaggctaaactgaagtaaatgaccccagtcccagtatatactagtttgatgtgctacttgttattattcagtgttcttcaagatacattcatttttatccatttttgcgacaaccggacgccaggaacgacgggaaaaaaaaaaaaaaaaaaaaaa

SEQ ID NO: 32882 - DNA, 1720 bp, Triticum aestivum
  Clone ID: PAT_TA_32882
cgtccgcgaaccccatccctcctcgcctcttcctttcttcctctctgtggcggcggtggagcagcgggtcggcgctctcaccaagcagcggtggataccggcggttcgcgcggcgcggcggcggggaccagcggcagatcggccgtgcggcgccaggccctcgggctccgtcaaggttgctaaaatggataagctcaagggctctgcgcgtcttatgattgtttcagatctcgatcacacaatggttgatcatcatgacgaagagaacctgtctttgcttaggtttggggccctttgggagtctgtttactgtcaggattctcttcttgtcttttcaacaggaagatcacctactctgtataaggaattgaggaaagagaagcctatgctaactccagatatcactattttgtctgtgggctctgagataacttatggtgaagccatggtccctgatcatggctgggaggaatatctgaacaataagtgggacaggaatattgttcttgaggagacagctaagttttctgagctgaagcttcaggtagagacagaacagcgtccacataaggtcagctttttggttgacaagaagaacgctcagggagtgatcaagtctctctccgagaagtttgagaaacgtggggtagatgcgaaaataatctacagtggtggccaggatcttgacatattagctcaaggggctggaaagggtcaagcacttgcatatttgctcaagaagttaggttcatgcggaaaaacacccaacaatactcttgcttgtggtgactctggtaatgatgcagaattattcagtatccctggtgtacatggtgtcatggttagcaatgcccaagaggaactactccagtggcatgcagaaaatgcgaaggataatcctaagataattcatgcaactgagaggtgtgctgctggtattattcaagctattgggcacttcaagctaggacctaatgtttctccaagagacgttgagttcccttacatcaaggaggaccctttcaagcctacagcggccattgtgaagttctatgttctgtacgaaaagtggcgtagagctgatgttccaaaggctgattctgttatagagtacttcaaaaacaccacagatgcaaatggagttattattcatccgtctggggtcgaactttcgatccattcgtccattgatgagctggcttcatgttatggtgacaaacaagggaaaaagtaccgatcatgggtggacagacttgttatcttgcagactgctcctgacagttggcttgtgagattcgacttgtgggaggcagaaggtaatgcgtgggcgtgctgttttacaacccttgcactgaatgtaaagcctgaaacccctgggggttttgtggtaacacacatccacaagacatggcgtaaagaatatcccggggtcgagcagtcatccaaactctagactggaccgccaccgccggcgcacgggaaggagtttttcttcttcttgaggatcaaataagaaatcgtagcgaaagcatgagaatttcttttacttgttcataatcttaataataagtgctcccagacacatatactgggctggatgatgtctacggaggtctcttgatgcctttggctaatgcttactgtcatgagaggctaaactgaagtaaatgaccccagtaccagtatataaaaaaaaaaaaaaaaaaaaaaaaaaaaaaaa

SEQ ID NO: 32883 - DNA, 1715 bp, Triticum aestivum
  Clone ID: PAT_TA_32883
gaacgcggcaccccccgctccccccctctcttggctccgtcgttgtggcgccctctccgagccggagtgtcggcaagcggctcaccgcgccgcgcgcgctggcctaggccccgccgcgcccgcggggtagcgccggcagaccggccgtgcggaggcagcccatccggcttcgcctaggttgcttatacgtctcagctgaggggctggagcggcgggtcggcgctctcaccaagcagcggtggacaccggcggtttgcgcggcgcggcggcggggagcggcggcagatcggccgtgcggcggcaggccatcgggctccgtcaaggttgctaaaatggataagcgtcaagggctctgcgcgtcttatggattgtttcagatactcgatcacacaattggttgatcatcatgattgtggtgaggccatggtctctgatcatggctgggaggaatatctgaacaataagtgggacaggaatattgctcttgaggggacagctaagttttctgagctgaagcttctagtagagtcagaacagacgtccacataaggtcagctttttggttcacaagaagaacgctcagggattgatcaagtctctgttcagagaaggttcgagaaacttggggagagatgcgaaaataatctacaggtggtggaatagatcttgacatattagctcaaggggctggaaagggtcaagcacttgcatatttgctcaagaagttaggttcatgcggaaaaacacccaacaatactcttgcttgtggtgactctggtaatgatgcagaattattcagtatccctggtgtacatggtgtcatggttagcaatgcccaagaggaactactccagtggcatgcagaaaatgcgaaggataatcctaagataattcatgcaactgagaggtgtgctgctggtattattcaagctattgggcacttcaagctaggacctaatgtttctccaagagacgttgagtttccttacatcaaggaggaccctttcaagcctacagcggccattgtgaagttctatgttctgtacgaaaagtggcgtagagctgatgttccaaaggctgattcagttatacagtacttcaaaaacatcacagatgcaaatggagttattattcatccgtctggggtcgaactttcgatccattcggccattgatgagctcgcttcatgttatggtgacaaacaagggaaaaagtaccggtcatgggtggacagactagttatcttgcagactgcttctgacagttggcttgtgagattcgacttgtgggaggcagaaggtgctgcgtgggcgtgctgttttacaactcttgcgctgaatgtaaagcctgaaacccctgggggttttgtggtaacacacatccacaagacatggcgtaaagaatatcccggggtcgagcagtcatgcaaactctagactggatagctaccgccggcgcattttcctcttgaggatcaaataagaaatcgtgtaccgaaagcatgcgaatttctttcacttgttcataatgttgttaataagtgctcccagacacacatactggactggatgacgtctcttgatgcctttgcctaatgcttgtatctcgtcgttactgtcatgagaggctaaactaaagtaaataacaccagtcccagtccagtatatactagtagttcgatgtgctattcaaaaaaaaaaaaaaaaaactgatag

SEQ ID NO: 32884 - DNA, 618 bp, Triticum aestivum
  unsure (1)..(618): unsure at all n locations
  Clone ID: PAT_TA_32884
cccacgcgtccgcccacgcgtccggggagcgctcccctccccctcgcctagggtttcgccccctcgatccccgcggctccggccggcgccgcccattccttctccaccgacgcaccgcttgccgattgcattgccctcctcgcggtgcgagggagcgagcgcggggatcggccgctccctccttccccgccggctccaactcgatctcctccccggaccgccgggggcgagcagggggaggcgagcgccgtggtcgccgcaccgcgcagcgtcggcagtagtaggatgatcacactgtttgcacagggctgaatctttgtgaccagtagtttgaaacaagaaaacttctaagtgaagctgcacacagagaacctttagagttgtctgctgttattgcttccatggcaacaaatgagaacctcccaccaaatgtcatcaggcaattggctaaagaactgaagaatcttgatgaatcacctccagaagggatttgaagttattgttaacgatgatgacttcagcaccatttttgctgatattgagggccctgctggaactccatatgagaatggagtattccgcatgaagntattgttgnctcgtgacttccctcactct

SEQ ID NO: 32885 - DNA, 605 bp, Triticum aestivum
  Clone ID: PAT_TA_32885
tactgttcttgcgccaatatctacctctaccggcacaaaagcatttggcccaaattcgcaggaccggaacgctgctccttctgctgtctcaggtggagcatcggcagcgcccaggaaggacgggccacttgccgtgaaagtccccgtcgataagaagaagatggatgcgaggaagaagagtttgaagagattataatatataagcaaaccaaactgtcaatgctcctcatatttgttctgtacttagttgtctggcggtgccagagtcccagaaataacgagaagaaactggttatggttgtctgcgagggaaggattgcttctcttctgttcgtgcccaactattggaccctgttgagccgaaactgtggaggcagaataattatgcgctgctgggcctctccgtggtcctgtatactttactagtgctgctgttccggcgtctgtttgtgatttaatggttcgatgtgaacttgaatggcggagaaacattttcttcccaataggtggtagagatttttctatctgaaaagaaacagtaattttgcaaagtcatcaaacttggtgatttagctctggctatatatatgctcatcaaaaaaaaa

SEQ ID NO: 32886 - DNA, 585 bp, Triticum aestivum
  Clone ID: PAT_TA_32886
tgctgccagtaatgtttttcttttgctcagtctctctcactacagaaaatgtacacctgtctgacaaacatatttattagtagatatgattttggatctgaacttttcccagtctgcagctcacattgtggtatggtcatagtacaacaaaaggaaaggatgtttaaactttttttgggcgtcatacatgaaaagtatctttatttccatcgagcttaattactaagaaattgttaccactattaataaacctacatgttctgaaagttcggtctcttgctctctttgcttatgaatcggacactttccctttctttagtccttccacggttccacctcactttgacttcatcctttgatggtgtttgtaggtatgtaagaagtggtcataatgttacttaaaggaggcctcaacttgcaccaaatacatgggcatgtgcaacagcaacttatgtagcttgtccaacatcgcctgagatggtttgggcatattcagcgcaggcctccagaagctccagtgcatagcggatggctaaagcgtgcggagaatgtcaagagagggcggggtagaccgaatttaacatg

SEQ ID NO: 32887 - DNA, 772 bp, Triticum aestivum
  Clone ID: PAT_TA_32887
attcggcacgaggatgaaaaagggctgtaaggttgtactttggtgcgtctctgtccaatgatggctggatccatctgacgctcttccaagcagagcagtgcagatttgctgactgagcagcggagaaacatgtttctacaaatgtgccaaaactgatggatttaactacaggatggagcagcaggcatagatgaaatctactgcaaatttctattggttgcggcatcttccgctgagtaactctacaaaacagcctgctagcattgattcttgcaataaaaaaataagtctggcatcattcataaaaagcttatagacatagataatttcttaatactgcactggttctcaccagtgagattgtagatgtggtattttgagaataccagtgtaattcactggtccaaaagctccatttcttaatgtgtttttgcagaatgctaccagtaatgtttttcttttccttaatgtacaaacatatctattagatatgattttggatctgaacttttccctgtctgcagctcacattgtggtatggtcatggtaaagcaaaaggaaaagatgtttaaactttttttgggcgtcatacatgaaaagtacctttatttccatcgagcttaattactaagaaaatgttaccactatttccttactaataaacctaaatgttctgaaagttcggtctcttgctctctttgcttatgaattggacactttccctttctttagtccttacacggttccacctcgctttgacttcatactttga

SEQ ID NO: 32888 - DNA, 696 bp, Triticum aestivum
  unsure (1)..(696): unsure at all n locations
  Clone ID: PAT_TA_32888
gaggaattcggcacgaggccaattcccgggctcgcgctccaatnttgcgacgcgcgccgctcccctcccctccccgcgagcccgacccagattggccgctcctccgtcctcctccggctgcatctgttgtcggaaatttatcactattgtggaaggacatctgctcaccaaagttgcttgcgaagccagaacaaagctatttgccgtcttgcttccatggcaaccaacgaaaacctcccaccaaatgtcattaggcaattggctaaagaattgaagaatcttgaccagtcacctcaagaggggattagagtgattgtgaatgacgatgacttcacaagtatttgtgcagatatagatggccctggtgggactccgtacgagaatggggttttccggatgaagctcgtcttgtcccgtgacttccctcaatccccaccgaaaggattttttgtgaccaaaatattccatccaaacatatcgagcagtggtgagatctgcgttaacacgttgaaaaaggattggaatcctactcatggattaaggcatgttctactggtaagtacatactacaacaatgtttggccctagttttgctaggggtaatacatacatcaactgtaattatcgattaataactgtcggtttctttttaacattctaaaaggtggtgagatgcctactgattgaaccattccc

SEQ ID NO: 32889 - DNA, 443 bp, Triticum aestivum
  Clone ID: PAT_TA_32889
ttttttttttcaacactaaagtaaaactgtagcaagcacaatggttacactacactgtttagatacctaattgctaatttaggttatgcggctgatggaaccaaaaaatatataaagaatctattttcaagtactccctggaaccaaaaaatatataaagaatctattttcaagtactccctctgtaaacggtccagtcctagctatgaggacattacacatcagtaagttccatggagacggtctcctttcctatacctaaactatgtatatatgcctccatggagaaggacgaagacgacacgacccacatcaccacaacacagttctagtttccttggtccatccccttgcttctcttcaggtctctctaccttggtgttgtcatgctactcctgcgttccagtctaacatttagccaatataaactcactgctctctgt

SEQ ID NO: 32890 - DNA, 498 bp, Triticum aestivum
  Clone ID: PAT_TA_32890
tcgagcggccgcccgggcaggtacaaaatatgcaaatccccactaaaacttattcagctcttggacacttccgaatgactgactgactggtataagatgacggcgctagacagagtctgccttggtgtagatccgtactctcgcgtcgcacaggaagcgtgtctcgcatacatgggtgtgaaatgttgctatgcaaaaaccaggatatatacacgcacacgcacagaagtgatatgcaacttgcattagtccctagttttatcttttgtcaataggtggtttcagttttcctgggaatattgacagggtacaattgaatgatcagaatgctttttttgttggctttgagttcttattgaatgatctcttttttgctggggtcttttatggaccccacggcattgcctttgatgtaaacaaccactttataacaaagaaagggtgttaacaatatttttgggcgagggaaaatttttttttaaaaaaataaaatttttt

SEQ ID NO: 32891 - DNA, 659 bp, Triticum aestivum
  Clone ID: PAT_TA_32891
gcttttttaagaactgaaataaatataaccagtgttacaaatgtttgccgaggaaaagtccttgcagaaaagaagaaccggaagcaggttatctatcttcacgagcaagtcggcgtctgtaaaccttcaccagagccattccagctctttcagagccacaaggcaaggaagttgaggaaccaagaccccaacggcgcggagcagtttgccgtcgagaggactagggctgccatcagggacctctagaccaagctcaacatctccctcgtgcctccatcaacaccgtgtgttggagggtcgtcgccgtccgcgacgacgagctactgccgcagctttgtcagccgcacggttagagggaggcatcaagggcccgccaccgctgtcggggccgacgtgcgtgtaatttctattaatgtatcctatgttgccaaacaacaacatgctcctgtcaatgctatatcgttgtgggtatggcatttcagtttcttcctcagacgatgttccaatataataagttccatagaattgcatgtacatgtcctgctatcttgatccaaaaaggaaagtaaaaaagggtgttcatctacctggcaccgcccagatgcccctcaagcggcgcaccacaagcgccccaactactagtcattaaaaaaaaaaaa

SEQ ID NO: 32892 - DNA, 617 bp, Triticum aestivum
  Clone ID: PAT_TA_32892
ctgctccagtggtgttttgttatttgattggcataaatggatctctccatgtttattggttgatctccaacccctactctgctgtggtgctgtgggagcaagaagagcatgcatgctttctctctacatctagggtccatacggccagattgacgggcctaaactctggctcaaaggtttctttcaagaatcaagagagaacattcaaggagtggattgtttggaaattaaaaccttcagatttcttagaagtgaggttgctttccaactacaattatagcttcacttggatttatgtgaatataagcgtaagatgtctagtggcaatgctacaaaatcattgcaggcgtgactcgtgagtatccggattgcactgctgctggccgtttcttgcaactgcgcacaacaggcttctgacaaagccaagtcttagactcatgaggtcccttttttcagccaaactgaaagcacttcatgttagcttgtattcgatgttggattaactacaatgcattgtacccatccatgctccagggtgagtctgtacatatccttgttagatgcaccaatgcctatgatagttctaactctaacaatatagtatcgtatgttaatcg

SEQ ID NO: 32893 - DNA, 1054 bp, Triticum aestivum
  Clone ID: PAT_TA_32893
ggctgagtttagcttgtgcattgctacgaagggcaaagatacttgttcttgatgaggcaacagcagcagttgatgttcaaactgatgctcttatacagaagacaatcagagaagaattcaagagttgtacaatgcttataatcgctcaccgtttgaataccatcatcgactgtgacaggttgcttattctaagttctgggaagatttcggaatttgacacccccgagaatcttgtgagcaacgagggaagtgctttctccaagatggttcagagtacaggacctagcaatgcagagtatcttaagtctcttgtgcttggcaatggtgaagagcggctgcgaaaggaagaaagtaagttgcaagatattcagagggaatgggctgcgtctaaccgatgggctgtcgctgcccagtttgcgcttgctgctagcctcgcgtcatcccacagtgacctcctctcattggaggctgcggacggaaacaacatcctcaggaaaacaagggatgcagtaatcaccctgcacagcgtccttgaagggaagcacaatactgaaatcgaggaatcactcgccgagtatgaggttccgcttccgcctgataggtggtggtcgtcactttacaaagtcatcgaaggcctcgccacgatgagcaaactgggtcgcaaccgtctacggcaacctggttacagttttgaaaaccacgggtctattgactgggatcaaatttaggtgtagaacactgcgttgctgcgctactgaatccctggaaccgcatcgtggagtagtttgggggtgtgcattaatcacgcacggtttaatttctacagtcttgtagtacatttttgtacattttaccgccagtgcattgacgtgcaagtcgggagtcagtagaaacgccgtcttgacgcctatctgaaggcgattttgtagcagtagcagtcttgtaatgtcgtccgcatggtttacatttcttgtggacagtctcggtaatcagcatacctgaaattttaataatattgttcaaagcaagtgtaaaaaaaaaaaaaaaaaactcg

SEQ ID NO: 32894 - DNA, 836 bp, Triticum aestivum
  Clone ID: PAT_TA_32894
ggaaaacaaaactatttcgtagtacagaacaagccaacaaaaacatttcaacactaaagtaagactgcagcaagcacaatggttacactacactgtttagataccaaattgctaatttaggttatgcggctgatggaaccaaacaatatataaagaatctattttcaagtactccctctgtaaacggtccagtcctatgaggacattacacatcagtcagagttccatggagacggtctcctttcctatgactaacctatgtatatatgcctccatggagatggacgaagacgacacgacccacatcatgacaacacggttctagtttccttggtccattcccttcttctcttcaggtctctaccttggtgttgtcatgctactcccactgaagtgtgtaaagcccagctctgaattttcggttccaccgctcatcatcatccatcttagagaataggcaaaatctgcttggtcaacgacatccacgtccacctggaaatcctcaacaggtactcacacacttccaccatcttgcacccggcggtgaagtgcagtgccctagcaccctgattcttggcagcttgcaccatctctgcgagatggtcgtgaccaccttcaagctgccttgccatccctgcagcagagccagatcgccgagtgtctccattttctgaatatccaagagaaaacgtcgccagtttttttcccgcagactcccgtgtgcctgcttggtcaacgacatccacgtccacctggacatcctcaacaggtactcgcacacttccaccatcttgcacccggcggtgaagtgcagtgccccagcaccgtgattcttg

SEQ ID NO: 32895 - DNA, 1290 bp, Triticum aestivum
  Clone ID: PAT_TA_32895
aaattgctaatttaggttatgcggctgatggaaccaaacaatatataaagaatctattttcaagtactccctctgtaaacggtccagtcctatgaggacattacacatcagtcagagttccatggagacggtctcctttcctatgactaacctatgtatatatgcctccatggagatggacgaagacgacacgacccacatcatgacaacacggttctagtttccttggtccattcccttcttctcttcaggtctctaccttggtgttgtcatgctactcctgcattccagtccactgaagtgtgtaaagcccagctctgaattttcggttccaccgctcatcatcatccatcttagagaataggcaaaatctgcttggtcaacgacatccacgtccacctggaaatcctcaacaggtactcacacacttccaccatcttgcacccggcggtgaagtgcagtgccctagcaccctgattcttggcagcttgcaccatctctgcgagatggtcgtgaccaccttcaagctgccttgccatccctgcagcagagccagatcgccgagtgtctccattttctgaatatccaagagaaaacgtcgccagtttttttcccgcagactcccgtgtgcctttgggacagcaaaacaaccctgcttggtcaacgacatccacgtccacctggacatcctcaacaggtactcgcacacttccaccatcttgcacccggcgggtgaaagtgcagtgccccagcaccgtgattcttgacagcttgcaccatctctgcgagatggccgtgaccaccttcaagctgccttgccatcccagactaatttacaaccatatcatcatcagtatttaagtaaaggatgaatctgcatgacaaggaagcacctcatagtgtcaatcagaagtatcacaaaataatcaaaagaaagatcatatgtataatcaattagtagaaacgtgatcatgcttatggagcaatgggaccaagaaaaggaacactttctttagtaagtataagtttttgctatgaagcaccatataacaacacagatacgacgatatggaaacaagcacataggatacggcaatttgtaaaaacagcagtacaaagatacaacaagtatatatgaatactttactttacgaagccttttatcccaaacaagttggggtaggctagatatgaaaccctttcacgaggacttcccaggaggtcacccatcctagtactactctcgcccaaatggatttcatacccaaaagactggctaattttacgttg

SEQ ID NO: 32896 - DNA, 699 bp, Triticum aestivum
  Clone ID: PAT_TA_32896
ctttatttaaaaaaatgtatatgagtttttagtatattatagttacttgagtcttttctttcttacgagggagcatatttatccgaattacatcagtttctttccttaaacaacaacaacaacaacaacaacaaagcctttactcccaaacaagttggggtaggctagaggtgaaacccataagatctaacgaaaatcttttgggtttcatctccataagagaggctagagtttttacattggcttgccaagcctatcacaaccctcctcctttacccgggcttgggactggctatgttgagacaacataggcggagttacatcatgtttctttccttgccatgtagaatatgcatgtattgttgttatgtgctaattagttctttcctctaaggttttttatttttcatatgtagatggttacccaggctcttatttctaagagcagcaagtaccaatttggaaaattcacccttgggaaattcttgagccttttaatggtttctggcttaatatacttgcttgcgcacaaaagttcgaagggttttgtatctggtgagctccataacaaagaagtagagagtagacatgccagtaaaagattctcctactaaccgtacattctggagaaagccaccaaggctacctccacgtcttcctccaaatgaaatatataagaacagtacaatacttcaccac

SEQ ID NO: 32897 - DNA, 803 bp, Triticum aestivum
  Clone ID: PAT_TA_32897
ttttttttttttttttcgtagtacagaacaagccaacaaaaacatttcaacactaaagtaagactgcagcaatcacaatggttacactacactgttcagataccaaattgctaatttaggttatgcggctgatggaaccaaacaatatataaagaatctattttcaagtactccctctgtaaacggtccagtcctatgaggacattacacatcagtcagagttccatggagacggtctcctttcctatgactaacctatgtatatatgcctccatggagatggacgaagacgacacgacccacatcatgacaacacggttctagtttccttgggtccattcccttcttctcttcaggtctctaccttggtgttgtcatgctactcccactgaagtgtgtaaagcccagctctgaattttcgggttgcaccgctcatcatcatccatcttagagaataggcaaaatctgcttggtcaacgacatccacgtccacctggaaatcctcaacaggtactcacacacttccaccatcttgcacccggcggtgaagtgcagtgccctggcaccgtgattcttggcagcttgcaccatctctgcgagatggtcgtgaccaccttcaagctgccttgccatcccttgtacttggttgggcagatggctacatagctatttcatgcttctaagtagttacacacggtcctgcagcagagccagatcgccgagtgtctccattttctgaatatccaagagaaaacgtcgccagtttttttcccgcagactcccgtgtgcctttgcctcgtgcc

SEQ ID NO: 32898 - DNA, 1306 bp, Triticum aestivum
  Clone ID: PAT_TA_32898
gaggctggctagtttttacgttggctcgccaagcctatcacaacccttagatatgaaaccctttcacgaggacttcccaggtggtcacccatcctagtactactctcgctcaaatgggtttcatacccatgggactggctagtttttacgttggctcgccaagcctatcacaaccctcctcctttacctggacttgggaccggctatgcctagaagacataggcggagtttttgacaatcccactgaactgagaatattaatgtttgcgggtagtatagggagtatgcatgtgattttctcggtgcttcaatttttcttataagtttgaaatggtggctttgcagcttcgtggtggccagtgcagatttatggctgaggagagcagaggtggaggagaagagggacaaagtgcataaagagtcaaaggcacttcttgattacacaaggaaggccatcaccaagcttaccgagctcaagaggatgctggagaaatttaaaaatgatgtggagaagcaacaagtggagcaaatggcagactggcagacaaaattggtcatgatggactcgaaggagcggcaatatatcctccaagtctcaaattacaaggcaatgctcaacagagttggatacacgccagaaattaatcattgtgtgttgatggaaatggcggagcataagaaggatcttgagaggaaaactaaacccattgccgacacattgcgtagctaccaggatttgcctccagataaagctctcgctgcgttagctatagaggacaaaaagaggcagtatgcagctgcagagaagtaccttgaagatgtgttgcaatctgctttaacaacacctggtctatgatgtgggtttaactaaatgtgaagttctatttgagtgtctaatgtcttagcatggattgatagtgtaatgcatgttcatgtttcggttcacgttcatatcttgcatctacgtacaaatggttatgcaaaattgtcttttaaatattgatatcaaactcaatgctcaggattatctctcgcattctgcccatttctgttggaagatcaagatttgtttcaatttgtatactagagcgaaaaagtgtgctgctagaatttccagaatatttctttgacatgacttgtcatattcttctttcaccttccatcatcttatgttgtagctcagtttcacaattttacctaggggttagaccagtttctaagtggtgcttggataattcatctaaatagaagagaaattatatttgtttgcttttatcattctctaaaaaaaaaaaaaaaaaaaaac

SEQ ID NO: 32899 - DNA, 558 bp, Triticum aestivum
  Clone ID: PAT_TA_32899
ccgaggttttttacacaactaatcacatcaaattaagaatatgtatgtctgaacattcaccagcgatatggaaaatatagccaagtatctatccgttttcccgagtcacgatttcaacagcggacgtcttagaaccataacgcaacgacgggtcgagaacagttcccagatttcatgacaggacggtgacgctggtacaaaatgcaaatccccactaaaacttattcagctcttggacacttccgaatgactgactgactgactggtataagacgacggtgctagacagactccgccttggtgtagatccgtacggcgacggccaagcccagtatcgcgagggggaccaagaactggaggatcttgatgacgaactcgggggtcttgtccctggttgtagtgcggctgcttgggcggtcatcaagaaacttggtcacattgtacaccttgccgccgatgactagccagcagtcgtccttggaggtgtgcttggcgacctcctcgagggtgaacaccttgccaccggacgacgacatggtctcctcctcctcctctctg

SEQ ID NO: 32900 - DNA, 1000 bp, Triticum aestivum
  unsure (1)..(1000): unsure at all n locations
  Clone ID: PAT_TA_32900
cttgccatcccaggactaatttacaaccatatcatcatcagtatttaagtaaaggatgaatctgcatgacaaggaagcacctcatagtgtcaatcagaagtatcacaaaataatcaaaagaaagatcatatgtataatcaattagtagaaacgtgatcatgcttatggagcaatgggaccaagaaaaggaacactttctttagtaagtataagtttttgctatgaagcaccatataacaacacagatacgacgatatggaaacaagcacataggatacggcttgtaaaaacagcagtacaaagatacaacaagtatatatgaataattaataaaatatgtatgcaaagaagacaataaataatcaatgcatgagatgaaataagatcagaatactgccccatttgttgactgaatgatcattaatttccccaatcaacataactgaatatctcctgtgtctttatgtcattgaacttcccttgctggggacgggattcctggcggcagcggtgcagttgactcgcggttgcggcttgagacggcagtcagggtgactctaggcggcgtggacatgcaggccccctcgatccaatccgctgctctgctcttgtcaatcaagcgacttatcctcacctcctcccggctgcacctctttggatgttgtgcacctgcggctactcttcgatggtgagcctcctcccatgacggcgccgttgggctgggaagcctttgtaaccaccccatcttgacgacccagcactgtccctgatctgccacagcggcgacctgtgcacgagcgatgggaaggcgaggaggaggaaggggcgtggtggtggagtagcagtcggcagtggggctcctagggcagaggccgtggagacgagggaggaggaggaagaggagggaggagggagggagcgcggcggcggacgagggagggaggagtgaggggcgtggggactgtggattggggcctcgtaccgaattncctgcagcccg

SEQ ID NO: 32901 - DNA, 1342 bp, Triticum aestivum
  Clone ID: PAT_TA_32901
attcggcaccaggttccgtattgtggagctcgagcgagggagaatattgattgatgattgtgacacttctaagttcggaatttgggatctgcggaaagtgttaggaataataccacaggcaccggtcctgttttcaggtactattcgatttaatctggatcctttcagcgagcataatgatgcggatctatgggaggctcttgaaagggctcatctaaaagatgtcataaggaggaatgctctagggctagatgctgaggtttctgaggccggtgaaaattttagcgttggacagcggcagctgttgagtctagctcgtgcattgctacgaagagcgaagatacttgttcttgatgaggctacagcagcagttgatgttcgaactgatgctcttatacagaagacaatcagagaagaattcaagagctgtacaatgcttataatcgctcaccgcttgaacactgtcatcgactgtgacaggttgcttattctaagttctgggaagatttcggaatttgacacccctgagaatcttctgagcaatgaggatggtgctttctccaagatggttcagagcacagggcctagcaatgcagaatatctcaagtctcttgtgcttggcaatggtgaagagaggctgcgaaaggaagaaagtaaaatgcaagatattcaaaggaaatgggccgcgtcgaaccgatgggctgttgctgcccagtttgcgcttgctgctagcctggcgtcatcccacagcgaccttctctcgttggaggttgctgagggaaacaacatcctcaggaaaacaaaggacgcagtaatcaccctgcagggcgtccttgaagggaagcacaatgccgaaatcgaggagtcactcaccgagtatcaggttccatctgataggtggtggtcgtcactttacaaagtcatcgaaggcctcgccacgatgagcaaactgggtcgcaaccgtctacggcaacctggttacagttttgaaaaccacgggtctattgactgggatcaaatttaggtgtagaacactgcgttgctgcgctactgaatccctggaaccgcatcgtggagtagtttggggggcgtgcattaatcaagcacggtttaatttctacagtcttgtagtacatttttgtacattttatcgccagtgcattgacgtgcaagtcgggagtcagtagaaacgcgtcttgacgcctatctgaaggcgattttgtagcagtagcagtctttgtaatgtcgtccgcatggtttacatttcttgtggacagtctcggtaatcagcatacccgaaattttaataatattgtgcaaagcaagtgtatgtggattcttt

SEQ ID NO: 32902 - DNA, 1248 bp, Triticum aestivum
  Clone ID: PAT_TA_32902
caaattttgcatagtcctgaggctttgttgtcattaaagggtacatccaaaaataagtcagcagcaagcgagcaccttaaagctgtctgctattatggcttccatggcgaccaacgagaacctcccaccaaccgtcatcaggcaattggctaaagaactgaagaatcttgacgactcacctccagaagggatcaaagttattgttaatgacgatgacttcgccactatttttgctgatattgagggccctgctggaactccatatgagaatggaatattccggatgaagctaatattatctcgtgacttccctcagtcacctccaaaaggatttttcacgactaaaatttttcatccaaacattgcaactagcggtgagatatgtgttaacacattgaagaaggattggaatcctagccttggattaaggcatgttctgctggtagtgagatgcctcctgattgagccatttcctgaatctgccctcaatgagcaagctgggaagttgctgcttgagaactacgaggagtatgcacggcatgcaaggctatataccagtatccatgctctcagacccaagaataagtccaagagtggagctatctctgagtcaacggcagctctgaataagggccagcctcatactgttcttgcgccaatatctacctctaccggcacaaaagcatttggcccgaattcgcaggatcggaatgctgccccttctgctgtctcaggtggagcatcggcagcgcccaggaaggacgggccactggccgtgaaagtccccgtcgataagaagaagatggatgcgaggaagaagagtttgaagagattataagcaaacgaaactgtcaatgctcctcatattttttctgtacttagttgtccgccggtgccagagtcccagaaataacgagaagaaactggatgtttgcgagggaaggattgcctctcttctgttcaggcccaactgtggagggagaataataatgccgctgctgggcctctcctggtcctgtatactttactagtgctgcagttcctgcgtctgttctgtgatttaaatgattggatgtaaacttgaatggtggacaacattttcttcccaataggcggtagagatttttctatctgaaaagaaacagtaatttcgcgcaaagtcatcaaacttggtgatttagctctggctatatatatatactcatcaaactcaagtgatttgaaccaaaaaaaaaaaaaaaaaactcg

SEQ ID NO: 32903 - DNA, 1255 bp, Triticum aestivum
  Clone ID: PAT_TA_32903
tgcgagcgcggcattaatgaaactgcagatctggagtactgtggcaccactagttactttatcaagctgtttctggataagaaatatgctctgccgtaccgtgtactcgatgctgtttttgcccatttcatgcggtttcttgatgatgagagaagcatgcctgttatatggcaccagtcactgctcgcctttgtggaaagatacaagaatgagttggagaagaaagacaaggaacagctctcacgcttgttagataaccagaagcattatttggtaactccagaaatccgcagggaactccggagtagtgccaacaggggcgaaaagccgaccgatatgtcgatatatatcctttacttacttactaagcccaaatgggtttcatacccaaaggactggctagtttttacgttggctcgccaagactatcataaccctcctttacccgggcttgggaccggttatgcctagaagacataggcgaagttgtcctttactggttgcgccatttatttccagtcttttttgctttgcatgttaatagtcggtcgagcaaaaagattttattctcttgcaatcgaaagtttttctactgatgtacaacaacaatgttgagcccttaactctgtgcttacgttcacctgtttccgtgatcaccaagccgatcgaagaggacaggtgggatgttccggaagtgcctatggaggaagattagtggccgtggagagtgtcatagttggtttgcctgtgtgagcttcatcagcgcttcagttttgatcattacgtgtttttgtgtgggcaatttgtacttgcgatgttgttgagaaagagaaagattgttattacatataccctggtttgtaaggacggctgctatagaggtgccggttgaattcactaaaacataagagctcaggttgatttcaaaatgtgttcatgataccagaatatggcatatagtgtaggtgaaggacttgaagagaacttttcggtgcccattggaacacaagacaattttcccaacacaccgcaaaaggctcccccaaactacatccggcttcttccacggtagcactccatcagctcccagtccaagctcttgcaccatcagcggatcatcacatacttgctggttaacaatagagtagctttgttcactagtaatttcccgcgagttttgcagattgcattgcaagtgaaagaggaacttaacgagagttggattatggtcgcaagcctgatcagtttatcctgt

SEQ ID NO: 32904 - DNA, 852 bp, Triticum aestivum
  Clone ID: PAT_TA_32904
acacaactaatcacatcaaattaagaatatgtatgtctgaacattcaccagcgatatggaaaatatagccaagtatctatccgtttttcccgagtcacgatttcaacagcggacgtcagtagaaccataacgcaacgacgggtcgagagcagttcccagattccatgacaggacggggacgctggtacacaaaatatgcaaatccccactaaaacttattcagctcttggacacttccgaatgactgactgactgactggtataagacgacggggctagacagactccgccttggtgtaaatccgtacggcgacggccaggcccagtatcgcgagggggaccaaaaactggaggatcttgatgacgaactcgggggtcttgtcctggttgtagtgcggctgcttgggccggcgtgtacttgaccttggtgggtatcgtggtcgcgtcgatctcaccaacatagtactcatccatcatcgcccgggcggtcgtgctgtgccccacgtcctcaaagtcgtcggtcgcgtccttggcggttgaagacagcaagacatcgtcgcctccagggtggtcatcaagaaacttggtcacattgtacaccttgccgccgatgactagccagcagtcgtccttggaggtgtgcttggcgacctcctcgagggtgaacaccttgccaccggacgacgacatggtctcctcctcctcctctctgctcctctctgctgtcaagcgagagtgatgggaagggtttggatccaaggagggggtgcggaattgattgatatctggaggagaggagaggggagggggcgccgcggtgggtaggtcgggtctgcgagggtttgggttgac

SEQ ID NO: 32905 - DNA, 1415 bp, Triticum aestivum
  Clone ID: PAT_TA_32905
cggcacgaggcccgatttttactgctccgctccccctcttcccccttcggtctgcccaaatcgggagcgctcccctcgccctcgcctagggtttcgcccctcgatccccgcggctccggccggcgccgcccattccttctccaccgccgcaccgcgtgccgattgcattctcctcctcgcggtgaggctgccaccgcgagggagcgagcgcggggggagatcggccgctccctccttccccgccggcccgaactcgatctcttccccggaccggcgcttgggcgcgcgggcaggggaaggccagcgctgtggtcgccgccctgcgcagcatcggcagtagtaggatgaccacactgtttgcacagggctgaatctttggaacaagaaaacttctaagtgaagctgcacacagagaacctttagagttgtctgctgttattgcttccatggcaacaaatgagaacctcccaccaaatgtcatcaggcaattggctaaagaactgaagaatcttgatgaatcacctccggaagggattaaagttattgttaatgatgatgacttcagcaccatttttgctgatattgagggccctgctggtactccatatgagaatggagtattccggatgaagctattgttgtcccgtgacttccctcactctcccccgaaaggattcttctcgacaaaaatattccatccaaacatagcaactagtggcgagatatgtgtgaacacgttgaaaaaagactggaaccctagtcttggattgagacatgttctgctggtagtgagatgccttctgatcgaaccattccccgaatctgcccttaatgaacaagctggaaaaatgttgcttgaaaactacgaggagtatgcacgcctagcaaggctatacaccgggcattcatgcacataaacataagaacaagtccaagagcggagccatttgtgagtcaaccacagctctaaacgttggccagagcaacaacaccgttccgagcaagaacataccatcggcgccagcactagtatccacctccacctcgaccaaagttcttggcatacaggatcagaacgctgctccttctgatccttctgtaggatcatcaacggcgcacaagaaggacgggccgcttgccgccaaaatcccagccgagaagaggaagatggatgccaggaagaagagcctgaagaggctgtaacagcgcaccccgccggatagcgttgacgcggggctgttgtagtagctagtagagtcaatccccttgataagcgccgccggattcagcagatgcacagcggaaccgaatggataaataaacccaagagacatctcatgaatctggtggctgattggtagagaagtatgcctgtactcaggcattagtgagatgtatgtgagttggtgtcctgt

SEQ ID NO: 32906 - DNA, 1278 bp, Triticum aestivum
  Clone ID: PAT_TA_32906
cgcgagggagcgagcgcggggatcggccgctccctccctccctccccgccggctccaactcgatctcttacccggaccggaccgccgggggcgcagcgtcggcagtaggatgatcacactgtttgcacagagctgaatctttgtgaccattagagtgctattttggaacaagaaaacttctaagtgaagctgcacagagagaacctttagagttgtctgctgttattgcttccatggcaacaaatgagaacctcccaccaaatgtcatcaggcaattggctaaagaactgaagaatcttgatgaatcacctccggaagggattaaagttattgttaatgatgatgacttcagcaccatttttgctgatattgagggccctgctggaactccatatgagaatggagtattccggatgaagctattgttgtctcgtgacttccctcactctcccccaaaaggttcttctcgacaaaaatattccatccaaacatagcaactagtggcgagattgtgtgaacacgctgaaaaaggattggaaccctagtcttgggttgagacatgttctgctggtagtgagatgccttctgatcgaaccattccccgaatctgcccttaatgaacaagctggaaagatgttgcttgaaaactacgaggagtatgcacgccttgcaaggctatacaccggcattcatgcacataaacataagaacaagtccaagagcggagccatttgcgagtcaaccacaactctaaacgttggccagagcaacaacaccgttccgagcaagaacataccatcggcgccagcactagtatccacctccacctcgaccaaagttctcggcatacaggatcagaacgcagctccttctgatcctgctgtagggccatcaacggcaaacaagaaggacgggccgcttgccaccaaaatcccagccgagaagaggaagatggatgccaggaagaagagcctgaagaggctgtaacagcgcaccccgccgggatagcgtcgaagtgtggctgttgtagtagttaggagattcaatcccctacccttgataagcgacgccagattcagcaggtgcacagtgggaccgaatgaataaataaacccaagggacatctgatgaatctggtggttgattggtagaagtatgcctgtagtcagaactgtagtgatgtgagatgagatgcatgtgagttgcacccctgttggaataaactctagtgatgtgcaatgacgaactatttggaagaacaaactgtcgccttttcag

SEQ ID NO: 32907 - DNA, 1578 bp, Triticum aestivum
  Clone ID: PAT_TA_32907
cccacgcgtccggcttataatcgctcaccgttttaataccgtcatcgactgtgacaggttggttattctaagttctgggaaggtttcggaatttgacacccctgagaatcttgtgagcaacgaggaaagtgctttctccaagatggttcagagtacaggacctagcaatgcagagtatcttaagtctcttgtgcttggaaatggtgaagaacggctgcgaaaggaagaaaatgagttgcaagatactcagaggaaatgggctgcgtctaaccgatgggctgttgctgcccagtttgcgcttgctgctagcctcgcgtcatcccacagtgacctcctctcgttggaggctgctgagggaaataacatcctcaggaaaacaaaggatgcagtaatcaccctgcacagcgtccttgaagggaagcacaataccgaaatcgaggaatcgctcaccgagtatgaggttccgcttccgcctgataggtggtggtcgtcactttacaaagtcatccaaggccttgccacgatgagcaaactgggtcgcaaccgtctacggcaacggcaacctggttacagttttgaaaaccacggctcatcgtctattgactgggatcaaatttaggtgtaggaaactgcattgcagcaccactgaatccctggaacctgcgttcgtggaatagtttgaaggcgtgcagttattaaccatcttcttacgaagccttttatcccaaacaagttggggtaggctagatatgaaaccctttcacgaggacttcccaggaggtcacccatcctagtactactctcgcccaaatgggtttcatacccaaaagactggctagtttttacgttggctcgccaagcctatcacaacccttagatatgaaaccctttcacgaggacttcctaggaggtcacccatcctagtactattctcgctcaaatgggtttcatacctatgggactggctagtttttacgttggctcgccaagcctatcacaaccctcctcctttacccgggcttgggaccggctatgcctagaagacataggcggagttaacaagtatatatgaataactaataaaatatgtatgcaaagaagacaataaataatcaatgcatgagatgaaataagatcagaatactgccccatttgttgactgaatgatcattaatttccccaatcaacataactgaatatctcctgtgtctttatgtcattgaacttcccttgctggggacgggattcctggcggcagcggtgcagttgactcgcggttgcggcttgagacggcagtcagggtgactctaggcggcgtggacatgcaggccccctcgatccaatccgctgctctgctcttgtcaatcaagcgacttatcctcacctcttcccggctgcacctctttggatgttgtgcacctgcggctactcttcgatggtgagcctcctcccatgacggcgccgttgggctgggaagcctttgtaaccaccccatcttgacgacccagcactgtccctgatctgccacagcggcgacctgtgcacgagcgatgggaaggcgaggaggaggaaggggcg

SEQ ID NO: 32908 - DNA, 2103 bp, Triticum aestivum
  unsure (1)..(2103): unsure at all n locations
  Clone ID: PAT_TA_32908
gctgggtccctgcgttgccggctagccgcttctcctgcgtcttctcctccccgcttctctcctcctagtcgagtcctggaccagatcggcatctggcgcaggaggctcggggtggtcgcaggttcgggcgccatctccttccttcccgtacactgggatcaaacagcccgcggcctggcggtgccggcctggatctggaggcagatggaccaggatcctggagctgggcacgaaggagctcgaggtcgacgactccggcttcgtcctcctcctctgacgtcgccaccttgctcaggcctggacgatggcaagcattgacgtgcgcacgtcgttgcaacagacacacctcaaccctcccgacgcacgcaataatcagcggtgccaaaatgatttggtgtttgcaagggtcgcttttgttgcattttctacgtgagaaaccatctcaggctgtgcttttattcatgttcatattccacgtatgcatgtgctgctccggtggtgttttattagttgattggcatatatggatctctccatgtttattagttgatctccaacccctactctgctgtggtgttgtgggagcaagaagagcatgcatgctttctctctacatctagggtccatatggccagattgacgggcctaaacactggctcaaaggtttctttcaagaatcatgagagaacattcaaggagtggattatttggaaattagaaccttcagatttcttagaacttcacttggatttatgtgaatataagcgtaagaggtctagtggcaatgctacaaaatcactgcaggcgatataataacgttgtagatagacggagactgaatcagttgacactactttgatgtctatcgagccaatgggacaacaaagtccttgcagaaaagaagaaccggaagcgggttatctatcttcacgagcaagttggcgtctgtaaaccttcaccggagccattccagctctttcagagccacaaggcaaggaagttgaggaaccaagaccccaacggtgcggagcagtttgccatcgagaggactagggctgccatcagggacctctaaaccaagctcaacatctccctcgtgcctccatcaacaccgtgtcctggagggtcgtcgccgtccgcgacgacgagctactgccgcagctttgtcagccacatggttagagggaggcatcaagggcctgccaccgctcccggggctgattttcttcctcaggtgatattccaatatacaataagttccatcaagaattgcatgtacatgtgctgctatcctgatccaaaaaggaaagtaaaaagggcgttcatctacctggcaccgcccagatgcccctcaagcggcgcgccacgggtgcgccccaactactagtgaaggattggagtatcaccaaagaactagctatggacaggggtgcgtggaagcttgctatccatgtgccagagccatgaattggtcgcgagatcttatgggtttcacctctagcctaccccaacttgtttgggactaaaggctttgttgttgttgttgttgttgtaacctaaagaagcagctgaaccgccaacaacacttgcaatggaaactcaatttcgtcgacaagatgaacaagtttctgctctactagagcgcacagaacaaatacaacgacaaattggatagatgcatcaagttctcttttctcaaggaatcagaaatgtggaaacaccagggacaaatggtagatagtagcaagtccactagttgatcgaagatgttctcgtgattgcttttgttgagaacatggatgacacatctccttcatatagaagttgatttggcttggtgattgaagagttggtcttccgtaatattctgtagcagcagcagtccagtgaacaagaacttggtctcttatgaactttggccattatgtttgtaacatgcatgtcttgtatatctgacttgtgtgtttccataatggttgtaggtgagtgtagaaaaccaatgaatcttctatatatattgaatgaatgcattgatcaacgatatcttgtgatgaatcgaagagtgcaattgtttgtatgtattacttatnaacanaatttaat

SEQ ID NO: 32909 - DNA, 1333 bp, Triticum aestivum
  Clone ID: PAT_TA_32909
cgcgctccaatcattgcgacgcgcgccgctcccctcccctcccctccccgcgagcccgacccagattggtcgctcctcaccctcctcctccggctgcatctgttatcagaaatttatcactattgtggaagaacatctgctcactaaagttgcttgcgaagccagaacaaagctatttgccatcttgcttccatggcaaccaacgaaaacctcccaccaaatgtcatcaggcaattgggctaaagaattgaagaatcttgaccagtcacctccagaagggattagagtgattgtgaatgacgatgacttcacaagtatttgtgcagatatagatggccctggcgggactccgtatgagaatgggttttcccggatgaagctagtcttgtcccgtgacttccctcaatccccaccaaaaggattttttgtgaccaaaatattccatccaaacatatcgagcagtggtgagatctgcgttaacacgttgaaaaaggattggaatcctactcatggattaaggcatgttctactggtggtgagatgcctactgattgaaccattcccagaatctgcgctcaatgagcaggctggaaagatgttacttgagaactatgcggactatgcacgggcatgcaaggttatacaccagcattcatgccctcaaacctaaggctaagcccaagagtggcactatctccgagtcgacttctgtaaacgtggatcagtcaagcacaacaaatctatgcgaaactgcaccatcggcgcccatggctttatgtgctactgctgctaccaaagtgccaggctcaaactcgctggatcagaatgctcccgctgagcccactgttggaccatctacgacattgcccaagaaggaaggacctgttgctacaaaagccccagccgataagaagaagattgacgcgaggaagaagagcttgaagagattgtaagcaaaatgttggggcatcagagtgccagatgtagcacagacgaatgaatattgggctccaggtggcatgagagggcaggtgccagatgtagcagacgagtgaatattgggctccaggtgacatgagaggcatctggtaaactgttttgtcacctgcggaaattgtgtcgaaagaatgtgaattgttgtatactccctctgtctgaaaaaacttgtcatcaaaatgaataaaaaggcatgtatctaggactaatatacatctaaatacatccccttttattcattttgatgacaagtatttccggacggagggagtatcttgcatcaacacttgtgtaatgacaattctcccaaagaaggctctgccttcactattcaatt

SEQ ID NO: 32910 - DNA, 844 bp, Triticum aestivum
  Clone ID: PAT_TA_32910
ttgggaaaccaaaatatttcgtagttgcagacaagctaacataaacatttcaacactaaagtaactgcagcaagcataatggttacactacactgtttagatagctaattgctaatttaggttatgcggctgatggaaccaaacaatatataaagaatctattttcaagtactccctctgtaaacggtccggtcctatgaggacattacacatcactcagaattccatggagatggtctcctttcctatacctaacctatgtatatatacctccatggagatggacaaagacgacacgacccacatcacgacagcacggttctagtttccttggtccatccccttgcttctcttcaggtctctaccttggtgttgccatgctactcccactgaagtgtgtaaagcccagctctgaattttcgattgcaccgctcatcatcatccatcttagagaataggcaaaatcttcacgtcgcctgcaagagacccattagaatttgggtccagaaatcaacatgggtcagtgaaaaggggttataaaggaaaatatgatatatccagagtcatttttgtttatggctccgtcttcttttcttccatattggctggttaaaatgaacaacggtgtcttcgatagcggttagagaagctccatctgcagtgtcactgtcaaccttggggtgttcctcagcaggaactataggctcagctgccacgtttatcttcttggttgtagtggaataaaacacgtctgacaccatgggtattttaaggagatatacctgcagctgcagctgcagcttagcctcgttcatttttaagtgggcatgcataactacataca

SEQ ID NO: 32911 - DNA, 1747 bp, Triticum aestivum
  Clone ID: PAT_TA_32911
atgaattagacgmtggrtcgcgagaccgcaggattcaactgcatctmaatwtwmtrtacccgtawactggattgggaggtcctggtgcgcaaaaatctactgtwtgcaacggcgcacgcagacctggatgacaccaagcattgacgtgtgcacgttcgtcgcaacagccacacctcaaccctcctgacgcacacaacaattagcggtgccaaaatgatttggtgtttgcaaggggtctgcttttgttgcattttctacacgtgagaaaccatctcaggctatttggatgcacctgcacagtactgatagtacatgaaattcatcaacctgctgttgccgcaaccaaccaaagtttgctctaacagagtgatgaatacaaatattcatgctaagctttcttcaaattatgctaattgatcttaaaaaactggctactggtgttatttgctgcaatttatttctgacagccaggtagtcttggaatgctttcgtaatgcaatttatttctgatagacaagctatgctaattgatcttgaaaagctggctactggtgttatctgctttgtggaaggctgttggcattaaactttagtgctcggctgtccatcatagtatcatttcctcgataattaatgaggcatgaaaaataggtgaaattgcaggaaaattgaagaaacggaggaacacgattcattttgtcaatgggaacatctactgttacagatacactttctgtattctacctatcgatggcgtaatgtttgaatattaagtcatttctttttgtcattagcaggtgcttttattcatgttcatattccacgtatgcatgtgctgctccggtggtgttttattagttgattggcatatatggatctctccatgtttattagttgatctccaacccctactctgctgtggtgttgtgggagcaagaagagcatgcatgctttctctctacatctagggtccatacggccagattgacgggcctaaactctgggtttctttcaagaatcatgagagaacattcaaggagtggcttatttggaaattagaaccttcagatttcttagaacttcactcggatttatgtgaatataagctataagaggtttagtggcaatgctacaaaatcactgtaggcgatataataacgtgtctgataggtggtgattgaatcatttgacaccaccttagatgtgtatcgagccaatgggacaacaaagaaaagaagaaccggaagcagggtatctatcttcacgagcaagttggcgtctgtaaaccttcaccggagccattccagctctttcaaagccacaaggcaaggaagttgaggaaccaagaccccaacggtgtggagcagtttgccatcgagaggactagggctaccataagggacctgtagaccaagctcaacatctccctcgtgcctccatcaacaccgtgtcctggagggtcgtcaccgtccgcgacgacgagctactgccgcagctttgcccagccgcacggttagagggaggcatcaagggcctgccaccgctcccggggccgatgtgcgtgtaatttctattaatgtatcttatgtagccaaacaacaacatgctcctgtcaatgctatatcattatgggcgtggcatttttcttcctcaggtgatattccaatatacaataagttccatcaagaattgcatgtacatgtgctgctatcctgatccaaaaaggaaagtaaaaagggcgttcatc

SEQ ID NO: 32912 - DNA, 756 bp, Triticum aestivum
  Clone ID: PAT_TA_32912
cggcacgagtgaagggagactaccatcgctacctcgcggagttcaagtcggccgccgagcgcaaggatgccgctgactccaccctcggtgcctaccaggccgctcaggtatccccctatctttaactagcttttctcccttcctctgatgagcggtttgacttttttttggatcttgggtggttccttgctctaggacatagccatgaaggagctgccaccgactcaccccatcaggctgggcctcgcgctcaacttctccgtgttctactatgagatcctcaactcgcctgatcgtgcgtgctcgctcgcgaaacaggccttcgatgaagccatcgctgagctggattccctcggagaagattcctacaaggacagcaccctgatcatgcaacttctccgtgacaatctcaccttgtggacctctgatatgcaggatgacgctggcgatgaaatgagggattcaagcaagcctgaggatgagcagtagtgaagggtcctagctactgccctctttctctcttagccttcgggtagttatgatgcttgtacaaggaccattttcgtgtgtcctttgttgctgggtcttttacctaccctttctttcgttatattgttatacatcgccgtcctcgtgcattattttactttacaacttgaatcctgctcgtgtatgcacgggttccttaagatttgaaccagagggttcaactcttgcttcctataatcaaacagctatgcatgatcggtgtttaac

SEQ ID NO: 32913 - DNA, 1114 bp, Triticum aestivum
  Clone ID: PAT_TA_32913
gctcctccccacttcccctcctgcacccacccactccgccgagaaacagcaacagccacagccacacgcccacgcgcacacaccagatcgtcgacagcgatggcaaaggcagcggcaacgagggaggagatggtctacttggcgaagctggcggagcaggccgagcggtacgaggagatggtcgagttcatggagaaggtcgtggcggcggcggggaccgtcgagctcaccatcgaggagaggaacctgctctcagtcgcgtacaagaacgtcatcggggcgcgtcgtgcttcctggcgcatcgtgtcctccatcgagcagaaggaggaagggcgtggagcggcggggcacgccgccgcggcgcgcgggtaccgcgcacttgtcgaggccgagctctccaacatctgcgcggggatcctccgtctcctcgacgaacgcctagtccccgccgctgccgccgtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcaggctgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgatcatgcaacttctccgtgacaatctcactttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgctgggtcttttatctaccctttctttcgttatattgttatacatcgccgtcctcgtgcattattttactttacaacttgaatcctgctcgtgtatgcacggcttccttcagatttgaaccagagggttgtcaactcttgctccct

SEQ ID NO: 32914 - DNA, 1051 bp, Triticum aestivum
  unsure (1)..(1051): unsure at all n locations
  Clone ID: PAT_TA_32914
tcacaaatatcagacaaccaatgtcacaaactgaagattggaacgacaacttggtgaaataaatttatcacaactcaatggagtgaccatgttagaggcctgaatgtaacatcactttccagctgccagagcattcaaaaaatctattgaggtatgtcattatgtgggaaaggacagaccctctactaagaaaaatgagaaccataaaatttatttagtttccatgactagaagcaaacagttgagatggttgtccaacatcgtttgagatatacgagatagagtcagggtagcaccaattgaggagaagcttgtccaacatcgtttaaaatggtttgggcatattcagcgcaggcctccagaagctccagtgcatagcggacggctaaagcgtgcggagaatgtcaagagagggcggggtcgaccgattttgacatgggaggagtccgttaagagagacctgaaggattggagtatcgacaaagagctagctatggacaggggtgcgtggaagcttgctatccatgtgccagagccatgagttggttgcgagatcttatgggtttcacctctagcctaccccaacttgtttgggactaaaggctttgttgttgttgttgttgttgttgttgttgttgttgtactcggcattgccattcggtggcagcctctatgtggtggatggaggngtggggtctcgaaccatcgcgcatcctgcgcatcaatcctccagaagattccaacctctcctcatggtcagtgataccaccacaaatggtcacccaatgtccagtgaaactgtcgaggatgcttcaactggtagagtgcaactccgagctgcttttggttggctgtgacagtggacactcaaggattgtgcttttccgggttgctgaccttctacatggagtcaccaccatgcagctgacaagcatcggtgatcaagccgtcttcatcggcggatggaacatggctgttaactccaagagcctgccatccgtccaggggaactncatcgccggtgtcaatgaaataggtggggggtcttgca

SEQ ID NO: 32915 - DNA, 1275 bp, Triticum aestivum
  Clone ID: PAT_TA_32915
tgatcacactgttggcacagagctgaatctttgtgaccataagagtgctattttggaacaagaaaacttctaagtgaagctgcacagagagaacctttagagttgtctgctgttattgcttccatggcaacaaatgagaacctcccaccaaatgtcatcaggcaattggctaaagaactgaagaatcttgatgaatcacctccggaagggattaaagttattgttttttttaggatgtattacatttatttctagtagctaattagtactccgatgtactatttctatatgtatgggtagcgtgaatgctattttttaacccatctcataatcaatagatatccgcctaggtccgagagaatttcgaagcacgccttctaaaccgtgacggagggagtaccagtaatgccctgtacctagccagcgacgcatcagttcggacggactcgagtagtgttcagactggcctccgtcgcttgtacggtagccacacacacacacacaccgtgacggcgtgccacgatcatgcctgggtttcttctagcgaggatgccctccgctcctgcaccaccctggcgaagaggctgccgtcgtagacgcccctggcggcgtccttgcggaggagcccgtcctcgtccttgccgatgctgtacagcagcttccactccgccgacgcgcccgcccatcccgcgtagtcgccgggctgccggttcgcggcgatcagctcgtccacctccgcggacgtcagggcgtccggcaccgtcttgccgtgcttggcgaacgccgcatcgaacttgtccggaacgaaccttccttgggagtcatacgcgcctgagtcgctcccgtggatgcccttgtggatgttctcgatgtagatggacatgcgcgccgtgtcattttccggtctggtctgggggccaaggacgccattgatgaaggtggcactcaaggtggacgaagcaaatccaaatccgagggcccgaaacgctgcgtacgtctcggagaaggtgacgacgccgtccttgtcgcggtcgaagaaggccgcgtgcttctgcagcgccgtcatgccgccggcgcccgaatcgtcgccgtaccccgacgcctggccccctaggaacatggggaacaggagcagcagggacaaggccgccgccgccgtcgccgtcgccgccgccggggaggacgacgcccgtcgcggtcttgcgtccatctcgagggatttcttccgccctcgctcgctcgctctttgactgctgtcccctctcttctctgcct

SEQ ID NO: 32916 - DNA, 1051 bp, Triticum aestivum
  Clone ID: PAT_TA_32916
cagtcgtgtgggcataataaaaccatatccgcaggacacaaacaacaggacatcggtcccatcccaagattccgttcacaagcgttcacaccctttcacactgcctatttttttaaacattaattcagcagtatagtaccgtccgtagctatgtggcgacagaccgtgacggcgtgacgcgacgagccaatcacaccggataagtaatgccctgtaactagccagcgacgcatcggttcggacggactcgagtgttcgactggcctccgtcgcttgtacggtagccacacaccgtgacggcgtgccacgatcatgcctgggtttctcctatagatgtcctccgctcctgcaccaccctggcgaagaggctgccgtcgtagacgcccctggcggcgtccttgcggaggagcccgtccttgtccttgccgatgctgtacagcaacttccactccgccgacgcgcccgcccatcccgcgtagtcgctgggctcccgattcgcggtgatcagctcgtccacctccgcggacgtcagggcgtccggcaccgtcttggcgtgcttggcgaatgccgcctcgaacttctcgggaacgaaccttccttgagagtcatacgcgcctgaatcgctcccatggatgcccttgtggatgttctcgatgtagatggacatgcgcgccgtatcattttccggtctggtctgggggccaaggacgccattgatgaaggtagcactcaaggtggaggcggcatacccgaatccaagggcccgaaacgctgcgtatgtctcggagaaggtgacgacgccgtccttgtcgccgtcgaagaacgccgcgtgcttctgcagcgccgtcatgctgccggcgcccgaatcgtcgccgtacgccgacgcctgcccccctaagaacatggggaacaggagcagcagggacaaggccgccgtcgccgccgccggcgaggacgatgcccgtcgcggtcttgcatccatctcaagggatttcttccgcctcgctcgcttttgactgttgtcacctctcttctctgtcccacgcgtccg

SEQ ID NO: 32917 - DNA, 2286 bp, Triticum aestivum
  unsure (1)..(2286): unsure at all n locations
  Clone ID: PAT_TA_32917
ggccgaaggaaggcgaaagcgacatctataagatgcccagatccgagagaggaagacgagggatattggccaagtcaaatgcatcaagcacagagcagaccaactcttggtgaaggacgatgagattaagcatagatggcgggagtacttcgacaagctgttcaatggggagaatgagagttcttaccattgaactggacaactcctttgatgagaccagcatgcgttttgtgcggcgcatccaggagtctgaggtcaaggaggctttaaaaaggatgaaaggaggcaaggcgatgggccctgattgtatccccattgaggtgtggaaaggtctcggggacatagcgatagtatggctaaccaagcttttcaacctcatttttcgggcaaacaagatgccagaagaatggagacggagtatattagtaccaatcttcaagaacaagggggatgttcagagttgtactaattaccgtggaattaagctgatgagccatacaatgaagctatgggagagagtcattgagcaccgcttaagaagaatgacaagcgtgaccaaaaatcagtttggtttcatgcctgggaggtcaaccatggaagccattttcttggtacgacagcttatggagagatatagggagcaaaagaaggacttgcatatggtgttcattgacttggagaaggcctatggtaagatatagcggaatgtcatgtggtgggccttggagaaacacaaaatcccagcaaagtacattaccctcatcaaggacatgtacgataatgttgtgacaagtgttcgaacaagtgatgtcgacaccgatgacttcccgattaagataggactgcatcaggggtcatctttgaccccttatctttttgcattggtgatggatgaggtcacaaggggtatacaaggagatatcccatggtgtatgctctttgcggatgatgtggtgctagttgacgatagtcggatggggtaaataggaagttagagttatggagacaaaccttggaatcgaaagggtttagtcttagtagaactaaaaccgagtacatgatgtgcggtttcagtactactaggtgtgaggaggaggttagccttgatgcacaggtggtacctcagaaggaggacacctttcgatatttggggtcaatgctgcaggaggatgggggtattgatgaagatgtgaaccatcgaatcaaagccggatggatgaagtggcgccaagcttctggcattctctgtgacaagagagtgccacaaaagctaaaagacaagttctacaggacggcggttcgacccgcaatgttgtatggcgcggagtgttggccgactaaaaggcgacatgttcaacagttaggtgtggcggagatgcgtatgttgagatggatgtgtggccacacgaggaaggatcgagtccggaatgatgatatacgagatagagttggggtagcaccaattgaggagaagcttgtccaacatcgtttgagatggtttgggcatattcagcgcaggcctccagaagctccagtgtatagcggacggctaaagcgtgcggagaatgtcaagagagggcggggtcgaccgattttgacatgggaggagtccgttaagagagatctgaaggattggagtatcgacaaagagctagctatggacaggggtgcgtggaagcttgctatccatgtgccagagccatgatttggttgcgaggtcttttggggtttcacctctagcctaccccaacttgcttgggactaaaggctttgttgttgttgttgttgttgatggattcacatgatgcgacggacctgctgtcggctgtcttccccgaccacttatgtgagctgctcctgccgctgaccctcctcaacttcgccctttgctcgctgttgctcctggtgccaccggatgcaagggtggagcttgcgcctctttctctacaccagtttatgttgctttcgcttacgttgctttcgttgctgcgaatgtggttaagatggcgttctacaccagcttcttatgttgcatgtgaatggggtgagtagatagaattgaaatgagctaagcatttggtgattcgccaagtgaagatagcatggaccctggggcggcatccgcgtcctggggtttgcagctcagcgtggtgctgctgacaaggtccatctccccttaacttactgcttagcaacgatcttaatattacaattttccccaagatgcatttgatttgtgatttgttttgtgaatgctggntgcatcagaacactagtctatgtaca

SEQ ID NO: 32918 - DNA, 2240 bp, Triticum aestivum
  Clone ID: PAT_TA_32918
actacatgctccggtctatattaagagctcccatggtattttttcacaccaatccacttggacggatcatcaacagattttcgaaggatttgggtgacattgacaggaatcttgctgtctttgtcaacatgtttatggcacaaatatctcagttactctcaacatttgttctcatcggtgttgtcagcactatgtctctttgggctatcatgccacttctgattttattttatgcagcctacctttattaccaggccacatcacgtgaggtaaagcgcatggattctattactaggtctcctgtgtatgctcagttttcagaggcattaaatggtctgtccacaatccgtgcctacaaagcctatgatagaatgtcaaacatcaatgggaaatcaatggacaacaacatcaggttcacactcgtgaacatgagttcaaataggtggctagccatccggctggaaacattgggtggcatcatgatatggttcacggcaacatttgctgtcatgcaaaaccaacgagcagagaatcagaaggcctttgcttccacgatgggtcttcttcttacctataccctcaatatcaccaatctgctcacagctgttcttcgtcttgctagtcttgctgaaaacagcatgaatgctgttgaacgtgtgggaacatacattgagttgccttctgaggctcctcctgtcattgaggataacaggccacctcctggttggccatcatctggtatcatcaagtttgaagatgttgtgcttcggtaccgaccagaacttcctcctgttcttcatggaatatcattcattattaatggaagtgagaaggtaggaatagttggcagaacaggtgctggtaaatctagcatgcttaatgctttgttccgtattgtggagctggagcgagggagaatattgattgatgattgtgatacttctaagtttggaatttgggatttgcgaaaagtgttaggaataataccacaggcaccggtcctcttttcaggtactattcgatttaatctggatcctttcagcgagcataatgatgcggatctatgggaggctcttgaaagggctcatctaaaagatgtcataaggaggaatgctctagggctagatgctgaggtttctgaggccggtgaaaattttagcgttggacagcggcagctgctgagtttagctcgtgcattgctacgaagggcaaagatacttgttcttgatgaggcaacagcagcagttgatgttcgaactgatgctcttatacagaagacaatcagagaagaattcaagagttgtacaatgcttataatcgctcaccgcttgaacactgttatcgactgtgacaggttgcttattctaagttctgggaagatttcggaatttgacacccccgagaaccttctgagcaatgaggatggtgctttctccaagatggttcagagcacagggcctagcaatgcagaatatcttaagtctcttgtgcttgggaatggtgaagagaggctgcgaaaggaagaaagtaagctgcaagatattcagaggaaatgggccgcgtcgaaccgatgggctgttgctgcccagtttgcgcttgctgctagcctcgcgtcatcccacagcgaccttctctcgttggaggttgctgagggaaacaacatcctcaggaaaacaaaggacgcggtactcaccctgcagggcgtccttgaagggaagcacaatactgaaatcgaggagtcactcaccgagtatcaggttccatctgataggtggtggtcgtcactttacaaagtcatcgaaggcctcgccacgatgagcaaactgggtcgcaaccgtctgcggcaacctggttacagttttgaaaaccacgggtctattgactgggatcaaatttaggtgtagaacactgcgttgctgcgctattgaatccctggaaccgcatcgtggagtagtttgggggtgtgcattaatcaggcacggtttaatttctacagtattgtagtacatttttgtacattttattgccagtacattgacgtgcaagtcgggagttactccagtagaaacgccgtcttgacgcctatctgaaggcgaataacaaggggattttgtagcagtagcagtcttgtaatgtcgtccgcatgggttacatttcttgtgcacaatctcggtaatcagcgtacccgaaattttgataatattgtgcaatacgagtgtacgtggattccaaaaaaaaaa

SEQ ID NO: 32919 - DNA, 1142 bp, Triticum aestivum
  Clone ID: PAT_TA_32919
cccacccactccgccgagaaacagcaacagccacagccacacgcccacgcgcacacaccagatcgtcgacagcgatggcaaaggcagcggcagcgggaacgagggaggagatggtctacatggcgaagctggcggagcaggccgagcggtacgaggagatggtcgagttcatggagaaggtcgtggcggcggcggggaccggcgagctcaccgtcgaggagaggaacctgctctcagtcgcgtacaagaacgtcatcggggcgcgtcgtgcttcctggcgcatcgtgtcctccatcgagcagaaggaggaagggcgcggagcggcggggcacgccgccgcggcgcgcgggtaccgcgcacttgtcgaggccgagctctccaacatctgcgcggggatcctccgtctcctctacgaacgcctagtccccgccgccgtcgccgtcgacgccaaggtattctacctgaagatgaagggagactaccatcgctacctcgcggagttcaagtcggccgccgagcgcaaggatgccgctgactccaccctcggtgcctaccaggccgctcaggacatagccatgaaggagctgccaccgactcaccccatcagactgggcctcgcgctcaacttctccgtgttctactatgagatcctcaactcgcctgatcgtgcgtgctcgctcgccaaacaggccttcgatgaagccatcgctgagctggattccctcggagaagattcctacaaggacagcaccctgataatgcaacttctccgtgacaatctcaccttgtggacctctgatatgcaggatgacgctggcgatgaaatgagggattcaagcaagcctgaggatgagcagtagtgaagggtcctagctactgccctctttctctcttaaccttcgggtagttatgatgcttgtacaaggaccattttcgtgtgtcctttgttgcttggtcttttacctaccctttctttcgttatattgttatacatcgccgtcctcgtgcattattttactttacaacttgaatactgctcgtgtatgcacggcttccttcagatttgaaccagagggttgtcaactcttgcttcctataatcaaacagctatgcatgttcggtgtttaaaaaaaaaggggggg

SEQ ID NO: 32920 - DNA, 979 bp, Triticum aestivum
  Clone ID: PAT_TA_32920
ctagggggctttttttttttttttttggaagatgcaccgagactctgttgatcaagggacacaagcaaagtgacacatacacaactaatcacatcaaattaagaatatgtatgtctgaacattcaccagcgatatggaaaatatagccaagtatctatccgttttcccgagtcacgatttcaacagcggacgtcttagaaccataacgcaacgacgggtcgagaacagttcccagatttcatgacaggacggtgacgctggtacaaaatgcaaatccccactaaaacttattcagctcttggacacttccgaatgactgactgactgactggtataagacgacggtgctagacagactccgccttggtgtagatccgtacggcgacggccaagcccagtatcgcgagggggaccaagaactggaggatcttgatgacgaactcgggggtcttgtcctggttgtagtgcggctgcttgggcggcgtgtacttgaccttggtgggtatcgtggtcgcgtcgatctcaccaacatagtactcatccatcatcgcccgggcggtcgtgctgtgccccgcatcctcaaagtcgtcggtcgcgtccttggcggttgaagacagcaagacatcgtcgcctccagggtggtcatcaagaaacttggtcacattgtacaccttgccgccgatgactagccagcagtcgtccttggaggtgtgcttggcgacctcctcgagggtgaacaccttgccaccggacgacgacatggtctcctcctcctcctctctgctcctctctgctgtcaagcgagagtgatgggaagggtttgatccaaggaggaggagcggaattgattgatatctggaggagaggagaggggagggggcgccgcggtgggtaggtcgggtctgcgagggtttgggttgacccacctaccccggcctcacctgccaacccacacccgtctgagattgcaaagcctggg

SEQ ID NO: 32921 - DNA, 845 bp, Triticum aestivum
  Clone ID: PAT_TA_32921
taggggccttttttttttttttttttctttttttttttttttttttttacacaactaatcacatcaaattaagaatatgtatgtctgaacattcaccagcgatatggaaaatatagccaagtatctatccgtttttcccgagtcacgattcaacagcggacgtcttagtagaaccataacgcaacgacgggtcgagagcagttcccagattccatgacaggacggtgacgctggtacaaaatatgcaaatccccactaaaacttattcagctcttggacacttccgaatgactgactgactggtataagatgacggtgctagacagagtctgccttggtgtagatccgtacggcgacggccaggcccagtatcgcgagggggaccaagaactggaggatcttgatgacgaactcgggggtcttgtcctggttgtagtgcggctgcttgggcggcgtgtacttgaccttggtgggtatcgtggtcgcgtcgatctcgccgacgtagtactcgtccatcatcgcccgggcggttgtgctgtgtcccacgtcctcgaagtcgtcggtcgcgtccttggcagttgaagacagcaagacgtcgtcgcctccagggtggtcatcaagaaacttggtcacattgtacaccttgccgccgatgacgagccagcagtcgtccttggagctgtgcttggcgacctcctccagggtgaagagcttgccaccggacgacgacatggtctcctcctcctcctcctcctcctcctctctctgcttccaaggagtcaagcgagagtgatgggaagggtttggatccaagggggaggagcggaatttccggaccggccggc

SEQ ID NO: 32922 - DNA, 1053 bp, Triticum aestivum
  unsure (1)..(1053): unsure at all n locations
  Clone ID: PAT_TA_32922
ccgaggtctagtctcgagtttttttttttttttttttaacatgtcaatttgccttttatttctgtgcaagatgtagccctgctactgcaacagcagtacaaatttggtgcgcctacaggccattcagtgtgacaaccgagactgtcgaacaaggggcacaaacaaagtgacacatacacaactaatcacatcaaattaagaatatgtatgtctgaacattcaccagcgatatggaaaatatagccaagtatctatccgtttttcccgagtcacgatttcaacagcggacgtcagtagaaccataacgcaacgacgggtcgagagcagttcccagattccatgacaggacggtgacgctggtacacaaaatatgcaaatccccactaaaacttattcagctcttggacacttccgaatgactgactgactgactggtataagacgacggtgctagacagactccgccttggtgtagatccgtacggcgacggccaggcccagtatcgcgagggggaccaagaactggaggatcttgatgacgaactcgggggtcttgtcctggttgtagtgcggctgcttgggcggcgtgtacttgaccttggtgggtatcgtggtcgcgtcgatctcgcccacgtagtactcgtccatcatcgcccgggcggtcgtgctgtgccccacgtcctcgaagtcgtcggtcgcatccttggctgttgaagacagcaagacgtcgtcgcctccagggtggtcatcgagaaacttggtcacattgtacaccttgccgccgatgactagccagcagtcgtccttggagctgtgcttggcgacctcctccagggtgaagagcttgccaccggacgacgccatgctctcctctctctctgtgcttccaaggaggagtcaagcgaggcgagagtgatggatggggtttgggggttggatccaaggagggggagcggaattgattgatatctggaggggaggggaaggggggcgtgtggtgtggtggctgcgccgccggtgggtccgaacccggccgnngcctcgagcccggcc

SEQ ID NO: 32923 - DNA, 844 bp, Triticum aestivum
  Clone ID: PAT_TA_32923
gccgctgatatgcgctggatagtatgcatggacggcttgatatgtgcttgcgtgcacgagtcgtccgcacggcgtcgtgtgtatagcagcgctgaacaatgaatctaaatattacgaaccagatcattggaagtttgggactgcgggtaacaactactttaggcacgcaacacggcagctgtatgctataacaagggacttggcgacctacgtatcagcaaacaagcatatcttgcacaaatatacaaatgaagacgtatcatttggttcttggttgattgggttggatgttgagcatgttgatcagagaagcctttgttgtggtattcctccagactgcgaatggaaggcgcaggctgggaacccatgtggggcatccttcgactggaactgctccggcgtctgcaatccagcagagagaatggaggaggtgcaccggcgatgctgggaacatcgcgaggctgctctgccacaagcgcgggagtcttgacaatcaaggggtggtggcatccttgtgctgctccatgtaaactcatgtaaattattagacggtagacgcagacgcagcagctgtcgatgccgttgtctgggttcttggagctacaaatttttgccttcccacgccgtgcatttgcatgaattggagggaaaatttgaacagagctactgcatagtgaaggttttgcatcgtgtatgtaagatatccgatatgtgaaaatgaatgcaggaaagctctgcaaattgtgtctgtcatgatttaaatggtcacaatatccctgaaaaaaaaaaaaaaaaaacctgaattctcagtgttgagtataatgtttatttaggaaaatggaaa

SEQ ID NO: 32924 - DNA, 811 bp, Triticum aestivum
  Clone ID: PAT_TA_32924
cagccgtcgtccaccagcccggtgctgctccggtgagtggccgccatccacccgccccgcgctgctccggcgggcatctgcccatccaccaccgcagccatgtggcaacccagcttgcggcgcggagtggggtgcttcaaccagcggcgagcgggagtggcagccgttggcgaccgaggatgaccgcaggctgccaccgggtgctgcaaccgacaagcaattttgctggaaccacggcaacaagtgtggcagatccgatgaacaagggaaggccatggagttgatttgctgggacggtggacggcggtggcggcggagctgcaacggcggttggtggtagggatgcgattgtgtgcccccgtgctgcaaccacggggcggttgggagttccaatgacaacctcgaacacggcggtgacctcgcgcgcgcgacgacgacgacttgtttgcggcgcgctggcacgagccaccgacggcaagcgcaggtcacggggcggccgacgagcgcattgttgtgcgaccgtgcgggaggccgggagtgcggatgaagacgaccagatgcgctgggtcgcgttgggctctatcctctttttttttctgcgagatgaacgcaagatcgtacggtctgaaagcgatgtatcgtgtggtagggcagtgaccagcccaaatttaggccggtgcgccggcgcctatcactcgccttttttatacgcggaagatgttcttatgttattggcgacaaaactcgtgccattcccttccctcatcagagaagcaggaatttcccgcaaaaaaaaaaaaaaaaaaaaaaa

SEQ ID NO: 32925 - DNA, 440 bp, Triticum aestivum
  Clone ID: PAT_TA_32925
cccacgcgtccgcccacgcgtccgcccacgcgtccgcccacgcgtccgcatttttgaaaatccagtatcatcttccaaggtcctcagattatgacgatgttcctgtgaaggatgcaccatctaaagtacctatattttcagacatgctgaataggggtgcttcatttaattggtcagaaactgggcagcagagttttaggattatgaagaagaaactgcaagaagctagttggcagtaaaaggtgtctcggttggaaaattctgctgagtttgcacatgtccttcgcatatctgtgaaatgatcacgctgttgacagagatgcacttactttgcgtatgttcacgaagtatcaaacgaaggcattgctgtaaggcctttgtgtgcacataatggattaatggcgtgctgatgtttgaacgggtacgacctgattggatgc

SEQ ID NO: 32926 - DNA, 498 bp, Triticum aestivum
  unsure (1)..(498): unsure at all n locations
  Clone ID: PAT_TA_32926
cgggctcaacccgcaataggccaacttcaacgcaacgcagcacgggcaacgttggttgaacaaggagctgaccgagtccagcaatggcggcgagggctgcatgtaccggccggctgctcagagcaaccaccgccaaggacagccgtctgccatcgtcgtccccggcggccagccggccggcgtgccgcatcccgtctctcaagttcccgttcctgtgggacaccaaggcgaggcaagggaagatcagccgcgccgccgagcagagggcggcgctgatcaccctgggagcagccagcgccagcaccacggaggagaaacaactcctgccgggggaagcgagacttgatttccccctgctgcctctggtacnaggcaaccggaaggctggtgtccggaatttccggnaacntggctggccttangcgggtcctgggcaaagncttccaaggcttatcaacaaagnatctcaaatccatcntaaactancgggtccaagnt

SEQ ID NO: 32927 - DNA, 788 bp, Triticum aestivum
  unsure (1)..(788): unsure at all n locations
  Clone ID: PAT_TA_32927
aggaaaggagtactctcttgttgattcccagaactttgttttctctggggctcacaatcatgctgcattcattctgccgaaaaccgagcatacccttagtcacaagctcgtgccgcttggttccggttcccagcagctgccgaggataacagtagcttcggtgaggtactctgctgcattgactcctccaacctcggccacatccgtctttgtctatcccagcgagcccaaattcaacctggaaaagagccaccccatgtctgatgaatgtgtgagctagattctcgcaaactcggcaatccactccttatgcccccttggctgtgcaagcagaggaacgccgctggaaagagaagcccgtcggtgattcagtctcacctccttgctgaacaggcttgaagcgaaaatgctgttatcagagtggtgattcgcacgacgccgaagttttggccttgttttgaatattggtttctgtagaccttttggatagaccacatatgcctgtaacttgtgattatactccattgttttttggctcaaggatagttgcacacagtagacatggcgcgttggtgctgtatgtaaattaggccccaccaggcaagtggggaataagtgatccccatatctctcagtagcagaagttttttgttatcttcaggttcattgtttctgtaaaacttgtgttcaaccatactgacatctctgctgctacaagctaagctttcatatccagtgtttttcgcctaanttttgggccttgtttgaatatgggttcggtaaacntt

SEQ ID NO: 32928 - DNA, 893 bp, Triticum aestivum
  Clone ID: PAT_TA_32928
gttgagaaacgcaaagacctagattggggaaggaggttcaagattatcagtggagttgctaggggattacaatatctccacgaagattctcaattgaagatagttcaccgggacctgaaagcaagcaacattctgttggactttgattacaaccctaagatttctgattttggcttggcaaagatatttggaggggatcaatcagaagatgtcactagacgtattgccgggaacatatggatacatgtcgcctgaatatgccatgcatggtcaatactcagcaaaatcggatgcgttcagcttcggcgttttggttttggagatcgtcacgggaagaagaaacaacggctcctgcaactccgagcaatatgtttatctcgtaaatcttgtatgggaacactggaccaggggaaatgtcgtcgagttgatcgatccatcccttagcggccatccttctcacgttgaccaggtgctgaaatgcatccgaaccgggctgctgtgtgtgcagaacagacctgaagataggccggcaatgtcgtcggtaaatgccatgcttaccagccagagtgtccgtctcccttctgtttccatgccagccttctgtgacagattgagtggatgcagtgataattcagaatcggagtcttcgaatggaatgaccatcacaaagcttgagccaagatgagccttgaagcagttgctgaaccagtttgtactagtgttactttactatcccgtccatcccataatataagagcgtttctgacactacactagtgttgaaaatgctcttatattatgggacggagggagtatctcctagagatgagcttgatgtacctggtgcttatgtttcatggttatgatgaaaagtcttatgtgcctccaaggtt

SEQ ID NO: 32929 - DNA, 424 bp, Triticum aestivum
  Clone ID: PAT_TA_32929
tcccgggccgacggatccgcgggacccgccagtcagcgggccccagaagctggcgggaaggacggcggcctgagagacagacggctgggacccgcgcccagccggattactattgtaccctcggggggtaggcctatataaacccctcggggcacccatgcaaagggttcggacctagagaggaagatagaccagatagcccagggagaagagagctagccttgctctctcccacctcccaaaacagctccaggagcaccattgtagttaccttgctttagtgatcatgcggagaccccgcagagcagcagtaggggtgttatctcctaggagagccctgaagctgggtaagttccgccagcgtgcatgtcttcgcctcatcccgcttccaggcaccggcgacgttctactcgctcccaacatg

SEQ ID NO: 32930 - DNA, 674 bp, Triticum aestivum
  Clone ID: PAT_TA_32930
actgctgcccattgataggctggtgatcactgctgtcgagaggaactacgcatccatcccttccgcccccagctacctcgcttgctccacgcatcgtctttgaaggagaggaagatgacgagcgtatggaagaccaaggttctccccgggctcaacaagatcttcgacaaggatggcaagaaggccgccgccgccgagttcttgaaatccttcaacaaggaggagattgacaaggagattgaggacaagaagacagaactagagcccaaggttgtggagaccattgaagcatctcctccagaaattaagggcttgatgaaggataagaaaacatccaagatcaagaagaactcagttgccgtcaccaagttccttgacgatttggccaagattgatttccccggagccaagctggtgagcgacgcggtggccaagtccggcaccacgcccctctccccggccatcgtcttcatcttggacaaggttgcgcccttcgtcccagcgcccaaagaggagcccaaggccgagcccgaggacgccgccccggcagaggagaccaccacccgcgaggtcgccgtggaggagaagaaggaggaagccgagccctccgccgcaccggcagaagcgcccgcggccgttggaagcagccgcgcccgctgctgaggaagtggaag

SEQ ID NO: 32931 - DNA, 1398 bp, Triticum aestivum
  Clone ID: PAT_TA_32931
gcagggatgcctctggacgaggcggttcgagggcgggtatcactgcctgtcgagagggaactacgccgcatccctctcttccgcccccaggctacctcgcttgctccacgcgtcgtctttgaaggagaggaaagatgaccggagcgtttggaagaccaaggttcttcccgggctcaacaagatcttcgacaaggcatggcaaagaaggccgcgcgccggcccgacgttcttgaaatccttcaacaaggaaggaggatgtgacaaggaagatatgaggacaagaagacagaactaagagcccaagcttgtggtagacgattgaagcatctcctccacgaaattaagggattgataaaggataagaaaacatccaagatcacaagaagaactcagttagccgtcaccaagttccttgacgatttggccaccgagttgattttcccgcggaagccaagcttgcgtgagcgacgcggtgggccaagtccggcaccacgcccctctccccgcgccatcgtcttcaccttgggcaccaacggctgcgcgtttcgtacccgcgcccaacgtaccgagcccaaggacggagcccgaaggccgagcccgccgccccggcacggggcagaccaaccacccgcgagggcgccgtggagggagagaagggaagaggaggccggagccctccgccgcaccggcagaagccgcgccggcgggcggctgaggcagccgccccctgctgaggtagtggaggagaagaaagaaggacgaagaaacccgccgaagccgccgcacctgccgccgaggagccagaggaagaagtgatcggtcgccgccggccggagtccaagagcaacccaaaccaccacctggcttgctagctgctggtaatggaagaaatcattttaagttattgtgaatttgtagtcgctctccgtgtcaaggtagctgcacaaaagtaagcacgtacgtacgacacactgcacttgccatgcataccacgcatgcaaacgtacacgcatggaacatttgttattctttcgatggaccggtctcctcaccgtatgtgtacattttacgtggggctttcttgcttttttgtggtggttaaaacctgtgtaattatgattatgttggtgtgttaatttgttggtcatggtataatcaggaacttgtgcattcttcctcttcaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaagcgggccccccaaaagtttcaaacttaatttacccttaaatgaaatttaaaacccctccaaaagtgcccccaaattcaaattcagggcccttcttttaaaaattt

SEQ ID NO: 32932 - DNA, 2570 bp, Triticum aestivum
  Clone ID: PAT_TA_32932
ggcacgtgtcccctccctctaaacctcaatggccaagtgcttttattcgagtaatttgtagaaattacatgactcggaacgcttcaacaggaactacatactgtcggagaattcaaacacacgggaggcacgacggaaagcaggaacgtcacattatttcgcctcaaatcaaagtcttggggaaaagcttccacggaaactgtggcacgcgtctgagtttattcctcgacgatgctcgttcagttcaccctcgccggcgaggacggcgactgggccgtcaacggcgtttgaaccctcagtgtttgaggcacggatactgtcatctttatgctcggtagattgtaccgagaccgcgactacgcaaggttcttcgtgctcgagaccttcggcagggtgccctatttcgcgtttatatcggtgcttcacttgtacgagacctttggctggtcgagaagagctgataacatcaaagtgcactttgctgaaagcatgaatgagttccatcacctcttaatcatggaagcattgggtggcaactctgtatggcttgatcgctttcttgcgcggtttagcgcctttttttactacttcgtcactgttggcatgtacatgctgagcccaagaatggcataccacttttctgaatgtgttgagaggcatgcatactcaacttatgacaagttccttaagctcaatggagaggagttgaaaaaactaccagctccagaggtggctgtaaactattacatgaatgaggatctctacatgtttgatgagtttcaaacatcaagagcctccaaatactaggaggcctaaagttgataacttgtatgatgtattcgtgaatgtacgggacgatgaggcggagcattgcaagacaatgaaggcctgtcaaacgcatgaaaccctccgttctcctcatgccgtgcagagctcagtagaagctgatgcagaatgattctgtcaagaagtcccttggaaatgaagactgaccggttgtacgtacctccgtgctagagcatcgtagagtatcatactaaattttggtgatatattgtattccatcctttttctcccttctcttcgtatgtagacattagccagacttgcgtacttgtgaatcttacatagcgaatataggtttataaatgcatcacagatttacaatgagagatgtgcaccgttggttaggcattaccgcgggccatgaacggtgtaatccagctgtgttgtggtgtgtgtaacatcaagggttttgatgcttgttgaaggaaaagtcgtgattttttcctgactccgaaacataaacgaaaaaaaccaactgaattgaaaagaaaaaaacatcaaaaaaaaaaaaacttgttgaaaaaaaagtcttgatgatttgctgaaaaaaaaaataaaaaaaaaaaaacatgaggaaagcgttgaccataggccagatggggttcaccttgaaaaaattgaggccctccacccagttggccccgatctccacgttgaggccgcctaagttgtgcttgttttttcgcccgcccacgcgccccgtcgcctccaggatcagcaggtccctcacaccggcgtcaaaaagccgctttcagctttctgctcctcgtcgtacttgggacggactttgaactccacgttgttgaggaccttgttcatgagaatgtccgcggagtcgatacctgcaagataagctccgtggacgtagccgttgtagtgctcgctggtgtgctccccggtgaagtagacccgcccgccaaccggcgcccggagctggtcgtactcgtagcggttgacgccgacgggccagttggagtaggagcccttgaagaatcggttggaccaccagcgcggcacgtagatatcggtggcgtcggggacgtcccggtcggggaacatgttccgcagcacgcccacggcctccgccatggtcacgttgtcgggctgctgctcgatccgccgcgactccacgtccgtcaccgtcaccatcagcacgttggcccccgggtactcctgctcgaacgactgccacatcccgtagtagcctctcctggagctggcgtagacgaagaactgcttcccggggcccgttggccagaacttcctggggaacttgaggaagatcttggtgtacacgcccatgtcaaatcggtagatggcaaggatcttccatgccggcagctgaggcttgaactgtatgaggtcgctttgcaggacccctatgctggcggacacgatcacgtagtctgcgctgtacgctgagttgtcctccgtagtcaccaccacgcctctctggtcgtaggagatctcacgcaccaccttgttgagcttgaccctaggatctacgatgttcccggacttgtcggaacgcaggtactggccggcgatgtgatatatgagggtctcgaatccccgctgatcggcgacaaagttggcgtcatccccgaagtcggcgaaggtggccgtcggctcggtgccctgcaggctggtgacgcgcggcggctcggcgaactcgtagtcgtacctgaagtagtcgagcaccatgtccaccggcgtcgccggcc

SEQ ID NO: 32933 - DNA, 482 bp, Triticum aestivum
  Clone ID: PAT_TA_32933
ctcgtatccagttacataaccgcaaggtgtcgatgcccatgggcgacactcacacctcgctcacactcgggacagcctaggcggatccatgctttccaacgaagcacgcccatccaacctatgcgggtggaatcgatgcccatggggacatctcggtatttcgtgcgcaagacgactatcccgccacccaaacggcctaggagaatccatgtcagcccatgccatgacacgcccattctcttgggcgacgaggtgaaaagatgcccgtggggacatctcggtaatatcatgcgagcaagttatataccgccacccctaggcctcgaagaatccgtgtcagcccacgcatgacacgcccattcttctcagccactcagcaatttttgtccgagaactgctgaaaaaaccccgacacttttaaaccgccccaaccctcccgcctcgaagaactaatggcagcccacgcaaagcaagcccattct

SEQ ID NO: 32934 - DNA, 904 bp, Triticum aestivum
  Clone ID: PAT_TA_32934
acaaacagtgactatgtgcatctccacaataacggcatccagatcttacagcttcgagcctgagatccaaagacatctctgaacaaaataaaggccatgtcgaattgtagcttacaactatgagctatagtacaaggattgtacatccaggaggcaagaaaactagtataggtattacaaaaaacttccctataatcggtgcgacaatcatcttgtccacaacccaggtttcatctggattgactggcactaggtcactcgctgtctgtaaggggtatccatgcatcgggtatagaagaacaacgagaattgaaactgagcattccatagaggtcagtttaagccttacaataaagcagataatacaatcaacattgggaccagaaataacaaactaaaatcatatatatagccttttaacaaactaaaatcaatataatagccagcaaatatagatcccagaaatatagtgatgccagaaaacaacttctggggcattttcaatatgctcactgtgaattgtgatccaccttcctggaaaagtctctgcttaatagggattaagcttatctctttggtagatctagaaataaaatgagctcatatattcccaacgatgctatcctgcaactcaatcagtgcacagatgagcttggtaacttacaacttatgagatgttccaacttctgaatttgcaaattccacgacgtccttggtcaaatgaggtgcgaatagattccaccatataggatacagagggagattccaatagctcaatttcccgttccagttcagcgagtcggtcttcaaagttactctgggaactactggctggcataaatactttcctatatgctttccttaggctccgtacctcttggtctgagaaaccgttgcgcctgag

SEQ ID NO: 32935 - DNA, 1110 bp, Triticum aestivum
  Clone ID: PAT_TA_32935
caataacggcatccgatcttacagcttcgagcctgagatccaaagacatctctgaacaaaatcaaggccatgtcgagttgctgcgtacaactatgagctatagtacaaggattgtacatccaggaggcaagaaaactagtacaggtattacacacaacctccctataatcggtgcgacaatcatcttgtccacaacccaggtttcatctggattgactggcacccggtcactcgctgtctgtatggtgtatccatgcgtcgggtatagaagaacaacgagaattgaaaccgagcattccatagagtcgggtgggctgtcaacttatgagatgttccaacttctgaatttgcaaattccacgacgtccttggtcaaatgaggtgcgaatagattccaccatataggatacagagggagattccaatagctcaatttcccgttccagttcagcgagtcggtcttcaaagttactctgggaactactggctggcataaatactttcctatatgctttccttaggctccgtacctcttggtctgagaaaccgttgcgcctgagaccttcaagattcagaccacgaagctctgctctatcacctgcaaccatcgtgtatcttggaacatcttgtgcaaccacagagcctccgcctagaaatgagaatgatccaatgtgacaaaattgatggacaacgacagccccagcagtatgagtgcagtcttcaacaataacatggccaccaaatagagtattattagcaaagatgttattgctgccaatcttgcagtcatgtgctacatggcaggaccccattatgagattattgtcaccaataaccgtgcagtcacaaggtttagaagatcggtgaatagagcagtaccatgtgatctcattgttgttaccaatgcgtagaaagtaaccgtgcagtggcttagtttagaagatcggtgaatagagcagtactctctgatctcattgttgttaccaatgcgtagaaagcattcatctcctggcttatatttgagatcttggcacttaacaccaaccacagcatagttcccaattacattattttccccaataattgttcgtccaggtagatctgcaccaag

SEQ ID NO: 32936 - DNA, 782 bp, Triticum aestivum
  Clone ID: PAT_TA_32936
ttttttttttttgatcgaagaaagaaaaatcattactcaatactgccgaatggatccaatcatttcagagatcagttaaagattacatatagcattacagaaaatagtacaagagcgctagatagtttctacaattcgagcaagtagtcaactatgatagatgggataagtcactcttgcaaaacacagcaagctatttaagcttctaattcttgaaacctctgataccttcaccccagaaactacaatatgggtgaaggttactaggtgtagaaaggttcacgtttaaaaagctccttgggctgcattgactcaaggttgacaatgaccagaaaagtactcccccatcaaactaatgatagaacattctcagcctcacgtactattcattactaaatcctctcgatcttaattcccaacctaattagcttctactgttcaaagcaacaccataacaaccgtacaggaacaccataacaattatccttgaaaacgctcattagaaagcagggtacgtgcccagcagtcatcaaactgaaaagcaaacccaactcgaatcagccgtccaaacgatcccttcaaccgcctggctgatacaaccagtgaatcgaccggtcacgcccacagttggccacaccatgcctcaccccagtaggccgctgtgccgtgtgcgcaaccactgattggtcttaccatgcttcaacctaagaatgctataagatcagtaatgtagttgtatacacatagaaactaccaatctaccatagaataattacgtggag

SEQ ID NO: 32937 - DNA, 836 bp, Triticum aestivum
  Clone ID: PAT_TA_32937
aaagtcaaaaggttgcacttcacttctactccctctgtagagaaatataagcttgtttagatcactaatataatgatctaaacaatcatatactatttctttacagagggggtaatataagaccttttagatcactactttacagagggagtaattatgttttggcattgcagttcccctagcgtctgctcgaatactccatatcacaggcttacaatgttgtgtacatccccttttccaatgaataaaggcaacacaaacttcccaaaaaaaggcaaaaagagatgcaaccatgcaggtcctgaaccgggcaatgctgctttcctttccatgatattccttaaaacagggcaacttcaacataacgagagacgcatcaactggcatcactgaagcgatatctgctgtgcagctttactgtggccaaagttctaatgtctgctccctgggtagaagaagtctgcgccgttttccttcaccttaaaatggaagctccaaactttccgccctttcgccggcctttgctcgatgagcattcctttgtttaccactgacaggtgtccatgaacatcaccggttaaaccagagctcagaggtgccgctttaatcacaagatccagaatatagcgcagatgccccaaaagttccacacaatcctcgcttgaataaataacctcatgaataagaaccacacgcaagcaattcatttcaaacaggagggtcacacaataatgccaaaagtccaaaacatcatctgcacaaccattggcgggaacttccacaagtgaaacatcctctatcataaccctgaaccgacctgccttttctccaaccct

SEQ ID NO: 32938 - DNA, 441 bp, Triticum aestivum
  Clone ID: PAT_TA_32938
aaaccggaaatataatactacatatatatccagggatagatgtagtacatgatgaggtgctgcatacatatcatggaggaacacgcacgtacgtacgtacattacatggagtgagtttgagtggcaactcaacaatttattcttacataaattgatactataaccatggaggcattgacagggcatgcatgcatgcatatgagtagctagtttaattattaattgttcttgcatgcactgtgatgtgtcatgccctaggccaggtgatggggcctgagtcgcaggagctgtccttgggccagaggatgagagagagggcaccgacgacctcattcaggcttgacatgcccaactcgttcttgagcttgtcagcctcaggcccgtcgtagcgtccctttttctggcgcgcaacaaggaccggacgcgtggtgtcggaccatc

SEQ ID NO: 32939 - DNA, 894 bp, Triticum aestivum
  Clone ID: PAT_TA_32939
ttctccttgtggatgcactccaataatataccagcggaggtgctcaacatatttgcaaacatgcctcacctagttgatattactctttacaaatttgatgtgctcgataagctgcctgccgagttcccacatagcgtacgtcgtctttttctacatgctgatgtcatagagcaagacctgatgccgatcctggagaaacttccccgtcttgtggtgttgctgttgggtgggtacaaaggccagaccatgtgcttctcttcccaagggttccctcggctgcaagtgttagaacttgatagattttccattgaggagtggaggatggaggaagggacaatgccaaagctctcccacctgacactttgggagtgggagaagatgagcaagctccccgtggggtggctgcaccttccatccctcggtcacctgaagctgaactttatgtacaagatttctgaagatgacatcacactaaagaagctgcggcggaaaggatgtgaggtggaggtgaagagatagagaaatccgctgcttgcccggtgcgaccacaattttgcttgtgctggatcaattgatgttaattagtgtcacaagatcaattttcagggctcgtgctcaacaaagtaattttcttatgagtgccttttgcgcaagtgtaaagggaaaatctttacggatattgctccacgatggatccatgaagacttcatatccttccaaccgcatgtatctgtggaatatgtatttgaacgccaataaaaatgcttcgtcgccgaggcgatactatgagtaatgagttgcatgtaggtgttcctttttctgatttgtaacctgtcttgccaatcttgtattgtgtgtattagtacctaatgttaatctaatcttcttttttcc

SEQ ID NO: 32940 - DNA, 498 bp, Triticum aestivum
  Clone ID: PAT_TA_32940
ggccgccctttttttttttttttttttttttaatttttagatcatccggaaggctcaaaaggcccttccggtatatatgaaaccacaaattccaaacaaaggtcgaggattcggaagctacagcaagaacgtctagaaaggctaaagtagctagaagtagcagataactagacacatccaaagcctatcacccaaattaaagcatatgaaacccagtgctaggcggaaagacatcttctagtagttaggcagctctccgtcatatggcttgcatttccagcggcaccaccaatgtcgaggaagtcctggtcttcctcatcggcgactgggttggagagccggccagctccagaggggaagctgggctgagtggggaggtcttcggcaccctggttagcacagttggggagaatggacgcgaaggagcagtacccacaggaatatctagacagggctccagtaatggaaatgcttttaagcactagttctagatcgcga

SEQ ID NO: 32941 - DNA, 1085 bp, Triticum aestivum
  Clone ID: PAT_TA_32941
gacatcaaactctttttgaggttttctttgaaccggttatttttttttttttttttttttttttttcgctttttttttttttgatgatccaattcttctttttgtttcactcaggtttacagatgagcaacaaaagctgtgacggaactctgggtcaatgcgaaaactgaataagattataagaatgttcgctgtgaaccgagatgaaaaactttagtacaaaaagtcatggtgtacaagaatggcaaaagtccagtctagccttggaaagtatcgtcagcaactggctggctatcaacaggaatatccaagctgttttcttcagcttctgtggtcacctcccttacatcagatacttcagaggaatgaggattttcccactctgtgtccccgatcgtacgtatatcgactccctcgtcatccaactcgactatgttctccgcaataggtatcaggtctgtatcgcttaaacaagccttatccacgttatcgtcgtccatgtccatgtgctttgaagtagagcatagctctgacctttcctcacagatttgttttgtgctagtctcttgcctttgtatttgtgattttagagcatccaggagagctaagagttcttccttttctttcgcagcagactcgagcttactcacagcttcctttattcgcatgtcagcatcggctgctgaaaccctagctttctcttcagctctcacgacagctgcttctaaaatgacagcatttcctctagcttttccaagctcagagcgccacatctgagcttcttgaagagcagaatctctttccttgagtaaatgctctctttcttcagcaagaagctttgacttttcttctgattcccttagcctaagcaaggacaattcaacttgattttcctgatcttgtttcaggcgttcaagttctgaagataaaaatcttcttgcttcatcaattgcatgagcagcagaagcagcagtttcagctgcctcagcagtctcctgtaatttatctgtaatctccctgatggtggaatctcgtgcacggatatcctgcaatagctggtgcagttcatcatctttaactcgaag

SEQ ID NO: 32942 - DNA, 456 bp, Triticum aestivum
  Clone ID: PAT_TA_32942
tttttttgcaatggtgcaacaacatgttcagaatcacaacaaatgctgctactactgactaataactggagttgccgagtttggcaggcactggatggatctggaggaacgctggccccgcgtcgtcttcgtcttcctcgccggtgcccgccattgacgccggttaaccgctagtacatctacatgaaaaccttggtttggttgactccttcctaatgctgctacgactacatgatgggcatggaatggggatctggctaatgacacaaccacagatcggactgctatggggattcgaggaaaggaagagtaacaactggctctaggatgctatttgaactgctgatgctgatgctgctggctactcttcattcacatctgtctgtctgttgacacctgcacagggtgtgtggaaggggaagggaccgtgggctatgtacagggcgacgtgcgggc

SEQ ID NO: 32943 - DNA, 1010 bp, Triticum aestivum
  Clone ID: PAT_TA_32943
aggcggcaccgccggaataactctacacctaatcgaaagttaattcagcaatcaaaccatcactcagctacaattaaccacctccccttcacccccctaatcaaactacgacttgacagctatctcacatcagattttccacatgcaagagaagtataccagcgggccgcctcagaacagctcctccagatagaggtacgaccgactcgaccgcacaagtgccgaggccgcagcaacgaccacccccgcgctgcccgcgcccggagaagcgcccggccgctaagtagacgaatcgatccaaaccaatgttccgcaggccgggcggctctcggactgctagtcccacatagcctggccgggtgagtatccggcccagctaagactccccggtgcagcggagagctggatggattcaatcaaatcttccacatgttggagtagtccatgggaggctcgccccggcacagctcctccagatcgaggtacgaccgcgacgacggtatcacgaacaaggtgtccccgccggcgagcgccccggtgtcgaagccgagcgaggggctcagcagcgccgacgtagacgccgcctccggcttgcagtgcctgcggatcgcgctctgctgctcccccatggcctggtagggcgagtacgcgccgccgccgtggttgccgttggccgtcgtcgccggcatgaagaagtagttggggctctgcatctgctgctgcggcaccggcggttccgtcttgatggaaaggtgctccatgtccggctccagcggcacggcggcgctggaggtggagctcgaggccccggcgaagtcgtcggcgcctgacggggagtccatgagcatcggcaggtcggggttgttgaagaagtcgtcaacgtcgaggaaggcgtacgggtcctccacgaccccgtcccccgccgacgccgtctggggcggcgcattcttcgccgccaagtccttgtcgaacacccggcaaacagcccaatcgatatgcacgcgcgcctc

SEQ ID NO: 32944 - DNA, 332 bp, Triticum aestivum
  Clone ID: PAT_TA_32944
cggacgcgtgggggcgaggaggagaccttttttgtgccgtgttcgtttgatacgcacggcacgtgtgggtggggccggcgacatcgttgtcatcacggagagaagagaaaagggtgaggtgtttctggaatttccgatgacgcttcatcatcatttcatcagtatagtactcctactgctgtagttagtctcggccttgggtagaattaatttgtctttttagctgtttccagtgctgggtttggtcttgcgattttgatggaattttcttgtacagagacagacagggtggattgattagtatacacggatatgtcttgctcttattgttc

SEQ ID NO: 32945 - DNA, 999 bp, Triticum aestivum
  Clone ID: PAT_TA_32945
ggcgaatcccgacggcatgctgctggtctggcggcgccggcatggggtcctccgcatcggggaaggggacggccgccacggggggtcggcgggcgagctgctctcctcgccgctgccctgactgcaccgctccggcgacagcccccggttgctgaccacgcggcaggagcgcctgggcggcggcgacgcgggcagcacggcgtcggccggcacctgcttcctgcgacggcgcgggatgatcccggccagccaggaacggctcttcttgcgctccttggctttgtccttgtcctccggtccgtggcggcggtggtggtggctgccgaagagcgtggcgagcacggagaatttcccggcgcgcggcttgtggtacccgatgtcgccttcctcgagcggggcactgccgccgtaggcggggccgacctgcggcgtccggaagaagagcaggctcgggtggtgcctgagcgcgccgcccgaggagtcggacttcctgcgggacacgtacggcgacacggacctcgggaacgccggggccggcgccgcctccgcgggcggagggggagcggtggcgggaggagtggacggcgtcgacgacgcgtcgttctgcgcggcggcgagcacgagcaggcggtcccgcaggcacgtggcgcagatgccgccgccggcctggaacgggtgcctcttgcacctcatgcccatctcatctcatctcatccccgtcgccgccagcgatgacgaggaagcccgcggcggctgctaaattctcgcggccgacgccgacgcgcgcacctgccgtcctcctttgctttcctttttggtttgtttaaacttgggtgggcttcttggaaatgggaagttggttggcggagctggtgcaggtgtccgggcgggaagatgggatctttctccgtcaggggagggacgccgcggccgccgcgggcttaaataaggttcggagacgaagagaagaggagaagaagatggagtcgtggacggagg

SEQ ID NO: 32946 - DNA, 704 bp, Triticum aestivum
  Clone ID: PAT_TA_32946
gctgatccggcgcaccagtagaggaggaggcggcggcggccatgggcagcggtcgctgtttgtgaaggtgtacatggagggcgtccccacccacccgaagctggatctgttgctggtggactggtacgacagactcctcgccgtcctaggccgcatgttcaaggcctccatcatacatccggatactgtcggccgtgatcaccgagtggttcttggggagaagcaggctcgccatgttgtcacttatcaagaccaggagggggactggttgatggccggggacgtaccgtgggagctattcctggcgggtgtgaagaaattgaagattgcaagggtggacagtagcacctctgattgattcaacgagggcgactcatgtggcctccattcctgggtgtgcttggatttcattaattcatttatgggggattaagatgagatggttatttcttggtgaagtcggctgcttcatagtgtacagtctgcaaaagtgtgggacatattcctgaaaaaaaaggagcaacacatatataatacctttttctaaacaaaaaacttcaaatttgatcgtttattttcacctctgtggccgacactatgaatatagatcaagtaccgggcttgctaaaactcaatctactgagatttaaccaagtcttagtcgactgcataaaaaaaaaaaaaaaaaaactcgaactagtctc

SEQ ID NO: 32947 - DNA, 1039 bp, Triticum aestivum
  Clone ID: PAT_TA_32947
ccccgcgcgtccggcttcttgatcggggttggttgggtgttgtatgagagggagtgagcgggcggcggtgtcagcgtcaacgtcggggatgagctgcaacggctgccgcgtgctgcgcaagggctgcaacgacgcctgcgtgctgcgcccctgcctgctctggatcgaggccgccgacgcgcagggccacgccaccctcttcgccgccaagttcttcggccgcgccggcctcatgtccttcctcaccgctgtccccgagcagcagcgcccagccgtgttccagtcgctgctgtacgaggcggcggggcggacgatcaacccggtgagcggcgcggtggggctgctctgggcggggagctggcacctctgcgaggcggcggtccagaccgtgctccggggcggcgccatccgcccgctgccggagctcgcgggcggcgtcccggaaggcggcgtcggtggcagcgatctgttcgcctcctcttccaggcgggccgtggtggggtgctccacgtattcggcggcgaagcgggtaacgccgaggaagacctgggcgccggaggccgcgtcccagcaccaggagcccccgtgcgacctcgggcttttcctcacccccggatcggccgccgcggcggagggggagcgacgggtgaggcgtgccggcacgccgtcgatgagctccgacggctccgtgaccacgagcgccggcgccggcgagaaggagccggagctgctgaatctttttgtttaatgaagctagttattaatctgcgcgttcattcaccgtagtagtaccgcgcgatcgaccgatcgatcgatgcgctgctcgctcgctggcgctggaaccagctgaactttttggtagcctccctctcgtcccaccggcgacgcgccccttgattcttttttgggcgtgcatgaaccgccggctcggtgtgacacggagatgactagatgagaccgccccggccggctttgttccttgtctactccgataatagtaccgctgctttctaaaaaccaccactactgctacaaagat

SEQ ID NO: 32948 - DNA, 944 bp, Triticum aestivum
  unsure (1)..(944): unsure at all n locations
  Clone ID: PAT_TA_32948
ccgccccgtggcgcttctcgcgctactctcgccctcctcctcctcgcgctgtcggcggcgctcgcccccgcccgcgcggccgccaccggcgtcttcgaggtgcgccgcaagttcccgcgccaccacggaggcggcgccggcgggggcaagcacctggcggacctccgggagcacgacgctcgccgccacggccgctccctcgccgccgccgtcgacctgcccctcggcggcaacggcctccccaccgagaccgggctctacttcacgcagattgggatcggcacgccggccaagagctactacgtgcaggtggacaccggcagcgacatactctgggtcaactgcgtctcctgcgacacctgcccccgcaagagcggcctcgggatagagctgacgctgtacgacccgagtggatcgtcgagcggcaccggggtcacgtgcggccaggagttctgcgtggcgactcacggcggcgtgctcccgtcctgcgtccccgccgcgccgtgccagtacagcatctcatacggagacggaagctccaccactgggttctttgtcacggacttcttgcagtacaaccaggtgtccggcaatagccaaaccaccttggccaatacaagcatcacgtttgggtgtggtgctaagattggtggagatttggggtcgtcaagccaggcccttgacggggattcttggatttggtcagtcaaattcatccatgctgtcgcagttagcggctgcaggaaaagtgaggaaggtcttcgcacattgcttggacaccataagtggcggagggatttttgctattggggatgtcggccagcccgggaatgtnctnnaaccccaaagtngaacaaaaaccccccttgtgcctggcaatccncaaataaaaatgtncactttggaacnattnaagtttggggggtttaacctcaacntccaaa

SEQ ID NO: 32949 - DNA, 1831 bp, Triticum aestivum
  Clone ID: PAT_TA_32949
tatcgaattcggcacgagattgtggaatatgcataccagcggacgaagaattttgagaggctgacttttctgtatcttattactggttacatggacaaggtgggcttcatgtgcaaaattgccggacagaataacaatttgatgggtcagttccacaatgcattgtatcttggggatgctaggaagcgagctgagatcctggagaatgctggacagcttcctcttgcctatgtcactgccgccactcatgggctcactgaaattgctgaaaggcttgctgctgagttgggtgagaatgttccttctctacctgaaggaaaaactcgctcacttttgattccgcccgcacctctcatatccagcgttgattggccattgctccgggtgatgcgtggcatatttgagggtggactggatgctactgggagagcagaagttgaggaagatgatgaagctgctggtgctgactggggtgatgaggacttggatattgtggatgcaagtgatgcagtggcaaatgggggtgatggttttgatcccgaggaaggtgaagcgaacgaggaggatggtgaggaaggtggttgggatcttgaagatctggaattgcctgaagcagagaccccaaaagctgctggaaatgctcgctccactgtgtttgttgctcctacaccaggaatgcctgtcagccaaatttggactcagaaatcttctcttgctggggagcatgcagcagcaggcaactttgacactgcaatgaggttgctcagccgccaggttgggcatcaagaactttgatcccctgaaacccatctttctcgatcttgcatatgggcagtcattcatatcttcgcgcacttgcaactgctcccgttatatcaattgctgttgagaaaggttggagtgagtcctcaagtcctaacgtgaggggccctccttcactagttttcaccttctcacaaatggaagacagactcaaggcagcctacaaagccacaaccgaggggaagttcccagaagcgctgagacagttcctcaacatcttgcataccattcccctgatcgtggtggactcgcggagagaagttgatgaagtgaaggagttgatcgagatagtgagggagtatgttcttggtctaagaatggaactcaagaggaaggaattgaaggacaacgtcaaccggcaacaggaactggcggcctacttcaccaactgcaagctccagagggttcacatgaggcttgtgctctcaaacgccatggctctatgctacaagcagaagaactttgcgaccgcggagcactttgcaaggctgctcctcgagaacagccccaacgaggtccaagcgaagaaggctcggcaggtgcagcagcagtgcaacggcaagcaggacagccatgagctcaactacgactacagaaatccgttcgtcgtctgtggctcgacgtatgttcccatctaccgcggccaaaaggatatctcgtgcccatactgcggatcccggtttgttcctaacattgaagggcagctttgtaccatatgcgagctggctgtggtcggcgcggacgcctcgggcctcctgtgctcccctacacaatgagatgagcggaagaggctagtcgttagagctcccctatattctttctagtctcgtaaagtcttgtcttatattttaccaggaggtttactgaatggtaaggaataagcataatagtacatggttttgtcagagtttttctcatacttcttctatctctctaacccccgttttttttccttgagatgctgttacatgcttgagcttatcatgatcaactcatgcaaactttgcct

SEQ ID NO: 32950 - DNA, 731 bp, Triticum aestivum
  unsure (1)..(731): unsure at all n locations
  Clone ID: PAT_TA_32950
nttttttttttttttttaatcaaagcctgagatttaagtgacctcttcttgcttagcaaaaaaataactaaagaacagatgaagtccaccctgagcgactcgtacacccaccagttctcctactgatattttatatacacggaagttcccgcggatacattaactgcaacgttcagtcatgcaacaccacccctccctcaaagtcgcctacagatgcaggctacaacaccttcccatctataatacaattccgagccggtttcggtttctacgggtaacgtaagtcactccaaaggtggtaacatcaatcagctgcattccaaagggtgctcaaaactagttggtcgggtcgaagtgccttccaaaggtttctgcgacgtaatctcggcggaactgcccaccataggatgtccttgcgtttgttccatctcggcggaactgcccaccgtaggatgttcttgcgttggttccatctcggccgaactgcccaccaagggatgttcttgcgttggtgccatctcagccgaactgcccaccaaggtatgttcttgcgttggtgccatctcagccgaactgccaaccaaaggatattcttgctttggttccatctcagccaaattgcccaccaaaggatgttcttgcgctggttccatcccggcccgtcggcccaccaaaggatgttcttgcgctggtgccatctcaccagaactgcacaccaaaggatgttcttg

SEQ ID NO: 32951 - DNA, 778 bp, Triticum aestivum
  Clone ID: PAT_TA_32951
tttttttttttttttgactaaaaaggtgggtatgtatatacttctcacatcacaatcgaattctgaatattgacaagagaaaccactgagcaagtgaaatttcccaccatctaaccaagagtttatttcctgttccctttttctttgttcactgaaccttgtgaactgaaggaagacaagaagtcttgaaggcacaaacaaatgtttcattctagagaatggaaaaaagaatacaaatcttgtgtctagacatttcaggagaatctgtttacactaaacaagcaggggctgctagtgctagtgctagacggtcttggcggcgacggatttgcagatggggcaccagttcttctgccggagccagtgctgtatgcaggtgatgtggtagtagtgcttacacgccatgttccccacctcctcaccaccagagtactcctcctggcatatgctgcattttctgtcacagtcttggtgtgtctctggggctgtgggcgtgtacaggcctcgtttcaggcacttgtacaacgcgtcctcggaaagccccgtgttcaccgtgccgatccggtcacccaacgcgagcaattcctcgtaggacatgccgtcgatgtccatcctcatcgcccggtgccggtcgctgagcatgaagtagttctccagctcttcgctgccttcgacgtcgaagcgccagtacccgctggagtcctcggcgccatcctgcagagacgaccctccctggagactacccctgtaccttgctaggaacccagagatgaaccct

SEQ ID NO: 32952 - DNA, 1508 bp, Triticum aestivum
  unsure (1)..(1508): unsure at all n locations
  Clone ID: PAT_TA_32952
cccctgttccggcctcggtagttgcctgggcagaaatttgaatgatgcgtcgccggcacgaaggccgtgcgatccgtcgagttatcatgaatcatcggatcagcgagcagagcccgcgtcagccttttatctaataaatgcgcccctcccagaagtcggggtttgttgcacgtattagctctagaattactacggttatccgagtagcacgtaccatcaaacaaactataactgatttaatgagccattcgcagtttcacagttcaaattggttcatacttgcacatgcatggcttaatctttgagacaagcatatgactactggcaggatcaaccaggtagcacgtccttggtgactaccagcacggccatcgttctgcgcttccacttccgtggaaactcagaggcaacagccgggccggtcgtcgctcttgagcggcacagctcatcatccttgaggatcggcgcagagagttgcgtatcctaccacgtaactgtggagaggtagaggcaactcctgttccggttgttctcagttccgagagctttgggtcgggtcgaggcaaccgaaagggccacgaccctttatcgtcagcagcatccgagaccaaaagcgggagcgaggttgccttgatagcaacgggcacgtaatgtgccagccccacgaggcaacgccgcaagcgctatttggccgcagcggcacacccaatgggcgtccgccgcgaggcaacaattatccgaagcaccacttcccgtaggtcgggtactagcacgcaagcactcttaatccagcgattcgaagccacacgagggacgggacacggcgccggtagtcggccgcagtacaacgggggatctaccggcagacacgggtccaaagctactcatgcgcttagtagccaacaagcggtcaaaccaaccaagcctccgcccgtgcagagcacgggaggatcacttgcacgaaggcgtcctgcaaggccaaatctcgcgttcccaccacccgggggatccactagttctagagcggccgccaccgcggtggagctccagcttttgttccctttagtcagggttaagttccnnctaggcnggnttaaattcgagcttggcgtaatcagaannnnnnnnnnnctagcaataaagctacgaatgcaacgattttccaaaggcaactttatcgggacatcggtgcaacgttgtcggacggtcttatcatgcacgaaacgggctactttcctgtttcccgagccgcattcggctgttgggtcagaatttcacttgagacgtacaggagaccgggacagcgatgacgttgccaccgaggggcaacgtttttccggaggcgacattggagggacatcgttgcgactgtttaccgtcggtcggatcgtgtacgcaacggggtactttcctgtttcccgagccaccttcggctgttgggtcagaatttctcacgagacatacacgggaccgggccaacaccttcgtgatggcataacgaccggacg

SEQ ID NO: 32953 - DNA, 813 bp, Triticum aestivum
  unsure (1)..(813): unsure at all n locations
  Clone ID: PAT_TA_32953
ttttttttttttttttttttttcaatacaccgaacttaatataaatgtttggctacagagttcaaatccagggatagccttatctcccatgtgacttcttaggcgtcaggccatcttcatatgacaaaacaaatgaaactttgaccaaattcaaggaaattctctgttattttccttgcatgaaaactgccagaactggtaggcctagagacaacaccgtacaacatgatcagttctttcagagttcaatttcagtatgaatgagtacatgcctgaattccaaacaccaatacacaccacgtgactggaccgggcaatatagttcttacccttggagactacacatacacattgctaagatgtacacaacataggcagaaatacctcgacaacttgagagccctgggattcatcccgatgacacagcagcagccgtggagcaccattcgcttctgcacgtgctcgtccgcgcatgtctccaccaccgccttgcgcctgacgttgtcaccgtagaacaagaacttctttaggtgttcagattgcaataggtagtcaggttcatcgtcatcatccgagtcctgccgtgggatccgcaagctgcatcttctgtgttggtgccatagagttgctgagacgcaaggcggcgctgtccatatgtgtcccctcagcatcagccttagtgctgctccatcatgagctccagtacgtgggtgcatgcgtgccagaggaggtcgaaattccccaattcagagagggtggggccgtggatgcacacgaacatattctaacctcgtgccgaattncctgcagncc

SEQ ID NO: 32954 - DNA, 821 bp, Triticum aestivum
  Clone ID: PAT_TA_32954
aagataaagcagacaagttcacatagaattccctggccggtaattggcatcaatttgtgaatttgagctcccacaaatcccaaggaatataaccaagaggatccttttaattaatacaaataatccaactgttggcgtgaaggactaacatgacttataactaataggagactctttgtgttttatttagtgtagtatacggtaggagaagggcatacccttggtacagaatgagacattaatttatgcgtgcgttattaggccggccgtcatctaaaaaaacttgttgatcacacaaccccacggaaccgcagcagataatggatgtttgtgatgagcgttgccagcaggcatcggcagtcgaacagagattttgttggatggcccaacccttccaattttcatgtaagtagcaccgttacgtggcatactggaccgtgtgccccaggacttcatggccatgccatacccaaacacgtccttgaacggcgtcgtgggcacgccaagcaccatacgattaccaggcgacgagttgggctgctggtttatgaactccacgatgctccccatgagcctcttgctggtgggcctcagcggactgtagaggtggaagccgtggtcctcgccctccgactcctccaccgtcacctcgcggcgccccttggtcatccaaggccacggcgcgtcgtgatcacgcatgcgggccgccaggtcgaggccacgctcgcgcagagtgtcctttccagccacggccacgagcacgcggcggcaagccagcgatgagtctacgaggccggaggatcgatccgggggtcgtattg

SEQ ID NO: 32955 - DNA, 581 bp, Triticum aestivum
  Clone ID: PAT_TA_32955
agaatgacttcggttttagtcgacatggtcttactgaaacggggtgctagtttagttaacaaccgaatggcctcgattttaatcgacatgtcacatcattttcaacactacaaatattacagtttgctgctgtttccggtcttggtaaggctgcccatggcccgggccttctcccggaggacaaacttctgcgtcttccccgtcgaggtcttgggcaagtccccgaacaccaccgtcttgggcgccatgtagtgcggcagcctctcccggcagaaaccgatgatctctgcctccgtggcaatagcaccgtccttcagcttgacgaacgcgcatggcgtctccccccagtggtcgtcgggcctcgccacgaccgccgcctccagcaccgccgggtggctgaagatcaccgactccacctcgatggagctgatgttctcgccgcctgatatgatgatgtccttggcccggtccttgagctggatgtacccgtgcgggtgccgcacggcgaggtctccggtgtgcagccacccgccggccatggactccttggtggcggtgatgtccttgtagtatccgctcat

SEQ ID NO: 32956 - DNA, 460 bp, Triticum aestivum
  Clone ID: PAT_TA_32956
gggttgcaacaatggtcgttcacgatcacattcaacggcagcttcctcggtacagggggtcagtccctggccgtgctcccaacctgaaccgcaacagggagagaggccacgccctgctgtatgctgattgcttttccaacaaactgttcttcaagccggataaattctgacgccgttttcgaatgggaaggcatgtgttcaatcgtatccgaaagggagtggttgctcatgacccatacttcgagtgcaagatggattcccttggcgagcttgggttctcctcttgccagaaatgcactgcggccgtccgcatgcttgcctatggaattccaggcaatttggtggatgagtacgtgcgtatgagtgagacaacatgtctgatgtcaatgtacaagttctgtcaggttatgatcgaggtgtttggtccagagtacttgaggcagccaactgccgctgatac

SEQ ID NO: 32957 - DNA, 671 bp, Triticum aestivum
  unsure (1)..(671): unsure at all n locations
  Clone ID: PAT_TA_32957
ggactgtgacagcaggctcgnccacagcccggttgcaagtggatgcgtggccgcaggcagcgagttccgcacggccattggcgcgggcgtcttccccgccacccgggctaaaaagttcagagggtgaggcagctaatccatgtagcacataacaccttaaaacttgaaccacgagccatgtatgatggaaaggaaccaattcaaaatccatccagctcgctccagaactttgagcaaccataaaatcaacttcaatcacaaatatggccttgtggaagaggacggggaaaacgaaataagaactgttctcgcaaatccacttcagtttggcgacatggcgcagaaggctgggagacgaatgagtgattcctcggacatccatgaattacatattagcacctgcataatcgagaaagcagattacaaataatggtagaatctgaacgaattaagaagatgtggggaggggggtggcagagaaggacgacggtggtcgtcgcacgacccgtgatggatgagctccaccggcgacgcccatgacctccgaagaaggggtggaagagggtcgagcggagctgctcgccggggaagggaaggcagtgccgaattcaagggagaggattgggcggtgggatctagatcaagatttatttctttttctaagaacatct

SEQ ID NO: 32958 - DNA, 475 bp, Triticum aestivum
  unsure (1)..(475): unsure at all n locations
  Clone ID: PAT_TA_32958
cgtgagatcaactctgtcaacgacaacccgctcatcgacgtctcccgtggcaaggccatgcacggtggcaacttccaaggcacccccatcggtgtctccatggacaacacccgcctcgccattgctgctattggcaagctgatgttcgcgcagttctcggagctcgtgaacgacttctacaacaatggcctgtcatccaacctgtccggtggacgcaacccgagcttggactatggtttcaagggcgccgagatcgccatggcctcatactgctctgagctgcagtttttgggcaacccggtgactaaccatgtccagagcgcggagcagcacaaccaggatgtgaactcacttggtctgatctcatccaggaagactgccgaggccattgacatcttgaagatcatggctttcacgttcctggtcgctctgtgccaggccattgaccttcgncacattgaggagaacatgaaga

SEQ ID NO: 32959 - DNA, 3608 bp, Triticum aestivum
  Clone ID: PAT_TA_32959
ggcatccggttcgagatcctcgaggccatcaccaagctgctcaacgccaatgtcacgccgtgcctgccgctccggggcaccatcactgcatccggtgaccttgttccgctgtcctacattgccggccttatcaccggccgacagaactctgttgcggtggcccctgatggcagcaaggtgaccgctgccgaggcattcaagatcgccgggatcgagcacgggttctttgagctgcagcccaaggagggccttgccatggtgaacggcacggctgtgggctctggtcttgcatcgaccgtgctctttgaggccaatgttctgtccgtccttgctgaggtcttgtctgcggtgttctgcgaggtgatgaacggcaagccggagttcactgaccacctgacccacaagctgaagcaccaccctggacagattgaagcagctgcaatcatggagcacatcttggagggaagctcatacatgaagcaggcaaagaagcttggcgagctcgaccccttgatgaagccgaagcaggaccggtatgccctccgcacttcgcctcagtggctcggcccacaaatcgaagttattcgatttgccaccaagtcgattgagcgtgagatcaactctcccccgagcccaggacaagacgtctcggccgaggcagatatttcccccgaggtcaagtcgtctcgtcccgtgttgcctttctcctcctccccgcattcgccgtctgcggttcgcgacccaccgcgcacaagctcacacatccaagacaatacaattaggagcctttgttctgggtttgggggccaatcaaaccaaaacaacaagttcatgtactgatctcgacgtccaggttccaactgcttttgatccgtttgctgaggcaaatgctgaggagctcccggccgctggtgctggatcaaagaactatgtgcatcgtgcgtgtcccagcagcgcaacggaagaaagagtctgacaactgttcagggcttctgaacgaaagtactacaagctacaacaagattctccaaggatctccaaaaaggaaattctggctgtaatgggtactcgtagttccaggatccagaactaaggccaggtcatccaatctccaaaggtgtatcatgcgtaaaaatgttgctatcttttgactcaggacttcaggctgggaacattgtcaaagcaaagagagcatacaatgattccaccggcattttaggccaacacacaaatcgcatacagtgtgcttgtcaccgaagccttaggcaagttagtacgtatacttggtattgtcacatctaagacatttgaattgctagtactcgtgtgaggcatctgtgtttgatgcacttttacatccaatgacatttgaatttgcatcggtgtgttgatgcaagttgtcctttcaaacatggtttgtatgcggccaaccacgtaaggcagtatggtttatccaggtttattgttgcactaaataaatgtacttcaggcttctcgcctcgccattgatgctattggcaagctgatgttcgcgcaagttctccggaggctggtgaacgacttctacaacaatggcctgccatccaacctgtccggtggtacgcaacccgagcttggaactatggtttcaagggcgccgagatcgccatggcctcatactgctctgagctgcagttcttgggcaacccggtgactaaccatgtccaggagcgcggagcagcacaaccaggaatgtgaactcacttggtctgatctcatccagcggagagaccgccgaggctattgacatcttgaagatcatgtcctccacgttcctggtcgcgctgtgccaggccattgatcttcgccacattgaggagaacatgaagacagcggtgaggaactgcgtgatgcaggtggccaagaagaccctgagcatgaagaaacatgggcgggctccacattcgcccgcttctgcgagaaccggatctgctgacccgcgatcgaccgcgaggcggtgttcgcgtacgcggacgacccgtgcagccccaactacccgctgatgcagaagctgcgggcggtgctggtggagcacgcgctggccaacggcgacggcgagcgcgccctggagacctccatcttcgccaaggtggcggagttcgagcagaacatccgcgcggcgctgcggaggtggaggccatgaacgcgcgcgcgtccgtggagaacggcacgccgctggctccgaaccggatcaaggactgccgctcctacccgctctaccagttcgtgcgcgaggtgtgcggcaccgagtacctgaccggcgagaagacacggtcgcccggggaggagctgaacaaggtgctggtggccatgaacgagcgcaagcacatcgacccgctgctcgagtgcctcaaggagtggaacggcgagcccctgccgctctgctgagcagtcgacgagagaaggtaacaccaaaggaaaagaaaacacgtacacacaaagtgaatatagaagtgttcaagactgtgaagcgggaggttcctggtatatctacgttcattgtacttagttaagttgatgttactgttgttttttctcgctgccgccatgccatgagcaggcgaggcaggcagcttctcaaacttgtgttgttgtaacttgtatgatgggagcttaagtacattactttgtttcataatacaccatgttatcgcctttgtttcttaattagtggaagacgcgggcaaggagagagaggagaggagacagatatttcccccgagccgaggacaagtcgtctcgtcccgtgctgcgtttctcctcctcccccgctcctcccccattcgccgtccgcggttctctccaccgaacaagctcacacatcaagacaataaatagagcctcgtttgtttggggccaatcaaaccaaacaacaagttcatgtctgatctcgacgtccaggttccaactgcttttgatccgtttgctgaggcaaatgctgaggactccggcgctggtgctggatcaaagaactatgtgcatgtgcgtgtccagcagcgcaacggaagaaagagtctgactactgttcagggcttgaagaaagattacagctacaacaagattctcaaggatctcaaaaaggaattctgctgtaatggtactgtagtccaggatccagaactaggccaggtcatccaactccaaggtgatcagcgtaaaaatgttgctactttcctagttcaggctggacttgcaaagaaagagagcatcaagattcacggattttaggcaacacacaaatgctcgtgtgctgtcaccgaagcctggaagttgtcgtatacttggtattgtcacatctaagaccatttgaattgctagtagtcacgtgaggcatctgtgtttgatgcacttttacatccgagacatttgaatttgcatcggtgtgttgatgcaagttgtccttcaccatggtttgtatgtgccaccagtatggcagtatggtttatccaggttattgtgcactaaataaatgtacttcaggcttatcttcttaaaaaaatcggcaaaaaaaaaaaaaaaaaaaaatcgggggggggcccggtaccccaattcgccctctagtgggtgta

SEQ ID NO: 32960 - DNA, 794 bp, Triticum aestivum
  unsure (1)..(794): unsure at all n locations
  Clone ID: PAT_TA_32960
gggaggactacatcgagaagtgctgggcgagcaggagcagcacatggccgtcaactactacccgcggtgccccgagccggacctcacctacggcctgcccaagcacacggaccccaacgccctcaccattctcctcatggacccccacgtctccggcctgcaggtgctcaaggacggcgcccagtggatcgccgtcgacccccggcccaacgccctcgtcgtcaacctaggcgaccagttacaggcagtgagcaacggcgcgtacaagagcgtctggcaccgcgcggtggtcaatgcggcgcgggagcgcctgtcggtggcatctttcctgtgcccgtgcaacagcgcggtgatcggcccggcggacaagctcgtcggcgacggggacgagcccgtgtaccgcagctacacctacgacgagtactacaagaagttctggagcaggaacctggaccaggaccactgcctggagctcttcacgggtcagaagtgatccgtgtgcgcaagcttgcctcatctacggttgggtgcagtggacatccacgacgcagcattactcaaataaaaaatgcccccaatgtgcggggttactcgagttgtttgaacttgtttttgcttcagcacaacgtatctatcgatgttcatcttgtattgtattccctatatactagtacgtgtgtgtgtgtgntgtttgtttattaattgtgatcctacttgtaaagaattatggtacactggtccaagaggaaacggctgtgtaataaatttgctgtcgaggagctgagctaactaaa

SEQ ID NO: 32961 - DNA, 1406 bp, Triticum aestivum
  unsure (1)..(1406): unsure at all n locations
  Clone ID: PAT_TA_32961
atacaaccagcccagccgcggcgtttcctcttcgcctacggccgttcctctgctcacgcctcgaccgtcacatctatctactccgtctctctctgttcttgtgccggcatggcggagcagctcatctccacggccgtgcaccacacgctgcccgacagctacgtcaggtcggaggcggaccggccgcgcctggacgaggtcgtgcccgacgccgacatccccgtcgtcgacctcgccaaccccgaccgcgccgccgtcgtcgcccagatcggcgccgcctgcagctcccacggcttcttccaggtgctcaaccacgggctgccgcttgaggtcatgctggcagcgatggcggtggcgcacgacttcttccgcctctcgccggaggagaaggccaagctctactccgacgacccggccaagaagatgcgcctctccaccagcttcaacgtgcgcaaggagaccgtgcacaactggcgcgactacctccgcctgcactgccacccgctcgagcagttcgccccggagtggcctgccaatccgccgcccttcagggatgtcatgagcacatactgcaaggaggtccggcagctcgggttccggctctacgccatgatttcggagagcctgggactggagcaggactacatcaagaaggtcctcggcgagcaggagcagcacatggcggtgaacttctaccccaagtgcccgtcgccggagctgacctacggcctcccggctcacaccgaccccaacgccctcaccatcctgatgatggacgagcaggttgccgggctgcaggtgctcaaggaaggccggtggatcgccgtcaacccgcggcccaacgcgctcgtcatcaatctcggcgaccagctgcaggcgctgagcaacgggagatataagagcgtgtggcaccgcgccgtggtgaactcggacaggccgaggatgtccatcgcctccttcctctgcccctgcaacagcgtcaagctcggccccgccgagaagctcatcggcgagaaatcgccggccgtctacagaaactacacctacgacgagtactacaagaagttctggagcaggaacctggaccaggagcactgcctggagctcttcagaacctagtttctttttctttgatataaaagaagcccattctcttttctttcccaggaaaatggtaagccactcaacaagggttcaccctccagccccctaccaaacaccttctcaaaaaaagaaaagaaatcagaacctagctagacatggggaaaaatcttggacgttnttttgcccttcttggtttcaccatcgccatgttttgtcggtatttaagagttgttcttgccatatcctcgatcgacctttgtgaaccgattgtggctctggccgtgtgcgtgcatagggatgca

SEQ ID NO: 32962 - DNA, 1074 bp, Triticum aestivum
  unsure (1)..(1074): unsure at all n locations
  Clone ID: PAT_TA_32962
gtctctgatcgaccgccaggtgctcaaccacgggctgccgctcggtggcgcacgacttcttccgcctctcgccggaggagaaggccaagctctactccgacgacccggccaagaagatgcgcctctccaccagcttcaacgtgcgcaaggagaccgtgcacaactggcgcgactacctccgcctgcactgccacccgctcgagcagttcgtgccggagtggccagccaatccgccgcccttcagggatgtcatgagcacatactgcaaggaggtccggcagctcgggttccggctctacgccatgatatcggagagcctgggactggagcaggactacatcaagaaggtcctcggcgagcaggagcagcacatggcggtgaacttctaccccaagtgcccgtcgccggagctgacctacggcctcccggctcacaccgaccccaacgccctcaccatcctgatgatggacgagcaggttgccgggctgcaggtgctcaaggaaggccggtggatcgccgtcaacccgcggcccaacgcgctcgtcatcaatctcggcgaccagctgcaggcgctgagcaacgggagatataagagcgtgtggcaccgcgccgtggtgaactcggacaggccgaggatgtccatcgcctncttcctctgcccctgcacagcgtcaagctccgccccgccgagaagctcatcggcgagaaatcgccgggcgtgtaccgcagctacagctacgacgagtactacaagaagttctggagcaggaacctggaccaggaccattgcctggagctcttcacgggtcagaagtgatccgtgtgcacaagcttgcctcatctacggctgggtgcagtggacatccacgacgtagcattactcaaataataaatgccctcaatgtgcggggttactcgagttgtttgaacttgtttttgcttgagcacaacgtatttattgatgtccatcttgtattgtaatccctatatactagtgggtgtgcgcgcgcgcttgttttaattgtgatcctactcgtaatgaattatggtactacaacatagnnnanattanag

SEQ ID NO: 32963 - DNA, 814 bp, Triticum aestivum
  unsure (1)..(814): unsure at all n locations
  Clone ID: PAT_TA_32963
acagaaactacacttacgacgagtactacaagaagttctggagcaggaacctggaccaggagcactgcctggagctcttcagaacctagtttctttttctttgatataaaagaagcccattctcttttctttcccaggaaaatggtaagccactcaacaagggttcaccctccagccccctaccaaacaccttctcaaaaaaagaaaagaaatcagaacctagctagacatggggaaaaaatctggacgtttttttgcccttcttgttttcaaccatcgccatgttttgtcggtcatttaggagttgttcttgccatatcctcgatcgacctttgtgaaccgattgtggctctggccgtgtgcgtgcatagggatgcaaatttgtagcgttctggggtgcctgtgacccttagttcaactggatgcaaattgtagcttctggggtgcctgtgacccttagttcaactggatgaagtaaattatcataagtgctgtgaacttttaaatttagttcattaggttgaactaaaaagggtcagggtgcgtaccatgatggagtttttccttttttgcgaggggtaccatgatggagttgataaaggcgaagttcttgtttgaattatgcgaaaaatatagtagctactcttgttttttagaacgatttatatctactagttgtaagaactgaaacggaataaaggactgttttttgtagctcgtaccaaaaaaaaaaaaaaactcgagacctgccccggccgatttaaagataaatagatacacccnccgtccggaaaaaaaaaaaaaaaaaaaaaaa

SEQ ID NO: 32964 - DNA, 1806 bp, Triticum aestivum
  Clone ID: PAT_TA_32964
cgacagaaacctatgatttcattcagtaagacacagaccaagaaccagtacagaggagtaacactcaagctctatagtttttcagctagcagaatataaccttcatctatgtacagtacaggaggaaaagcaaggcacacatacgtgcaggtgcagcaaccgcctggaagcaagcaacaatcattcataggtgtactacagatcgatacgatggaattacatacatacacacatacacgtacatacgaggtatggatcggagcatcgatcattccatcaaggcttccacatgtcctggaaggtggagtggaagctggcgaggacgaggaggaggacgacgaccatggcgacgccccagggggagctgccctcggagggcgcggccgggtacccccgccagcggctctcggtggggtagaacccgaagtagccctcgaaggtgtcgactatgccccaaaccgcgaaacagcttcgcctcggcgccgcatagcgcgccacccttccggtccacttcccgcctccggaaaacctccccgaggggttcccgcgggcggagaacgaaccggccgaactccccggtggtgcagccgactggaaccaaccccccatcatccttggccgcgcggaagatcgacccggtcgcggcccataccagcacacatctccgcccccacacgtacgtgctatggaaaggagaaccgatcattccatcaagagttcctgcatgtcggtggaaggtggagtggaatttggtttggacggggcgcagcaggacgaaacgacggcgacgccctcatgggggagctgccctcaaaggtagggcgcgtccagggtgagccccggccacgcagctgccacaggtcggggtgagaagccgaggtgcgccctctcgccaagtctcgacgggaggagatccagcggatgaggagcacgagcgcgatgggcacgcccagcaggaaccagctgaactgctccgacgcctcctccatgaactcctcgtaggagaagaacctacgacgcccccagcagcagcgtcaccatcatcaggatcaggatcaccggggtacggcagcggcgacagcgtgaacgcctccagcaccgacgactccccgcgccgggtccgtagtacgacatggctgcctcgcccgctgacgttgcctgctggacgcccctcgggggcgcagagcgttctccctgtgccccagctagcgtcacgccaacggacgctgcagtaggcgaccaggaagtgccccaaagagggggggtcactcgtgatgtttgcgattaatcttgctcgtagtcaccgtacttgtcgattttcatcgatgtattgcacccagtggagagaagtgggtacgggagccggcgcgtgtccgtggtgggtcgaatgcgtcgtcggaatcgctaccgcctgtatctctcttgtgcccgggcaaccccgcggtgatcggcccttcgaaaaagatcgtcggcgacggggacgagcccgtgtaccgcagctacacctacgaggagtactacaagaagttctggagcaggaacctggaccaggaccactgcctggagctcttcacgggtcagaagtgatccgtgtgcgcaagcttgcctcatctacggttgggtgcagtggaatcacgacgcagcattactcggccgcttctttgccttgcgtcgcctggtggcgtttgcttggcctgcgaggtggggaaagtggaaggaagaggtggggggataggggcgcgtaactgctagtagcgtgttgcggctgtggcctggaggagacggatggatcccggaacggccggc

SEQ ID NO: 32965 - DNA, 275 bp, Triticum aestivum
  Clone ID: PAT_TA_32965
gaagcgttgatttataactgatcttgctaccattgcgattgatgaaggactttgtgtttggttagtcccttgtcttgtttaacatctgtatgttgtggaatttcctaggatttccaccgacaaagctgtcttgcttgtgctgtgtgcaatgtactgaatgcccaaggtgctactttcgatttcaggagaataaaagattggatgaataaagctgtgttattcatgctttgtaaatagttctgaattgaaataatgattgtagtgttatcataaaa

SEQ ID NO: 32966 - DNA, 1207 bp, Triticum aestivum
  unsure (1)..(1207): unsure at all n locations
  Clone ID: PAT_TA_32966
gaggggttcgaacgaggggtacgaggaggaggacgagtacaggaagaagcctactagtggtggtgggaggtacgaacaggatgatgagtacaagaagaagcccagtggtggtgggaggtatgaagaggatgacgagtacaggaagaagcctactagcggtggtggcggctacggaggtggaaggtatgagggagaagatgagtacaagaagaagcctaccagtggtggctatggtggggggaggtatgagcaagaagatgactacaagaggccccctagtggtggctatggtgggggaaggtacgaagaagacgatgagtacaagaagaagcctagtgcaggtggatatggaggtggaggagggagatacgaagatgagtacaagaagccaaccggtggccatgctggagggaggtacgaggaagatgatgagtacaagaggcctagtggtggaagccatggagggaggtatgaagaagaggactacaagaagaagcctagtggtggaggaaggtacgaagaagatgactacaagaagaaacctagtggtggaggaaggtatgaagaagatgactacaagaagaagcctagtggtggaagccatggagggaaggatgagtcagaaggcggtggcattggagactacattaaacttgcacagggtttcatgaagaagcaggatggcgaaggtgggcacaagaagactagtggccatggaggaggagggtatggaaaggaggaaaatgaagaggatagcggcaagaagaaacatggtggccgccctgagagtggaaaagacgagtcggagggcagtggcatggcagactacctgaaacttgcacagggtttcatgaagaaggatggtgaagggggaagtggagctggtatgggggactacttaaagcttgcagaggggttcatgaagaagcgttgatttataactgatcttgctaccattgcgattgatgaaggactttgtgtttggttagtcccttgtcttgtttaacatctgtatgttgtggaatttcctaggatttccaccgacaaagctgtcttgcttgtgctgtgtgcaatgtactgaatgcccaaggtgctactttcgatttcaggagaataaaagattggnagcaacaaagnctgtgttattcacagatattcaggtagaataaaagattggatgaataaagctctgttattcatgctatgg

SEQ ID NO: 32967 - DNA, 581 bp, Triticum aestivum
  unsure (1)..(581): unsure at all n locations
  Clone ID: PAT_TA_32967
tttttttttgctgtttggtcgtcccctgttggggttagcctttttcccccctctctctcacacccaaatcactgccactttggcatataatgtcatcgaaattccccatcagcgcgcacaaacccgacagttacctttttctcttccaaaccaactctttttccccatcctttttttcttttcgagatggcttttcgatatgctcgcccactactaccgctttgttcgcccgccctcggcctgtcccgaggctccaagtgtgcagtgcagctcacaccactcatcacaggttacagctggccaatccggatctaacgcctacggtcctcgtggatcacagcttcccctggccgtccgatctctccctgccgccaggataggatcctgcgcgctctcctccagggtgcgcaacaaggcgcccatggacggggccgaaggttggggttcggcccangcangangccgccaacnncgggcaacngggggacncctcgcccggcgttctnnnccgctcccgagncgctcgtcaaaaaaatccgggcnttccaagggggctttaaccccggggngnagnaccccgg

SEQ ID NO: 32968 - DNA, 662 bp, Triticum aestivum
  Clone ID: PAT_TA_32968
cgacccagcgtccgcccagcgtccgtcgagacacacaaaagtcgacgaccatgaggattagtgaaatggatgtggatagggttgtaggatacttcaaggacaagagcatcctcatcactggttcaacaggattcctaggaaaagggcgggaggcttatattggtgtttcttgtatgatttctgggaagtgcttgtggagaagatattgagggttcagcctgatgtcaagaagctctttcttctgattcgggcctccgacgtcgaatccgtatgtgagataatagattgaagcgtctcaactcctatacacaggagcccgcatgtatatattgatattggtgaggcctgatctcacgtgaggcatacacatatggttgagagatacatggagagataagggaagattacatcaagagataaagataaaaggatcttcctaactactccaatatcttgaggtacaaggctacggatatcttgaggtacaaggctacaagagagaattgtaacgtgacaatgttaacacgcccccataatcacaacgggattaagttgagattacgccgaaacacttcaaagcttctagtaggcaatgcctttgtaaacccatctgcaagctgatctttagagggaataaacctgatctcaagctctttgtttgc

SEQ ID NO: 32969 - DNA, 903 bp, Triticum aestivum
  Clone ID: PAT_TA_32969
agcagaattctggatggctgccaatgtccaaaatcctcatgttagtacactgaagttaatttctgtgtacgttggtattggagtttgcacaatgatctttgtgctatcgagatctttatttgtcgttgttcttggcatccaaacttcaagatccttattttcccagttactcaattcattgttccgtgcacctatgtccttctttgattctactcctcaaggaaggattcttagccgggtctcttcagatttgagtatcgttgaccttgatattccatttgcattcatgtttagcctcagttccagcttaaacgcatatagcaatgtgggggtattggctgttgttgtatggcaagttctctttgtagcactgccgatgatagttttggtaattcagttgcagaggtactatttagcctcagctaaggaattgatgcggatcaacggaaccaccaagtctgctctagcaaatcatttaggtgaatcgatctcaggggctataacaatacgtgcctttgaggaggaagatcgtttctttgccaaaaatctggagcttgttgacaagaatgccggtccatacttctttaattttgcagcaactgaatggttaattgaacgtctggaaataatgggtgctgtggttctttcttcttctgcctttgtcatggctcttcttcctgcaggaacttttagccctggttttattggaatggcattgtcctatggcctttccctaaataattcctttgttaacaccatacaaaaaggcagtgatcgcgcaaataaaataatatctgtggaacgggtgaaccagtacatggacatttcgagtgaagcaccagaagtttttgaagaaaaccgaccagcaccagattggcccccaagttggcagcgtggagctta

SEQ ID NO: 32970 - DNA, 1464 bp, Triticum aestivum
  unsure (1)..(1464): unsure at all n locations
  Clone ID: PAT_TA_32970
attcggcacgaggccgcaactcccctccccaagnaatctcaatttacatgaatccagtgagatgatttggccggcccggcaacgacgcaactccggctccggctccggctcccagccccagcagaattattccgatcccggtttggatggattccagagtaacagcagcagtggcgaggatgacgttgatgatgatgaatacactccacacaagcgaggcactgggagaccaaggaagatactgagagggcgtgggaggccgagaaaggacgagcaacaatcacaatcacaagcaaaacatcctccaactccaactgcaactgcgtcgtcaaccggcggcatgcaacaatcagaagcagaagcagcagcagcagagcctcgtaaggttgccctctctgcgaatggagatgctgcctccccatcgaccaagagtggccgtgggaggccaaggaagataccgggagggcgtgggaggccgagaaaggacgagcagcaatcactagcaaagcattctccaactgcagctgcgtcaactggtaaagcagcagcagcagcagagcatcctccaactccattgtcaactgatggtatcaagagagggcgtgggaggccgagaaaggaggccgacaaaggaggatcaacaaaggccggtcctcctgctcctgctgcatcggcaggagtcaagagatcgcgtgggaggccaagagtgtacagaccaatgcccgtcaaaactggagatgaacttgagaatccagtatcagttgatgtcgcacttgagaatccaagaatgcacaggccatcatcagctgatattgtgtccatggtcatgaagagaggaatacctgctaaggctcgagatgcaaggcctgctgaagctggagatgcaatacctgctaaagctagatatgcaaggcctgctgaagctggagatgcaacgcctgctgaagaaactggaggtgctgcgtcgacgggaatcaagagaccacgtgggaggccaagaaaggagaagccagcagcagcaatgtctgctcaagctggggatgctgtgtcggccgggatcaagagagggcgtgggaggccaagaaaaaaatgacaagcctgattctgcctacacacatcagaaactagtggttggggtgcctggttcgaaacccccatgaataaaaattaatgctaggaaagatgggcaaatgcctttcaaaaggtcgccgcctccctccaggtatctgagtatattaatatcctgctctatgcttgaaaataagttgacgtgccaacaaacaagaaaaggatttaccttcaacaccagaatgctggaggaacatgtttgaatcatttatggcactgtcaagatgcaatcgttttcttatttcatatttctatgtgactatcaatcaacttaccataccatgatggagtggcaaaattgtacaattggtgacaatcaatatatgctatactgag

SEQ ID NO: 32971 - DNA, 755 bp, Triticum aestivum
  Clone ID: PAT_TA_32971
caccgatggcggatgcggaggcgccggcggcgaagcggctggcccgcgcgggcagcttctcgggagtgtggtggaagctcggcgatcccgccggggacccggccgcggtcgagcgtcggctgcgcgccgtcgccgacgaggaggcagccgtccgtgcccgcattagcaggcgccacgccggtgcctgcggcgtccggcgcggcatcgccgtcgcctccctcgccatcgaggtggtggcgttggtgcatgcttactggacggcgaggcggcggcgcgtggccggctggagcaggaagctgctgctcctgcttgcgcctcctctgctcgccgtaccggcctcggccgccgtcgtcgtggccgcgttcgccaggctccacaacatgttcgaggcgcgggacgagcagcggctgagggcgctggtggcggagcgcaaggccaagatcgggcagttcagaggcagccaccacaacatgcacaagctcatcgaggtctccactaagtacgatccagatgctgctgctgctgctacttccgaccagccggtcactgccgccgccgcccggaggatcaagcggagccactcgcggctgagcttccacatcggagacgactgactcaacctccatccaccttctccgcatcatccatccatggcgacgacaacgacatcacatcgtgcgtggaacatttgtcttcaccgtccgtcagtactgtaaatttagtggcactaccatcatagtaaggcatgctacgtg

SEQ ID NO: 32972 - DNA, 828 bp, Triticum aestivum
  Clone ID: PAT_TA_32972
cccacgcgtccgcttctctgtcccgtcgctctccattcccatccgctccacgcccccagctccccaccgcggcaccgccgtcccaagctcgtcggcgccgccgtatcctatcctcgtctcctcgccatctcgcgcgtttgctgccgtgccgcggcatcggcggccacgtcgccgagactccgcctggtcaactctggttggcaggtggtggcgcgtccgtacgtaccgcggggaggtggtggtgggggcgcagccatttgtgagcagcaggagttgtcgtggtggccagggccgcatcgtggccggggagaagagcgccgcaccgaggaggcgccggcgtcgacggcagggcgcggaggcgcaccttgattcaggagacgcgcgcgcaggatgtcgcttgtccggcgagagccgacgtaggcggcggcggcgagcgcgttgtcggatgcgtcggggacgggatgccccctccccctcccgcttgctcgagtcgcagcgcgtcgagctcgaaatggttgcgaccttgctggctaggcagggctgcagggtggtgcaatccagggagagggctgggctcgccatcgattttgccgacctcgctctgcaggcagtgtcatgggcgccaggcagagacaattcatcattaacccctgattctcgccctctagcattttttccctctcaatgttttctgtgatgtatcagcactccctactctgcttgatactgcattttctggctgaaactagttgccatgttgtcataatttgcaaccggaatatgttgcttcttttagcagcaaacaaaactgaccaaactagttgtgtt

SEQ ID NO: 32973 - DNA, 784 bp, Triticum aestivum
  Clone ID: PAT_TA_32973
gggggttgatttccccagctccccagcgtcgaagcagatggaggagatccagcggaagctggcggtgctggcctacccgcgcgccagcgcgcctgcgcagtccctcctcttcgccggcgtcgagcgctaccgcctcctcgagtggctcttcttccggctgctgggcgacagatcaccgttcacgcagcagaactggcagggggacagcctcgaccgcgacgaggagaacagcaggatccaacacttggcggagatcgcgaatttcctgggtatcacgccttcggtcgacactgaggcgattcagggcagaggcagctacgacgagcgggtggagctcctccgtctaattgttgacttggttgaagctagctgctatgccgacaatccagagtggagtgttgatgagcagttggcaaaggacgtacaacttgtagattccattgcagagaaacaggcacaaatattttcagaggagtgcaagctttttcctgcagatgtccaaatacaatcaatttaccccctgcctgatatagcagaactagagttgaagctctctgagtataccaaaaagatgtcaaatctgcaacagatggtgcaggagctagcctcaaagtatgactataatccgaacgaagactatgccgagacagagttgaagttgagggaacatttgcaatcgtttcttgaaacagtaaaatccttcaatatgatatacactaaggaaattcatccttggacccacatgatggaggtgccacagttgcatgggtttggtccagctgct

SEQ ID NO: 32974 - DNA, 1303 bp, Triticum aestivum
  Clone ID: PAT_TA_32974
cagcaattccccgcccgccgcgccccggcgcgcgcggagaccctccccacgccgccggcgctgatcgccccccccgccccggcgcgcgcgccgtccccccccccttcccccggcgcgcgcgagcacccgccccgggtggctcttcttccggctgctgggcgacagatcgccgttcacccagcagaactggcaggtggacagcctcgaccgcgacgaggagaacagcaggatccagcacttggcggagatcgcgaatttcctcggtatcacgccttcggtcgacactgaggcgattcagggcagaggcagctacgacgagcgggtggagttcctccgtctaattgttgacttggtggaagctagctgctatgccgacaatccagagtggagtgttgatgagcagttggcaaaggatgtacaacttgtagattccattgctgagaaacaggcgcaaattttttcggaggagtgcaaactttttcctgcagatgttcaaatacaatcgatttatcccctgcctgatataccagagctagttaagctctctgagtgccaaaaagatgtcaaatttgcaacagatggtgcaggagctagcctcaaagtatgactataatccgaacgaagactatgccgagacagagttgaagttgagggaacatttgcaatcgtttctcgaaacagtaaaatccttcaatatgatatacactaaggaaattcatccttggacccacatgatggaggtgccacagttgcatgggtttggtccagctgctaaccgcttgttagaggcttataacacacttttaaagttccttggaaatctgaggagcctgcgagattcatatacagcaatggcagctgggtcactttcaaattcaagcgagccctcatccgtcacaaaaatcatttcagactgtgaatccgcgctcacgttcttaaacaacagccttgccatcctttcaacttccgtggcacgggagcagggtgaaacactctgattgtatggccatcttataccaagattcaactctgctacacgtgtgtaagcttgtagtgtttcagttgtttgccttttggtttcagttgaggcgcggagtaaagcttgtgttcccattgggtcgtgtatttgtgtgtggttgttggattcttttgcagttgtaacttgtgacgttcagtgaacagttcttatacttatagcatagtgcttacctctggcgttctgtgttccttccttcttagcgtgactgcttgggacggcttatggattatgtctctgcgcctcattggtgcattcatcgactgc

SEQ ID NO: 32975 - DNA, 1422 bp, Triticum aestivum
  Clone ID: PAT_TA_32975
gcacggcgccccgatagcggcctctgcttctctactcttctcctaacttccacactcgtgtccctttctttcctccccgtcgcttccgcagatcaaaattcaaaaccctagcgaactcctccgcaagcacgtgatcgaccggccatggcttccgccctcggagcccaggtggctgccgtggcgccgattggttcggatggtcgccactacaggagttgttcttcgctcaagggtaataactcccgcaataagtcatggactggaaaattagcatgggaaaacaagaccctgcaaccaagacatacgaaggtcttttgtatgtccgtgcaacaagcaagcaaaagtaaatgtaaagttgctattaaacctctggaactggagaatacaaaggagccacccctcaacttgtacaaaccaaagggaccctacacagcctcaattgtctccgttgagagaattgtaggtcctaaagctcctggtgaaacatgtcacattgtcattgaccatggtggtaatgtcccatactgggaaggacaaagttatggtgtcattcctccaggagagaacccaaagaaacctggggccccaaataccgtccgactctattctattgcgtctactaggtatggcgattcttttgatggaaggactgctagtctttgtgtgcgccgtgctgtttattatgatcctgaaactggaaaagaagatccttcaaagaagggtatctgcagtaacttcttgtgtgactcaaaaccaggtgacaaaattcagatcacaggcccctcaggcaaaataatgcttctgcctgaggatgacccaaacgcaactcatatcatgattggaactggcacgggtgttgctcctttccgtggctacctacgtcgtatgttcatggaagatgtcccatctttcaagtttggtggtctggcttggctctttcttggtgttgccaatactgacagcctgctctatgacgaagagttcacaaactaccttcagcagtatccagaaaatttcaggtatgacaaagcactaagccgggagcagaaaaacaagagcggtggcaagatgtatgtgcaggacaggatcgaggagtacagtgatgaaatcttcaagcttttggatgatggtgcacacatctacttctgtggtttgaaggggatgatgctagggattcaggacacactcaagagagtagctgagcaaagaggtgagagttgggatcagaagctgtcacagctgaaaaagaacaagcaatggcacgtcgaggtttactaggttacaatggctgagattgttaattattgtttcccggggagatggaaaacagaaagataagtaggtcattctcttcccattgtaaaattgtcaatattattcatacgcgtgtgcgtcgcatgattaataaaacaatgtgcaatt

SEQ ID NO: 32976 - DNA, 665 bp, Triticum aestivum
  Clone ID: PAT_TA_32976
gaggcgtgaacgaggcgtaccgtgggacgctctccagctacgcgtatgttcttatgtgcatcaacttcttgcagctccgcgagccaaagattctgccttgcctgcaggccatggagccaacctacaccctgacggtcgacggcactgagtgcgcgtacttcgacagagtcgaccagctccagggttttggcgccggcaacaaggccagcattggtgagctgttgtgggggttcttccactactgggcgtcccagcaccgctacaagcgcgacgtcatctccgtccgcctggggaagacgatcagaaagcaggagaagggctggacgacgcgcgtcgggggcgaccgccacctgatgtgcatcgaggatccgttcgagaccggccatgacctcggccgcgtcgtcgacaggcagaccatctggatcatcagggaggagatggagcgagccgccaccgtgctgcagaacgacgacgacccctgcgcgactctcttcgagccctatggttatgacttatgagaaatgactgaccgatcgatcgatcggggctctagtgctggctgctgcagaaacgaggctctagtgtttgttgatagctcagatgacagttctctggacagtgtgacgatattaataaaattccggagacagaagaaacgatatggg

SEQ ID NO: 32977 - DNA, 252 bp, Triticum aestivum
  Clone ID: PAT_TA_32977
cgcctctcctcgggagggagcgagtgaaactcaaatccacttcagagcaagcatttaggtcctaaatgagaaagtaaggatgtacttgagcagtatgagaagacccagttccattatctcagaagccagaagtttcacatctaatatctttgattctaaaatttgtctaagaaaatggtcattctgctattaacaccacgattatgtctcaattgtagattcttaattgcttaaaattattttatatgtttg

SEQ ID NO: 32978 - DNA, 1596 bp, Triticum aestivum
  Clone ID: PAT_TA_32978
ccccgctgccgatcactccctcgctccctctcctctcctctccactcccacccccagatatttcacgcggcccgctttaggcggccgcccgcgcaggtacggcttcatgcacctggagttgatacccatgctcgttgggttttttacctacaagattgctatgtttactcaagcgattcaggaatcaatacctgatgttggaaaccgcgaagtttgaacaccgttttggctaatagaaaaacaaagcgaaggttgttgttgccgttggggggagactggtcaccgttcatcaatatagtaaggtattattaaggttttagaagagtctaatctggagcctggagatgccgccaggtagatgagatgcacgctgaggctgaggatgctgtctgaacatatcgactgattgacagcattccgcggagaaagtttactttgactgtacctgggccgcgggccccctagaaacaaacgcgcaatggaccttgacagtgtggatgttgatctgagcaaggagcttatggcaccgggccaagtcaatcttgcagacgcagctcaaggctgcccgccgtggtcgatccacacgcgttgaggctgtcaatagatccacctacattagatggaagctagctccgactcgacgggagcaggagcaatgggaccgagcgaccagggcaaccaccggtggcattgatgtcatactaagggagtcgcagcagaaagtgcagctgaaaggggaccctaaggtggtggcagctgaggccagagagcaatacctaaagttgaaagaaaggttgcagttgcttactttaggtattggtggcgtcggggtggtttctgcttatgtttcatacactcctgaaattgctgcgagctttagtgcagggctgattggatctctggtgtatctccgcatgcttggaaccagtgtggattctttagcgggtggaactaaagcagctgccaagggtgctgcggcacagccaagattgcttattccaatggttcttgtgatgatgtacaatcgatggaatgcgatactagttccagagtacggcttcatgcacctggagttgatacccatgctcgttgggttttttacctacaagattgctatgtttactcaagcgattcaggaatcagtacctgatgttggaaaccacgaagtttgaacactgttttggctggtagaaaaacaaagagaaggttgttgttgccctcggggggagattggtcaccgtccatcaatatagtaaggtcttattaatgttttagaagggtctaatctggagcctggagatgccgccaggtagatgagatgcacgctgaggctgaggatactgtctgaacatatggactgattgacagcattccgcggagaaagtttactttgactgtacaaagggaagttggcaaacacaaattcaagttccctgtagtgtacacctttgaacttttggtgcattgaccctgagtcctatggttgagctggcatttaacattatttacgcaaggaggtcggcaggattcggatcagtacagaatgtaaatagtgcgggctgtcaatatactagctcacgaagctatatattttac

SEQ ID NO: 32979 - DNA, 1108 bp, Triticum aestivum
  unsure (1)..(1108): unsure at all n locations
  Clone ID: PAT_TA_32979
gaaagtgagttgagatacagtacttcctaccatccacaaacagatgggcaaacagagagagttaaccaatgtgtggaaacatacctcagatgtatgaccaccactcagcccaagaaatggtgttcctggttacctttagccgagttttggtacaacactacctatcacactgctttgaaaatgtcccctttccaggccttgtatggttttcctccacccatgatatctgaactagccattcctggccctgaagacgaggaggctcagaatttcttggctgctaaacaggatatgttggaacaattaaaagaaaacttgcaacaagctcagaacaggatgaagaagtatgctgacttaaagaggagtgaaagagtttttgaagtgggagatatggtgtatttgaagatggcaccatacagattagcagcttttggatttagaggcgcactgaaactacaaaacaagtactattgcccttttctgatcacgcaaaatattggcaagtgggcttacaaactacagtttcctgcacatgtgcagattcatcctgttttccatgtcagtcagttgaaaaagcacattggtgctaaatccattcccagtccaaacctacctatggtagcagctgatggtacaataaaaacaggacctgcagcagtgcttcaagtcagacaagtaccgaggcacaacctaccggtggttcagtggttcattcaatgaaaaaatctctctccagaagaggctacatgggaggatgcggatttcatcaagtacacatttcccgcctttttcagagcagtcactgaagaatggcgtgcaaatcaacaagcgccgtgaggacacgtcgtctctttaggagggagcaatgtcaggcacaagaggcaacgcggtgtagctttaaagacaatantcgtttcagttaacggacggccacgatggatcccctgcgagggactgttatccaccgttggattaactttaccagctgtcgctgtagcttttcacctataacagccgggatgtggctgggatccgaggatcacttttccccaattctgaatcatgggctagaaccctaacactcgagctccatatactcgcaatatac

SEQ ID NO: 32980 - DNA, 907 bp, Triticum aestivum
  unsure (1)..(907): unsure at all n locations
  Clone ID: PAT_TA_32980
gttccatccagctctctttactcaacaaaactcaagtttgatttcattaacgtaacgtacagagcaaaacgggcttattattccattccattccatggaaccaacctctgctacgtcagtcgttccggctcctttcggtatgttcatattcatattcatattcatttacaacaacgcccaaaatgtacacattacattacagcatcatgcaaaatgtctgtctgaaatttattcctccttcctatggctcctctctcttcggctatgaattctctggtcacgggtacacaacacgtgataaagcttccacaagcagctagtctgtcttgaatctgtgcacaaacttctccaagccatctttgcactcctccactaccttcttcgacctgtccgcgacgcttgaaccaaacgcctttgcttctgatgacacattctttgcctttgaggctgcagcagccccaagatctgcgcacccttgccttgcttctgccgctcgctcctttaggcttgagatcaaggacctcacatactgcatcactctctccagggcatggctggatcgcactttcatctcaccaccaaacgacttgagcttctccagcaacgactccgcccggttgatggcctcgtcgactgggtgttctttgccagcattagcccatgtcaccccagccgatgcatcctcctcaagccctgcctcgactacaactttgattccctgtcgctcccactggttccgggcctcctcgagtgcgcgagcatgctccctggccttctttgcttcatcctctgcccaagccctggcnatagacaaagccttcctttcaacttcaagctcgtactgaagttgcacagcagcctggttttcattctcgatttccttttgaagtttctcaatcctgcctgc

SEQ ID NO: 32981 - DNA, 408 bp, Triticum aestivum
  Clone ID: PAT_TA_32981
acgggtaacaactcaattggctttgaagaagcaataaccgttcgtactaatgaatacagcaagaattacaagacatggaaagataagacaacgaaaacattgttacaaagcaaacatatagtttcaaatcaattaactattgaagctaatgtgcccaaaagaatctaggagtataactacctacttcaaaggcatatttatacagttcttctacattttatactatcccgtgcgaatgcatgggttgacgactagtgagagtaactcttcaactcatacattgtttaattccccttcatgcttatcgaaggatgaatggtatgatgattgttatgatcatgttgattcttttgaaatatcgctttttgatgatgcttgttatgcttgtggccaagatgccaatatgaa

SEQ ID NO: 32982 - DNA, 546 bp, Triticum aestivum
  Clone ID: PAT_TA_32982
attcgccggccgacgggcccaacaacgcggggagaagcggcgaccccacccccacaagagcccaggaacccgtagaatctcgagtggaccacatcagcgatctctcggactccgtccttggggagatcatctcgcttctccccaccaaggattgctgccgcacccaagtcctctcaattcggtggcgccctctatggcgcgctgtgcccgttaatctcgactgtcgtcatctagctctcttcaatgattttgaaatccccagagccatcatctcctcccaccagggctccgttcaaagcctctacatcccgccttctacctgagcaagcatagcatgccctgcatggtggacgcctggctggaatcccctgaattcacagaactacagctgcttgagttcaactattccccctggaaatcacataccacataccgaatgccatgaacttgtgccctcagcactgatgtccatctcggggttttcatcctctctccacaccgccacctttgtgaagtgctacctaccagacaatctggtaccctcgt

SEQ ID NO: 32983 - DNA, 1011 bp, Triticum aestivum
  Clone ID: PAT_TA_32983
gtaggtgtccaccgattcgactcggggcagattgttaatgcagacgttgatagccgccgtcgggagattttattagggtagcggcctgtagattgtattgcatatcggctgggtgtcgagccaagcggcttggcaggcgtgctccgccgccgacatggcgacagcgttcgcagcgacgctggtggccacatgcaccaacatggccatgattctgcagcatcgctatgtccatggcttctgcgacgttgtggcgttctgcagtgtcctcttgctggccatgattctttcggtgttcctttgtcgcgggagggtgcgcctgtgcaccgtaggagtacttcctggcgagcatggcgaagatgatcacggcgaatgacgatgtcccggcgtcgccgcggggcctcaaggagctgctcgcgtgctacgtgctacctcgccctcgatgccggaagagcaccaccgcggcatcgcttcttctccatcttcgcgccgcatcgtttcttctctgccttgccccgcccccacgcaccaggagaacccgacgctgctgcgtgccgcgcgagccatccaaaagggagctcgccgcacgcatgatccacgcatccaacaacacttccgccctgcggccacaaagcggggctccgtcgccgccactaggtgcccgtaccgggcaggacctgcctcgagccgatgccgctgctgctctgcggagcgagaatcgccggtcgctgtgccggttaatcacgcgtacaagctgtcggccgtggcggcggcgcacaccacccgcagtcagattacgaaatatgattaggggttagtaatcagattgtataattctgaccataacagaggatgaaatgtcatgggtagtgtaattatagcagctaagtaggtaatattagggaaggatatatatgcatcatgaatcaggttctggtcatttaatccttgcaggtcgtcgcaaatggaaacctgtcacataattcagtaaagtttgtatacagttgcatagtt

SEQ ID NO: 32984 - DNA, 843 bp, Triticum aestivum
  Clone ID: PAT_TA_32984
aagcggcagtaactaccagacagaggaggatgagactgacactgcgattgactttggcaacctcttgccccgagcgcctcggaagcaccggagcaggagcgctcatccccgtgaaggaggagggcacgacgacgaagagaggatgatggataagcttctgagacactacagcaagaaggggatggagagggaggaggagcacaagacgaggtcgaagtccaggacccctcggcctcgagcagatcgacctgctgatggcaacaacagagatggagcgcccagtcatccagagagaaccgcatctctgcctacagaatcaggttcaccggtggggaggacgaaggctcctgcccctgttcggtccacctcgctgcagcaggacacgtccagggggaacgtgcacccgaagatgccggatttcgacgaactggctgcacggatcagcgccatgaagagggcatgagttgcctgtcaccagacctgttttcaggcttccagcacgccgtgtgttctaccacagcaacaacatctcatgacggcgatcgcatgaatcagaggatctcctgaggtagttgcatgcttccttggaccttggtggccctgttttaatctttcctttggtggtatacttgcattgcattgcattgctccctgtgtgatgtctagggcagagagcattggttggagaattggagtgggcaatttgatagggaatagtaccatactatatagtagtacatgttgttgggtgcggttgtttgatgtgctgatgtgcttacctgtgagtgtatagatgccgttattgaggctatactgaaaatgacgactcttccttcttgtttc

SEQ ID NO: 32985 - DNA, 753 bp, Triticum aestivum
  unsure (1)..(753): unsure at all n locations
  Clone ID: PAT_TA_32985
cgcgctcgcgtcctcccataaccatcgcatcgcggttgcggcgcgcgcgcaccaccggacccgaatcacactcactccctcgcacgcacggccagctcagcgtagcggaccgcgcacgctctccaaacccggccgacggcggaggggggccgagtccggcagcgtggcgcgaggccgggagctttgaggggctccaagcaaatggcgggcgcggcgaggaagaagcttgttgggcggtacgaggtggggcggaccatcgggcaggggtcgttcgccaaggtgaagttcgcggtcgacgccgacacgggcgcccccgtcgccatgaaggtgctcgacaaggccaccatcctcaaccaccggatgctgcaacagatcaaaaaggagatatcaataatgaagattgtaagacaccccaacatcatcaggctaaacgaggttctagctggacagacaaagatatacataatcatggagcttatcaccggaggcgagctgttcgataaaatagcccgccaagggaagcttcgtgaaaatgaggctaggaagtacttccagcagcttattgatgccattaactattgccatagtaaaggtgtctatcatagagatctgaagcctgaaaacctgcttcttgattcacgtgggaacttaaaagtttctgattttggacttagctcgctgtcgcaaaacggctttcttcacacgacatgtggcacaccgaattatgttgctcctgaggtgcttagcgacngt

SEQ ID NO: 32986 - DNA, 997 bp, Triticum aestivum
  Clone ID: PAT_TA_32986
cgacccacgcgtccgcaattttcttcagcggctcgaacgccacgcgacccacgcataaactcgcctcggagcggaaactgaagaaacccaaacaggagcggaaagcagcggcggcggcgatggcgggcggtgaccgggagagggatgtcgaggaggagacgcgcaaccagatgatgcagaacctcttcggcgaccagtctgaggacgaagaggaggacgaccccatcgaggtcgccgacgatgacgaccaggggccgccacagcagatgcagcgccatcgccaagttctggaccaagaggaggacgaggaggaagaagacgagggacgcagccacggccctgcccacgacgcctaccactcggaagaaggggagggtgaggcagagaatggaggggaaggagaagcggaaggagaaggtgagagtgagggccaacttggaatggaagaggaaagtgaaacagaggcccatcctgctgatcttgatcaaggagaaagtgacccggaaaaggttcagagctcaccagaaagagaactgagtgatggggtgatgcaaactgacgcaagaggcatggacagtgaagaagatggctacgagcagcaggcggttcccagtagaagaagggaagttgttgcctctgaatctgaggggtctgaagataattattatgctggtcaagctcctgaagatgaggaagctcctcaaaggaaaccaagatccttcccaatggaggaagagagagatcatgaagttgtccgtgatgtgtttggtgatagcgatgaagatgaacctgctccttatcatgccccgcatgaaattgacgaagattccaatcccatggaggatgaattgcaatatgagaaagacttgcagtcagatgatgacgcggctgatgatgatatacgatatgattcagatgacaaccgcgagccaaaaacaaaatagaagccagttgttccaccgttgaacttggttggtccacgttaggagccaccagg

SEQ ID NO: 32987 - DNA, 1236 bp, Triticum aestivum
  Clone ID: PAT_TA_32987
cctttccttggtgactagactagttcgttccagcgccgcgagactctcctcggctcctcctcctagtctccaccactgccatcccggagctgccaactcccatggcgctctcccgccgccttctcctcttcctctccctcgtcgccatcacggcggtcaccggcacctccgagatcatcgtgaccaggtgctacccgccgccgacgcccactgtcaacggcagcaccagcgcgttccggcgcgatctcctctcgctgctcgacgccgtcccctcggccaccgcgcggacgggcttcgcctccatgcggaccggcggcgcgttcgcccgcggcctctgcttcggcgaccccgcgccagacccgtgcttccgctgcctgtctgacgccggcgggaagatcaccgacctgtgcggacacgccaaccggcgcgcgggcttcctgaccgacggctgcttcctgggctactccgacgccaacgcgtcctccgccggcgcggacgacgacgacatcagtggcgtgacattctccggcgacgccgtcccacgcatcgacaacgtcgacgtgctgaagctcgttgccgtggcgcggtccctggtcccgcggtccgcgaacggccaggtggccgccgccgacgcgactgccacggcgagcaacggctacacggtgcgcatgctggcacagtgcgcgacggacagcgccccggcggagtgcgcccggtgcctgcgggattcgtcgctgcagatggccaagagctggagtctcacgctcaccgccggcgtcgacgtgcaaggaagcgtggccgcggttctcggcccgaactgctacctccgcttcgagatatcggcaccgccgctgcccgtgagagagaagattcggaggatcgtaaaggataacctcgtcctgactgtgtgcattggcttcatcgtcgccggggttatcatcctgctgctagttcatgtctgccgcctggtgacgaggaagctcgggaatgctgcagccgcaccagcggcagaagggaagccatgatctgaccggtaagaaggaagaagaccgaataaaagcaaggaaccatctacaggacatgagagggctcgggcgttaccaacttcctgcaggaacacatagctagctagggtagtgttgaactgttatgttggtctgtcatatgcatttggatgcttggtactccattttactactgctctgttccgtattctccaaaaaaaaaaaaaaaaaa

SEQ ID NO: 32988 - DNA, 270 bp, Triticum aestivum
  Clone ID: PAT_TA_32988
gcgcagtgaggcgaacggcgtacgagctgctgcctggcaatgtggacagaacgcatatatcatggcaccctgccgctgccatgctgctgcctgccattgcgccccgagttcatggcaatgatccctgcgaccagaccagcccgaccatgcatgtgtatacaagatttttgtatagttgttggacagagcaatttgcttccgctcttatctggtgttaatttgaccgtgctctggcttggacagagcagtttggactttggactttgcccc

SEQ ID NO: 32989 - DNA, 507 bp, Triticum aestivum
  Clone ID: PAT_TA_32989
tagttgatatgttgtacgtcttgttatttgttctactgtaagtattactgaaatacgttatgtataggtaagagagaagatgatgcaaaggcgataaaacgtttccaacgttaaaaggaaaaaggacaggagcttggtttaagggcatctttggtttggcctcatcatcaaatgtatgttgtgagctactggagtttatgttgagtcgctgaagcacacacgtgaagataatgttgagtttgaccacaagagatcgaaaactatagtgatagagggtgacgatgacatgcaaatggacagcaggctagttctgtgtatcaaacacagtgagcatagtttagcagaatgtgaacaacttctaagttgtagttcttgtaatatgtttttgttgtgaggaattcaagctcaaaattgaccataagtgtgattgcatgtgttcgctgataatctgatttgtatgatgaattttgaatgcaatttataaatttgaataatggctctaaattt

SEQ ID NO: 32990 - DNA, 993 bp, Triticum aestivum
  Clone ID: PAT_TA_32990
ggcgaggcaagcagagcaacggcgacaaagtagcagtagtagcgcagcaggaaagggagcgtgcccagagggcggccgggaacagttgcggtggtgcgtgcgtgcctggagggggagcacgggggcgcgaccgtgacacacaagtgcgtgcttgccggcgacggagacggcacgggagtgagttccgggcggccaaaatggagcggcgcaagctcctatgaaaccagcgcgagacgccgcatcgatccacgccgtgggtgcgagctgaggcagaccaaaacgacgactacgacgagttgatgcggtggccgaagtggatctcgtggaagggcggcaagagaacaggaacaacgcctagaggaaaaggggatcgaggcggatctcactgtgatgctcggggaaggctcaaggttgccggggacggtcggagatgagtagatcgacgcggtggcgcgccggtgatgcaaaggaggggatcggctcgatcccgatgatgtcgtgccgtgttgcccgaatccgtgcccgtggctgatgaagacgaagccgacgagtctcctagacacagtggcgcagctcgaggtggccggtggatgtggtggtccacaacgacgagctccggtgcgtcgtggcaacctcgaatcaaaacggggaaagggtgggggagtgaaaaaaagttgagctagggttcaggggagtggtgacgctgctaagtagggcaaggaagggccgtggatgcgcgccacggcgccatggcgtccatggatgtgctccacgatgcctccctgctacaggttgaagaaaaccagtgtggactgggccttcgtgcactatagcacttaggtccagtggcatagtatcggctaggccttttcctttcccctttttctatttcaattcttttgcctctgttttgcacttaattggagcaccaaatgacctttgtaaaaatgtgcccctagccacattaaatactttgcaatatttagtactgcc

SEQ ID NO: 32991 - DNA, 949 bp, Triticum aestivum
  Clone ID: PAT_TA_32991
cgtccgcccattttccgagcagcggctcgtgcatggacagctaacgcctgtacgcttctgaatatgagccagtaaaataccccggaaagaaataaaagttgtgcagctcccaagatcgatgagcagtaccaatcccccttccgcgaccagccatgttgtcctcacacgccatccgctggagcatggatgcgggctctctgaatggcagtccagatgcagaggaaccgactccatgagttttaaaaaggggcttcttcaggcatcagcttctccatccatccccttctgccgccgctgcccgatgtcgacgacggcccaggagccgccgcacgtcctggcggtggacgacagcctcgtcgaccgcgtcgtcatctccaggctcctccgcagctccaagtacagagtgacgacggtggacagcgggaagaaggcgctggaggtgctgagcctgggccacgagagcgtgcagctgatcatcacggactactgcatgccggagatgaccggctacgacctgctgaagcgggtcaaggagtcggcggagctgcgcggcatcccggtggtgatcatgtcgtcggagaactcccccgccaggatccgccggtgcctcgacgagggcgcggaggagttcctcatcaagcccgtgcgcccctccgacgtctcccgcctctgcacccgggccatcgccgccatgcccatgcggtagcaacggccggtcggtgccgtgctgctgatcggtgctagtctgctagattgctaatccaatcctccctccctccctcctctgttgagttctcactgacgagataatcccatgtacatgcgtctgctgcagggttgcattccaattccatggtgaaatcgaaactgaatgaattccatggcaacccacggaatgtatgtatgtattcatttacttgccaatgtatgaaatccaccaataactgcg

SEQ ID NO: 32992 - DNA, 653 bp, Triticum aestivum
  unsure (1)..(653): unsure at all n locations
  Clone ID: PAT_TA_32992
nnnnaagatgatggagatcacaaacaaagtagtggtgtgagcatatcttccacactcagctccactgataccatatggagacccacacagactcatggccccagtttcggtgcatcaaatcactgtcagttacctccataccctggtggcttgccccagcccatgggtggggatcaaaaccccatgagatgctgctgcacttttccgtccgtaagcaatataccaaatcagatgcctgaatattggaatggaggtgccaatagctacatggcccctggtgggtatgatacattctaccaaaactggaccaatggaagcgcagatccaggcctgaacagtgcacaggttgacctttcatactccatgtacaccctgttctgattaacagagctgtgttgcaaccctaacaatacagacgcaccagtcatgcatacatgctaacctagcccgcaaaaggggtggatgtcggcgacatgggggtcgccagtgcaagtgttcgtgctgaagcttaagcttgtaaagatgaaacgtgaaacttattgtaaaacggttttgttggatggtacctttggcgcaaatttgccgaatacccgcccttggatctgtactcttgtagtgtggccgatgttttactgctgttttgtgctggcccc

SEQ ID NO: 32993 - DNA, 1084 bp, Triticum aestivum
  Clone ID: PAT_TA_32993
gcaggagggtgctcggaccacacccacaccgcaccgagccgccgcccccgccccgcccccgaaagaaggcgcaaattcagaccgggtccacggtcgaatcccaaacccccatcttcccggccgccgcggtgggcatctccagcatgccggcgcccaaggagagcctcctgcccgacctgctctaccacgccgtcgtctcgatcgccgccctggcgggcctcctccgcgccgcgctcgtcttcctcggcctccccgcgccgccctcgctgctggccggcgaggccaccgaccccgccgaccagctcacggcggccaccccggcgggccccagcctggcggagcggatcgggagcaggctccgccccgcgcggtgcggccggggcgggggcgcggcggcctcgccgacgcccgactgccggcgtctgccttgttcgcttcgagggcggacgccgtggtgaacccgccttggcctgtgtccacctcttcccctgcgcctgcctcgagatctagtctggcactaccaccacgccacctgcccgctccccggctccccccgccccccggccgcgaccgcgaccggccgtgggcgggcgccggccccaaccctgacggcctcgatttagagaagacgagcggagggacgggaaaagagagattcgccccgtcgcgtcgcccccggctatgtgctagctccgtgtgtggcctctccgtgtgcgcgtaggaatttagatggatcctagcaggcagagggctcttgtgcccctcgcctttcgcatttgccttttggtttcgttttctgtacgcctcgtgccatcgctgtaccgtgtaaatatttttcagcagagagcgctcccaccgggtgtagcgctttgtgtgatgagaaatctgtgtacggccctcggctttttttacgagaaacggaaaattgatggaacaaagaaaaaaaaaaaaaaccagaggggcctctgtgttcttgcctcttggatgcccctaacttctctctccagatatttatggaaaaatcactactaaagtttccttattttactctttccgtgcacaccgttgtattaccaatttcagg

SEQ ID NO: 32994 - DNA, 1182 bp, Triticum aestivum
  Clone ID: PAT_TA_32994
tttttttttttttttttttatttaaaaaaaacttaaacaggatatagacatgtgcatttgttattgaattcatgcaccagccggttgccccatttgtctgttttatggaagagggccgacattatactccaacatttgcaccggccagttaggctgctatcaaatcaaatcaaatcaaatcaaatcgaggtccttggcctttttaccgtcatgactgagacatgcctctgcagccacagatgtttctttttcgcctaacccttgtaaaagaatgaactgagcccggctaaatgttatgcagtttccagcatcagatagatgcttcttgttcacagatcatcctccctttcccctttttttcggcggcagaatgatcaaaaacttcagaaaactcggatcatgctgcagccttacaagcatttgcaaggtttgccatgaacacttacagccagcttattatctatacccatgatctagcgtgaagcctatgtacctgcttcatccggaccgtactcgctatttagctcgacacaaactatctacaatactgtcaaactagcaatgcagcagactgcattatctgatctactagggttgacccaagtcactcagctatggtaacacacagttacagtcaccgcagaagcaactgggatggatgaagggcgtgtggatcagcaagcggttcgcaagagatgccggatgcagcagcaaagctccaacttggcaattggaaatcttattggcaaaggtatccgtggtagtgccatactagcaagtagttgtcctcagcaacgcagattttgcagaaacctctattggtctccagattatgctctcgagtttgctgcataagctcttgtagaacctgtggtattccagagagtcaccagcgacctttcgaacatccaccataaataaagcgggagcgacttcaaatatctctagaacaacagcgaatgggctcattttgtttgatgatactccttcaagacgtaacttgtaattctgggaatgcaccttgagacccatggaatcagcgacaacttcaatagtagctgctatagtctttgcaggtttccttgatacgaagcgagtttggcgtttgacatactcctgttgtctatcaaataatgatgaaagatttaacccttgagatagggtaatcatctcaaaggcatt

SEQ ID NO: 32995 - DNA, 999 bp, Triticum aestivum
  Clone ID: PAT_TA_32995
ccgatgcccgccgacgatgatgtcaaggcggagacccgagtcgactttgccttcattggctttcacctcttgtcgtctgacgagaacccgctgtcgttccgcgtggcctgcatctgcaaggatggctctagggttcgtgccgccattttctcgccggagacatgggattgggttatccacccgtgggcggaattggaaatcggtggagacagcagcctaaagttcaaggctggttcggtggtggatggttccatttactggccttgccatggccaaagatgcatggtgaggatcaacactgccaccatggatatcaccaccatggatctacccgctcaggtgaaggtggatgggtacaatttcaaggctgcggagaccaaagatggcgcactctgcatcgtctatgcatctgatgatttcgtcctccatgtttggatcgacggtatggatggtgatgggattcagacctggataccgcacaagacaatctctttgcgtcctgagatgcgtcgcgttactagggggttgctgggagacctcaaagttgtgcaagttagggatggatacgcctacttatcaaccacaagcatgtcccatgttggcctactctgctgctggtttttctccctttccttggagactatgaagcttgacttactgattcaggggaggtatgatggtcgtggctatccctactttatggcctggcctccttctttggttggtgatggtggacctcaacttgaaagttcttactgaagtatgtacttgtccaccattgcgtatgaggaaatgagtgaaagttcgtatccattatcaaatactttggaggtgcattagaatatctagatggcattgaaaattggaaagattttttcttctatcttcacttgctgtagctaatgagttgttcacttagagatattcgggtcaattgaaacattggtacggtgctggagctaatgagttttattgaagtttaagttttccttctgctgt

SEQ ID NO: 32996 - DNA, 815 bp, Triticum aestivum
  Clone ID: PAT_TA_32996
actactactagggcacaaaccctcccaactagcgaccgatctcactcaaaacaagcggccaatgtcgacatatggggagaaggttggtatgtttggtgggtcaaatggtgatgtctacgacatcaccgaattgacaaattcagcgccgtcaagccttaggagcttggagatttggagcacgtcgggccacgaagggatcatcaacgccatatccttcaccttcgtcgacagcaaaaacaatatgaacaaagcaggtccatggggcaccccgcttcctggccagaagagcaagactattcacttgacaaacgtgcgtatcaccgagctgtctggctactcctacggtggatacatcacctcgctcacctttcgcaccaccgacgcccagaagcaccatggcccgttcggaaaagtgaggccaaaagccggcgtggacacccatttccgcatccccctcatgaatggttctatcgtcgccttctgcgcccaagccgatgactacctcagcgccattggtgcttatctcaagatctgattgacccatcatatgtatgatctacatatgattcggttcactagctaccaagactagctagaaggttactttgtgtgtgtgtgtgcgcgcgcatgtacgtcgttgttcaataaggcggcagcacgctagctacccagactggcaggttgctctccgtgcgtttatgtttatgtcggtgtcagtgattggtcccttgctgtttaatgttttgctggtgatgtttattgtgtggtcaagcatgtaatagtaagtttcgaaacttaagtaatttccgaacaac

SEQ ID NO: 32997 - DNA, 1191 bp, Triticum aestivum
  unsure (1)..(1191): unsure at all n locations
  Clone ID: PAT_TA_32997
gaagcaaatagacgacgccgagtgctatctggtnagcggatcgttcgaccaagcggttttgactgcattgtctgtgtctgatcaaattcgagcggctaatagagaaagagtgtgcgaagatgatgagcttttggagatgctcgaattagttggaattgtactcgttcaagcacttaaagagctcagaaggacaactgagatgtttgttcagcttaaagctatgtatggttcagtggcatcaataccggtgaaggttttcctgacaggggctaccatgctaatggcagaaggttctgggcctgaccttcgaccaatctttgaggacttccttgctaaatggagatacacagatgatcaagtttatgttttgaacggagaacaggaaagatcttcaaatggtctgattgttacatcaactatggcaactgaagagtatttggaggtggtagaattttatacagttacattccttagcattgcctctggtgagcctgaaaatgccatctcatgggtagagaaggcagaattaattgagcaagatcgacaggagctacttgaaaaactttatgcattacaagcagctgcaaatgaaaagtcatccactgctagaggagcaaaacaatcagcagagaggaactttcccgcgtctgacaaaggcccaacaccagcaacacacgaggatggtccgacaagcgccacacgtgcacccaatgtgaaaacaaacggcttaccaaagtccattgagccttcccttcagcgcgtcgcaaataactttgatcccatgttttggtggttccattcggtgcgcgtaaagtttggtagaatgcacattgttctaccaagtggtaagctaatgcttctgttctcgctgttgttctcgacagtctatgttctacggaggaaaggcgccggcttgaaaagggttgtactacaacatgcttcgtccctgcgacgggcgttcctcgacgccctccaactcgccttctccgtccagatgaacccactagcggctgttcaacaaacgccgcaagcccctcgaggaagctggtgatacaccgatacaatgtagttacccatcccaacatgtaactagcaataccgggaattgaagttggacatatgggatactggtcgttttttgtgctactgatgaatgtattggaatataaagcaagtctgttaaatacatca

SEQ ID NO: 32998 - DNA, 1406 bp, Triticum aestivum
  unsure (1)..(1406): unsure at all n locations
  Clone ID: PAT_TA_32998
tcggctgggggcgcccgagggcttcccgtctcgcaaaaattcaacacttctctccgctcgttactttctcgtggctggcggcttccttcctgcgcccgagtcccagtcccaggagtagaagaggaaggggtcggtgccgagcaagtccggcagcgcagcggcgggccatgccagctacgagtacgaggaggagtcggtgcacaccccccgcgccctgaagctcttcacctgcacatgcctcccccccaaggcccaggatagtcaaggcccgccccttcccctgccatgggttcgcggcggggtgcagcgcgacgatgcgggggacggggctggcgtctggcgcacgccgggtacgccgtgtacggggtggactacgagggaccacggcaacgagccggaggggctcccagggctcatctccccctcctttgacctcctcgtcagcgacacggacgccttcttcaccgccgtcgtcgcctccacggccaacacggacctccgcttcatcctcggcgagtccatgggcggcgccgtggcgctgctcttctcctccatgcgcccggcgtactggaccggcgccgtcctcgtcgcccccatgtgcaagatcgctgatgagatgcggccgcatccggtggtggtgagcgtcctcaagctgatgaccaacatcatccccacgtggaagatcgtgccgaccaccgacgtcatcgacgccgcctacaggatgcaggagaagcgcgacgagatcaggaacaacccccactgctaccagggcaagccgcgcctcaagaccgcctacgagctcctcaaagtcagcctcaacctcgagaacaacgtactctcaaaggtgtcattgccgttcctgatcgttcacggaggcgacgacaaggtgacggacccatcggtgagcgacctcctctaccgctcagcggtgagccaggacaagaagctcaacctctacccgggcatgtggccacgccctcacctccggcgagagccccgaaaacatccacaccgtcttccaagatatcatcgcatggctcgaccaaagatcatccccgaaatcatcatcgtcggcggccgccttggacttgtcatcggagatggaacagaaggccaagcacgatgagcagaatatcgacaagcaatagcacgaaagttaatgacaatgagcagctgtaggcatggttaagtacagctgggattcggattcgtgttaaggctactggctggctacaagtgtgatgtctttatccttctatcttcctacctgcttcctcattcgctgacttctggcttcccggcatcccatgcaacctgcatctttcaaagtttcaacatatagcaatatagttgagttttcccagtttactttgattacctcgactttaacaggtntnaacaacaag

SEQ ID NO: 32999 - DNA, 821 bp, Triticum aestivum
  Clone ID: PAT_TA_32999
cccacgcgtccgcccacgcgtccgatgcacgcgtctagctagctcatctcctagctctaggctgcgagaaacagaggaggaggagcaggagaagcgcaccggctccaacaggatctttgtgctccgaggaagcgaggagcgcagagcagagcaaagtcggagaccctctgggcctgtcgtttcaccgccggcctcgcgtcgcgtgatcggtcgatgcgtggggctcggcggcagcggcgcaggccgcgggagcgcgacgtggcggcctggcccttcttcctcgcctgctgcctccttgcgctcgccgtgtccagagccgaggagccgcgcgcatcgccggtgagagggagaggaggaggaggggaggatcagcggctgagcagggtggggtcgagcccgccgtgctgcgtgtgcgagcggaggtgcggcggctgcgcgccgtgcacgcccgtgcaggtgcgcgccggagttcggccgctgtgcgccaactacgagcccgtcaggtggaagtgcaagtgcggcgacgccgtcttcgacccatgactcgtctccaagagataattcagatgaatgcgtgaactgcagcctgcagggcaaagcggcggcggtcgataattcaggtgatgccgttcgccagcgccatgcaatataccactacagtaagtggaaataaagtctgcattgcatgcatggctgctactaggagtaaatagtagtagtaattccttttctcggccttgatttcctataaatcttgaagaagagaagaaagaacaatctgtatttatatgctcgtattatgtttatgtcgttgatcggac

SEQ ID NO: 33000 - DNA, 985 bp, Triticum aestivum
  Clone ID: PAT_TA_33000
gccggccggtcccgggcccgcccgccgcagctccgccatcgccgttcggtttgtttcttctcccttgctctgaccccctcttgaccccggtcgtctgcgggcggaaggagcgctagctagcccagaaccgacggggcgatccatcatccgatggccaccgacacgttcgtcaccgacgtgaccttcggggcggacgtgatcgtcaccaccgtgaccaactccggcgcggccgtggagggctggctccaggagatccgctccgtcctcggcgacctcgtcgtcggggtcgacgtcgagtggcgccccagctacagcccatcccaaaaccccgtcgcgctccttcagctctgcgtcggccgtcgctgcctcatcttccagctcctccacgccgacttcgtcccccaggctctctcgggcttcctcgccgaccccaacctccgctttgttggcgtcggcgtgcaggaggacgtcgagcgcctcagcgacgaccacagcctcgatgtggccaacgcggtcgacctgcgtggcctcgcggcggaggggatgcaaatgccggagctccgccaggccggactgcaggccgtggcgcgcaccgtcatgggagccaaccttcagaagccacagagggtgaggatgggcccgtgggacgcctactgcctctcctacgatcagatcaagtacgcctgcatcgacgctttcgtctccttcgaggttggccggaagctgctcacaggcgacctctgagttgatgatttctgcggctgagtcctgaaaacttgcattcttaagtctagctcgtactactattgtacttagatctagttcttcatctcataatgctaggcaagggtttgggagtgattctgtgatggaagaattagacattggtggtgatgaggattaacttcagagcagggaaaagattgcgcctacaactgagtgccatgagcatgaacccttttgtgccaatcgaaactgctctgcg

SEQ ID NO: 33001 - DNA, 788 bp, Triticum aestivum
  Clone ID: PAT_TA_33001
gccggccggttcgggagccagaaaggcgagcagaagtttcacttggcctccccccctcgagtcctccggcaaccccgacgcgggcgccaagatcttcaagaccaagtgcgcccagtgccacaccgtcgacgccggcgccggccacaagcaaggtccaaacttgcatggtctgtttgggaggcagtcgggtaccaccgctggttactcctactctgcggcaaacaagaacaaggctgtggagtgggaggagaacactctgtatgactacttgcttaatcctaagaagtacattcctggaaccaagatgatcttccctgggctgaagaagccgcaggaccgtgctgatctcattgcgtacctgaagaaagccacctcctcttgaacgggcatgatgatgctatgatcttgtcatggccagtgaattcattttgcagtaaaataagaagattagacattaatagtcactctggtttgatggggtgtgatccacgagacaattatcttgcgaatttcgttttcatgatatgggtttcatatcactaggtttagttggaaatctttgtcagtcttttgattcggttgctggaaaaccccagtacgcacattttgaccaccaggtggcggtgggactggaatgcacacccatgttgatgaacatgagatctttaaaattgatataaagctttctgcccgtgttatggagtcgtcaaatctgaccctttattctgccatgttgcttgtcctatgtgtatttccagttgtgacttttaccatgtagactttcattc

SEQ ID NO: 33002 - DNA, 947 bp, Triticum aestivum
  unsure (1)..(947): unsure at all n locations
  Clone ID: PAT_TA_33002
tgcggttgttgccttccggccgggcggacgccgcagccggcgaggcgagatcgtttcacttggcctccccccctcgagtcctccggcgagtctctgcggcggcggcggcggtttcacttggcctcccccctccactcctaccgcgggtccctgcgcgagtgtctgcggcggcggcgatggcttccttctccgaggctccccccggcaaccccgacgccggcgccaagatcttcaagaccaagtgcgcgcagtgccacaccgtcgacgcgggcgccggccacaagcaaggtccaaacttgcatggtctgtttgggaggcagtcaggtaccaccgctggttactcctactctgcggcaaacaagaacaaggctgtggagtgggaggagaacactctgtatgactacttgcttaatcctaagaagtacattcctggaaccaagatggtcttccctgggctgaagaagccacaggaccgtgctgatctcattgcgtacctgaagaaagccacctcctcttgaaatggcatagatgatgctatgatcttgtcatggcgagtgaattcattttgcagtaaaataagaagattagacattaatagtcactctggtttgatggggtgtgatccacgagacaattatcttgcgaatttcgttttcatgatatgggtttcatatcactaggtttagttggtaaaatcttcgtcaatcttttgattcagttgctggaaaaccccagtacgcatgttttgaccaccaggtggcggtgggactggaatgcacacccatgttgatgaacatgagatctttaaaattgatataaagctttctgcctgtgttaaaaaaaaaaaaaatggagtcgtcaaatctgacaaaaaattctgcaaaaaaaaaaaaaaaaaaaaaaaaaaaaaaaaaaaaaaaaaaaaaaaaaaaaaaaaaaaaaanaaa

SEQ ID NO: 33003 - DNA, 1260 bp, Triticum aestivum
  Clone ID: PAT_TA_33003
ctttgctcacaccggacatcaccatcatgtctgtgggcactgtgatagcatatggccaggagatgactccggatgttggctgggaggaatttctgaataacaagtgggatagggatattgttgttcaggagacagctaagttccctcagctaaagccacagccagagaggaatcagggtccgcgtgaggtcagcttcttcgtcgacaagcagggtgctcaggaagtgattaattatcttcctcaaaaactggaacagcttgggctatatgtgaagataatctatagtagcggagaggccctagatgtattgccacgaggtgcagggaaagggcaagctcttatatatttactcgagaagttcagttcgagcggaaaaccaccgagcaatgttcttgtgtgtggtgactctggcaatgatgcagatttattcagcgttccatctgcctatggtgtcatggttagcaatgcccaagaggagcttcttcagtggtatgaagagaatggaaaagataaccttaagttgcttcatgcaactgagagatgcgcttccggtatcatgcaagctatcggtcacttcaaactagggcctagtttttctgtaagagatcttgaattcccatatctgaaggtagacaccatcaagcctgcagatgtggtggtgaaattctatgttctttacgagaagtggcggaggggtgaggttcagaagtctccatcagttgtacaatacttgaaaagcattactaatggcacactgatacatccttgtggaatggagcggtcacttcatgcatccattgatgcactgagttcatgctatggtgacaaacaaggccaaaagttccgagcatgggtggaccgactttttacatcgccgatcagtacaagtaactggttggtgaggtttgataactgggaaatggaaagtgatgtgcaatattgctgccggacaactcttctgctgaatacgaagcctgagactccagagggcttggaactgacacacatccacaagacctggcttgaaagatactcagctgggaatgatcataccttcatcttatagatcatttaaccactcaccatatatgcacggaccctctcagagtcgcaatagatttacaaatgtactggttcttgtgtaaatggatctctcggctgattcaaactactgtactgttctgacgctcccagagagggtcaatcttcatgttgatctcatgcactaataagaaatggtcaatgggttctatctaaaa

SEQ ID NO: 33004 - DNA, 716 bp, Triticum aestivum
  unsure (1)..(716): unsure at all n locations
  Clone ID: PAT_TA_33004
gcggggtggggagcgcggggccttgaccgtcgcccaggcaagccaggccggatagggcggcggcgacgacgaagcagagaaattccccaccaaaggacagagcttttttcgactccaccgagctctccttgcgcggcgggtgttcggcggattgcgccggaggaggggagggggagatgtcgggggcgacggagacggcgacctgggaggagatgctgcggcggatgctgccgccggggaccgccatcccggagggcgcggcggggaacctcgactactccatcgcgctcgagtacgacggcccgcccgtcgcctacgaggtgcccaggatcgcccccgtcgacatggcggacgtgcccacggccgagcctgtctccgcctcctacgggctcctcgggaacggcggcgccaccgtgcccgtcgcgcccgtcttcaggccgcccgcgagccgggcgcgcgccgagccgacaaaccccaggagaggcgcggggccggccgactcggcgccgcgtgacgaggcccttaagccggggtcccgggcgcgccctcagccgccaaccataggttggatactcccgagctcantnattgncaaggggnttttggacaaagcantaattccaatttcgaanaannnnngggggnccttcttnannnnnaaaanccnnnntnaaaaaangnnnaantnaaaannncnggggggcctttnnnaaaaa

SEQ ID NO: 33005 - DNA, 1463 bp, Triticum aestivum
  Clone ID: PAT_TA_33005
gtttttttgactctgctttgtttcttcatttacttgttttttgttcatttgtttcagatcaaaacactgcgaataatgtcagcgattacaagaagcgcgttgaacttgatatagatatcaacatagcactatcaaacagtactgcctacattttttcatttttctattattgatcagacaatattttttgtcttttttgcatgctttgctggcagtgattttctcattgttttgtgccttttttcctttttcttcttgttttacatgacaacgggatagacgataagcaacaacatgtcaaagagttacaggacactttgcatccattagatattgcaaggcaaaagtacttcttcacagatgatgcgacacctagctgcagaattcttccagaccatgatgattgtgggaatcaaataatagagccagaattgtggcgcccattagagatgaactcggaagaatataattctcaaatagaggaagcaaagaaaaaatatccatgcaatgcaagcaaggatgagcaagaagtgcaaggagattcctccatacagtgtgcgcagagacaacccgtgtccacaggcatttgcaagtacagagactttcttccacagtttgaagaaaaggatggcatcatcgacttgacatcgcctgttgcacgcatgtcacacacttggggcagagcaacaacatactactcccgaatgggcaaatggaacaatgagaacgctgaaagtcctacacaaaagcacaagaagagatattcaacaacagcaattttagggaagaggcttttttcagatgagtttgatgaaaatgatgaacaagaaagcactaaacaccaaccaatccctgtgtctccggatgttcaagttttgggggaaagatcattcaatggttcatgctctagtatggtaaacacggcggacaatttatacaacacgaagctatcattaggcacttcatcaagtggtaaagagaatttgcctccaaaaaggataacacacccaagcaagtggctctcctcaccatatgatcacaacgagagaggacctcttcaagccacatggagataagagctacacaaggggcataagtgggcactaaagcaaagtttgaacctccacagtagcaaagtggttgtgtttgattggacaaaacaagccttttccccttgggcaactttggcgatccatttggtgtgaagtggccaccttgggagcatatgttttccacgttttccctccccggccccttcgcccgagtctccccccgaggtcttttacgccctccctcccccctactccacgtggtttttttcccctgaagtggtgatctgaagaaggaaggagggaaatgaagagaaaaacacttagaagcttcaatggagctgggaaagcattgcctctacacgaaagtgatcgtatcttctttccgtcagtacctcggccgcgaccacgcta

SEQ ID NO: 33006 - DNA, 686 bp, Triticum aestivum
  Clone ID: PAT_TA_33006
tttacaaaacagactgttggcaacgcttgtgaaacagttggtgttattcatgcaatagggaatgctgcatccgacatcaagctggttgagggatcttattttgataggttttataaacaaacagctgacatggatccagttcagcgtgctgtctttctcgaggaggatgatgagatggagggtgctcatgctgttgctgctactgctggtgacactgacgtaaacgttgaggtgaatgaacattttgtctgtttctcctgtgttgatggtgaactttatgagcttgatggacgaaaatcaaaaccgatatctcatggcccttcatcacctgagaccttgctgcaggatgctgcaaaagtcatcaaggccagaattgcgacgaaccctaactcgttgaacttcaacgtcatggttctttcaaaacagtgaatcggtgatgtaaggtggaatggataggcttggtcttttccattctcatgggctggtgccggagatcgacgcgtgccggagcatagcccgtcggaaaaacagagacttgttgcctaaaagtaaactgtgctctttgtgcagaagttatgtctttgtcttctggcttttgtatcagaaataaaaaaggagtattagttgctggattgaaaaatgtctactatatacttttggtgccttttatcgttcttattcctatc

SEQ ID NO: 33007 - DNA, 2767 bp, Triticum aestivum
  Clone ID: PAT_TA_33007
cgcgtccccctcgatctccggacaaaaatccgccctttttacgcccgccttgccctttctggccgcgagagcctccccacccccaccacgatctcgccccctcgcgtgcgcgtgtttccgtcgccccttgtctgtccctttcgcccgatttccttgcggttgaggaggttgttggagcgggccggggaagaaaagaagttagcccgccgcgccgcgcctcgccgcgccgccgccgcagccatgaacgcgctcgccgcgaccagccgcaacttccgccaggccgcccggctgctcggcctcgactccaagctcgagaagagcctcctcatccccttccgcgagatcaaggtcgaatgcaccatccccaaggacgacggcacgctggcctccttcgtgggcttccgcgtgcagcacgacaatgcccgcgggcccatgaaaggtggcatccgctaccaccccgaggttgatccagatgaagtaaacgcacttgctcaactgatgacatggaaaactgccgttgcggctgtaccatatggtggagcaaagggaggaatagggtgctctcctggtgatttaagtaggagtgagttggagcgtctgacgcgtgtatttactcagaaaattcatgaccttattggaactcataccgatattccagctccagacatgggaactaattcacagaccatggcatggatctttgacgagtactcaaaattccatggtcactccccagctgttgtcacagggaagcccatagatcttggtggatcattaggtagggatgctgccactgggcggggtgtaatgtacgctactgaggctctcctggccgaatatgggaagtctatttctggatcaacctttgttattcagggattcggtaatgttggttcatgggctgcacaactcattcatgagaaaggtggtaaggtaattgcacttggagatgtatcatgcacaatcagaaacaaagcagggatagacgtacctgctctgatgaaccacgtggtaacaaccgccgcttgcgcccctcccgcttcccgcaccgcacgcgcgaatctgcccgcccccccgccccctctcccctctcgccgcccggcctctcttctttcttcctacgcgcgccgagagaagatggggaagcgatggatcccgctcgaggccaaccccgacgtcatgaaccagttcatctggggactgggagtcaccgcagggggaggcgcagttctgcgacgtctacggcctcgacgacgagctgctcgccatggtgccccagcccgtcctcgccgtcatcttcctctacccgctcacctccctgggatgagaaggtggaggaatacgatgcttctgccacctctgaacggcagggggcaaggattcaaggcgacgaaggtgtactttacaaaacaggactgttggcaaacgcttgatgggaacagttggtgttattcactgcaatagatgggaaatgctgcatcccgacatcaatgctgggcttgaagggatccttacttttgatagagttttactaaacaaagcagctgagatggatccagttcagcgtgctgtctttctcgggagggaggatgatgagatggatgggtgctcattctgttgctgctactgctggtgacactgacgtaaacgtttgaggtgaatgaacattttgtctgtttctcctgtgttgatggtgaaacttttatgagcttgatggacgaaaatcaaaaccgatatctcatggcccttcatcacctgagaccttgctgcaggatgctgcaaaagtcatcaaggccagaattgcgacgaaccctaactcgttgaacttcaacgtcatggattctttcaaaacagtgaatcaggtgatgtaaggatggaatggataggtaaggtcttttccatgctaatgggctggtgcctggaagtaagtattgcgcgacggacaatcagagatttattgcctaaaatcaaactctgctctttgataaaaagttatgttttggtgtagcacagtaatgagggtggtcagttgaaaagactttcatggcgctgaagtcatggatgcctcagagttgctagtgcatgaatgcgatgtcctcctcccatgtgccttaggcggggttcttaacagggaaaatgcccctgaaattaaggccaaatttataatcgaagctgctaatcatccaaccgatccagaagctgacgagattcttaccaagaagggagtggtcgtgttacctgatatctatgctaatgctggggcgtgtgatcgttagctattttgagtgggttcagaacattcaaggattcatgtgggaagaagaaaaggtgaacatggagctccataagtacatgaacagcgcgttccagaacatcaaggccatgtgcaagtctcaagattgcaaccttaggatgggagcattcaccttgggagtgaaccgggttgctcgcgccaccatcttgaggggctgggaggcatgaggaattccagattccttatcgaataatccatgcccgacaccgtggtggatgacagttcttatatccaccatcattgatttggtaaattcatcataagttgccggcatgggaaaataattttcggtgtacatgaacagagaacgatgggtttgttctttctgttagcctaattatctgccctgggttgccaactatgtgatctagttctgtgtgattgtaaaccttcagagttgttgaatgtttaccaaaagtctctggattttaatatcaaaaaggttattttggc

SEQ ID NO: 33008 - DNA, 1435 bp, Triticum aestivum
  Clone ID: PAT_TA_33008
cggacgcgtcggtcatttcttactgagtgcttacaatggaacagctacatgagagggtgcggcccagttgaggctagcatgctattcttctctggatacatcgccttctggtcgaactttgctacattggacgaaagaacgggggttatcgtcagcaggagggcggataggcactttgaggaggaaggcccaatcctctgtgctgcattagatgggatgaagcttccatcgtttcccgaatatgaagtgagagtcaggtacgctactgagcacagatgtggtgtggttgtcaaaggcccaaggctaagtggaaacatttccggaactgatcggttgaaagacaaccgcttgcatctaaaggctgaacctttcgatgattcggaagaagccaaaaacaccgcagctttggttaacgagctctctaacgagatcacgtgtatactggtttctcaacccatcaatgcaaagcgtgcagtcgaggggaagaatattgctaatgttgtgctattgcgaggctgtggtatccggattgaggtacctccctttgaaaccaagcatggactcacgccgtgcatggtagctcctaccaagatcatagccgggctggggctgtcattgggcattgatatccttgaagcacctggagcaactggagattatagaactctcttaacttccaaggcaaaagctatagccaaggcactctctgctcctctggacacaccacctcgcgtttttgtgcctggagaggatgaatataaagccggaagagaaaatggatacgactttggtttcttgcacatcaaggctattgatgatgctggccatgacaaggctgtcaagttaaaggtgcgaggtctggaagctgtcgaccgggctattggtcagcttgcaaggctcctgtgggaagctgagaagtcggggcactaccagtacttcctctgtgtcactggagaccactctactcctgttgagtacggagaccacagctttgaacctgtcccgtttgcaatatgccgtctgagagatttcgtgggagcgattggggagggcaatgtgatgaataccccccttgacgatttcccgctgcctttggttaaatccggagaagatttaactgatgattcagaaccagcggaacacaagcctggggagcgtaaagcttttagcggcgatacagtgtgtgaatacaccgagattgctgctgcaaggggctgccttgggcggttccctggaagtgagatgatgggcatcatcaagaagttcatgaaagcaaagaacgattaacgccagttcgattgctaacactgtacttgatctttgtaataatgacgaacggataaacgacgcagaaccagcttaatccgataggaataaaatctatcatggttgaggtggaatgtcatgtggtttgaatctgttcaaaaaaaaaaaa

SEQ ID NO: 33009 - DNA, 607 bp, Triticum aestivum
  Clone ID: PAT_TA_33009
ggacattccagaatcggctaccaaacctgttctcctgaagagaatgaggtatatgcttcaaatgatcaaagaacagtaatggtttcttcaatttgtggctcatgtgatgtgttgcatgttgacaagtttagagaagagactaatagaagaaatcaggtggtcagttcagatagtaagctacatccaattttctttggcaggtggaagtatgatgaatgcacaggcaattttgttagtgtagatagttcgatgggtttctgacattcttttgaatcacagttcacaactgtacattgccgttcgtctctcgttccagccatcttgctggatgtatatgtgaaggatgaagctgaagtgaggttcatatgcacagttactatattatagaatgatgtgtactggttcagatcttgctgcgggtttgcctccttgcttcctatcgaatttgagctaaaacctgtggagttgttgcaaaattcagacccttgatttacttggtacccttaaaaatcatttcaccttctgcatgagatgtcgatggatgctcgatgagctacctggcagagaagttgttttgccatttgatgcccaaaaaataaaataaaaa

SEQ ID NO: 33010 - DNA, 2290 bp, Triticum aestivum
  Clone ID: PAT_TA_33010
gccatcacttgagttttttttttttttttttttttgacatcaatctcagctgctccaccgcattttgatttctccagctgtttgaaccccaaatagatccatcaccatcagtttagaaccaaatggtatcacaaagcagccatgtgttttccctttaggctttagctatatctatcagcaaatttatcactacacaacaatggtccacactgaacaagctgtatgtataaacgctggcttagctaacacaacaacggcagcagcactgtacaattagcaacaacagcctatgtgctcccttgtctctggtcggcggcaggatgttgctgccagtcttgttcgacgaggcgggaggagctgagctcggtggtgctgtagaaggactcgtccgggcagaagcccccgtactccttctcgtcctcccaccggagcacctccctgatgtatcggaaggcctcgtcgacggtggggccgtcgcgggcacgcgcctgccacacgaagagcttccggtcgcccgtgtgcgccgcgtacaggttcttgaacttcatcgccacatagaagaacgcctgctgtgccatcgactggttgttgtgggtgcggagcgggtcgaagtcgctgaaccactcgcaggcggtgagtggggaccgcccgatcttctcctcaaagatgtcgaacttgttgagcaccaggacgaatggtgtgtcgcggaaagacgggtgcctgattgtggcctcaaacaagtccttgctctgaatcatcttattctcgaggcgcctactggtgccactggcaggggctcccagctggtcatagtcgctgagtgctacagagaatataaccgcgcggacatcctcaaacatttcaacccatttgcagccctcattcaagcccttggcattgactctaatcagctgatatttgttttgtgcctgagagcttgggtcatgactgtcaccatagagttctgacatagggttccgttcgtccagagtgaagtcaataaaggccaatccatttccttgtgatactccttcagcatacaagacatctttctctgaaggttcatactcattgcttgatacttcaatagccctgctcaagaaatattcagcaacgtcagggagaaaatacaattcatcctttcttttatatgttgcttgtatggcaggatgcttccacaactcatcaacaactggagcatattcacgtgtagctgcagggaagaatgcatctaggtctcccattgctatgatgtccaaaagccaatctgagaacttcttcagcttggcatttattgagtatatgcaggaatttaaaccattcgattcgtttccatcttgttgggtatcctcatcctctgagtttgggttgtttgatatagccaaagcctcttcctcgaagcgctcacggccctctagcagaatcccaaggtacttgaacatgttgctttggatcattagtttgatattgtcaagttcttctggggtaaatctacttccatatagtaacttagcctgcttaaaaatggtgcttgttccagctccaggtgatccaagaataagaagtttttgtattcttttctggtctaagtattcgggcactgttcttgctgaataaggagcatcatctctgggctctacagagtttgcaggaggcaccggtagtgaaaccaaggtgcacacaaaacgtgtcaaaggtgactcccatatcttccctttgatgttattttggccttcttcctcatatccaccatcatgatagacccaaaagtgagtatcgcggggacattgaacttgtgcaaacctcagaattttccgttcgatgctggtaatttcccttccattcatataaacctgagtgttgccattactagcattgggctgaatctttccattgaagttcaggttggtgctgacaacccggtttggcttttccccttcctttccccataggcccgactccttgtcataccaatatctaccgggcttcagattttgaggaggccgtgggcagctaagcaagtctgacatctcttcttgacaaagagggaagccattgacgatgagttgctcgggccggagctggttggcctggcactccttctcggctttcaagatttgccttacctccagcgagctgagcaaccgtgataatatcctcgagctcttccccagcttcgaccgcctgccctcatagatcggccggccaatgcaagtgatacacttgcgtccttccggcatcgatcccatggccctcagcaggcagtagccgccagtacctcttgtcgcag

SEQ ID NO: 33011 - DNA, 991 bp, Triticum aestivum
  Clone ID: PAT_TA_33011
ctcctccgtccattgcttcccccagccgcgcatcatccatccatccatccgttcctctctccttccttcctgtccactacaccatggcgctcatgctcagcccggccgcgaccttcctccccgtcgccggcaagcccgccgccgccatgcggaacctcctcttcggcaccagcagcaagggaagaagcgttcgcaaggtggtggcgatggcggacatcctgggcgacttcggggcgcgggacccgttcccggaggagatcgcgagcaacttcggggagaagacgctgggcaacgtggacacgctgcaccgcatcctcattcccacgctctccgtgctctcgctctcccgcgtgccgctcgacgccgaccccgcgccgctctccgaggaggacgcccgcaagctgctcttcaaggtggtcggatggcggctcctcttccccagcaagggcgactccgacgtgctcaagctcgagtgcgtctggaaggtccgcgaccaggcctgcggcgacgagctcatcgccaggatcaacaagaccctcgacggcgccggccatgcccccgccgcgctccagttcgaggcgcccaaccaagtcagggcccagctctacccgccctccgtcggtgggctgcgcgccaacgacttcatcgtcgcgcggacgatcgcccacaaccggacctaagatccccccgcagagaagaatgcctccacgatcaaatgaccaaagcgatctcctcccaaatccactgactgtccggtgcttacactccccggcttgttgcttctaattcttgccattgcacacgccactggatctacattcatagcaattttgtaggtctatgatgatgatgttggcatcgccattttgaccgctaatgtgttctctcaaatgggggggctctggacgatgcgccccacttttaccaccacatctacaattacaaaaatgttcaccaaaccattagctatttaaatgctaaaaaaaaaaaa

SEQ ID NO: 33012 - DNA, 753 bp, Triticum aestivum
  Clone ID: PAT_TA_33012
ggaaaggggagccaaaatcccccgtttcattatttcattttggcaagacgcaaaccccacaatgttagccaatgccaccaggtaaaaaccacacaatgttagccaatgccaccagatatagtaatatgctaaagtgacgtgtatctgggagcagagggtaagtcgtcgtcggcggcgaagctcagggccatgacgacgtccgacatgatgggccttacggtgtcctcctcctgcaagcaaatggccgccacggccaccgcctgcttcagttccctgccggtcggcccttctaccaggagcggatccaccagctcgtgcatcctcctctgctcgctgaacatgggcgccgcccaggccaccaggttctgctccccagagggcctgctgtcgtcgatgacccgcctgccggtgatgagctcgagcagcaccacgccgaagctgtacacgtccgacttcaccgtcaggtgccccttcctcacgtactcgggcgcgcagtaaccgtaggtgcccatcaccctcgacgagccgtccttctcctcctccgcatcaccgcccttgccgttgcgggtgatggggtgtggccagcttggcgaggccgaagtcggagagcttggcgttgtatccctcgtcgaggaggatgttggaggacttgaggtcgcggtagatcaccggcgggttggcagtctcgtggaggaactccaggccctgggcggcgtcgtgtgcgatcctcatcctggtccgccacggcagaac

SEQ ID NO: 33013 - DNA, 740 bp, Triticum aestivum
  Clone ID: PAT_TA_33013
caaaatgggtctttccttttttttttctaaaaccgatgtttcgatattgagctgaaagcaaaatgggacattccaaattgttttctggttaatgaccagtttctacgacactgctatacaacttggatttgctttcaaatgaaaaagaaaaaaacatatcgttcctccatgtacaccggacactttgtgatgttgtttaacttttgtgattgtttttgatcatcttgctaaagtcctttattgtagtattcctccatccattacagagaatgttgcagttggttggcctccttgaccttcaatttaccatgcgaagttcttgacgagtattttgccttgatcctctgtgttgtgaatactaaatagaatgtcaacagcaaatctgacccttgcgtttgctacgtcgttcattgtgaactgtcgctgcataggatttcgcgaagcccaagtttgcatccagttaagagcaaaaatcccacaagcgtcgcttccgatttgctttggcatgtttgggtactctacaccaaactttctgaaactcattcctctcaaattagaatcttcccatgtttttatgaaattaacaaacttcaaatctctgatcccgttcctgaaagataacgagcccttcataatatgaatctaggaagacaaaactttcttggtataatgtcaacaacgaacaagaaccagtgctcatcatgtactgacggaaagaagaacgatcacttttcgtgtag

SEQ ID NO: 33014 - DNA, 807 bp, Triticum aestivum
  Clone ID: PAT_TA_33014
cctcgtctcctccatctcttccctcgccgcaaccactccctgctgttcttggccgcctccccgccccgcacgccacgccgcaccccctcccccttatctctggcccatggtgaagcaacgccgcgtccctcaccgagctgcacgccatctggctggaagccagagctcgagctcgacgcctccagcgcccccgacgatttccgtgtggatccggtctctaggctgccaatcttttcggatgtagttagccagcgggctcgaatctgaacgagataagcgatgtgggtagccaacgaagagacaagattcgtcagtgccggcgcatttggatggcggcggcaccattacgtaagatgccaatagcagagatagcgagctggtgcagtccgaagagtgtagtgaagccggatccgcaagcgtccaggaggattaaattgggtaatccaccagagcaataggaggatgggagctgaggcctgatcgggatgcagcgcccgtcccggtccctgctgccgtcggagaggcgaggatgtcgtcggctgcgccatagcagctcggcggttccatgaatagcggggcgacctccgccgccgccacgctgctgcacggctaaacacccccagcatgaatggggatgggtatgacagtgacaacagctacaacgccacgcggcccatgagtacccaactacctgctctcctgtaggctgtagctacttcgttttgttctgtttgacggactactactactttgtgtacctgttttgattttggcataacgattagagtaaatagtgttttgctgctg

SEQ ID NO: 33015 - DNA, 888 bp, Triticum aestivum
  Clone ID: PAT_TA_33015
ggacggccaaaccactgtgcggccgctgccgccgtcttgccgcctgctccctctcatctcgtcgccgcctcctccgcactccctgcacgtcgccaaaactctcatacccaggcagacccatgcctgggcccgggcccgacccgttgcccccaccatgtccgctcagctagatgccgccctctccgccggcttcgtccgcctcctcaacgccgggcaggaggacgcggactgcggcggcgggcactacgatccgaagtcgggggactacgccgtcgggatcgttgtctccggcaccgaggctcgcctcgacgttgccgttggcgccgaccgcctcgctacgctcctcaccaaggagctcctcccgctttgccgcgcgaagctccgtactggaggtgctaaaccggctccgcctcggccagggagcgtgggcgtcttggaggcctcccccgtggatgaagagacccaaaatcagaagcgcggggccaggacgctggtgccgcccggcacggtggtcttcgcggaggtgctcgggcgcacactgagcgggcggccgctcctgtcggcgacggcggctcttccgacgcctctccgtggcaccgggcaagctgggccaggcccggcgagccgccggggcgggtgtgtgcgccgcgggggccggcgccccgcgccccgcccggggtgcgggggccccgtctgggccttccccctgtgtgccgctctgcggcgcggggcggtcgcggttctgccgtgttgtgtccgcgctgttccccgcggcggggtggggcgtcgtgcggccgggcctgttttcgttgggcgcctgggtgttccgtctcgtgtctgggggcccgccgtgtcggggcggcgccgggggcggggcggtgcgggggg

SEQ ID NO: 33016 - DNA, 792 bp, Triticum aestivum
  unsure (1)..(792): unsure at all n locations
  Clone ID: PAT_TA_33016
atgtcatcaagcctacgctcgactccaagcaaacggcggaacccaagcctgcccccaagaagaaaaagaagaagaagaagcagccagctgaggtacaggcccagccggcggcgccgccgccaacgcagaaggagcagacgtcccagacgccgtctgttggcggcacggtcgaagctgccaagaaggacccgccgccagtgaggccgtacgcgcatgtcgctgaggattctgacacgaagaagcccccgccgccggagctcacagggcggcgcgtcgtgaaagaaaaccccttcctgctgcgggaccgcgaggccaagaacgcggacgggaccgccgccgcgcccaagtggcgccggagggacccgtttgaggggtatccggagcgacgccccccgggcgcgagcggcggcggggtggtgctgtacacgacgacgctccgcggcgtgcggcgcacgttcgaggactgcgagcgcgcgcgtgcggcggtcgagatgtgcgcggaggcggcgggcctgaccgtggacgagcgcgacgtggcgctgcacggggagtacctgcgcgagctccgggagctgctggcggccgacgaggagcagggcgccggcgtctcgccgccgcccgggctgttcgtgatggggcggtacctgggcggcgcgggctggtcccgggagagcggccagggcgcccgggcacggtcgaggacgtcccctcctaccagtgctgcggcgctccaaattttaancatcatcccgngcanaaattncacaaagcaacattnntttcctccccatt

SEQ ID NO: 33017 - DNA, 620 bp, Triticum aestivum
  Clone ID: PAT_TA_33017
cccacgcgtccggcccacctcggcaggccgacctacatgggcccgcccggcagcggccagagcagcaagatcgcgaaccagatcgcggtggcgggcgcggtggtcggcctcggcgagtccctggccttcgccggcgccgccgggctggacgagcggctgttcctcggcgcggtgtccaagggcgccgcggggtcgcgcgtgatggacatcttcggcgagcgcgcgctgagccgcgacttcacgtccgggggcgccgtgcggtacatcatcaaggacctcggcatggcgctggaggtcggcgacggccaggaggaggatgaggtcaacgtgctgccagggtcggcgctgtaccggcagatgttctcggccatggcggcgaacggcgacggcgagctgtgcctgcagggactgatcaccgtcgtcgagcgcctgaacggcatccgcaagtgaggcagggcaggtgttcgtcaaaatgcggtagcgggatatgtatctcatggtcatgtattattagatttcctggtcaaaattcaatctctatgtcatatttttaaccaacgatttgtggatgctatcatcgatcatactgttatcatgctttactcgctgatttgtggaaa

SEQ ID NO: 33018 - DNA, 1046 bp, Triticum aestivum
  unsure (1)..(1046): unsure at all n locations
  Clone ID: PAT_TA_33018
gccccgttgtagcaattcccccttctttcttctcgaaaccctactactcgatacaccctcgatcaaatccaccccagatcggtccagcggaagtggggagggggaacatcgccccccgccgccccgcccccgcccccgcggcggcccgccaccggccgctggcgcttggtcctctccccgaacccggccaagccccacgccctcaggaaccgccagcgcagcaaaggagcacgacgccgcagcgacaccaccgccgccgcacgaccacctcccacttccgccccatttccacatcctcaagttggggacatgcaacggtgacacgagtgcaagatgcagatgggatcgagcttgtgatgcactggttgaataattgagcagtcaatcagccagtaaccaacatttattgaactccaattcaggaacacttagctcgaagtctgtaacgaatgaaaaacatgtgcaaagaatccaagaaacgcttcatcagctaaagcaaaggatggaattgatcaagaactacaagagcgcggtggaagaacctcattaaggaggatccaacaagtataaaaaaagggctctgacaatcggaccctcagaacattaattatgatggagctcgttgtcaccaccgcgtgaaataaatcgacgcgtcttatcttgtaaacatgcttggagtagtctgtggagtaagggacatggaatttttaagtggtggttacaaagctgcgtttgtgtgttgagtgcgtgtattttgagttttatgaagtcatgggagtccctgtaaaatggaccaagcatatatgcatgaatgccccaaattcttcggcctgatcggttggatattatgcactgaacttgcttgatgtctatcggcatagaaataatgtgataatccgggggtaatcagttaaaaaaaaaaaaaaaaaaaaaaaaaaaaaanaaaaaaaaaaaaannaaaaaaaaannaaaaaaannaaaaaaaaannaaaagggcnngngccgncttctagnaggnatnccaagnncttacgtacgggncgtgc

SEQ ID NO: 33019 - DNA, 833 bp, Triticum aestivum
  unsure (1)..(833): unsure at all n locations
  Clone ID: PAT_TA_33019
agacgcagcccaccaccgttcccctccaaatccatccgatccaatctgcccgctcgcagctccacggaaggaagccgcgtcaaccatgtcgggccgcggcaagggcgggaaggggctgggcaagggcggcgccaagcgccaccggaaggtgctgcgggacaacatccagggcatcaccaagccggccatccggcggctggcccggcgcggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcaccctctacggattcggcggctaggccccctgctccgtccagtctctgctcccgctgttccatctgtccgactgcatgtgtatgaatcgttggtgagggtttggtctgtagttagtgtaaggcgatgtgtatgaatgtaatggggaatcagagttggtattatcttggctgcatctctgctgcgtgtttattcgatgcgtttgtgatccattgaggctgtatttgcttaattcagtttttagctgaatgagcgccaaaatttgggtatgcacaaacgttctctggatttaaatgtgtttcttcaccagccattctgttntgcattctgaaactctggaattggtctgaatgttgctgtttcatcggttggttttatctgtgtagttagtggatggcgatggttatgaatgcaatggaatcagtgttctcgcgaaaaaaaaaaaaaaaaaaaaaaaaaaaa

SEQ ID NO: 33020 - DNA, 1548 bp, Triticum aestivum
  Clone ID: PAT_TA_33020
ggagacgacgatcgacgggctaccagtgagttagttacccatgggccgcaacatggcgcttcccctgctcctggcgctggcggccctagtggcgtcgctgccgtcgggttccgtcgcgacggcggggacggctggtgcgttcgacagctggttgtcggcgaaccagaaagacttcgcgatcaaccaggcgttgtacgcgaagaaggcggtgggtgacaccggcagcaccatcgacgagtccctgtccaaggcggaggataacaagaccacctacgtggtggaccccaagggcggtggtgactacaagaccatcacggccgcgatcgacgccatcccggagggcaacaccggtcgcgtaatcctggacctgaaacccggcgagtaccgtgagaagatcttcctcaatctcagcaagccctacgtcactttcaagtccgatcccaagaacccggccatcatcgcctggagcgacaccgctgcgacgctagggaaagacgggaagcccgtgggcacggtggggagcaccacttgcgccatcgagtccgactacttcgtggcgtacggcgtcgtgttcaagaacgacgcgccactggccaagccgggggccaagggcgggcaggcggtggcgctgcgtacgttcggcaccaagcaggccttctacaactgcaccatcgacggcgggcaggacacgctgtacgaccacaaggggctgcactacttcaaggactgcgtgatcaaagggagcgtggacttcatcttcgggtttgggaggtccttgtacgagaactgccgcatcgtgtccatcgtgaaggagatcgccgttctcacggcgcagcagcggaccaagaccatcgagggcgctatcgagagcgggttctcattcaagaactgcagcatcatgagcgaaggcgggggggatatctatcttggcagggcgtggggggactcgtcgcgtgtcatctacgcctacaccgagatgagcaaggaggtggtgccagttggatgggacggatggaacatcaagcagcctgagagtagcgggatctactacggcgagttcaaatgcagcgggccggggtcggacgcgaggaagagggtcgggtgggctgtggatctcaccgaggcccaggccaagcccttcatcggcacacactacatcttcggcgactcttggattctgccaccgccaactgggaactctcctccctctaaaaaaggctacagtggaggagcccccgccacatcccccgcctcatcgcccgagtccgcagattcggcctcatcgcccgagtcggcggattcagccgcgtcgcccaagtcggcgtccaaagcatcgtcgcccaaatccgcctactcagctggatccaagacgaagaagaaagaattatagaggaagaagatctcgtctgcaagaggctaattaattggcttcgatcgggctttaggaccagacagcatgcatccctagatgagcttattttcatagtttcttcagggtcgaaatgaaacacttctcaagattgagagatagagacttcatattttaga

SEQ ID NO: 33021 - DNA, 761 bp, Triticum aestivum
  unsure (1)..(761): unsure at all n locations
  Clone ID: PAT_TA_33021
accccacagtctccgtcacctgaccgatctccgttggccagcgtcaccgccctcgacaactcccctgatccacccctatcgtggtcatcgtcctcgaagcgtcggtttccaaaagaggaggacgatcccatcgtggttcttcatccctctcacgccaccgtctccgccaccttatggatctccggtggccggagtcgctgccctcagccggctgatgaattagccccaaactccccgagaaacacctgtcgggtcatcgtcctcgaagcgtcggttcccagcgactaacacggaggctccgcccccgctggccctgctcctgccccgagaagggtctcagggaggagatggtgatttaagttttgttctcagttcctaattatatgtcaggttcagaattggtaagttgtaagaactatttgtgcgtgtggaagagaagagctatggtcactttagacaaacttctctagcaaaaaatttggcagcactatgtccatgtaatatttgcttagctacttggttatgtttggttcatcaatgctaggaccaaggaggagcatatgatactttattatatataagatgtgagttaatgatgatttcctatacttcaattntgtggcatcgcattgctcaacttactgatagataaattagtnttcctgaagtgtaatacttgagtccttgcgtcttcaggtaggtctcacacggaatccattaatccattcaagagttatagatgcttttctgtttacaatttt

SEQ ID NO: 33022 - DNA, 728 bp, Triticum aestivum
  Clone ID: PAT_TA_33022
atcctgagctgcgacccgaacaccaccttgcggccgccggccttggcgtcgccgtgctcccggagcacgtcggcgaggccgccggcgccggccggctccggacccagagcggccgtctccatgtgagccttcctgaggcttcgctccgagaggaagggcggcagggcggagcagcagaactgcttggtctcgagaatggaggtggggctcatggaggaggacggcccctgctccgcgccgtccaagaacccggcctgcggcagcgccatgtacggcctcggggaagaagaagactgagcagcggcagcggcgaggggctcaggttgaggcatgagacctccgcccccgcctccggcaccaaccgctctcctcgatctgttccgcagcatcgcctcagacggacggacggacggacggagaaccacaaagcaacgtccccggacggacggatcgagccggaaccgctccaactacaatggccgccgccgctcccaacgcatttgcctcgatctaggctctgtcagggaccagagtctcgttctgaaatcgaacggggcgcgaggtggaagacgagcagggcggttgtgggcaagggaatgcttgccgaggtaggtggccgaggagaagcaggagaggagagcacaaattccgccggaaaccgcccacggatgagcacccggccgccgcgaaaaccgccggaaagccctcgggctgggccctcgtgccga

SEQ ID NO: 33023 - DNA, 752 bp, Triticum aestivum
  unsure (1)..(752): unsure at all n locations
  Clone ID: PAT_TA_33023
cggtgctggtgaagttgacgggccggcatcccctaacaaggagataaaccaacagactctggtaccacagcgaaagaaagcgaggtttgtgctaccaaagagcgcccaggtggacgccgaggcgcggagcgagctgcaggacctgatggacgcaagggaggctggcatgtccttcattctgggccactcccacatgaaggccaagagcgggtctagcttcgtgaagcggatcgtgatcaacttcttctacgagttcctgaggaggaacagccgcggcccgtcctacgccgccaacataccccatgcttccaccctggaggtaggaatggtctaccaggtgtgatagtacgtagccggctgtgtgaaagtgaagctagagagatcagatcaagtgttgtttctccgtctgtatatatcccctctcgtcgccgacaatgctaacgcgagaaacggcagtagatgctggagcacgccatgggctaggctaacaaacaggcagcagcagatccttggagagccctgcattaagtgcatttttgtctaccaggtgtcaaaagccttttgttgagttggccggcccttgtgtttggttgccctggtctgttggtgttcatgttgctttactggggcaactgtaagtttgtaagtgagcagaaagatagaaatgtttatgtttagaaactttatttttttaaatagaaactttattttcttattacctgnactaatattgcaatgcaccggcagcatac

SEQ ID NO: 33024 - DNA, 692 bp, Triticum aestivum
  Clone ID: PAT_TA_33024
tttttggtccgggaaaacggggcggtgtatattacatgcatggattccctatacatacatactactagtacatgcgagatgcatggagcgacgaacatctcgcggtttcctctccgggacaagggagggaggtaagggatgcacaggaaccaactcggcatacatacacctatgtacagcgctgcgcatcttgcctcgatcgatcgcgagcggcggcgagaggttggttagtcgtaggacgggggatcggaggagtggttagttggtgctcagaagtctatgatgggctcgccgacggtgaggttccgctccaccgtccaggggaggttgaagagcttggccgtgatgaacttgaagatcttgttcacgttgatgttgtgcgtcgcgctcgagaagaagagggtcgccttcatcgctcttgcgtatgctctggcctcatcgacaatggtccattgcatctcaagaggaagctgagcgaagtcgtcaaacttcgttcctattaggattggaatagccgtcttattccatttcctggccctctcgtaccaatcggtaacattattgagcgtgcaccggctggtaagatcgaacatgaacaagatcgccacggcgtccttgcacgcgatcgggacgtggtcggcggactggctgtctcctgccacatcccagatgttgaaggcgagcctggcgcc

SEQ ID NO: 33025 - DNA, 571 bp, Triticum aestivum
  Clone ID: PAT_TA_33025
gtccacgagagcgacgccgggctccggcgagctcgccatcatcgccatcctctacaagctcggcgccccggactccttctactaccagctcaagcggaagctggcggagctggcggccgaccggtgcagctacggcgagcaggacgcgcgcgtggcgaccgggctggtgcacctgcgctcgctggagaagcggacggggagctacttccggtacatgggctccctcacggcgccaccgtgcgccgagaacgtctactggaacgtcctgggcaaggtgaggcagatgaccaaggagcagatcgacctcgtcaccgcgccgctgccggccgccgccaagcagaacgcccggccggtgcagccgctcaacggcagggtcgtcaccttctacaacccgcccaacagcaccatctccttcgacatgtgatcttacccccattagatggagtgctaattaacctagaaattaacgtgttactgtattcgtgtatcaccatcagcgtactgaccagctaatctcgtttttgccttgtcattatctcttcgctgctttactcagatgaaacattgtgac

SEQ ID NO: 33026 - DNA, 841 bp, Triticum aestivum
  Clone ID: PAT_TA_33026
tttttgatccatcttaagaaaagcgctaattatcaacaaaagtcgagggggataaacatccgtttgatatgatcagaactaaaagcatccaactgctaatggccaacagaagtcaccgaaaagaaaacaacgtcacttgcgaagaacagggctaaacacacggaattagtgctgcaccgctaactgatctatgaacaacagatgaacatgaactaacccaaaccaatcccaactgtcctcaggctagctagtttttttttctttctcttcttgtttctgtatgaatcgatccactgtcgcccccttcttttccctggttagctccccatgatccgcctgatggcagctcgctgcgacgaggatagcctcgccgggaaggccacgtcgaacctgatcctcaggctccccttcttccctggctcctttcggatcggccacccttcattctcaatcacaatctcctggccagggcgcaccacttcctccaccctgacgggaaggctcctgccatcaagggtcctgaggtttatggtcgtcccggcaagagcgtccaccagggggatctcctggcttaccaggaggttgttcccttctgtaagtgtcaggtgtcatggggctgattgtcgatgacgaaggtcaggtcctgcggtcaggtgccgtgccgcctgtcgccggtgttggcatctgtcttccctgttccctgcctcccgcctccccaccccgcgacctccctgtcccctgtcccaccttcccccctgctttcgcgtcttgcctcgtgccctgcgtcctccttcttcctccttgttccagctctccgcgcgtccagagtgctgtcttctgt

SEQ ID NO: 33027 - DNA, 498 bp, Triticum aestivum
  unsure (1)..(498): unsure at all n locations
  Clone ID: PAT_TA_33027
cacgggtaaggaaagcagcggcaagtgcaccacaggtggcaaatgtcattgctcaaaaagaaggaaattacgaattaagaggtcgattaaagtgcccgccattagcaacanaatatctgatatacctccggccgaatagtccgggcggaagtacgggcagaagccgattaagggttcccctcatccgaggggctactataaatgcagcaccgtcaggggctgcccggcgaggaagcatgttgagcggtgcgtggacgagccggtgatgctcatcgtgacgtacgaaggcgagcacagccataaccggctgccaacacaatctgcccagacctagaagacaaccggccgatcgcttcgccgcccctttcgatccatgaacgccaggcccgggcctttgtttgaagatacggtcgaactgttcgtgtgaaagtgaagctaggtctcgcggatctcaaaagtaggagccacaaacaacattgaggccattaatcatctggg

SEQ ID NO: 33028 - DNA, 248 bp, Triticum aestivum
  Clone ID: PAT_TA_33028
tcgggatatccgcccgccagcgctccactctccccccgtctccggcaccgtgcgcgccgccgccgccgctaagatccagcccctcgtccgctccgccacgcgccagcgccagcgcccagcgcgcgtcggcccgtccgcccccgccgcccccgcccgaggtttcaaaacccggggtttacacacctttgatggcactgtctctttgaagaacactgcatctgcgctgtttgtccaaagggaggacgatg

SEQ ID NO: 33029 - DNA, 809 bp, Triticum aestivum
  Clone ID: PAT_TA_33029
ccacaacctaatagcagatgttgccaccaaggatgagatccggctgaattgcgcagctgaagagagagctttctagacagactcgacatatgattctgagaagctggcggagagaatagcaaagctctctggcggagttgctgtgatcaaggttggagctgcaacagaaacggagcttgaggaccgcaagctccgcatagaggatgccaagaatgccacttttgcagccattgaggaaggtatagtacctggaggtggtgcggcctatgttcacctgtcgactctcgtaccagctatcaaggagaagctggatgaccctgaggagcgccttggtgctgatatcattcagaaggctctagtggcacccgcatcgttgatcgcgcacaatgccggagtcgaaggggaggtgatcgtggagaaaatcaaggacagcgagtgggaatttggatacaacgcgatgaccgacaagcatgagaacctggtagaggctggcgtcatcgaccccgcgaaggtgacgaggtgtgccctgcagaacgcggcgtcggtggccggaatggtcctgaccacgcaggcgatcgtcgtggagaagcctagcaagaaggcccccgcgcccgccgggatgccccagggcatgatgtagaagcgcaatgatacgtagcaacctgggggcatgcaattttaggggcagtgggagtgatcatttctccaagggagataactgtgggtacctcgagaaatcattggtgtgtaatggatagtgatgacctgttctattgtctatttggtaccgctaataccgtgaaaactat

SEQ ID NO: 33030 - DNA, 2167 bp, Triticum aestivum
  Clone ID: PAT_TA_33030
cgcagccgccgctcgcccccatccagaaaagccctagctagctagacccaccccatccatggacattaaagctattgctgccatatctgctggaaacgatgactttattgggaccatgattgtggaggctattaacaaggttggccctgacggtgtcctctcgattgaatcatcatcgtcgtttgagaccactgttgaagttgaagacctgcccatcccatcgtcatggccggtgcgggctcggctgggcgcgcctccaggaatggagattgacagaggatacatctctcctcagtttgtcacaaactctgagaagtcggttgttgagtttgaaaacgctcgagttcttgtcactgatcagaagatttcctcgattaaagaaatccttcctttgttggagcaaactacgcagttgagagcaccacttctcataattgcagaggatgtatctggtgaggctttggcaactctagttgtcaacaagcttagaggaattctgaatgtagctgcgattaaagctcccggttttggtgaaaggcgcaaggctctccttcaggacattgccattgttacaggtgctgaatttcaagccaaagatcttgggcaactgatcgagcagacaacagtggagcagctcggcatagccaggaaggtgacaatctccgggtcatccacaaccataatagcagatgttgccaccaaggatgagatccaggctagaattgcacagctgaagagagagctttctcagacagactcgacatatgattctgagaagctggcggagagaatagcaaagctctctggcggagttgctgtgatcaaggttggagctgcaaccgagacggagctcgaggaccgcaagctccgcatagaggatgccaagaatgcaacttttgcggccattgaggaaggtatagtacctggaggtggtgcggcctatgttcacctgtcgacattcgtaccagccatcaaggagaagctggatgaccctgaggagcgcctcggtgctgatatcattcagaaggctctggtggcaccagcatcgtggaattctgaatgtagctgcaattaaagctcctggttttggtgaaaggcgcaaggctctccttcaggacattgccattgttacaggaccgacaagcacgagaacctggttgaggctggagtcatcgaccccgcgaaggtgacgaggtgcgccctgcagaacgcggcctcgctccccggcatcctcctccccacccgcgcgtgcggcctccaggggcctggcccgggcgcccccgcccctgccggggtgcccccgggctcggtctggctccgcatcggttccggagcagccggcggggagaatgccattgctggggcgcggtgttgctgtggccaggggtggagcggctgcagaaacggagcgggaggaccgcaagctccgcatagaggatgccaagaatgccacttttgcagccattgaggaaggtatagtacctggaggtggtgcggcctatgttcacctgtcgactctcgtaccagctatcaaggagaagctggatgaccctgaggagcgccttggtgctgatatcattcagaaggctctagtggcacccgcatcgttgatcgcgcacaatgccggagtcgaaggggaggtgatcgtggataaaatcaaggacagcgagtgggaattcggctacaacgcgatgaccgacaagcacgagaacctggttgaggctggcgtcattgacccagcgaaggtgacgaggtgcgccctgcagaacgcagcgtcggtggccggaatggtcctgaccacccaggcgatcgtcgtggagaagccgagcaagaaggctcccgcgcccgccgggatgccccagggcatgatgtagaagcgcaatgatatgtagcaacctgggggcatgcaattttaggggcgtgtggtgatcgttttgccaggggagagaaccgtggcaccttaaggaggaaatcatggtgtgtaatggataatgatggcctgttctattgtctgtttggcacgcttcgtggcgattgccatgttgaaaactattttggctagctgagtttgagaagaagtaataaattagtaaagttgaggatgtgccctgattgatttttcaaagaaaaaaaaaaaaaaaaaaaactcgagactagtgttctctct

SEQ ID NO: 33031 - DNA, 838 bp, Triticum aestivum
  Clone ID: PAT_TA_33031
gctaacttggggagttttctgcatcagcggttatttttgtagacatgattcgaatcagttcagtaccaaattcatgtgagactgactagaccatcttctcaaatggatactaccaaactggaaattattgaaacaagctagtagcaaaaataaccatattagtgaaataaaatactcatgtcactacatgacaagctaatcaagtcgaaaatttgaagagaaaaaaagtgtggtcaataagagctttgaccacctaattaagagggtacgtactccactcagcctagacaaagcttctattacgaagcctcctctcccaccccacccccacttttaactacagactcgatcccgtgccggcggcggcgcggcggcggcgtcacatgacgctacaggaactggggttctcctcgttgaacatgctgttgtacggttcctgcggcggggacgaccgcatgcctggcgggccgtacatgtactccggcggcggcggcggcatcatcatcggcgggtaaggcgagtacccgccgtacggcggcggaggcggcattggctgcatggacgccaccggcgtgggcgcgtagtacgacacgctcgcgctcggctgcgccatgttgtagctcatcaccggttgcggcgcgtagtacgggaacgggccgccgtggccgtgcgcgcgctctggccccgtccccggcgctggcacgggcggcatcgcctgctgtggctgtggctgcttcgtctttggctgctgctgctgctgctgctgctgcggcttctccgtagcggcgtccccgtcgccggcttccgttctgctgcttgttcttcttcttccctcgtg

SEQ ID NO: 33032 - DNA, 2702 bp, Triticum aestivum
  Clone ID: PAT_TA_33032
catccgcccacgcgtccggaaggagaaacctctttcacttaaagatttgaaggccctggtcctcattttaaagcaggctttatggcaacttctttggattattccttcacatacctctcctagccagaaagcattgcccaatcctttaggccttaagataatggtcatcgacagtcttaggagccaggcaaggaatgggttatctgaattacttacccaggcgcaagactggaacagccgactcccattcactgccgaaagtgatttctattctcaagaagcaacagtgaaaattttgtttctcaggcgatacttggcaacactcgagcatcagagattataaagcttgctccctttttggcaccttttaccattagagttaaaatatttacttcacaattggcaaattctaaacaatcgacggcatctcattccgccttgacaagacatcggtttaaaataagaagaagtcgactcctcgaagatgcttttgatcagctaagcttgctctctgaagaagatcttaaaggaccaatccgagtatcatttgttaatgagcatggtgtggaagaagctggaattgatggaggtggaattttcaaagatttcatggaaaatatcactcgtgctgcttttgatgtgcagtatggcctattcaaggaaacagtcgaccacgttctgtaccccaaccctggatcaggattggttgatgagcagcatctgtttctgaagtctcccaatttaagagtggatacaagtggatccatgaaagatgagcaccgactgaaacctgcgagatccgcaggagataaatatcgacccgccctcccatggcactagttgcaccgtaagaacgggggctatgcggggagaaccttattccaacttcagaaagccaccactgtctcgtcgatttgagcaggacacaaaccctaaacagactaaaaacacacttaaaaatgaagcaggagccctcccaccggcaaggacagggatccaccacatctccatggccctatgacaacgagagatgagacaggccgaccgtggtgctgacagcagtcggggaaaccgttggtgagtccctcgtgtgggaagatggtgtcgcttcctttgtattatttgcggtatggactgatgtttccggtgaagtatgagtacggtcctcggtcatgctctgatccccggataggtgagtgaggggtacattttccagcttcttgatgatacgcacttctcctgacgtaagcctcaactcatattgttctttcacatgctggggaacgcccttcagaacaagggtagcgaccaatgtgattttacattcttccaagcaaattggatcacttgaattgttacgctgcaggcatgttttttcaaaatcatcgagacgtttctgcgggaatgttcttttgaaatcatccagaagttttgggctcagctgtttgacataatcttcgatattcttacgccgattctcttgtgcttcatcctcttgacatggctctgaaggtgttacttccccacgaggtactgcagtcaaatccgtctttcggtctttgtaggttatgggatcccccatagctcctgtgtcttcggcccggcccgctgcaagctgaaagagaagtctaacttcttgaacgatctgccttccttggatccagagttgtatcgacatcttctatttttgaagcattacaagggcgacctctcagatttggagttgtacttcgttatcgtgaataatgaatatggtgaacaagctgaagaagagctccttcctggtgggagagagatgcgtgttactaatcagaatgttattacgtttatccaccttgttgccaaccatcgattaaactatcagatccgtggacaaggtagacattttctaagaggttttcaaaaacttataccaaaggaatggattgatatgttcaatgaacatgaaattcagcttctcatatctggctctttggaaagtttggacattgatgacttgcgcttaaacaccaactattctggaggttatcatccggaccatgagattatcgatatgttgtgggaggttctaaagagcttcagttcagataatcagaaaaagtttctcaagtttgtgactggatgttctcgcgggccactccttggatttgagtaccttgatcctaaattctgcattcagagagctggtgtccccggcttggaggaacatggagaccgtttgcccacctcggctacttgcatgaaccttcttaagctccctccttacagaaccaaggagcagttgcaaaccaaactgttgtatgcaataaactctgaagccggtttcgatctgagctaattgcattgtggattcgaacattgtgcacagtgtagatagttgctagataacagcttaaaggcaaaccaagaccagagcacctacgatttgggcccaatttgaagcccaacaaacaaagggcagacatcttagggtggctgggggaatcagaggcggcgcctgcaacagctcagcagccatgacaaggctgaccggcggagagtggtaaaggcaagctagcgcagatgctgttgtaagcagccatgaacatgtacatatgtattagtcgttgtgattgaatggccgcttgtggaataatataagggatgaaagaaattggtagttcggagttcgtcaaaaaaaaaaaaaaaagtcgacgcggccg

SEQ ID NO: 33033 - DNA, 696 bp, Triticum aestivum
  unsure (1)..(696): unsure at all n locations
  Clone ID: PAT_TA_33033
ttcaccaacatgggcgctgttgcacaggcggcagccatgcttggctacgaggtgatcgtcggcgaggcggagcagcactcggacctgcccgcctttgcgcggctggtgaactcgtgcgacgtgctggtgngcgtgcacggtgctgggctcaccaacctggtgttcctcccgccgggggctgtggtggtgcaggtggtgccgctgggcgggctggaggccatggcgagggacgacttcggggagccggctggagacatggggctcggttacgtgcagtacggccgctccgacggggagagcaactggcggagctgtacccacgtgaccaccgtgtgctgagggacctggcgctccggtcggagtacctggtcggccagaacgtcacgctcgatgtcgctcggttcagtggcgccttgtcccgtgctctggagcttcttcaccattagaagacactccacagggcgtagattgtttacaagataattagtcaagtgttttactactgcagtaaaataaagggtctggctaaatcatgtgtgagctgttggatcgctgtcacacggtcagaaggcaaattcgaaggctaatctagggactaaactctctcactcaactaaggattagcaattccataagatatagtgaaacataacacaaattggaacaaccaaggttgaatcaggtatctcttcagat

SEQ ID NO: 33034 - DNA, 1177 bp, Triticum aestivum
  unsure (1)..(1177): unsure at all n locations
  Clone ID: PAT_TA_33034
tcgacccacgcgtccgcccacgcgtcccaaaagctggcgtgtttgttgcccaagctgcaggaaatggaggaccatttcctaaaacgctggtgtcattcagcccatggattaccactgttgccgctggagttgatgaccgcagatacaagaatcatttgatactaggaaatggaaagcgtattgctggacttggagtatcacctgcaacacatggaaataaatcgtttggcctgatttctgctactgatgctctgctgggttcatcttcaaccaagtacagtgcactagattgtcaaagaccagaactcttaaataagaggaaagttcaggggaaaattctattgtgcggctattcttttaattatatttctgggacggcttcaatcaagaaagtgtctcaaacagccaagagtctaggtgcagctggctttgttgttgctgtagaagatagttacccagggacaaagtttgatcctgtgcctgtcaatattcctgggattctcatcacagatgtcagcaaaacaaaggatcttatagactactacaactcttctacaacgagagactgggctggacgggcaacagcgttccaagcaacagtcggtattgcagatggcttggcaccaacactgttcaattcagctccccaggttgcgttgttctcttcccgggggcctgatgtaaaagattttagcttccaagatgctgatgttctcaaacctgatatactcgctcctggcaatctcatatggtccgcatgggcacctaatggaacagatgaagcaaactacgctggggaaggatttgcaatgatgtctggaactagcatggctgcaccacatattgctggcattgcagcactaataaaacagaagtatcccaagtggagcccgtcagcaataaagtccgccttgatgactactgccaatacgatcgacaaagggagccatcctctcagagcgcagcaatactccacgtcagaaatgatgacacttgcacgggccacaccatttgattatggcagtggcgcggttaacccaaaagtgccctgggatcctgggctantctagatgcaactccaccaagattacatcacatttctttggctccatccctgacgttgattccaagcgaaagtatccaaacataaccggtcaagctgcggtcccggcccaan

SEQ ID NO: 33035 - DNA, 1125 bp, Triticum aestivum
  unsure (1)..(1125): unsure at all n locations
  Clone ID: PAT_TA_33035
gggcctcgcgcgccgtccccacgtcgttgtggccacccccggccgcatcgccacgctcatcaagaacgaccctgacctcgccaaagtcttcgcccgcaccaagtttcttgtgttggatgaggcagatagagttgtagattccaatttcgaggaggacctcaaggtgatatttgattgtttgccaaagaagcggcaaacatttctattttctgccacaatgtcggataatctgagatctttgcttgaactttcgggaagcaagtcgtacttttttgaggcatacgaagggttcaagactgttgagaacttaaagcaacagtatatccatatacctccggatggaaaagagctccatcttctgtatctcctgtcaaaaatgaaggaagataatatacgttcagccattgtatttgtttcaacttgcaggacatgccaatatttggactttgtgttgcaagagctgggtcgacctgctgtttctttgcactctcacaaggctcagtcacaaaggctttcagcgttgcatcgttttaagtctggtcaggtccctgtgttgatcgctaccgatgtggccagtcgtgggttggatatccaaactgttgatcttgttatcaactatgacattccaaggtttccacgtgattatatccatagggttgggcgaactgcaagagctaccaggggagggctctcaatatgctttgtgacccagagggatatatgtctcctacatgagatagaagatgacgtggggaatcgattcagtgcatatgagtgcgacgacaaagaagtcaccaaagatattacaaaggtattcaaagcgaggcgtctcgcaaacatgaggatggcggacgagggccacgaagacaaggtccaagacaggaaagaccagaagaagagagaccaggcgaagaaagcgcaaacacgacgagtgaagtgaacctggctagagatggctcacgcgtaccggccggctttgtggacgtgctgctccctcgtcccgcgcaccggccccacacctcccgcctacgcaccctgtctgcctcattatccaggtgaatttttgtactgtagtagctaattcatgttgtaaatcacaatatcagttatgcaatcgtaaaatna

SEQ ID NO: 33036 - DNA, 1039 bp, Triticum aestivum
  Clone ID: PAT_TA_33036
cttaggatagaattttataatttctcaatcttaacatctaaattataccaattccatgaccaatcttatttttccctcgcttatgaggacttcttagcgggaccagcgttacccagagcagtagcatcgtggaattgtcttgcgccctccttgacagactgccagatggagcgagcagcaggaggagttccctgggcactgacgaaagagtcaactcgggcgctcagctgaaagaacgagtgctgaacgtgggtgctctgagtgtaacgagcgcggaggaatgcggtgtacaggacaatcaggatccaagatcgacgctggaagagaatggccgaaaggaaaatacggccccatagagaaatctcaagagaagcaacaatggccattgaggcatcgtagtactccttcacgaaagcgccaatcttgttagcaatagggtggtcgacgctggttcggcggctaggagtagcaccatcagcctcgggcgcaggcctgggagcgacgacagcggggatgaggttggcgcgagtgtaggtggcaacgtggaagaccgagtaaatggtgtaagggatcaaggcgaggggatactgagggcagaacagccaaacaagagacatggcaaggtattggatgttctcatcggcaagcatagccaagggagtgggagcagcacgctgtccgctcttagcgcgagcgcgcatagtcttgtagacgacaatgccataggtgacagcggcggcgataaaggctgtgcggtaagagaatttggccatgccggtgtagtagttcattctcagccaggaaaagccatatcgaatcgtagcgaggataagggtgaggtgtccgacaaaccaaccgaactgaagggtttgggcaagggccataagcctctcctggagaggaagattggggtttggcggaggagccatgttggcgaatgtatgtattgagtcgtagagatgcgtaaagcttggtgcttgagaatcggacgagcgggggttggtgaagagggaagaaagaagaccccgaaccggccggc

SEQ ID NO: 33037 - DNA, 1344 bp, Triticum aestivum
  Clone ID: PAT_TA_33037
ttgtgctacttgcgtggtcgcggcggaggtaccaccatctcacttccaacttcatctatagctagacaacaaccatttacatttcttagccgcacacgcaaagatataatgaaatatcatgtattccatcagtgctacatacagtagggtacgggtggtaccaccaccttacttaaactacagctaaactataatcatttacatttcttaggtggtttaatataaagtatggcatggatacccaagcgcctcaagacgcagaatcgcaggcgctccctcttatatcaacaaactcacaaaccttcgcaaaacttgtcctcagtcagaccagtgaggtccattaacttctatgaaactcctaaccacgagggccatgtcagccagagttccgccaaagttttctccaacttctgcaacctctcatgctttgtcttgatggtatttgtgagaacggggttgagcgggggccggaagtactgatcggttcggctgtcctgagggcaggttatctagaagtgtcctgtgcagtcttgctagtctttttgactgtgactcttagcagtggaaggacagttgcagcagcacggagcagagccgctgcgataactttagacaccttttgctggcttggcagcatgttcaccaggaggtgtcgggcgccgtcttgttagtctcgtcttcagagccaattgtcagcagttgaggaacaggtggagctttactgagcatttgctcatggatctcgtcaattacactttggcgttctggggagccgaattttggtggtgtttcacgtgatttgatggcaagcgctcgtctatcttcctttttgtagtccagtgaacccaatgccccaccaggatttgttggcatgaaagcaatcaatgctactagtgctgtgcgtacactccatgatggctgccagtgttcggggtggtaatttgatatgctcaaacatatcttcttctgaatctcgaatcttccacttggcgtgagcagcatgaaggatggcggcttgaacgggtagtctgagggcaactggatcctcccgtggtagattcctccctcaaattcgctgtctcgaggccccaggatagcaaattgccactcaaaaatgtcctcctcgaggggcaaggccatgaaatcgggggaaggattagactgcatctccttcacctcctgcaggatccgcttcaccgccgggttactccggttgaacttgcctgcggccgccatcgcctccgccccaggaaacctgtagactcgccgccgccgcttaccggggcaaggatgcgccttcgaattgtgaattgtagggaggagagagagaggggggactggaag

SEQ ID NO: 33038 - DNA, 1269 bp, Triticum aestivum
  unsure (1)..(1269): unsure at all n locations
  Clone ID: PAT_TA_33038
ttcggcacgaggctgaaatggaagacgatgacaagcggcaagnaaggttttgcagctgatgaggataactggagtgactgagaacttctgagttttttgagggagaggacttatgagttgatcacgtgtatatatacaaggttactaacaatattgacacaagtgatgccgaaataaagtcagggttcttgttaggtattacatgaacaagtaattacttgtgtttgcctactactccctccgtccgaaaatacttgtcatcaaaatagataaaaatgaatgtatctagaactaaaatacgtctagatacatctccttttatccattttgatgacaagtatttccggacggagggagtactttgcgaggatgctgcactttaggaggtcgacattttttatcttatcaaaagataagtgctgacagaacggtccactgtgagagcatatttaaacctacaacgtcttaacatcttctttgccctcgattcacaggcacgtcatcgattgtttccttcaaaaccccgtgttttctttctaaccagagtcatctgcagcctgccgccgctgctgctggctgggagccactgccgacgttcgccgaggccgcgttgttcgaaagggcctctgccccctggcccttgttgatggaggcctcggcgtccttgccgggaagtggcacggcgtcggagctcttggaggcgtgccggttgctcctgaaccgggtcctcagcttgctgaaggggcgccagtgccaccggttctgcgactttatttgacccatcagcttctgctgctccctccggacgatcctccgggtgtaccaggctccgccacgccaccccagggcgtacccaacaaccgtagttgtcaatgcagtggctatacaagctgaagtgctaatattataggaggtaacaatctttttgatctcatcatgttcaactttgtgggtgttcctcaaagattcctcaatggaatggagcctcttgtcaatctttgtttgctgcatatgacgaagagaataaccggcccaggccgtgaggacggaggcgatggaggtgccgacggtgaagacgacgcggtggctctcgaacacttccttggtggagaagaaggtgtcgcggacggcggaccaggagttggtcgcccgccgccgcacgctcggcagcgacagcaccgcgcggcccgcgccggccagccgccgagccgccatctcggtgccctctgctcgctcggtgggatattttttctggagcggacgcgtggg

SEQ ID NO: 33039 - DNA, 714 bp, Triticum aestivum
  Clone ID: PAT_TA_33039
aactagaaacaggaattcattacttggccatggcctgccttctgaaactacatctgggttctactacacatttacacaatgtccacaaacgactggtgcacagacctgagatggccataacactcctcgctgctcctgaagttctccaagcatacccaacaaatgtggctgccgcacctgcactcaacatggttgcagccatcagatttctcaattgtgtatccacaggaagggcagctcttcacattcgccttccctttgcgccattcaagcagcgtcaagtctgggtcttccttgtattctttgtaagcttcgcatgatatgaaaggatgatactcaaaatgacacttggtgcatatctccacatagcaagccccacaagaaaaaggtttggtttctgcatctggagctgccacttggtagatggattggcaatcaggtgttgggcagaagcggtacattcctgctctagatgcaacaaatgccctcaaggaagctctgaataggtcctccagcttctcatttgacaagagatgcttcaggtctacaacaaggagaggctccttgcacccagttttcaggcaacaaatagggaacccatcatgtgatttcatggcagattcacactgatccaccagacaagccagacaaaacatgtgcccacatgattcaagcctaaaaggatcttctatctcacacaagcaaatagggcat

SEQ ID NO: 33040 - DNA, 692 bp, Triticum aestivum
  unsure (1)..(692): unsure at all n locations
  Clone ID: PAT_TA_33040
tttttttttaatntaaaaattgatacctttaacattttccatactacacggagcttgtcatacatgggggtcctccggttactacagtgcaacgttgcatacgcaacaaaatgctgcatcaaatggccggactagtatctatgcacaacacaaaaacgtaaaaacaataaaaatatgatgcaaacatgctcctagatggctaacaaaattgctaccccatcaaaggcattcttattatacggaggaataatataagatagttgaagtagtcatcatcggaaacgaagatcgaagacataagcggaggatatttgtgatcttatcattctttatggaggagtgatggagattccgttggtgtcaactcacctccactctctctctctctgtgagattataattttctcatgccatgcaaccattaacgagtatgtgatttttctggaatgaaaatttaaatgggccaaaagcccacagactttcagcagttacaaggatattccgtacatgccggacagttggggtcgcccattccgtttgtcgatctcgcacttggacgcgccaacgctccagacggcgccatggtgatgagcaaaatgacctcgaatataacaagcagaagaaccatgttcatgtggcacccccaagccatggcaaaatgaatattgttgcactcaccgctctggcacgag

SEQ ID NO: 33041 - DNA, 689 bp, Triticum aestivum
  unsure (1)..(689): unsure at all n locations
  Clone ID: PAT_TA_33041
acngtatggaagattataggggccttttttttttttttttttcggggaacaatgttcatgagctttatttctttcattgacttgaaccggcatgcagtaccaggtccaattaagcccacgacacataggccatggggagaactgcgatgcttggcattgcactacatgttctcactaagagtcgtcgcttttcatcacccttgtttggtatatcctcaaatgccctagacccattttaccccgaaacgccttgaaaaacattctctatcaacgagacatttaagcctgctggtcgctgaggatgtcggagtcaccagcgtcgagaatggccatggtggagcatcggaagagcttaccgcatgcggtaccgagctcgatgttgttgccagagaagtggtggatgggggccttggacaacatgctgtagtactcaagctcagacttgcggagaggaggagtgtttccagcaatgatgatgagcttggccttgccggatcggaggctcttgagggtagacttgtaaccaagagtgacctttccggacttcataacaagcgccaacttggagttgatgctgttggcatccttcttgctcttcttctggggggccattttgactgattgggcgactggttggcggcgacttgtcgtttggtgatggattgccggacccggccggcccggccggc

SEQ ID NO: 33042 - DNA, 1553 bp, Triticum aestivum
  Clone ID: PAT_TA_33042
acaaaagcaatactttatttttcgtttaacttttgccggtagcttacaatctttgtgtacaactgcacatactaagtttttgagttttccaaaaagaaggcaaagagttggccaaactaggagtttgacacttaacagctatgcatccttattgctaacaaacacttatacagtataatttcccaaacaaaaatattacttatggtaaatacatattgcatgtactgtagtttcaccacttgtacgcggaaaatctctccatcctctgctgttcagtcaaggaggctgtttacccggtcgccgccttcctctgcatatcctttctgcacttggtactgagaaaactgaagctattgtcaatctcatcaatacactgagcatctctctatatctcgtatgtcattcccacacgcagcagcctgttatgtggaacacatgtgatcttctctggttgcctgaagttcttcctcatgaaattgtaggcgtagtcaactattattttcttcaccaaaccggcattttgctccgccaccacgttagtttctcccagtagatggacaacaccatcatccatccctctctgaataaactctatctcatccattaacccgttcactgggctagcagtgattccatctaaaaaccttttcggcaaccttgcatcttgaacttcaacagaaggctccattgcatctcctgattcttcgaatgcattatcttctccttcaagggaatgactactttcgctgtagagtgattcttgatggatgaattgcttcaagttcccaataagcaagttctcgaactctcttggatcttctactttattgttgtaaccatagcgcaccacacatcggaataccctgtattctcttggctccacgtatcggaagaggaaccgctcatttgtttctatattgctgattggtaagtactttattgaggtaatcacaagaactgaatggatggaaggtactttttctaccaaatggggcagtatgggtgggattccttgcacaagctcagagtacagaacgcctattcctggcaacctagcaagatttctccttgttgccaactctgccacatagttgtttgacactttgttcttgagctcgtatttgtaccgatgaacatgaacatagtgccatgtgcccattataagcatcaaaattgctgcaaaacctagtggcaagtagccaccttctacaaatttgtagaatgctgaggataagtacacgagctctgcgccgccaaatattattggaaagagtgcaatccacagcagacttgtcttccatatcatggccattaccagtgtgactagaagtgttgttatgaacatcacaaagacgacagcgataccatatgcattgccaatcttgtctgtagtttggaaaatagctgtcacagctacacataagatcattaatgcatagttgatctcagggatgtagacctgcccatgatacttttttgaggtgtgagtgacacgaacccgtggaaagcaaccaagaacttgggactgagcaatgattgcaaaggcaccagaa

SEQ ID NO: 33043 - DNA, 667 bp, Triticum aestivum
  Clone ID: PAT_TA_33043
cgacgttggtaactctgctctattttttaagcactgtgagatgaagtacatgatgcattggggtgatgtttgtgttggttgctgatcatcgtctttgtcccttgcttgggtaggaatccaagatcaagaaccaacatcgtcaactacaaaagcaaccacacatgcacacattattgatgactagcgtgtttcacaaaacccaacagagatgcccagctctccgtgtgaggcatagtttgtcccgatttggctgatattgtatatgctggacagatgtggtggcacacgatcaacagcgcattgcgcctcatcgacgaagccatgcattatcagagtaacggtggcacatggtgaaagaatttaggccgataaagggttgatgcagggatggaataaagcattctcgaggattataatcgcgtgaggtgtctcggagcgggaggctcaaattccaacgctgccatgtgtagtggtaattggaataaaggactgtttggttcagacatttgagagtaaatcatcggtggtaatcacagttggtcgttacttgtagagtcgttgatgtcgttttcgctgctgtagagtcaaataccgggaataggcgcctgtttatgtccgtacatcgcacaactggtgggttggcaaccttttaagatcacacaggcac

SEQ ID NO: 33044 - DNA, 725 bp, Triticum aestivum
  Clone ID: PAT_TA_33044
cgcgagacgggctaaactataatttacggatgggccatacatgagcggaaatggtaggccagccatcactgtcgacatacatgggcatactgtgcaaaagcgaggggccccatctgctgggtgatctggtcgacattgttacggtgaccgaaccagtagcagtctaggcccatcttcacaccgtccttggattcatggctatcctcgacggctagcggcttcggcgtgtctgtcagaaaccgctcccagaacagatcgttcgccacggcctgttcatgtggagtctcggcctcggcgttcgtctcgtcctgcgaagtgtctgtggtgctggcctcggagctcatgtcgacttcggccgttgtattgcgcttgtcttcttgaatttctgggaatagtagcattggactctggacagcataacccggaggctctgctagctccggtgaagttggctgaagatctactccggtctccactggtgcttcctgcagacctgcatgagccggatcatcagtgctgggtgcagcagaagcagaagcagtagcagcgctgaacatgtcttcagagggcgcatagttgcccgccctctggacgagcttctccatggagaccagggccagctccatcttctcaaaaggctcggcgttcaccatgaccatgcccggcgtctcaccaccagtcgcccgcagatgctcctcggccgccgcggcgggcggacgcgtggg

SEQ ID NO: 33045 - DNA, 936 bp, Triticum aestivum
  Clone ID: PAT_TA_33045
ggccatccttaaggggaatttattattatcctgtttttgtaagaaactcaattatccaacgtccaatattgtctaaactcaaggttgccaaacggcttcgatgatactcatcctacacccttccgaccttgttacacccttaaaaacgaatcgctcgtcagcagccttgaaaagctcctcaaactccttttctgttcgctcttgggagtttaaaagagtcaacatcagtagatccatgctccgcataagcttctcatcccagttattctcaaccccaggctcgcggagacagtggtcattgatgagtatgcgggccccaggtttgagagccggtataagattcttcaaaattgttacagcataatgcgaagctaggttgtgaaatatccacctaaagtagaacacatcagcgccccggacaggctgttccgtgaagaagtcgtgagcctggagcgatatacgttggaccaccccttcatcttcgcatataggattcggggcactgctgacggtttttggcaaatcttgcacaacgaatttcatcttgctccatttcctagccaggtccacgcacacgaagccatggctcccgccgacatccacgaatgtcccctcattggcgttcacatcagaaaagtcgtagctgtcaacgaaatggccaacttcgtagccctctcctccagtgaggcttgccattgctaccgcgaatcgcttgcctcgtggagggtctttgccaaatgttgcaaacatgggctctttgtcaaccgttccccaagcatggttgaatccggtccgcgtgagcgaggtagcctttgggtcggcacgaagagcttccagagtgtgtgctcccgctggaaagaaatcttctccgttcaagcccacccaggcttgaagattggagtcttgagcaaggattttggaagcagcactgtgtgc

SEQ ID NO: 33046 - DNA, 1172 bp, Triticum aestivum
  Clone ID: PAT_TA_33046
gcagcttcatggactttgcttcagatcggttgtagagtcacaacgtacaagagctaaatagaactccaggtcgacacaaggcaaatttcattcatggcataaaaggggtctttgaccccaactgatctgatcatcatttttgccaactatttcttgaagcatatcatatactacatcatacccatggaaggaagcacacaatgcaccaaactcttcgctgcaaaatggggggtttcttctccctttgtcaccccggtagtgctcaggccttcttcccttccctaactagtcctgaaacttatactatactgatttcagtaaccacgaagctttactaactttacgatgacaacacaagtaaaaaatgtactcatgcatcccctggatgtctgtctgtcacggggagcagtctacaggtgcgactctgaaccccgacgtctgctcggacacctcctccctttttcgggggcggtccgcaaagagcatcaggagaaggccgaggacgaggcccgaggcgaggagcgccagccccgcggagacgaggctgaggtcgtgctccaggggcgggcagtactgcgaggcgatggagctgaatgtgtcgcgcacaaacttgcagtcctggaagttgagcatgggcggcgcgtagtggtgcagcgcgtagctcacgttcgccgctgtgacaagctggctgtagatctccgggtgtcacggtgcttgggccggagcacgcgtccgcgtcgggagcgttgcacgtgtagtcctgccatgctgtcgttgcattgtcaaatgtcacctccttagacaagcactgccgatcattcaggttttcatcgtagggagaacacaggtaaggcatgagctgcccaggatgcagatggcgctcttttcggttcgaaagagcggatatagccctgttgaccaacttcacgagctgcaccacgacttgtttactctggtacaaggttcggttggttgtactcgcgtccacacatggaaggatgttgctgagagcagtttctgctcgaggatggtctgcccattcgtccattgcctggcatgtatcctttgaagcactgctaactatcaaaagaatcccgataagaatgaagagagctgccactatgttccagcatatggtagcaaatggtaaactgtatatccggacgcgtggg

SEQ ID NO: 33047 - DNA, 754 bp, Triticum aestivum
  Clone ID: PAT_TA_33047
ctgtctttctttttttgtatctatcaaaggaagggtttatttcgatctattaagtatttcattgtgttttttaaggaggggtatgtattcgtttctgtagttcatgtaatttttaaatggaaggatagatttggatcatttgatgtagcaaaatttgttgtttaacatgagaaagagcccgatacattatttcaagtaattttatttaacatgataagcagcagttgggatccttaacaactggaaacattcaaggaattagaaactgcatcctcgaacagtttaggcaatgttggatgcctaggccgtggctggaatcccatcatttgattagccgggtgtggcgacgccttggtaaagctcagccaatcgcatggccacactcatggagcgcctcgggaacttctcagcgccatccgcggacacacgactcctcctgcgtatcccatgtccttcctccggaatgtgtcaacacagtcctcgaagattgtgtccaccagcatcttgtccatcattcggactgtcacccagctgggagcggttccatcatggccgacattcgcctcttcccctcgtcggggaggttgtcgaggtcgccgagcatgcttcttgtgccatggttgccgccgccgcacgaagagggaaactagggttctcggagaggggagacggcgagacggcgagtcggagagacgggcacgagagcagcggcagcgtcccccctcacggggattgggggtatcccggattcaag

SEQ ID NO: 33048 - DNA, 1544 bp, Triticum aestivum
  Clone ID: PAT_TA_33048
gttcctttcaaccagccgggaaccaaataactaacctgttattttttcatggaccacatccttctttaccccgagggcaaccgtaggagggaaagttcaaacagacgaaactgaattagttacaatgttactacaagctgtcctgaaccgtaccgaaacgggaggtattgtatgcggtggaacaaaaagaagggatcagtaggttcaatccaggcaggaaaaacaggacgcacacggggtgggcgctgtgcgcgacaacataaaacaaaataaattaggagacaacctgggtggaagaagaggtcggtaattacagctgctgagctctgctcctccattgcaagcacggaacccacttccattccttggctgtccactcccacgaaggtcacgtggggatttatatatccggcgaacacctcgtttcgtaaatgtgcatctggcaaggccccaatttgtgatgcatccgcttcagaaaggggcgggtatggatcatatcctccctggatctgttgtttttcctgtttctctggaccagagcgccggttgcctgtgcagatatgagggacaacgcgccggccaggaccgcatccgtcatcattcgtgtggatctgatgtggatttgggcccggatgcccggcagcttgagccgaggtaacggacaggtccccagcaggcaccgcaccagccaccaccctggcgtgcaccctagcattcgactcccggggttccttgttggcccgttttgacgcccaagtcaggtccaagcagggccgactgtcgaggccagctgcgtgcctcccacccaatgtgccccacctcaatggatggcatagtgacggagatgtgaaggtctctgccaccatttacagcttccaacatcgtgatacactgtgagctctcaacattttgtgcaggatcttgaccagtggcaatgaagatagctgatacaatgttgcttgcgtgggcattgaaacccccaagagctccagcaacagctgaaccagcaaggttcttgatcacgttcaactcgacgagtgactgaacgttggtcttgagaaccttctccacaacttcctctctgattattgcctcacaaaccacggacttaccacgcccctcaatccaatttacagcagctgatttcttgtcagaacaaaaattgcctgagatgctgacgacatccatatcagggaaatcctcctctaggtagtccagcacatgttgcacgcccttggagatcatgttcatccccatggcatcaccagtgctgcaggtgaacctcatgtacaggttcctccctgccaacgcgcatttgaccccctgcagccttccgaatctcgttgatctgctaaagaccacagacagagtgtcgaaattgtccgggttctccaagaacctcatgagctcggcggcgcggcgggcggttgggaacctggcgacgggggcgcggctcatcccgtcacggaacacgacgctggaggcaccgccagactcggcaatggccttgcatccacggttggtgctggcgaccggacgcgtgg

SEQ ID NO: 33049 - DNA, 1094 bp, Triticum aestivum
  Clone ID: PAT_TA_33049
tgcaatcatggataaactgcagcacaagtgaaccctgtccgccgaggggatacatcgtgaatttcacattttgaatggtaaacgatcataccggccagataagggcaatatggtgtgttcctctcatcctctgatttgctagcatacttctctgtatctactacagttcattctcaccccggccatgctgatgtaagcaggccatacggatactagaatttgaacagcttactgtgcacattcaacactagccggcacgtcaacgagactcttgtcgtggtcctgcggaaggtgccacttggctcagagctagcactgctatctgctttgcctgggctgtaatcatggcttagatgcttgaattgtgggcactgtgagatatttgcaaccttgtctagattatgcagctcattgtcttgtataccatgtaggaagtctgtataagcctgatctttgaatattaagaggctgcagggcattagtagaagtgacgaagaagcaggaccagcttccttcgtgccttcaaccttataggaaccattactctcctgcaactcatcagattgtgtattttggagatatgtatgttcgagctctcttagctttccatggggtgtgaaatcaagccggacgcgtgaagcaagggatatgatagcgacaacaggaaaataggcaggaccgtcttggtgtggcatgatcccttgattaggatgatactcattaatcagaacatgattgattgctgaaggaaataaaccagtccactggcagattctgtcagttatctttgtaagccatggaggtaatgcctgaggcagtagccccttctcgtgcaccactcctccccagttctggagccgccggtttttcaaaatcttccacttgggcgccggtgcctggtatatatggtggaggagctgggactgctcggtctgggagatgaagtcggggacgtataggacggtggggacggagccgacggcgtagtccccggggatcctcaggcacaactccggcgaagggttcccctccgccgccgctttctgggtcgccttttcctccattgctgcttcggccccgcgtgctcgtgctac

SEQ ID NO: 33050 - DNA, 565 bp, Triticum aestivum
  Clone ID: PAT_TA_33050
ctctttccccccccctcccacaccttttctgttccagtaatatgcatcagggcaccaaactagtgcccttctgtgccacatgtacacaatttattcactcctgtaccacatgcacacaatataatcactcctgtaccacatgtatacaatataatggcacttgtacttccattttactgtcacttatttatcattacaaactgctcaacttatcaatgttccaggtacattgatacagtctatagtataccatcaggacacaggctctccttcacaattcacaaccggaaatcagagatagcagttttcgcatctaacccgatggagtagtaatgtttgatgtaatctctgacgagggtctccctgtacaacggtggattctcatcggacagcagctccttgatcggaccatacattctcgtagaggcagggtggaaatgcgtgctgaagaagcacgcgattgagaaccttggcgtgggcgttcttcgccaccaccctatgctccacgctcctgaaccccgtcgttgggagatcagctgtaagagatcgcccgatgttcacgatg

SEQ ID NO: 33051 - DNA, 808 bp, Triticum aestivum
  Clone ID: PAT_TA_33051
tcctccacgcccgccttccctccgggggcgccggcttctacggcaactgctactacatcatgcgcgtctcctacacaagccaggcggccggctccaccacgcagagcgtgaccgtgaaccgtgtcgccgcgttgcaggaggggctgccctcggagttcgcgcggtggggcgccggcgagatggcgagcgtcgacccgtaccagatcacctccgactaccggacgctgttcgtctccgactggacgcggctgggcttcgccgaggtggactacgggtggggcccgcccgcccacgtcgtgccgctgacaaacctggactacatcggcacgtgcatcctcgtcaagccctgggtacacaagccaggcgcccggctcatcacgcagtgcgtgacgccggaccgtgtcgccgctttccacgacgccttggtggacaccaactaggctcaccactgtctccccacacttcgttcacgggttccctccttttttacaccatctcgttagtgtttaattacagcttggtgagcgaaagtaatggtaaaccgagcaagaataatggcgaacagatactgtagtagtgaagaaacgtataaagtggaagaagaatacgcgcagatatgggggacaggtagacacagctagtagatggtagtgggcaacggcgagattggtataggatgcctttgggtggtctcggtggcgttgcaggaagtgtatactaggtacatccttttcttcttctttctttttcttccttctctttttggggggttttgattgaaggatcgaagctgggcttggtgggaaac

SEQ ID NO: 33052 - DNA, 1206 bp, Triticum aestivum
  Clone ID: PAT_TA_33052
atgcttcaccttagtaaatttttattatgttttccaattatgaactccaacttattgcccaaaaattcagaagcatatacaccaccatagtgctcagaaatggtggtgcctataattctatagcatggaactacagttgcacacattaagctctacagaattattgtcttaagtacatagtctgctgcacctcctcacaagccaatcatccgtaaatcacccaatttctggcagttgttccgtctatgaccttcaatcccacaattcttgcaccttgctggtttacaaacaggcttcagggcatctccccggtccaggcatgtagtcctcttgtgcccctgctgccgacatatgctgcagaacattgtccgcttgctgagtccctcgtacggtgccttctcccggctggttgttgggcgccccatttctttccatttcttcggcgccaataaactagtgtgtctgttcccagtctcatttccagaagtagcatcatcattcactgcctcgatgcctgcacccccactcacagcagctgctgttggtggttgtattttttgtgtgcatgatctctctggtattgagtcagatgggctggcagcacatcacacgcatccctcgtccatcgcttcacaatgtgtttcggtggtgtctctgtaatacgaatgaaatccatcaccttcaaaacatggctacaaaggagtcccatgtgtgcaaattgcccacactcgcaatcgaattcctcacctccttcaagaacatttaccttatatgacaccctacaccacttttctctccttgcagcctctgtatgaatcacaagatacagtttccctttctcaagctcctcaacttggtatgcaccgcactcatagagtatatgtccaaactgctcgaacatagcacgtgtctatatcttaccagcatgtctttcaatagctaagtttgctttgtatagtgttctaccctgaaacgtagaggtcagcactacaaaactagtggcaattaccaaacgttgacttactattcgtgtccgcttctcctcgtagttctcctcagcttccctgtcaaactgtagtctcatgtatttttttgacaaacatatgcatcagacaaccaggtgggacatagctcttcagcatgtggtttgcactttcactgcattgggtgtttgtcatcttagcacagaaaacaccggacgcgtgg

SEQ ID NO: 33053 - DNA, 678 bp, Triticum aestivum
  Clone ID: PAT_TA_33053
ccagtaaatttaaatgtaatgagaaaacgagttacacaaccttagtgcaaaataataattaaatgaagaacaataatggaaagtccataataacacacaactctggtcggtttctagtcacttaggagtagttcttgttgatggaccggcacttgtgtctgatctccccattcttgctggtcttcacgtcgatgttgcccatcttcaccatggcttccccaaacttttgctcccagtccacagagaacttagcattttgcttcacggattcaattgtcttgggcgactcgagcgcggcatctgatttcaacaacacttcatggttaatcacgttcttgtagtattggttgtccaagtatccaggggtgtagatgtcctgatcgaccgtagggttgtcgcctctgctgcacttacttgtcaccaagttggccaacgtagagttcatggccgtggggtctgaagaagggttgggcggcaggcggtcacggaaggacgagcagtgggagatgccaacggagtgtgcgccggagagggtgaccatgtcgtcgaggctgaggcccttgtttgcgaacaaagcctcgagcatcatgatgttggcgaagggagggggcaggttagggagggtctcgctagcgagggacacattcccgtcgtacccacgcgtccgcggacgcgtgg

SEQ ID NO: 33054 - DNA, 343 bp, Triticum aestivum
  Clone ID: PAT_TA_33054
gcggctcacaatgtcatagcatagactggaacaaaatatacattgtgtatatataattactactattatccagtgctcacgatttatgttcacatagatacattgtagcaacaaatacctggtattgtggataatgaccactccattgccacaactatagaatacaccagactggccaaaagtgctccattgcctcaactgtagaatacatcggactggccaaaagttgtccatggccacaattatagaacacaccagactgaccaaaagatgcctgcatatggccaataactacagatatgctctcctggaccatggtttgctgtttcgcccggacgcgtgg

SEQ ID NO: 33055 - DNA, 647 bp, Triticum aestivum
  unsure (1)..(647): unsure at all n locations
  Clone ID: PAT_TA_33055
tatttattttggtttgtctttttttttttttttttaatttgtggtaattgtcttttttgttttttttgnacaagctatcagcaaagaagatgaaaaagatgtacatttgacttatggtcagcactgtgcaaccatggcggtataaaggcgcaaagtatatcaggcctgaaaatgtttattttcaaaaaggtttttatacatctccaaccgcgatgcgagagatgctaccacggcttcaggtcacccaccgggccagcagtccagttcagacgggcctggccgggcttcaagaagacatcttcgccatgcggaagcttgcgggcaagcccgttaagtatctgatggaacgcatctcctgcttgagctggctgggggaacagcatggcctgcttcatcgaagggtttgcgagaagcctttgcttcctcagtatgtcctctgttggaatggatgtcaggatgctgtccagcctcgggacgtcctcctcaggaacaaacacgccgatctcctcccatgggatggcatccgcgaagggcaggacgatgtcgtctgcgatgatcaccgggatgcagccgaaaaccacggcttccaccagtctggggctccatggtgcccagcccaatgggcacaggcagaaccggacgcgtgg

SEQ ID NO: 33056 - DNA, 1806 bp, Triticum aestivum
  Clone ID: PAT_TA_33056
cgctatggtatccacgccctcacataaaaccgtaaaagagcaaaagccttgcatcacttcatcgatcagcactaaaaaaacatggcaatataaatgaacatattttgtcaggcctgaaaatgcttagtatcaaaaaaaaaggttgaaaactcgaaccgtggtccgacagtgggcaccccggccgcaagtaagccgcaaggctataagtattcttaagactggaaaatgtttattttaaaaaaggtttttataccatcctcccaaccgcgatgcgcacgagatgctaccacggcttcaggtcacccgccggggcagccgtcgtagataaggcggacctcgccgggctacaagaagacatcttccgccttgcggaagcttgcgagccagcccgtttagttttctggatgaattccacccccggttgggcctgcctgggggaacagcatagcttgcttcatcgaaggggtttggcgggaagcttttgttccctcagtttttccttgtgccggatgggatgtcaggatgctgcccagcctcggaacatcctcctcgggaacaaccaccccaatctcctcccatgggatggcgtccgcgaatggcaggacgatgtcgtctgcgatgatcaccgggatgcagccgaaaaccacggcttccaccagcccggggctccatggagcccagcccaatgggcacaggcagaacacagacctctgcatatcttcatagtatgtcggtgggtgatcggttgagatgtcgaacagcgggttgttcttgaagttctcccagacagatgctccagcagctcctctggagtagtatccacccctcgggatcattggcccggtgtcgtagccaagaccacggacgaagacggagatgggtcgaggggtctctccgggattaaggtggttttgcatttgctgcggaggcgctagtggcgggattgtgacggacctctccttgacacggacatggttcccaagggtctgaaccagtacggcacgctgaagcaagggaaggattcctcgtccaattgctttctcttcctgataatggaagcaagcgccaaagtcatgtggtgtgacaaagaaatgatctgccccctccgatctattccagtaaggccatttcgtcgcgatcagctcgatcgcgctgcgcatcatccgcggagacttgaagggcaaggggagacccgaaggcgtgaggtcgcatgtcgggtacacgggtgtgtagaaccaatccgcttcctcgggattagtggtccgaaccgcgctcgacagcaggaaccggtgcatgaagatctccgcggcgaacatgtggttcaggcaccttgggtctttcttcagcagcttcttgttgtattttccagggaggtcatagataaacaccttgagcctcccaacagggtcatcgtccagcacatcaccagcactccctgagatcctctctgtctggtggccctgctgcgccggcgcctgctgggcctccgccgcaacaaacagcgccgccgccgccgcaagaaccgcaatggcaaccaagacccgcctcgccatcatcctctcgatccccacaaacctgcccctctctctgtccggctccgcccccttctgaaccgctaggcaatcgccaaggctagttaaagaagaagagaacggggggcagggaagaggcttttccggcaattccttgccccaccaagaagcgtttggtggcggcggaaggtgaggagggcctgtcctacgccgaggccgcgccttactacgacgagacctggttcgaggaaccctcgggcctgctccctcgtgc

SEQ ID NO: 33057 - DNA, 698 bp, Triticum aestivum
  Clone ID: PAT_TA_33057
tttttaggtcgttttgagcatcattatgacagctggtcccgctggacagggagacgtggcacgacataatgggtcacaaatagacagaatagaagggactacattgtaaaagggagaaagaggataaagtttttttattgaaaaaaaggactacattgtaaaagggagaaagaggataaagtttttttattgaaaaaaagggaggataaggttccatctcctctcaccgttgactatgccggctgggccttccctgctctggccggtggagctcgagctcgccggcatgcaagccagcagcaactctcctgtgccggctgggccacgagcttcgccgtgccccactccgagcagcacacctggagcatggccgccggcgccgctgctcgcgccaacgcgcggctggcgcgactactgctgcttgcgcccacgcgctgcctgtgtggctgctgctactctcgcagcggctgatgctgctcgcggccggcgccactgctcgcgcccacgcgctgcctgcgcggctgctgctgctcgcgtccggcgtcgctgctgcttgcggccgacgccggtgctgcatatggcgggtggacagggaggcgcacgacagagcttcgtcgccgcccgatgccatgccccgcatcgggctccgccgccccggcccggcgctggcgccggtgaaaggttcaccggacgcgtgg

SEQ ID NO: 33058 - DNA, 773 bp, Triticum aestivum
  Clone ID: PAT_TA_33058
gcaaacaaaccgaagcttgaatttatccaaaaaccgttaaaggtttaatgacaaattgaacaatgtgtatctcagaaaccatcaaatggttcagcccattacctacaacaaaccaacatacgaggaaaaacatgaagcagccccccagccaaaactgtttttcgatctactgccgcctcccgttccccattccatttttttaactagagcagcaacacccactcacactggcttacccatgggcgcggtcttttgcctgctagtagaacagtttgcagcacgttatttatgtttttgtgtgccctaggggcctactcaatggaagcagaggactaagttgcagagagggaataatgttcagtccccaatctgggtcaacatatcagtgaatccaccacgtaggagggaacttgcgcgaccgtggcccgattgcttgggtgccgaccggcggccacggctcaacttgggcctccggcagagtgaaccttcccatgtcaccacgcaggaagcattcttggtcctcgacgccacggtcgtcgtaaaagaaaatggacactccagtgcgaaacttgtcgtcgagatcctcaaaatcactggcattgaagatcctggagcaaccacgcccaatgaatatgagcttggcctgaaggaaaaactcatggtccgacttggagctgggattgggctcatgccagtagagacggggctccacggacgccgtgaggttcatgccagtggagacggggctcccggacgcgtgggcggacgcgtgg

SEQ ID NO: 33059 - DNA, 961 bp, Triticum aestivum
  Clone ID: PAT_TA_33059
tttttaaatcaaatttggtactttatctagcattcaatattagttaaaactaaatatcaccttgatgccattaaaatgaaaatgttgaatgctgtttcgcttatggcaaatcccttgatttttttctctgccataagaccaacaagaagatccaatttctctacatcatctccatatattgctcttatggcttcaattgcatccttgtcacttgtcagatcctcccaactttttattggaatcagaaatagtctcctcctgaactcattgtacctcggtacacttctctccctgtctcggtatacttctagggcagcaaggtcgattctgtcagatcgattggtaccatccaaattttgtggtataaggtccctgaagaaacttgggtagttccatagttcaagtgcaccacaagcttgatatcccattgataatgtttgtttttcaaaccctatttttgaaagctgatcttcccccttgagaccaaccaactctccaatatcgatatcttccaggtatggtggggaattatttgcagcgggttgcccggttggatccctgagcttgagagtggttggtattaaggaatgcattctgtaaacactggtaaactcttcagtcaaagaataaggtacgccatggttgatcggcttcttcaatcccacaagcccacctaatgccgttcctcctatgtgaccaaatgtatctttaaatttcttacccaataatccataccaatttgcgcgcattgcagctctcatggttttagtcttgagaagctcgacagtccaatcaatagtgtgaatctttgcaatgacagcagaagtgaccaatttggcataccgatataattcttcatctgataggttgggatgatcttcctttattgcatcacaaactgcattgtgttccttaacaaaaagagcttgtaagatcgaaaccccaacccaaccatgcgaac

SEQ ID NO: 33060 - DNA, 2106 bp, Triticum aestivum
  Clone ID: PAT_TA_33060
atgtgttttttttttcttttctttaagcgcagtgtaatctgtatgcattggcactcagatggatacccttatgcgtacaacttgtgtcatgcaataatgaatcctattacatatgttacactgacatatttaagtatatttatttacactgaacaaacacaataattttgtgaacaaatgatacttcatagaacttgccaaattgcatgcactacatatggcagggggccttttatttttgcactagtagtctgcatcccacacagagaaagcactagaggacctcatccagttggcagtaatttcagggtagtgccggttgatcacatctcgtaggccttcagttgttttgacccactgcatccccttcttggtgtatgttttctcattgaaattgcttgtaataaatcgatctgcttcgagcctccttgatgccattaaaatgaaaatgttgaatgctgtttcgcttatggcaaatcccttgatttttttctctgccataagaccaacaagaagatccaatttctctacatcatctccatatattgctcttatggcttcaattgcatccttgtcacttgtcagatcctcccaactttttattggaatcagaaatagtctcctcctgaactcattgtacctcggtacacttctctccctgtctcggtatacttctagggcagcaaggtcgattctgtcagatcgattggtaccatccaaattttgtggtataaggtccctgaagaaacttgggtagttccattgttctagtgcaccgcatgcttgataccccagtgatctcttgcagttcaaagactatgttccgccatggttgaccgcttcttgaaactcccacacccccacctttatacggttcctccttattgtggccaaatgtatccatttattttctcgatcccaatcatccattcccatttgcgcggattgcagctatcatggttttagtctttgaggaagttctgacagtcccaatcaatagtgtgaatctttgcaatgacagcagaagtgaccaatttggcataccgatataattcttcatctgatagtttgggatgttcttcctttattgcatcacaaactgcattgtgttccttaacaaaaagagcttgtaagatcgaaaccccaacccaaccgttgcgaacgtcgcccgataatggcacaccattctcctcatgcaaaagaagaccgtcatctccgatcactagttttccatcaacataagtcctggtcttttctacctgtttctcattattaccatatactgcactcccatcccaccaagctgtgcggacattattgtaaccagtctttattccatcagaatttgtaggctgttcttttgtggcgtagaacttgaacgatttgagggggcactcattggccacttcttttggagcagtgatttcaatctgtttggtatcctccatatgatccatccagtcatgaaccatgaactgtatccatgcagctgctagtatattgaactgcttccctgtgtccttgtattctcgcctggctaacagctttgtcgccacaacaaatggatctgggctcatcaactcatcctgttgatcaactggtttcatgtttctcccaaaaaaggtgtattggctaccagcctcagcattatgggggtcgttgtacttgccatctccggtgcggtacgggaactccttggggtcaaacagagtaccatgagaactcccaacagctagcaggttgtatttctcgaggagggtccggcgggtgtttaggtagagtaaaccgatcagaacaggcatcttgtgccacaagtttctcttgtcaaatgcatgaatgaatagaaagccaatcttgtcacccaaagacatcttagagaaaacatcacggaggtccggatgaacacgaggcttgaagagacctgaacccatggctctttggtagaaggaaaacctggagatgtgctgagctctcagaaatccccgcacggctcaacccatgctgggtgcacgccgctatatatcgatcgattcaaggttggctggacgtatacgactgcaatattaatactattgatgaaacacaagaattggaggcgaccaattc

SEQ ID NO: 33061 - DNA, 638 bp, Triticum aestivum
  Clone ID: PAT_TA_33061
tttttttttttttttttttttttttcttcttttgtttttttagcttgcaaacgagtccattcgtgcagtaccatcggttggacaggctcaaacgagcatgcaccaccagtttttacatcttcagcatcatcaaacccatgtatatacactttggctggagtacacacaacacgcgcgcaccacacagactcttctacgtactactcttcgtcttcaaatcaccatgaaccttaccttacaggcacggctaaagtagtagctaaacaaagcaggcagagcaccagcagcacgtatcattcatacgtattgatcacatgccgccgatgcaggagaagatcctggcgctccggccccggcgcatcgccccgcgggccggccactcgggcgccgcggagcccacctcgccggccagctcctccagcgaccggtgccgccggtgccccgcctccctccccgcgccgtccgccgccgcccactgctgcttctgctgctcccagacgtcgtcctcgtccgcgacggcggcgccgcgcgccgagccgcacctggagtagctccgggtgcgccgctccttgatggccttgtagacgaacgggatgagcccctccattactgattagatggttggctcggacgcgtgg

SEQ ID NO: 33062 - DNA, 368 bp, Triticum aestivum
  Clone ID: PAT_TA_33062
cgggtcgaccgggggagagttgtacagccaaatcccaactgcaggccttcgtacactattaatcttcaaccagaggttatctcgtacgatcaatggaaagatcttaaggcagatacaaaaggtggactttcgacatggattaaaggtgcatttcatggaaacaaaagcgacatccaagattcattactccaaaatctgtattctattctcagcacgtcgcctatgtgggacaggctgcaactcacaggggacaaaaatgtccttggtgaattcatggaatttaaaagcaagaatgaagacattccaatcctgaaaaaagttaagaaattaaaagttaacccaattgtcaaccaaaaatcaactccttt

SEQ ID NO: 33063 - DNA, 841 bp, Triticum aestivum
  Clone ID: PAT_TA_33063
ggtcatcaaatgtaaggcacagagcctgatattattgctaaacttgcacattttggtgtcagttttttgatagcttggacatcaacttagcttcagcagcaatgcactggaaaagatagataattttcaaattgttgcaagcaaggccatacacatcaaactacaaaaaatagaaattaagaaggccacgccacagcatcatctgatttgttagaggtagacatgtaccaccaagccagcagcggcgacagcaaattgaccctctgattttctttctttcatgatattttctgctacattctggatctcgaggataaggtttccctggtgaatattgccattctccatatagctcttctccattttgagacaccgtttagctgcggcatgcaggtcaaaatgaagagcaacattgctattgaaaaacttcttgagataggcaatgtagtctctgaaatgaactataccgcaagtccaaggcagtagcctgtccggagaccatgcctccgccataagatcttcgaactcgatgatctccaatggcggcagttccttgataccatccatttcctccctttcatcctccatcttcttaatccacgccttcacagaatcgtagtcgtactgcctcatgaagagttgggggaagcccttctcctccgaatttggggtctcactgtgttccatcttctttggggaactagtatttcgtggagggatgggatcgggagcgggactggaaagcgacgacgaggcggcggacgaggaagagatctcccccggctgtagggcctcacggggttgcatttctttggggacctagggtttcgcggacgcgtgg

SEQ ID NO: 33064 - DNA, 994 bp, Triticum aestivum
  Clone ID: PAT_TA_33064
ttgtttgaatgccttccggcaagaaatggacaactagtctatttctctcacattttcagagtaacaccatcaacagtggcaggaccaagctgctccagcctaaacaattgactggtactgctggttaagcaatgcaaactactacgaaacgtaacttactgtcagcgcatcgtcaataacttataaccacatggcagagattagctttcttagctgaaatggatcactacttttgatatgtcagtttaccaaaagaaaagaagcacaggtccagttcttgcaggcaacgaaccaacagagtattggcaatcattcggcaattcccatccagccagcactaataccacttctactttcagataaccagagtcagacaggcaccaagtaaacagaaccatctacagttgctactagatgtacaatctaagaggaggtgaacttggtgacggccttggtgccctcggagacggcgtgcttggcgagctcgccggggaggacgaggcgtacggaggtctggatctcccgggaggtgatggtgggcttcttgttgtagcgggcgagcttggcggcctcgccggcgagcttctcgaagatgtcgttgatgaaggagttcatgatggacatggccttggaggagatgccgatgtcggggtgcacctgcttcagcaccttgaagatgtagatcttgtacgtctccacgctcttcttgctcttcttcttcgactttttgtcgccgccgccctccttgccggaagtcttgctcttgcccgccgccggcagccgcttctcggccctgggcttcttcccggccggcgccttctcggccttctccgtcgtggcctcctcctccgcgggcttcttcgccgccggcttcttctccgccgccttgggggccatcgctgcttctggagcggggaaaggggaagccgccgaagccggtgcggggccgtttgttggggaaaggttggagattcggacgcggggcggacgcggg

SEQ ID NO: 33065 - DNA, 1134 bp, Triticum aestivum
  Clone ID: PAT_TA_33065
cccgcccccgtttggaaaccccagtgctcaagttacataagtgatgatgagatgaatcaaaggctctatattgcacctagtttgtgcatgcttctttcttgctatctcaacatgttactgctacaagtctcctctcctccctggttactcatttattgcttctctctccaacatctggcttgagatgatggttgaacaactatcatgtacaatggcgtccgcacgcttcccatgcaaaaaaagaaaaaagggacgccgctcctctcctttttttttgtacctttctagcgacatatatatcatggatattaaatacagaacgaactatcagcaagaagaagaaagaaaaatctggcggcctcgctcgctccctcgcgcttttctccataaccttgtttcgagtatcagagctccacctcctggagatcctccccgaacccaccaccgctgttgaaccgattaagggacgagttgctgtgggagcggctgtgggaaggtctcacaccgggcatcattggcggggactgcatggtctgcccgtccggcgatctcgaggcggcggtgctgctcatctgctccgagtatgtcccgctccatgatgctgcccgtgaccacgcgtccgtggccgcttggcagggggggtcatgatgttgtccatgctcgggtgccgctgcatgcccggttgtatttgcattgggggcggcggggaggcgtagaacgaggactcaactgccggcgaggacgatggcccgtcctggtttgcggtttcgctgtgcgcgtcggctgctgtctcggtcggctgcattgaagcatctgcggctggagttgggacgaagaaactggcggcgggcagcttgttcaccgatggcatggctggtctgttgtatgatggccctccgaacgagtttccgccaccaccacccttgttgaatgtgtcgacgtatcttgatctaacacccgccctcccgcgtgctgagaactgattctggctaggtggcatcggcggcatccctgaaaccggctccgaaggatttggaggcttcgcttctgaaaatccattaggtgtataacctccgccgctggggggcccagtcgagttgttgtgatctggaacgccgttctggcctcgtgccg

SEQ ID NO: 33066 - DNA, 1104 bp, Triticum aestivum
  Clone ID: PAT_TA_33066
agcatcagcatggacgacggcctccaagatttaagtggtcaagtatgaatgacgatgcagcttgcagggtaccgacacccaaataagttcaggccagtccttgatgtgaagaagctaagggaggcggatcccgacccttatgacagccaaaattaggccgccactcgtctctctcctacacctgctcttcagatggccaacaacacttcgcgagcaatgactgctgtccagttaagagcaagaaagatcttgctgttacttgtcttttcaacagttcttctgtgtggaaggcactttgctcacactcaaatactacctctgaaacatggaagaaggaaaaggttactcttctgatcttgagaaaacagtttcagagaagctagcagatgtagaagattctctgaagaagttgaagcaggttctcttcaatttgctgttgtgctaggcatgaacagaatggcttcctcttcttgcgaaccacactgatgttgtcttctggtttctgctgcaatggttttttttactatggacaacgtttcttgaggctatgtctctgctataggtctccgcatttcgggggactaagtccgacgacgggagattctacatatattttctaaaagacatgtcacttggtcgaggccttgatcatggtgatatgtgtttattcgtccggtgactcagtagaacgataacctctgtgcacagtgatgtttcagtttctacattgatggtttcaagcataagaaggtttcaaaattaaatgagccttgtacaggactgataacaaattatgctttctgagtttcaagctactgaaagtaattgaagctttgccttcgctatgtaagaatggttgcatgtgttaattagtggtgcacattttttgagactgtccaaaattctattataaaatgcttatatgaaattgatgggtaaaaaagctctcctcgcgcttagtcctcctccgtgataacatagactcaaaattggaaaaaggacagagatacattgcactgctgggtttagagtgcacagtgggagcccaccccagctccacctcgctcctcctatgtgtgccctgcattgctcctccggggcgtt

SEQ ID NO: 33067 - DNA, 940 bp, Triticum aestivum
  Clone ID: PAT_TA_33067
ttttctagattcccttgttaattcatattgtgattctaacacacaaagatataattgttttgagcactggaatcaaatatgctagacgaactacagattccaggtccatcgagcaggctaccagatgataaacgatcgagcagactaccagatgataaacgacatgcttacgatctactaattggcttgttcatgatggaactgctcatctcatggaatagcagccttgatgctcttggcgtactcttctattcttctcagcccttcttcaggagaagcggcttcgcccaactgtctaacaatcgcactgccaataatcacaccatccgctccccagcccgcgatctgtttcgcatgctctggagttgatatgccaaagccaacagccacaggtttgtctgtaacctgcttgatctccttaagaagatgctcaacacgtaagtttacatttgagcgtgcacctgtaactccgacagcactcacaagataaacgaatccttctgaagcttttgtgatttccttcatcctctctgttggtgtggttggtgttgtaagtagcaccagctctatgttatgcatagttgcctcgctcctcaacaatgttgtctcctccaacggaagatcaggtacgacaagaccatgtacaccagcttgcttaatcttagccatgaagttccgcactccattctttagaatagggttgtaatatgtgaagagaactattggacaagagagctctggtataacctccgtgagcatcgccaagacagaaccgagtgtagtgcctttcttaagcgcacgggatgctgctgcctgaatgactggaccatcagctaatgggtccgagtagggcacgccgagctcgatcacgtctgagccgcaggagtctaggatcctcagcgcctttgatgtggtcgccggacgcgtgggcggacgcgtg

SEQ ID NO: 33068 - DNA, 1788 bp, Triticum aestivum
  Clone ID: PAT_TA_33068
cgccccataccagccccaactagaccaacctgcacaatgcttcaaagtacatgggccaaatgcaatccctaccagcttcaattgaacaaagataccaagtgcaaaagagtacatgcacgaattcggtaaatggtactagcttccaacactatatatacaatagatacggatataggtaacacgccgagcaaacaccgcgaggtgcatcaagagcagcttcggtcacaacagcgagcgagcacacgttccagcatatgccctgaggatggtcatgccttgtgcggccaaccatccaaccctttaaacacgacacggttgacctggatcttccagcgcaaggatctgtgctgcactttaggcatttgactgaagcagcatgtcacctagcgcctcggcatggtcgcccacgcgtcagcgccgctcctccgaccttgacctcacgaacctcctgcgagtcctgggcctctgaacctcctcgtctaggctatcctcatcctcatcatcgctgtcgtcgtcgtattggaggcctagcaagttctctccccacaggtagcggcgcctctgccttctcagggcccttgatgaccctcttggctcgtctcctgatctcagcggcccactgttcatcatatggaatagaaagaacgttgtcaacagagacaagcttcgctcacttggccccccgcctcccccccctgccccaccggcttcacgctcatctgcacttggcccaccctcaacggccccagccccagccgccccggtcccgcgcattgccgccccgttcgcccgctggttctccccgcgctcccgcgcgcgcccccggcgcggccccgcccgccgccggcccgggtccgcggcgccccccccgggcgtggcgtccgcccgcccggcaggtctacggagcgcaccataggtaccagaaaatgcgcatgcttcccgcgagcagcttcttggcttctcgtccaggtactgtctggcatctttgatgatctcccagcccttcacagcacccctacacagtgggcacatcaattcgttcgagttggatgcctcagctgactcgacttgcccagtcacttgtcccataagagcttccaatgttactggaccttgattatagttagttccttcttgttgtccagatacggctgcagggctacggatgacatgttcatgactgagattttcacggaattcaggtacatcgattaacagcctggggctccctctactgggaccgagatgggatctctgtgaagcattttggttacttgtatctccaggcaaggaagagcttggctgtgatgaactgtccatgcggttcactttcattttcctgaatctgtctaggcaatttgagtgtctgtagcttgtatcacatatgtaggatctgcatcctttgtcatgagaactgcacaacagaagtacagcattgtgaggatggtccatgcaaattggacaccgagcatcatcccattccttgtgcagtgcagccatctcggcatctgcgcttggcatcctgaacaacttcttctctggatttggcatcttggacatgctgttctgagctcaaccttgaagaacacccagacaggcaatccggctctccgaaaccttcgcggaaagcgctcaactcagacttcggcgccggtcctcaaatagtaaccgcccgtggctgcgggcggagacggcggtgggggctaggacggggccggcgacgcgggtgaggggccggcggcgaggctaggccacgccgcggcggccggattggattcggacgcgtgg

SEQ ID NO: 33069 - DNA, 1005 bp, Triticum aestivum
  Clone ID: PAT_TA_33069
caaacataaaaactgatagtacatatgcctgttgcttaactcagttactaataagatgagatcgatcattgaacttctaaacatattaattcataggagctcttatactctatttacagcaaacatatttctgcctgtctgatctccatcacaagtctgattcctgatgtccatcacgccatgtgacttgtatcccattagaacgaacacaacaaccaacacaactgaataggtccttcctggtagcctgcatgagcgtcaaggagccagccttaactgtagggacatatcaagaaaatttgaggcgttcaagcacgtgctcactgaaaccaaaccaaatattgccggcatcgggccgatgtccgtgcagggttcaactttaaactttgcagattgcaaaccgccccagctggttcccccctccctccaacgtgtaatctggtaaggaaaagtgcgacggcgtggggcgatggtagaatagatgaactccaattggatttagagtgtgatttgcgtgccaccaccaatccaacatattcctccacttgatagcctcaactaccgatgtcgcctccttacttcacattattgtggatgctcatcggacgcatcaatcatcctgtaatgcaaacccttgaatatgataaggggaaggcatagatggaccgaatcacgttctccttgttgggaatccagtaccggcccggccggccgctcggggatggaataaaacacgacatggagagatagaggaagaacatccttttaaagagtcgtatgtgtgggatagttggtcaggagtccatggcagttcatcctacagctgcggatgtgtaacatgtaaataccggttttacctatttccatcttgacctttggtgacaacttctgcttggttgtggaacctacacttgacagttgtgacaatatcacaatatgaaaattttgaatactgggatagaggaatgattcaacatgtctaagaaaatactactaatgagctcg

SEQ ID NO: 33070 - DNA, 1232 bp, Triticum aestivum
  Clone ID: PAT_TA_33070
cgtttttatggtgttctggagacacctttttattgctgcacgcacttttttgttgattcgcgctatttacagaacaaaaccgccccagtttgcctgcagcccgcgcaaaaccacgggagcgcagcagcctacccgatcctgccggctagctatacaggctgccggtcgcagaattcgtaggcggccctcggcaggtcgacatcggggccccgcacgatgtggtcctcggcgccccacaccatcttcccctcggcgccgggcacgctcacctggccggtctacaccgagttcggcttcccgacgtgcgtcaccgtgcgcttcaccgtgatcggctgggccagcaggatgacgacgagggacgggtagttcagctctgcctcggtggtggtcttgaggttggcgcaggtgaccgtgcggtgggcgatctcggtgacgccctcgtcgccgaggccgaggccgcagaggtaggggaggtagtcgtcggcgtggaggtcgtagactaggcccgggtcgaaggcgagcgcggggttgacgtagcccgcgcccatggcgtagaaggtggcgtggcggtactgctcgtccttgaggggcacgccggtgcggtccactgcgtccgacgtcgtcatgatcgccgatttgatcgccgccggtgaccagtccgggtgcagactcttgatgagtgcggcgatgccgctcaggtgcggcgtcgacatggacgtgccagactccacgaagaaagagaggccgacgcccccgtcggagaactccgtgtgcgactcgctcggcgcccacgccgcgagtatgttcatgccaggccccgtgatgtccggcttcaggatgcccgggctggccttgctcggacctcgggacgagaagaaagtaacggccggcgccggcagcgcgcccatgactgtgcccttgaacgcgatgctcgccgtcgggttggccgtggagttaatgtaggccgcgatcttggtcccggccggacgcctcaggtgcgtcgcagggaggacatgcgggtcggcgaaggtggtgtacccttcggctgctctgttcatgacgatcatgcccaagccgccgtacgcggacacggtctggccagcttcgatgcggccgtttaggcctctgctctcgcagagcaccaccttgtcgctcacctcggctccgcgcagcacgctgcaatcacggctagtgtcggagccgtcggcgccggggtacacgagcggaagcgg

SEQ ID NO: 33071 - DNA, 592 bp, Triticum aestivum
  Clone ID: PAT_TA_33071
aatgcaataacttgaagatataattactcatccatgagatttgacatggccaaacatataagcttctcctcaaagtactgtccagattgttgttctatcatccagaacttatgtacatgcaacttatcgcatttccctaattctagcctatgtagcaatgagttgtactttatgtattggagcccagcacaacaataaccaacaattgtagaagagtacctatgatgtattgtgatccagattctgatcatagggaaaaaaatcatacaaatacatgtacaaaatatgcagagatacatgatgttgttcgacgtgtagaagtagactaatattcgctcgtcgccttcagggaaaggcggcgaacaaggttgccataccagacctggccatcatctccacttctcttgcgaaaccacttttgcatttccttctgagaccaaactgactaagcctcttcaagtaatcgttctctcatcaggtaattgtccccagtgattataaaaatggtaagctattgattagcatatataatctctaaaaaggactaattaaaccaccacagacccgaagttggtcaaaccggacgcgtggg

SEQ ID NO: 33072 - DNA, 1379 bp, Triticum aestivum
  unsure (1)..(1379): unsure at all n locations
  Clone ID: PAT_TA_33072
ccacgcgtgcgagcccttgctcgtcgacgcgcgcccccagcgatcctcgcacatcaaccgcaaagcagcgcacgccatcgtatagtagaatataccgaactccactccagcccatgcaagacttgaagtccatcccagccctcgccgggcggctggtcggtgccgcggcccggcgggagatccggcgcgggcagggccgggcctgccgtcccggcgtggcctggccgggggggcccggtccgccgggggcgggcgggcagtgcccgcgctgccggtgcacgaccaccaagtcctgctactacaactacaacaacttcaagctgccgcgccacctccacaagagcagccgccggcactggaccaagaccggtgcccgcggcctccgccccgtccgcggcggcgggggcggcggcaagcgcaaccggccctcgccgtcggcgccgccgccgcccgcggccacggccaccgacggcgagcgccgcgcggccgccttcgtcctccgccccctccaaccggcgaagcgcgagcgcgaccccacgcgcccaacggaaaaggatacaccgacgacgacgacccacccccctccggccacgccgtcgtccaactccaactccaacgccgtctccttcgccaaccgcatgacgaactaccccttcgcggcaagccttgccacctccggcgccgatattcgccgaccaggccgccgcgctcgcgtccctcttcgcgccgcctcctccgccgcctctcccggtgttcagcttctcggcggagccgaagatggaggaggcgatcgggtcactgctgctccctgggcaggaaccggcgcaggagccagaggagcccacctgcacctccaccgtcgccgacatggcgccgttcatgtccctggaagcggggatgtcggagctccgggggacgcgtcgccggccgattactggaacggcggggctcggtgacgcgtcgccggccgactattggaacggctaccgttgcttgacggagttcctcatcgcgattgccttaattaccttgcagttaaatgcttcttaacgacgaccaacaggtagttggtaagctgtggagtatagtacacgtaatgctaccgaccaactgcctgctggttaagtactccatattgttttcgttcctatgttgacgtaggtactgccaggtcttgtaccgtacctctttgttcttgttgcatttctgtggctgcacatcacaggtttgtgtaagaaagctaaccattgtgtcgctacaaccgattcacattaccacttactcctctcattatattttttaagttcgcagtcgcctcccctttgcttgttgtaccccnaaatgggcaanttactgncttgtctaaacagaantagaaa

SEQ ID NO: 33073 - DNA, 1217 bp, Triticum aestivum
  unsure (1)..(1217): unsure at all n locations
  Clone ID: PAT_TA_33073
gcatggagaactctgaaccagcacatgccatagcaccatcgcaatttatatacacaagtagagagggactcctgatggacaatttaagtgctccaaccaagttaaaagacaagcaaaatcggctcgttttccgccatatagcaaggaagcaaccttgacatcagaagcagggcaacggaagggctctggcgtgatcagtcagtaggaagaagttgagtgtttgatttccaacaacgtcggagcgctcaatcgcggggctgcagccttgatatgtactcgtcatacagcttcgctgctccctccaaatcgccgagatcagcgcagcagtcggctatcgcgccgtaggcctcggtgcagccaggaatcctcgccggtctcctttgatagcgccagaaccttgttggtaccagctcattgcttctctgtactgtcccaacctttgcagtgatgcgcctaatccccgcgcaactttcttctcctcaaagcgatcccctatgctttctgcaagctccagagccgtcttgaactccactaccgccttatcaaggtcctgattcctcatataattcttcccatttttcaaagtttaccaccaactctcctgccctacctacagcggaaccgtaaaggtgcccgggggcgcgaaagggatttaagatctggctgccccgccctttcttaaaggcgcctgctatcaaagcctcgtctgaaggttgcttcatttcctgttcactttgatgtttcggtcctttcttntgcccgttgctaaataattccaccccacagcaagctccctattaagagcgaccagcaattgaaaatcgggcatattggccaaaagaattagttggttgacatgtctccgctgatgcctcaagaggcattatgagcatcgacattgttgaaagaacagcagttttcagcaggttagcatgcaccattttatggtgaccaggaaggattagctcgagcgcgcgcgtcagctgccacgcctcgccgtccctggcatccagccgcgcgaaatcgccgctgccgcgagcccgagtaaggggcagggagccgactcggagcgatccgccgcgtcggagaagcgtctgacgccagcgacgctgacgggtagaagaagagagggaccgggagggcgccgggaggggtggccggcgcggcggtggcctgccgcgccccggtaagaggccgccgcctgcatcgccgtctcc

SEQ ID NO: 33074 - DNA, 856 bp, Triticum aestivum
  Clone ID: PAT_TA_33074
accttggctgttaaagggctcaagaagtagtaagaaaaattatatctacttgaatacattgcaacatccagtctattggtacacatgtttgtaagtgtgttttctaatgcacatgcttctgccaaggcaagcctgctctgtagcataactacacgttctcactatatcatgacctcaaggggggtaatggttacagtgtcgtaagatcaacgaaaaggggcaaaaatgttagtgcctgttagaacatcttcctggatccagtgtcatggtgcacaaggaatgaccgccatggcttcgtcgtgaaccatatgaatgatgccggttcgccatcaatatgataatatgtacacgattcaccaaatcctcaccaccagtctgggacttttaatctcctactcctgtgaatcgcaagattaactgcggggattttgtgcctcacctgccgccatatcaagtccaccgcatcatccttcctggggggatactggaattcatagtgactagagacgtttttcagctttgaccacatctcaacccacttctctttaggcatctgtctgagctggttgagcaagtaatcaggttctagagcctcttcaactgagaagaaaagtgagaactcgctgtaatcaatctcatcctcaaaagggagctcgatcctgctgctgataatcacaggaatgcaatgactaacaatggcatcaaacagccggcatgacgaaggagtatccccggcaggatggaggcaaaactttgatgatcgcatgccatctgtagagattttaatcggacgcgtggtggcaagatattttcaaagcgcacaccatctttgccctttaataacttcgcgagtttt

SEQ ID NO: 33075 - DNA, 737 bp, Triticum aestivum
  Clone ID: PAT_TA_33075
gaacaactcgtcccccctatcccctcgtccgacggcgccgtgccggcggcgcgatcggaggccggagctcctcccgtccagatctccgtccccctcctcctctccgtctcttggagtgtgaacccaactacccgaaggcgcccttcctccgccgcattccgatctgatggccggatctcgcaactgggcggatctaccggacgggccgacggcgctcatcgccgaccgcgtcctcgcctacgacgtcgccgactacgtccgtttccgcgccgtgtgcctcccgtggcgtcgatgctcagcggacccgcgcgcgcacggcagcctcgaccgccggttccatccccggcggtgggcgcgtccgccgggaggagctcgcggcgcccaaccgccgctccttcctgaacacctccaccggcgagtgcgtccaggtggacctcccggagctccatgaccactgcgtgctcgccctcacctccgagggcctcctcgttctggtccaccacaagccgcagcgcaacaccgtccgcctgctcaacccgttcaccggccacctcacggaactcccgccgctcaccacgctgctatctccacacgaccagcacatgcgtatggatctgattggggcggtgcgcggaggtcgtaccgtgaggcggccggtgctcgggttgtgcaggcggacggtgttgcgctgcggcaggcggtggtccaggacgtggcggccctcggtggtgtgggcg

SEQ ID NO: 33076 - DNA, 722 bp, Triticum aestivum
  Clone ID: PAT_TA_33076
tcgacgaaaccacatgacattaatgacagcagcccaaaataagtgactcaactttacactaactttatacatataaatttagcaaataaagctacctatgctagtagaagtagaaccctatccaacagaactctgcccagccttcacatattccaacaaccgaaaccattgcaaacagaaaagttgcacttcttgtgaaatcctgggcgccgaaatatgcaggcacatttgagttcagaggcaggaaaaaggatcatcagaagacaaatctgagccctctttgaggctccaagaactacctccaataggatagctactgatctcgaatcgcattttgcagtctgtattagcccaattagcagaactaagaccactcagtttggcagtcaccacttgcttctcagcataagttacgtcttgtttcattttgatgaacaacctctccagctttggtgcattctccacgatgaacaagagaaaatcaaactcgttattatcccttgtagttcacagaaagacaagagtctcaaggtgcgactggacacactcaataggacctgtctcctgccagaacttgagactacggctgctggtggtttcaagagaagactgcaatttcggtaagcaaacagtttagctgcacacggtgctgaattgctgattatgcagcagcgatctgattcaatgtactgatgatgctccaaatgcgaaacggacgctgg

SEQ ID NO: 33077 - DNA, 1316 bp, Triticum aestivum
  unsure (1)..(1316): unsure at all n locations
  Clone ID: PAT_TA_33077
nnnnnacagcttcaatcaaactggaataagcatgagaacacaacaaccaacccactgggaagttttcttccatttttccttctcgagtcgtctacaattttaatatcacaggtcacatacatgtttgacacacaacagcaacaacaaaataaatcaggtgtatgcataggcctggctagcaacccaaacaactgacattgaaggcagacattggcgtctcctgaagttcagtctagccagaaaggttctggcatccgacatcttcctgacgaacttcgtaagccggttccagttgtgtgactcgaacaggctcttgttcatcctgacatagttgaaggagaaagacgcgcccgaggtgccgcccgagtagcgcctcgagcttctgacgacctggctcagtgacgcgtcgtccagcctctccacggagttctcaccattgagaggtaggttccataccttagcggcagccatcagttgccggagagtgccttcggggctgctctgaggaccgcttctctcctcgtccctcaggtcgaaacagccgcagcacagggcagctctgtgtcgagagaacatttgggcgacggggagatagccgtctcttagcaatgtgttgtagtagccggctgtcagctcggatgggtgtgaacatgtgtagtagtgccaatgtatgccggaaaccttccccgagatggtcacgccggtgccagaaaagacggcgtcagcgaccgcgcataacctctctccatggagaagaagcattccggaataccactcgaggaaaaatcggccataaggggtattccagcatcctccatcggcacggaaaaagtttgtctcttcaggattctgccacgtgctatctatgccagctggaccaccacttccccactcttgaatcccaagaatccgcgcatgagcacccaatgatgcttgcatgaacttgtcataacattgaaattccccaagttcagatgagctgtctggctgatttagcttctcggttgggcatgatggatacctaagctcacctcctgggcccattccaacttgaacttccgtcactatggccccaaggtactccttgaaattgtcgcggaagctcctcatgaagtcagcataagcttgcataggtgatctccccttcagaagtggaagaatgtcacatcccaatgagatgtattccttgtttctctttttatatctatcagtatatgacagatctggcatcttctccatctcctcaagcacccattgggaagagggacccagaacgagtcttgtggcccggcgccgcacgcgtgggcggacgcgtg

SEQ ID NO: 33078 - DNA, 655 bp, Triticum aestivum
  Clone ID: PAT_TA_33078
agcacaaacaagccaaatgaatggcaaaaattgaaattaaaggttattgcactatactattatacatgattgtacatttcacacagaatgaaggcttggatacttattccagtaacatctcctatcacttcaccatcaggatctggtaacaatatacatccagacagatggtcagcatcacatgactcctaagctacgggttttatcagttagctgaaggataagggccttttggatgacatagaacctgtccttgatgtaatcagtgcctcgggcgaatttggggatctcgacatcttctggtattgtggcctcaccactatccaactgagaaccatgttcactgaatcttccggaatccgaaagatgcattcttttttaccccatgacgctggtatcttccatctcctgcttctgtgctatatctttggctgcccaaaagaaggcgtaacgcagctgcgatcgtcatgctgctgattggcagatacggctccttctgtcaagaaggaagagtagctatcatgcgagtctcttccagtgaagtcatcaaaggaacagctcgaaatagacactctcctctccaaagtagggaaattgttcttttccttgtcttttcccagtaccaatttccgtagcttagagaaaaacttcctct

SEQ ID NO: 33079 - DNA, 942 bp, Triticum aestivum
  unsure (1)..(942): unsure at all n locations
  Clone ID: PAT_TA_33079
gnaatnctgnacctgtgctttccctccgaanaaagttntgtgnaaatctnttgctaacagcnctaagcantgcatgtaagttanacactctactctgtgnntcttgtaatgagctacaatgtgaatatcnccatgtggggcgagggttaactgncttgatgttgatacatatgtattgggaccacntcaatcatttgagggtcaatcattctatctcaganttttggntgaagccttggtgtgctgatgttatctttgaacatcaagtaccgaggagttattgaggttgnatcacattctgcaatcccattacgtttgagaagtgttggagtcgttttggtattcgggatgcacaccattccaacaccatatgatcctagcgtattgattcggaaagcccaaaggcatggctaaagatccattgagatactctccaatcattggttcactgatgtaccttcggagcgcaacggtcgctgacatcgcgtttgctgtgagcaaactgagccggtttgtttccaaaccgggtgatgtacattggcatgctgttgagagaaaaggtactatgaactatggacttcactataccggatacccgtcggtacttgaagggtatagtgatgcgaattggatctctgatgctgatgagatgaaggccacaactgggtatatgtttactcttggaggtggcgctgtttcctggaagtcttgcaagcaagcgatcttaacgagatcgacaatggaagcagaattaacggcattagacacatctggtgttgaagcgagatggcttcgagatcttttgatggacttgccattggttgataaaccggttccggctatccttatgaactgtgacaatcagactgtcatcaccaaggtgaagagttcaaaggacaacatgaaatccaccaaacacataagaatgagattaaaagctgt

SEQ ID NO: 33080 - DNA, 539 bp, Triticum aestivum
  Clone ID: PAT_TA_33080
ttttgacatcaaagcaaggtttatcatatctcaaatgttacatgtggctaaagcaaaccagccatcgaccgtgaacacacatcatcattcagacggcccaccatacatgaacccgccgttggggctgatctgagacacggcgtacaccttatcgttcgtcatgtagggcgtgaaatcttgcgggactccaaacctcttgccatcttgatccagaaacatgatattgctgaatgacgcggctttcacgttgctgggacggaaaccgctccccatcggggccaaaggactagcttgagtcagcacaaaacctcgggcttgtatctcatccgccttgtcggccaaggtggcgaacaaggtcttggggaaacgcccgattaactttggcttcgacccgaatccacagtgcacaagccagtctcccgttgctttgtcatgccatccaacaacaatcatgttacgatcgaacgctttcgaatacttaataatcaaggcagctccactgtgttgatcttgacgcccacgcgtccgcggacgcgtgg

SEQ ID NO: 33081 - DNA, 611 bp, Triticum aestivum
  Clone ID: PAT_TA_33081
gccgcgaaccgctccggatcgaactcccgcgcgtgggagccccagagctccgcgtccaggtgcaccgtggacaccggcacgtagatgttgacgcccttgggcacgcggacgccgccgagggtgagctcccgcagcgcctgccgcgacaccaccgagcccgccgggtacagccgcagcgtctcctggatcaccatcgtcagctgcttcattctctggagcgacgagaggtccagcgcgccgccgccggcgagggcctcccgtgcctcgtccctcacccggcgctgccactccgggtggagcgccaggagcatcatgcaccaggccgccgtcacggccgtggtctcgtacccggcgaagtatatgttcttgcagttgtcgaccacgaagtcctcggccgccgcgacgccgacgcccgcctcggcctggccgctgcggagcatggcgttgagcaggttgttcccgccgtccgcctcgccgctctccctcacgacgtccagtatgagccgccgcacgcgccggttgagccgccacgcctccctgttgctcctcgtgggcaggaacctgagcccggtcatctcggcgagcaggttcggcctggaccggacgcgtgg

SEQ ID NO: 33082 - DNA, 1748 bp, Triticum aestivum
  Clone ID: PAT_TA_33082
gggaccgttacccaagaatgggtcgtgagcgtcccagatgtgagctgcatttctaatagtaccagaaaaaaaaagtgccaccaaatgaccttcaacaacgctaatttctagctttctgattcatcatcaagaagccaatggaccaaaggcggccacggtttgctaatagatttgaacttaaagaagggtcggatgttagtgccaaaccgttacagcaggtacatcaagaacatcacaaagaaaacatggtacttcctactaaaccacaaacattttgagtaccaaaaccagcaactgaaatctctctttagaagtgctgacaagctttaacagaatccttcggtctcaacaacccacttaatccaggagcttcctcttcctggtgacactcatggggaacttgatggggagaaaactcttgagtttacaatacttgaattcatacatgtcggtgtcttctcccaagcggtcttcagcttttatatacggatgagttgacagcagtgccttggtcttcatatcaacagtaaccaccgaaatcttgtaatggccatcattcgtggcctcagagtacagaaagtgtaccacatgggcatcgtccatactcacaagagggaatttcagaatactgaagtcatagcgagtgcgaacagaaggcaacactggatctgagtgcataatatcatcctggacccaccccatgtctccatcctctgttatctccaaagtatgggaggttatggtgtaaccagaatcagatgggccaacaagctctccatcaatacggtcaacatgaacaaacttgagcaaacgaccttcatcggtgacagacaccccgcggtacatttgtaagtatcctctgccaacaggtggatggtcagggggggggccctgaacaggtggtaaatccaaggtaagagatatcaggccttcctttgaaggcatcaaagaataagatacctcccatgcagtaatcaacccagcaaatataattcttgaaagatatcactgtatcagttgaccatggagagatatccaacttttcacggttaggatggaggatcggtagccgcttaacctcccacatggcatcatcatctttgccatcggtgttgagcacaacaatttcagcttcagacctgttgctgtctgaaattggaataagttggtccagctgcgccacagcaaacacttgttcatcgcggcacaagagaccagcatcccctgggaaaaacaggcgctgcagagttatctctgccccatccaccttacgtgcgatgagcggctcggtgtgtgccggaagccgtttgagaagcggcggcaggtcccgtgagatgacactgcagatgaagggatcctgatagcaccgcaggttggacgtctcgtgcgaccttaagaagtaggtgatcacaaacagaaagtggttgccgtgcgccgccaagatgtcgcacgcggtatctggactcgcatcgctcggagacagcacatagaggcgggaggtgtctgggggatcggcgaggcagagtgcgatgtcgaagttgacgccctgggaggtggtaccttgggccctcaagggccgatagcccttctccggcaaggatgtgttggcgcccctgatgaagacgaagccatctagcatcacccagccggggcggacgtcggtcatggcggtggatcggtggggatggtggggtattagggtttgagaggcggatcggacgctgcgggaaagataaaggggatcgagc

SEQ ID NO: 33083 - DNA, 1069 bp, Triticum aestivum
  Clone ID: PAT_TA_33083
tgcctgcgcagcatgtcttcgcgtctcgcctacacgcctgtcggctctgcgtctcgcccaatccaacacgattttcatggcccccctacaaccgcagcaaacatcttcccgccgcgatgacagcccccgcaagtctccgggggttacaactggaccggtaagggttaactgttgccgctacaacaggacccctcctccgggcgccgtttgaagatgccttcaccttcttactacgtttcttgcttcttgcccggcttttcctgcggctcttgctcttctcccccagctttgcccggcgttcaagtcgctcgccccggctggagtgtccttgcgaatatgggatgaggccctcaaggagctcgctgatgccttttatctccaggatatcagtgggaggcaagctcctcaacacccggaaaaagcacaaaactgcgcaacatgacagaacttgggctttgtattccattcccgttatatactcaagaagcacgcgaaagccctttctttgggagaccaagaagggctttttctatagggtcctctggatcagctttcctgcaaagctgtgagaataactcaagaagcctgcgtggtcttctaagctcaaatgcgagttgtattgctcttgtatagtctgaatctgacactgcattttccaattcctggcctcttaaaacttcctcctccttcttaaggaaatcctcctgcttatcttccatcgtgcaatcgtgccaaaggttaagatcagaatcggttccgccagtagcaagcatttcagttttcttgccaacagccagtgcccaaaccttcccatcgtgcttgtcatacgtagcaatgcactcattcgtttttatcgtccatagcttcactagaccatcgcttccacaagaaacaaactgagttccacgtgaaaggaatgaagctcttaaaacacttgacgtatgaccctcaaatgtcttcaggcatgagccatcagcaacatgccatattttgacagttttgtcgccagatgatgttatgacacattgttcaacaggggaaaactccggacgcgtgggcggacgcgtgg

SEQ ID NO: 33084 - DNA, 1358 bp, Triticum aestivum
  Clone ID: PAT_TA_33084
ttttttttttttcaaaggcaatttctgcttcttgttcttttgcaatgaccaacactacattcaaacaaagagtagggtaatttacaagatatgcagtgtgcccactgtagctgcaactacgagatgtttttttcctcctttttagattcatcactgtgagctaaagacgggcgatttccaaaaatgtgatgaactgcggtctgtgccatggaaatgcatgcaccctcatttttcagcaatctgctactttcgttgagttagctccagtcatgcgttggggaagctctgacctcctcatgaccctcagtctcttcgcagtcgaaacaaacacactccatggtatgtccccgaccagcatcctgtctccttcgtcatcttcgtacactagagcgtattcaccggttccatccagcaaccctgaaaatattttctcttctgctcctcgcactccgctttcatcacaagataaatccttctgggcttcaaaaaagcctcggaacaactcttcgacggcagttgacagcttatggtagttgtcacatgatgcgaggtctacttttcttccaataggtattccatccatgttgagcttgatgagcgggttcttcttgcagaccggcttcgctctgtcggtggcctcgacgttttgtcgctcaggggattgttgcttagatgaagttccatttgtgaggtttctcctgaaggatcggactggaggccagccgactaccggaacaacagcagctctccccggggggtctctactgctgtgcacaggtgcacgtccttccctgtcctcttgctgcctccgatcataaccttgtggtttggccccaacggcgtcgaagaagcctctcttggcgccggtggtggtgctggtgaggcatgaatgcgtggcgaagcgcgccaggtgcagggagaccgcccgagcagctctcgcccgccccgctcccttctccctggtgctggactccggggaggccgagcttgaggtccagctccttgtcctcctcgcgctcgtgctcgtgctcggcgtcgaatggtggccttgttcctcggtggcctgcttgagcttccctcgcctgccaccccttgtcatccgggatgaggttcagcagccggggaggggtgccttgttccattggactggatctagacgtgccgcaccggagacgggggtcggacagctgcagcagggctgcaaccggaggagtcctggccgcggccgggatggagagctcgaggaagtaatggcgagaccaccgcacgggcgtcggcgtcggcggctcgttgtggttgctcgagctggccggtgccctttccgcccttttgtgctagtgctggtgtggtgaatggtg

SEQ ID NO: 33085 - DNA, 734 bp, Triticum aestivum
  Clone ID: PAT_TA_33085
ttttttttttttttttcattaaaaccaaaactttattatgaccatgcatatattattggtcataccacacatgataatgtgtgtcgtcttactgcattattacatatatagatagagagagatggatagaggagatttcccaaatatcatgaatcagtagtagggcggaatggcagcggagacgccacaggggttggtgcggtagctgggcagctggtactggtagagtccacccatggccggcatgttctgcgccatcatcatggccatggggttgagaccctgggctgccagcagctgctgctgctgctgcatcagagctggctcgtacaggctgctgctggcggcagcggcacgctcaagctgcatcatcatctgcagctgctgcgcgacggactgcacgtccatcatcctcatctgctgctggcagcactgttgccggagcggctggaacatggcgctcggctgcccacacccggcgtagtagggcgccgccgccagcgggctgcactgcggctgcctcaggtactccgcgtaggggtacagcccgccggcgcccatcatcgtcgtcaggccggcgccagcgccgtacaagccctgcagccccgcgcaggggcagggcatctgcattgcagaggcgctggcagctgacagagccaggcacacgacgagaacgatgaccatcttcatgctgttctgttcgacgatcctctctacgcactgcggacgcgtgg

SEQ ID NO: 33086 - DNA, 623 bp, Triticum aestivum
  Clone ID: PAT_TA_33086
acgtttttgttcggttgctttcacaatgaaccacatggtcacaggctctcacacattcaattcctccattgggcctccaaactcggctaatttgcataaccaaatcacattttcaaacaggcaccccacacgtcagtgtctcaccagtgaaaagaacaaaagaacacgcgcacgttgtcagcggggcctcagcgtcatgcataattgcacgtacacgagttccccgtcacgtcaagggcctacccaataatttagctactggcgagaatcccacgacgccggcgacggcatcgtcgacgccgtcctcaccgtcgcggtcaccgacgaggcggtggtcgccgacgacagccgcggcgaggccacctgcttgatgaccacgttcgggagtggactgcgcatccgccgctcctgctccttcaccagctccgcggccagggcgtccaccttctccgcgttcgtcctctccgacagcctccgcccgcggaagagcaccgactccacgttccgctgcgagagcattgctccggccgccgcgcctgccgtctgcgtgtggggagaattgagtgcgctgctgggcctgtaggcggacgtagttgcctcgtccgaattcctgcagtgccatg

SEQ ID NO: 33087 - DNA, 1210 bp, Triticum aestivum
  unsure (1)..(1210): unsure at all n locations
  Clone ID: PAT_TA_33087
ttgggtttttttttttaagcaagcaaccaagccattacattaccaagcagtcaagatacacacatgtatcacacatacaagccaaaccactggtactatacatattttgcacacggctaccaactagtgcagtgtggataagcacaccctaacatatcaacatagatacactggtgcgcacagaataaaccttgtgcctagcacctccctacactgcctaaacaaagtcacatatgtacaatcttcctttgctggagttccaagtcttgttagcactttgaagcaccgcggttccaagttatggtttcttccttgctgatgaatttgccgggcgttgaggcattcccgtcgcttatgagtcacactcggcatctccttcaccgcaaagctgctcgactcggctcgcgatatgtttgccataggtgtacttcctcagtgcttgcaagtgaccctttacacggctgaccagaagttcccgctgctcatcgttgcatgtttcaagtatcttctgaacaacataattagcatactgatccttcatcattgccagcaaggtatcatttccgtcagtctgctccacaatctctctgattagaagatctcgttccgcaatatctccatgttggaaacacttctctatcacatttgatgcaaatttattttggctcatggtgacaacctgcccagccaacttactgataatttgagccctttcatgactttttcctttttccacaacatgctgtgtgacatagttgccatactggtcttgtgcgaggatgcaagcggactgcaaaatttcatctattatgcactgacctcgtgaatcaccacccacaatgctccaaaactctctgaataacacggcaacnncatatggatgcattgaaaggctagcaacttgtccccgaaaagcagatactacaaaaccaatatgttccgtggggacacactctatgcacttctgtataacatgattcccattttggtcacgaacacatcgcataatatttccatcaagctcgcggaccagatctattttctggtcaagttccataacttccagagccttttgtattactcggcatccatacatctgaaggctcaaaggtacaacagtgaccagcaagcttggcggcaagatcccttctttgctcaggagttccatgttcaaaaaacttttggatcacatattcccgacggacgcgtg

SEQ ID NO: 33088 - DNA, 629 bp, Triticum aestivum
  Clone ID: PAT_TA_33088
aaacgatggtaaagaatgaatacagacgaagataatgaaacaaggtgaacaatgaaacccagaaggataacaatccgatcgaagtgatctagaactatcggcacagagcacacatgtaaaccactaaaagaaaagtagttgagtaaatagaaccagtggtgctcgatggcgatagagagatttggtagaccagttcacccttctaccaaagggctacatctggttggaggggctgtgacttaacatggaagaaaaactctcttcaccctattctccttcaacgcagagctgatcagactcaagttgatttcactcgtggtagatccttgtcggcgatctccaaaccttcggtcgaccttcgcgaaccacaatcactcttcgttactgaagatctggctcggtaaagacaacaactcttgaacattcgaagccgatacctatccgtctagagagtgcgcaactctcaagagtaataggtacaagaactctcactcagaactactgtgatgctaaaccactgtctaagtttgtgctcttagtttttctctcggtggatcttaaactcaaatcactcggagagggtttgctcaaatcaatcttctcagacccacgcgtccgcggacgcgtgg

SEQ ID NO: 33089 - DNA, 181 bp, Triticum aestivum
  Clone ID: PAT_TA_33089
agtcagaactgtactgtctgattgattcacttttgtaagattgcacacaggaatatcgcgcgcgcacacacacacacacacaattcacaagcaaaatcaaggcagagacacatgagtgaaacgaattgatgcggcggagcatagtcctctcctcctgttaagggaacctgctgggctacgg

SEQ ID NO: 33090 - DNA, 663 bp, Triticum aestivum
  unsure (1)..(663): unsure at all n locations
  Clone ID: PAT_TA_33090
tttttttttttttagtcagaactgtactgtctgattgattcacttttgtaagattgcacacttttaccccgcaaaaaaaaaattgcacacaggaatatcgcacacgcacacgcacacaattcacaagcaaaaacaaggcagatgcggcggagcatatagtcctctcctcctgttaagtgaaccccctgtactacgtaaaccaaacccttctacctccatccatacgtcaaagatcaagcgccaagcaggctgaaagaccggcgttcggttctgggagccagcgtgaagttgaggccgaacatctccttgagagcctgccccggctcaaccaggtcgatcagcctcgccaccagcgaggcgctctctcggacatgctccatgtcagcccgcgcccataccaggcgagatagctgaagccgccgctgtttggagcccagatcgatcccccatctggtgtagattccctccttgtccccgttggcgagcttcttcagcatctgcttgtanagcatgtccctctcgcgtttcatattcttcaagctggatgcgattgcggtattaagcttgcctcctgcggaggtggtgctgaaggagctcaggatgaaggacagtctcctgtgctccacttccatgtagacgctatctgcagcatctcccttgaag

SEQ ID NO: 33091 - DNA, 675 bp, Triticum aestivum
  Clone ID: PAT_TA_33091
cagaataaacggggcactcgtctcctcattcccctcgtgctttttttttgcaatagaacacaagatttctggacagaatacaattttgtgtgtgcatattctgttcttgttcgtcttacaaggcatcttgagttgcaaaatgaaagtgaataaaggcacatgatatcatctgaacttgaaggttgttgcacaagccctagtcatgtgtggaagtggagctgagcttgagcaagacgaggacggcggccgccatgggcagggagaccatgagcagcgcctcgacgatgttgggccgcgtgatatcggggagcagcacgctgccgtacttcacggccgccgcgccgccgatggacccgagccccagcgtcagcaggtagccggagtcatcctgcgggattggacccttgctgtccggctcagcctcggcgccgttggtgtcgcgggacacgcgagcgcgaccgccggcgcgtctcctcgccgagcgccggcagctcacgcgggagccgcgccccggcggcggggctgcgccggggccggagacggtggcccgggatggcgcggccaccgcgcacgcacccgccatggacacgagtagggcgcggcaggaagcagagacgggaaggccttccgcgtagcgcagcgcctacgttcgcccacgcgtccgcggacgcgtgg

SEQ ID NO: 33092 - DNA, 639 bp, Triticum aestivum
  Clone ID: PAT_TA_33092
taggggcctttttttttttttttttttttttttttttttttttttttagtaactagagtgattatcagattattatgtctcagacaaaacaaaaggagcacagagtgaaactgtaactactgacaaaaggtaggtctaatagcagcacagtgttcttgccatagatctcaaacagttcaacaggaacactgcaacagcctgtctcggaactttgactcacatcttcagttccgtcgtccatgtcccctggacacttggccgtttcgccacgtgtctggttctcagcttcaccactttcctgcccagagaacaccttagcctactagcttgcaacatgatgtcctcaggtgctaaatttctgacgcaaaccactctctcgttatggtttttgtaaatgcccttcaagttaggatgctgaccacggacaagctgtgtcactacctctaactggggattcttttccttcaaagctggaagatgtgactccataaaagccctgattcccctgctgctccctccccaatcgcagtagttcaccacaagcttctgcagctgccaaacacccctcagcgccatcacgccgccctcaggatcaaaaagtgtgtgggtgggggactggccccttctgtcgtcttctcg

SEQ ID NO: 33093 - DNA, 896 bp, Triticum aestivum
  Clone ID: PAT_TA_33093
acatggcacaatgtttttagttcatgacagttttacatttataacttgtcctgtcataacatgcagaacattcctccttccttcagaacaaattctgcgctgacagctttaatgaatgcaatggtctaaagatcaggcatttgccatcaaaatatcagctagacaggtgacactaacaaaaaaaaaatccccaagttcacatgttattatcagactgcggctcaaacaaaaggagacagaatgaaactgtaataactactgacggaacagaggtctaatagcagcacggagttcttgctatagatctgagacggttgttgctgagtgcgtgccatcaggaactttgactcacatcttcagttccgtcgtccatgttccctggacgcttggccgcttcgtcacgtgtctggttctcagcttcaccactttcctgcccagagaacaccttagcctactagcttgcagcattatgtcctcaggtgccaagtttctgacgcaaaccactctctcattatggtttttgtaaatgcccttcaagttaggatgctgaccacggacaagctgtgtcaccacctctaactggggattcttttccttgatagctggaagatgcgactccataaaagccctgatccccttgctgctccctccccaatcgcagaagttcaccacgagcttctgcagctgccaaacgcccctcagcgccatcccgcctcactccgggtcaacccaaaccagaccagcaaggtgtgcggctaggcggaaggcgaggcccgagcaggaggcggaacccggcgtaccatgtgaataaaattaggttcaaggatcacaaatgcagggcttgatcacaacccaactagcaaaatacatataattgactcaactgtggccgagcg

SEQ ID NO: 33094 - DNA, 537 bp, Triticum aestivum
  Clone ID: PAT_TA_33094
cgtccgtgagagccgagcgctcgaaatggacactgacatccttccacaaggtttcattcagcgagcatgacatcctggactgccttgatgaggacaatgtcatcggtagcggtgcatccgggaaggtttacaaggcggtgctcggcaacggcgaggtggtcgccgtcaagaagctgtggggcggcgcgttgaagaaagacgtcgagaacgccggcgagggatcggcggcagacaacagcttcgaggccgaggtgaggacgcttggcaagattcggcacaagaacatcgtcaagctcctgtgctgctgcacgcacaatgactccaagatgctggtgtacgagtacatgcccaacggcagcctcggggacgtgctgcatagcaggaaggccggtctgctggattggccgacgcggtacaagattgcactggacgcagccgaggggctgtcctacctgcaccaggactgcgtcccggcgatcgtccacagggatgtcaagtccaacaacatcctcttggatgcagagttcagcgcttgcg

SEQ ID NO: 33095 - DNA, 674 bp, Triticum aestivum
  Clone ID: PAT_TA_33095
ccacagtataagttgaacttttatttagaagaccaagactccaacagcagcagccatgatcaacatgtgggctaataagctgggtccaaaccagtactgacattaattatttattaggcggatagatcgtagcaaacgtgaagttttgcgcgcgccgacgtgtgcaccactcagtgagcgtcacgggacggcgaggccgcacgcggcctcaacccgatgtaaaggcggggcaagcgaggtcggggatccgaggctcgtcgcaaaccaagagcacggcgttgacgtcgtcggcgaagtcggcacggtcagagacgtcgggggcatccctgaaggcggggcacatgcactccgcggcgctgggtttcccgcggacattccggcagcaccgctctctctcgtcggccaggttcttcccgcggaggtcgactctgcccagccggaagtcgacgcacagtccgagctcagataggtagtccggcgtgcactgcccgccggcggacggtgccggtgccggtgcggtcgcctggccctggacggaggccgcagctgcaaggatcgcggcgaggagaaggagcggggcgcgggaggaggccatggctttggtggttgccattgttgctgctcgagtgctcgatcgatggatgatgcttctacttcctttgagcggacgcggg

SEQ ID NO: 33096 - DNA, 746 bp, Triticum aestivum
  Clone ID: PAT_TA_33096
taggggccttttttttttttttttcgacgatgaacttacggagtcaatccgtgctttattattatggaaaggaagaccaacactccaacagcagcggccatgatcaacatgtgggctaataagctgggtccaaaccagtacgtactagtacaagtcagtactgacattaattatttattaggcggatagatatatagtagcacaggtgaagttttgcgcgcgccgacgtgtgcaccacagtgagcgtcacgggacggcgaggccgcacgcggcctcaacccgatgtagaggcggggcaagcgaggtcggggatctgaggctggtcgcagaccaagagcacgacgttgacgtcgtcggcgaagtcggcacggtcagagacgtcgggggcatccctgaaggcggtgcacaggcactccgcggcgctcggtttcccgcggacattccggcagcaccgctccctctcgtcggccaggttcttcccgcggaggtcgactctgcccagccggaagtcgacgcagagtccgagctcagataggtagtccggcgtgcactgcccgccggcggacggtgccggtgccggcggggtcgcctggccctggacggaggccgcagctgcaaggatcgcggcgaggagcaggagcggggcgcgggaggttgccattgttgctgctcgaatgctggatcgatggatgcttcttctacttcctttcaggaggtgtgtgtttgctgccccaggcccggccggc

SEQ ID NO: 33097 - DNA, 1126 bp, Triticum aestivum
  Clone ID: PAT_TA_33097
gcacgtggctggttcttcttttctgttcttgcccacaccatgcctgttcagctcagttctgcacttcgcgtagccaggccccccccccggtactctgggactgaatcgattcaatcgagatgacaacctctttttgccggaaccaaacatactctaggcctgaatcgaatcaatggagctgacagcctcctttctctttctgccggggccacgtatagcttcacccaatgctacactgttcagcctacgatccgacgctgaaccggattctgtggttggggggtgatatattcctccaaagcagtgcgggcagtgctcttcttttgctttttcctcgtcgccgccaaattttaatgacagaacagaacttcgcttccacattcaagaccaccagagttccggttcaattttcgcaaacacagccaaccaattgacgtttaccagccaaattcaccttacaccaccaaacgaccagcgctaaactcgtaaccagttccaaaaaatgatctcctattcttaagctcgcctaaaccgggttcccctgggagcacctctatgcagcagcaaccggtgtctgcttagggccgttgttgacacgggcatacctcccgttcccgttctcgttctggaagggccgtggctggtggaagccgttcccgttgtggtgctgatagccattcccctggtgcggccctcgcccgcggcctgaaaactcgttccggtttcggaagtcgttcctccggttgaagttttctccgccgtcgttcctcctgttgaagttgtcgccgtcgtccctcctgctgaagtcttcaccgtcgtccctcctgttgaagttatcgccgccacggtagctcgcactattcatgtagccacctccccgtcctctgaagttatcaccacggtgacccctcccatattggaaacgaccacctccaccagcattcatgacaacaccattcacaactctcgtactggttcgtttctgctcaatgcccacttcagtgtccccaatataaagtggagatgcctgaattgctgcttgcatagattgctgggattcaaattcaacaaagccaaagcagtactgatcaatcttgttgttcctaacttggatgccgtctggctt

SEQ ID NO: 33098 - DNA, 435 bp, Triticum aestivum
  Clone ID: PAT_TA_33098
agagcaaaaatgtctcatatatttaatcgaatatctttcattacaaagaacatgatccaaagtttacaagatgtgaaactacctagtactagtaggcaattcttgaccttgcaatcaatacttatcagccattctaaaacacaatgtttgaaacattgaccctgaaaatggcattctaattatctaactaccatccccattcttgaccttacaatcaacatctgagccatgcatcatctgtttatcttgcaataaaggttcaaggccgtggcatcagtagctctgtacacataagaggagagtactagtcaacacctgacaaatactttgatcatttatttccgatgataaaacctctcttgaataaaatcatgtgctgacataccacatatcctttgtttgctaagaaagatctgcagttctgcggacgcgtgg

SEQ ID NO: 33099 - DNA, 369 bp, Triticum aestivum
  Clone ID: PAT_TA_33099
cccggcgtggacggagaggacggagccgacggggcactcgcgccagccgaggtcctggatgtcgcgcttcacggcctctgtggagagcagggccgcggaggggcccgcggcgcccggcgggggcgccacggcgttgatgctgactgtggcgcggcgcgggcgcagtaggtcgagcgagttgagcgcgtcgacgatcaccggcttgttggagttgtacaacttcttgaagccgtgcatgaagaggatctgattgagttggtcgatggtaagatgtcgaccgctgcgggtggtgaagaagaggacgtagtcctccagcgtcatccgcggccgatcggccgctggtggcttcgtcatcgcccggacgcgtgg

SEQ ID NO: 33100 - DNA, 482 bp, Triticum aestivum
  Clone ID: PAT_TA_33100
acggtcaggcacgtccgggtcgaccggaatcccatgagcatgaggaaaggaaagctttgtgctgcattggtgttttaagtctttgagcagtcaaatgagctaagctcctgtgaatgaaacgcctgtcctgctaagcccaaactctaatgtgcttgacttggaagtaggccactctttcactgtgaggatcttcttttagtctgtagccaccccttgcccactaatgacatgacccaggtattctatctgtggttgagcaaatgaacatttattcaacttcacatatagttgattctgcttcagaaggtcaaatacttgctgcaaatgggtgacatgatcttgcaaggatttgctgtagattaagatgtcatcaacaaaaacaagtacacaaaccctagtcagctcagccagaattgtgttcatagcactctggagggtgggtggtgcatttgtgagcccaaatatcctaaaattcatagtga

SEQ ID NO: 33101 - DNA, 754 bp, Triticum aestivum
  Clone ID: PAT_TA_33101
ccgcccgggcaggtgtctcgagtttttttttttttttttaaaactacaatactacattaaccagcgtgtattatgtcaacgacaaatttctggatctcctgaattacagcaaaatgtccattacaatttctaaccaattcagaattgaaattccttttcttattgcttgcgggattcttctgttgcaacttgcaaggacggagtacctcacacctcggctctgcatagtcattttggtctggccacgggggatgcggcggctgatcaatggttggcatcgccatgcggattggccaccgcacgagcgatcgcgttagcatcaacagcagtgacacggttgttgtgtcgtgggagtctgtctgccgcggcagcacgaggtccaggagcgcgtccacggtcgggcaccactggagtaggcgccgagggaggagcagcttggacggttgttgtctccttgtgtggcttccgatgggagggtctcgtcggccgaacgttggctggctcaacccggttgccgcaatgtgggacggggccggcgacccgctcccgagatgcctccgccggggcattagaacgaagacgatgacttggcctccaaggggaatcagcaagaagttgaaggggcagagtggtgccgtgtcgacaccgttcttcaggtcttcttggcgtctctgtgcgtggaagagtggcttcgccgagtcgacgacgccgttcgtcgggccgcaggggcatcgggtccccaggtactacccgt

SEQ ID NO: 33102 - DNA, 604 bp, Triticum aestivum
  unsure (1)..(604): unsure at all n locations
  Clone ID: PAT_TA_33102
ataaaacttaccctatcttttcttgtatacaaatggaacttacatatagcagtgtacagtgtaatattcaaaacagaaaacaagtaaaagaaacaaacaagctagattcacacatattgacattttagagcaaagtacctttttacacctccattaactagctaagctgcaaaataactagttctgaataagaaagtttactgaacttgttgcaaatcttcacagctatgccaagcccttactacatcccctagctccaccctcaactgatcccaaccaaacacttgaacctcgccgtcgccgtcgtccatctccagccgcatctcgacgagcattagtggcggcaccagctccgaaatccccactgatattgccggcctccctggaggacggcgctggcaccccactcctttcttccccacgacgacgtacccgatcgacccgctcgcccggctgagctgctcagcgtctgtccggcgacgctgtcgtcatgaaccgctctccctgctctgctccgccgaacagcccggacaggtcgagcccgcgaatcgtggatatgatgtcgaatgcgttcaccgncggcgcccggaacgccagcgcgcgc

SEQ ID NO: 33103 - DNA, 713 bp, Triticum aestivum
  Clone ID: PAT_TA_33103
gtgttttttttttttttttgtacttttaacatcaattatatggttaaatgaaaacaagcacaagctgcccttattacatatggaccgtactctgatatgatggcaaggccttgcaggaagtatataggagtacaatctacatcagtgggccggtatatatgaaaagcaacatggcatgtggatgcaaattaaagatgactggtagataggctcacacacaacatagaacaatctacgtatcacacggatgtgaagattgcaacatagacgcacacacaacatagaccaatcttggtacggacggcagagcgcagtttctttaggacgatgacgagcgatttgcctccttcttgacccacacgttgtgcccttacggcagatagtggcagattggtccgtcaccaggcttggtgccggaggaccttgaaggagaaatgctccggcgtcccagtgggacgtgtcagtgtggcaaatagcggcgacagtgacggcaaggccactatgggcaaccctccatctccaccatgtacgccctcgttgcgggtgtgttatggcacatgtagacagtgtagggatagttatggtcgtggcatgacacgaagctcgatccgtccaccgggtgcacagctcggacggcgtacggttgcttaggtgcccctgagcggggtaggtcggaggccatcggccggacgttgcgggtgccgagcgccgcc

SEQ ID NO: 33104 - DNA, 488 bp, Triticum aestivum
  Clone ID: PAT_TA_33104
gaagcggaagccgaaggagagagcttggatgtaacatcggtgagccaggtcccggccactcccagcgtggccacggcacgcgctcagagagcaagcaagactgcggccctgagcaagttcaagtcttctgtgaagccttctctcgaggctgcttctgacagtgaacaagacgagatgtccggactgacaactgatgaggatccgtctgatgattccgacgaccctgacgaggaggagtcttaagttcttgggagctgaggtatctgctggcgttcttgaccggaagaacccagcaattgttatttgaggtatgcagggtgacactgccactatgtattgtttcttttgaaccagtagatcatgtattcatgtgctcttcagcttgcaaagctggaaagattatgatttgattgtgtacgtagattcgattcaaggatcaatgagattgtataaagagctctacatgaaagaatattgctcttttacgg

SEQ ID NO: 33105 - DNA, 687 bp, Triticum aestivum
  unsure (1)..(687): unsure at all n locations
  Clone ID: PAT_TA_33105
cgtagattacagnttaaaatccaatctacaataagattcattatctccagatttgcagcaatagtctgaaagcacctaaaggtttgtatgagcataaccattacttaatatacaaaggcactatcttccagatttcaatgccaactagatacttattttgcatcaacaaagtaactaataattgtaaactcataccgacaactttacattcatttctgcatacgatgaacagctgcagatttcagtgagaaccttcaacttcatgcccagtgccctcatcatcaccaatcaaacacggaggccaggccataatatacggataggcacggtcatgaaatgtcccatggatcagtaactcaatctccgtggtccccaatgaatggtagaataaccagcagcgttgtgtgccaataggggttatgcatgacatgtacaagtacacgcatccagacctagcttgcacaactctgagtttgccctccgattccccggtcgtccgctcaatctgtgcgctcaaagagggtatgagctgctgcacccaaaccccaattccatcaccgtccacaccacggatccaaacatggaggtgaaaatcatcagatgcatagagagctctccgtccttagtgtccccaacggtgaaatcgacctgcccgtattcattatccatgaggtaatgagggtagat

SEQ ID NO: 33106 - DNA, 440 bp, Triticum aestivum
  unsure (1)..(440): unsure at all n locations
  Clone ID: PAT_TA_33106
tattgttactagtaaaagctttctactgtggttatgccagcttcacaattctcgttgtataaattgtataatgggaatccaagtatacacagtatagaagagcaatcaacatccctgtttgtgtttgggcaagtggccaaaccggccataagcagtggtaccgccgctactcctaaaatagtaaaatggtttctgaatccgaagttaatgttgtttggtggcgtctcactgaatgtttcaaagcgtcgggtcgcttgcataaaatcttgcgccgcctcgttcccgccggtagcagcaccctcttgcaacgcgtttctcaaatacggctaccctttgtacttgcacatacggccgctctatctgacgcgttcgcggacgcttgggccgtcctcgggaacctccccgatnaagctctcgaagcgaaggaaatttgcctcaag

SEQ ID NO: 33107 - DNA, 1012 bp, Triticum aestivum
  unsure (1)..(1012): unsure at all n locations
  Clone ID: PAT_TA_33107
cccgaatcccctccaacgaaccctagcctcctggtgccgccgcgccttccttccccccccccccccccgcgtcgtgagccgctcccggctcgtcgtgccgctcgcgaggtggcccacgtgcagcggccccatggccggcctcgacgagcacggcctcgatccggcctcagcaggagaacctcgagccgaggagtgcggcctcgatcgggactcggcagctggggcggcgacggaggaggaggggaaaggaggggagcagcagctagcatctggtgtcgcggcggatggacactatcctggcctcgaggagaaggagggctcgcctccagcggtcggaaaaactccgctaggcgacggcggcgaggagatgtggaaagtaaccaaggattcgcttcgccatgaactcttcccctcattttgacacaacagaggtgagttcaaatacccgagaggaagactacttggggcagatgttgatatgtctgcatctacttttgtttgaaaggggctagcttttactgtgaatctctaggacagtttggcacatgaggcagtagagatggattagttacaggggtattaggagagagaagcacttgccaacttcgtcctccccggctttagaagccattcctgccacggtcaattatgtgtttgccagtgcacatccaaaattcctttggtccctcagattatatgatgaagagaatatgaatttagcaaacgatgtgaagaaatcccgcacacaccggctacgacttcacccgcacgcggtggtggccgccggggggacctccctagacctgggtcgtcctctccatctgcctgctacgcggctagcgctgtgtgagtgcctggtgcgatcaagttggcatgatggacatgtcggtagatgctaaacagtggctgcagtcgcacctgtactactaacgacggcctggacgtgatctcaaggcacgggccaagtgtcagcatgnnnnnnntggaacagtatgannnnnncaatgagcaa

SEQ ID NO: 33108 - DNA, 674 bp, Triticum aestivum
  Clone ID: PAT_TA_33108
gaattcggcacgagcgactttctccgtcttcctcgactcgactcgattcgattcgtccgtgcaccgacctctaccgcgtcctcgctcccagccatggccggcggcgatggcgaccgcgcccgcgcgccgaagcggtacaagtcctcggcgccatcgaaggcggctctggtggacgagaccgccgagatgaactacgccgacgacttcgacgacgatgcccgcgacggggataacgaggtgaagaagagggacttcaccaagctggagctcaagctggatcacgtgaaccggccgctgtgggcgtgcgcagacggccgcatcttcctcgagaccttctcccctctctacaagcaggcctacgatttcctcatcgccatcgccgaacctgtatgcaggccagaatctatgcatgaatacaatctaacgccacactcgttgtatgccgcggtctcagttggacttgagacaaccactatcattagtgtcttgagtaagctctccaagactaagttgccccatgagataattgatttcatccatgggtcaactgcgaattatggcaaagtaaagcttgttctgaagaaaaatcaatattttgtggagtcgccgttccctgaggttttgaagaccctcctgaacgatgacgtaatttcaaaagcacgaaaagctcccga

SEQ ID NO: 33109 - DNA, 1290 bp, Triticum aestivum
  Clone ID: PAT_TA_33109
cacaaaagtattatgttcttcaaaaaaatgtccacaaaacattctgttctttaaagaaaaaattcacaaaatcatcccatgagaagattgcacataacattcacgctgaaagcaacacatctgagacataggaaagcaataggagtagtattaaaccaagtgaatttatcataacactcaccactctgaccagtgaccatcatcatatgcctatagcttcaagctctccaggtacctcctgccttccagcttcgccgcgaagtatcccttggtgaagtcaaggccatcgaccgtcttgtagcgtgcgtcccccagctgctgaaacgggcccatcgtgcagggaaggtgcacgctgtggaacgccgcaatggtgatcctctccttgtcagggttaaccaccgcccggtgctcgatgctcctgtacttgccgttgctgaggatctcaaggacgtcgccgatgttgacgacgagagctccgggcagggcgtccacggagaaccactccccatccttcctgacctgcagcccttgcacgtcgttggcgtggaggagcagcgtcatgccaacgccgtcggtgtgcggcgagaggcccagcaccttgccggcctgacggcagggagggtagtagttgatcctcacgcactggggcaggcccttgaaggtgccaaggagcgcctcctggtcaactcccaggtccttggccatgaacctgaacagttgctcggccacacttgctagctccgtcgtgtacttgtcaagcgtgtccctgaaggtggagggcttggtgggccagaagtccaggctccgctcctgggcgggcctggtggcgaggaacagcaggtccacccagtccagcttctgctccttggagaagacgaagtggtggccgaagccctgcatgccgttgggcggtatcgccacggccgacttctcctccaggggaaggccgaagaactcggcgacgtcggccttcgtctgccccagcaggcccccgtccacggcatggttcacgagctggaagaagccccagtgctcgcaggcggatccgagcttagccgactcctccaccgagaactcggggtcgagcagcctggacatgtcgatcgtcggcagagcatgaccccccgcatcggcggcggggggatcggcatcgatctccggcctgatgtacctctcggggacctcgccggagtcgtggaaggcctctgcgagggcctgcacgctctcttcatggcccgtgaactccaccttcatcttgtcgaaggactctgccatccttcccttccccgc

SEQ ID NO: 33110 - DNA, 467 bp, Triticum aestivum
  Clone ID: PAT_TA_33110
tgggcccagcaaaattttgttcagaaaatagaaaatttattttcgaatataaacacatattctttttcatcagccccgcaaggaattcagctactttacatttctatacagctcatggctctcttcactgtaggattatgatcaaacaaacaaagagaaaaaattgtcagacagctaaggaacctacattttgtggtttccccctctacaaactgcttgcctacgataagcagattttccttcccatgacatccgccagcgtgcttactcaccacccctctcacgaccatcatcgttgttgcacagtcggcacctctgacctatggatcaaacgtcagttgacgtgctcctcccatgtataaaaatatacacttctcttcaacgcccttctcttgcccaccgatgtacagcatctcagatgcgatttgtgtcgatcagtcgacctttggcggtcactagttctctcc

SEQ ID NO: 33111 - DNA, 1577 bp, Triticum aestivum
  Clone ID: PAT_TA_33111
tttgtactctctcactgctcgccgctccttctcggctgcttcttgcccaaaacgcccaggtagcttcaccgccggtgtctcaggagacccacgacccccaccgcttccttcctgctcgtgcaggggcggtgcagaaaaatgctagatcacaccagagggcgcggattgctttctcctctgatgatcaatccatgccgctggtgccagtggcggccgccgtaaatgctgccttcgcccctgcgcggtcccacgcagattgggccgtgtcgatgcaggcgttttacacctacagggggcatccatctaatagggagtctgcgaggagatcaaggttacgcaagcagcaagagtgcgaggaattatcgaggaaggttgctgagctgacaacagagaacaacgccctcagaactgagcttgcccagcttaagaaggcctgtgaagatatggaagcacagaatgcacaactaatgtctcaggaacctgccgcggtcacaaccacactgggcatgagcatcgcagcgcccaaagtgcagcatcacgatgatgagggtaagcttcataagaaggctaataataacagcaacgggaagtacgtaggtggcagccacaaactggaggctaaccctaggtgagagaccccacgagggagtgacagagatgagatgtggtgttcctttatctaaccacaagcacccatcatcgattcagtgtgcttttagcaaagatgatgttttagttcacttctcacagctcaccgggggccctgtagagttgccccgtcgcaggcatgggcagcacttcccaatgccacgccaaatctgaacatagggattgatctttggagtgcttctcaatccttagctgtgatcccagtgcagggggaagcaaatcctgggttggcccttgcccgatgtgatggtgttggtcagctggatgagcgtgaaattaagagggagaggcgaaaacaatctaatagggagtctgcgaggagatcaaggttacgcaagcagcaagagtgcgaggaattatccaggaaggttgctgagctgacaacagagaacaacgccctcagaactgagcttgaccagcttaagaaggcctgtgaagatatggaagcacaaaatgcacgactaatgtctcaggaacctgctgcggtcacaaccacactgggcatgagcatcgcagcgcccaaagtgcagcagcacgatgatgagggtaagcttcataagaaggctaataataacagcaacgggaagtacgtaggtggcagccgcaaactggaggctaaccctaggtgagagaccccacgagggagtgacagagatgagatgtggtgttcctttatctaaccataacacccatcatcgattcagtgtgctttttagcaaagatgatgttttagtccacttctcacagccctgtagagttgccccgtcgcagccatgtattatttatggctcgtcgccgagaagaatgtgtaaattgattggtgtacctagagcttagaaattttatgtttgctaacttttcatgaggattcatataacctgcaaatttgatggcctgatcggctgatc

SEQ ID NO: 33112 - DNA, 464 bp, Triticum aestivum
  Clone ID: PAT_TA_33112
acagagctcagctatcccaaactcggtcatcctttctaatgttagatttctttcttatgaaaatatgaaaaagagtgttacttgttctcccgcagctatacaacatccattggtgaaaggagctttagtcgtcacgggcaagctccgtaaggaaataatggaccttaagcagcaagtcaataactcgaggaagagaattgtatcctgaggggcatcatcgccaagaatatcacatcaccacctccgaagaaagagacataaacacatgggtatgggcactccccttggcaactgccaagcttgggggaggtgccccggtatcgtatcaccatcacactcctatctttactgtttttcttagttcgatccttttagtaaaatcttgatctagtagaataaagctttagtatgatctagttttgagctttgctttatgatccttctgtgtaacgtggaccggcgaa

SEQ ID NO: 33113 - DNA, 709 bp, Triticum aestivum
  unsure (1)..(709): unsure at all n locations
  Clone ID: PAT_TA_33113
agcaaaagacaccctccaacttgatcataaccttcttaccccaactgagatcgaagctttcaagatgattgagttagcttgtatacaaaacaagtatctcacacaagaaaatattttgttgaaggagcatactgttgcactcaagggcattattcgcaagctggagctcctccgctccttgtgcggcgatcccccgtagaccacacctccttcagcaaagaaggggacataatcacttgggtatgggcactccccttggcaactgccaagcttgggggaggtgccccggtatcgtatcaccatcacactcctatctttaccgtttttcttagttcgatccttttagtaatatcttgatctagtagaataaagtttagtatgatttagttttgagttttgctttatgatctctctatgtaatcgagtccgtgagctatatataataaagattagtgttgagtcaagggctttgctatcttgctatgatcttgaggaaatagaaagaaaaaaagaagttcaaaaagaaattatggatagtgataacttcacacatagaaagtttgaggcataaaagttgttgagggttgatgaacgtagccctggtcatcgttgcaactaataggagagtgataaggaaagaggggttcacatataaatatattatnttggacatcttttatgattgtgaagcactaatcaagtatgacat

SEQ ID NO: 33114 - DNA, 555 bp, Triticum aestivum
  Clone ID: PAT_TA_33114
ttttttttttttgaaataaaaccggaaatgtgaacatacaatttctaatcccgtgcctaattaatctcggatgctgaggatttacaaagcactaatgtacaccgaccatgatcatattaatgaccaaaccaaaaacaaggtgctcgccggactgcgcgcgtcaatttccgtcgacggcgaccgtcaccgacgtcgggaatagtacatcgccgtccattcttcgacggccgatgccttccacggccgacaagctcaccgtcgttgcaccgtcaacgtcgctgctgctcaagctacgcttcagctgccgtatgctagggcacagcacctcgtccgcccacgactccaacgacgtggccgtggcggtcgatgctcctgccgccgtccacgcggcaccggccagcctgtccagcacgccggcgtccacgtgcacggaccacccaccactgccggcggcgtcgccgaacttggccgataccacgtcggagacgctccgtttgagaggcccgaagtcgactgatctgaacaccactggcgccttgtcggctcggttgagct

SEQ ID NO: 33115 - DNA, 1118 bp, Triticum aestivum
  Clone ID: PAT_TA_33115
tcgagcggccgcccggggccggtgccgcggccgaggtgagagaactagtctcgagttttttttttttttttgacaaagttgagtcggcccggttcataagttcactatgtagcatctctcgtcaacacggtgacacatcatgataatcatgtgcatgtgaaagtgaataatcatgcaatcatgtaatataatcttatgttttgcatgtttcgcccaattaactatgcaacatccgcatagaaatcctgaattgtaatccgggccgcaactggaatcctcaccaccttctgatcattaccccatgtaaggctgccaaaagtgtaatccccttgtagcttccacacaggggacagtttcacttgaaacatgcgaaccttgtttttcgcatcaaacactagaacaggcggatcaacctccatccttactccgacagggctctggatttctacatggtacacggaatcgacatccccaacgtttgtcactgtccttgacacggtgaccggactccttaggttgggaaccgagatggacggcaagttcaggtggtacgccggtagcattcccgtcgtattgcagtgcacggaggccctcttgacgatggtgcagcggaagtatttatcgtaatcttgtggatcaatgtcgtaaaccaggcctggatcagccgccccatgagggttgatgttgccgcctccgtagtcgaacgggtcagcaatcttccgaggcagcccttccgccagtatcgacatgtcgtgctcatcggttatatgggcggtagtgatgatggctgatttgattgcagcagaggaccagtttgggtgaagagctttcagcagggcaacaacgcctgctacatgtggggcagccatcgacgtcccggacaaaattgcgtgaattcattcctttgccgccaagatgttgactccaggtgccgctatgtcaggcttgataatggcggggtaatcaggcgacggaccccttgaggagaacatcgccacttttggtgccagcatctctttccccgtgacggtgcgcgccggttcgatcttcgccatgggagagcttgcgtcgtccatgtagctcggacgcgtgggcggacgcgtgggcggacgcgtggg

SEQ ID NO: 33116 - DNA, 774 bp, Triticum aestivum
  unsure (1)..(774): unsure at all n locations
  Clone ID: PAT_TA_33116
attcaacttggtagcttgtattgatcgactagggatggcttataaagcaattacaacttggagtaaaatgaaacaactctaactgaatttggagacagcaggaaaaccttcttcgggacgaacctttccatacccaaattcttactctaaattaataataactaggggcaatcgactcctggcgatgccgaatttggtctcctccgtctctggtatgtggcgccacacatgaaaatatatgcgaacgattacacataattcgcacatgaaaaatacttgaatgcaaacagacaaataggtagataaacattactactttaacaacaactagcatcacagaagttgatgtcgcttataacttatcattacttttcctttaggctcttggttcatcttgctcccatcagccttagggaatgaagatattagcttgagctcaaaatttcttaacaaatggctccatatcaccttaatttgtaggtatgccaaggccatgccagggcaaacatgccttccaccaccaaatgttgtgaaagagtacttgccaccaactttgtcctcctctcttccaggaccaaaccgatccgggtcatacagatgagggtcactgtaaatgtgtgctagcttattgttgagtgccgtagggactacaacattatgccccccaggtatgtcatattcctcgccttccttggtatgcaccctgaattntgtatgtgccttgcgaactaaaactggtgctgatgtatgcattctaattgcctccctgatgca

SEQ ID NO: 33117 - DNA, 1187 bp, Triticum aestivum
  Clone ID: PAT_TA_33117
cgggtcgaccggggatgaaagataatggccattgatgtctccattaccatcatatggatatggaagagagcgcaagggacctcgatatgggagcctcatacatggtcaagacctgaaggatgtgattataaccggtcataatggcactataaatgggcaaggccaaagttggtggatcaaatttcgcaagaaactcctcaatcacaccaggggtcctcttgttcagctcatgcggtcaagtaacattactatttctaacatcacattacgtgattctcccttctggacacttcatctatatgactgcaaggatgtcacagtctcgggaactactattctggctccaattgctggggctccaaacaccgatgggatagatccagattcttgcgagaatgtgatgattgaaaattgctatatttctgttggtgatgacggggtagctataaagagtggttgcggcccgtggggaattgcttatgggcgtccgtctactaacatcactgttcgcaatgtcataatccgctccatggtcagcgctggcgtgtctataggaagcgagatgtctggtggtgtctcaaacgttttggtagagaacgtccacatttggagttcgcggcgaggtgtgaggataaagactgcccctggaagaggggcctatgtaaacaacatcgtctacagaaacataaccctagaaaatgtccgtgttggcatcgtgataaagaccgactataatgaacacccagatgaacggtttgacccgaaggcagttcccgttgtcggcaacatctcgtatacgtcaatccatgggcaaagggtgcgggtacccgtcaggatacaagggagcgcagagatccccgtgaggaatgttactttccatgatatgtcggttggcatacttgacaagaagcaccatgttttccagtgctccttcgtccaggggcaggtcatcggctatgttttccctgtgccctgcaagaacctggacctgtacaatgagcggcgcgagatggttaaacaatcgacactgcagaacatttcagatatcgactacagtttctgacacggtggttcttttcactgtattatttaggagtatccagtgatgagcttagtcttgttttactgcatacacaggaaattttggttgtagctgtttacatacccctctgtctaaggcatgtatt

SEQ ID NO: 33118 - DNA, 938 bp, Triticum aestivum
  Clone ID: PAT_TA_33118
tgggacccggacgcggcgtcccgaaacagcagtcagtagacgacactgaatcgccgcgacttcttccgcggtgggtaccctctccggcggcctccttccccacgctgcacatcgccggcgacccttccgaaccgcccgcctgctcccgccgcgctggtctaggctccaggtcaacgcggcccgtcatcgccgcccggccactcccccgcgcgcccaggagcgctccctccccacggtacctgccgggatccggactcctacgtgctcgcggccatcctgaggccatggagggtgtcgcacgtctcgtcgggtttgctagaaatggggatcagaggtgtgacggtgtccgatgtgcggggatatggggcgcaggggcgggtcgacggagcggtacgaagggtcagaattttcagaagatacatttattgctaaagttaaaatggaaatagtcgtgtgcaaggagcaggttgagccagtaattgacaaaataattgagaaggccagaactggagaaattggtgatgggaagatattcttgatacccgtcgcggatgttgtaagggtacgcaccggcgaacgcggagtgcatgcggagaggatgatcggcggtctgtcagacaaactgcctccggtgatcacaatctcatgagtagagcttgactgctcttgctgcctgtaactgtaagcgcatccctcaggctggttgcttgtggccgtgtgtgtcttgacctttggggaataatgtgtatgtaactttgcgtgttggcacgaataaattggcaccagcatccatacggcgggtgggtgttgttgaatggggtggttactgtggttcgtgtgcggaatgcagtgattgcaaactccctcctggtgagaaggtgctggatgtaacctgtgccagttcaatcctagtttcaatttccttcaaaaaaaaaaaa

SEQ ID NO: 33119 - DNA, 885 bp, Triticum aestivum
  Clone ID: PAT_TA_33119
tccgccccccttccgtcaggagtcgggaccggctcgcgccgctcttctccggcaggcgcggtatcgccgatcgacagccgcccggcgtgccccagagcggagcgggccgctctacgggagcaggagcaggtcggatcgagccatgcggcggcggtccgcgaccagcctggcgccagcgaccggcaccatctactgctgcacgcactgcgactcctacctcacctgcgcccagcacatcaccgccacagatgttccgctgaagagctgcggcacaggcctacctcttcgacagggtatcaaccgtggtcgcctgcgcgactgaggacgcccggctgatgactacgagccggcagagcatccgcgccctgttgtgagtcggctgcggcgcctgactaggatgggaatacgtatctgcatttgactattctgaggaggtataagaaccatacgtgcatcgtggtgcgttgcaacctccattagggcggaggcggccctcccgaccgcatccagctgtgggatgagcatgaccctcgcataaggtgccgcgacgacgaagagcagggcgccgtgtgacgtggcaaaggcaatcataaattagttgataagataagcagaaatgagctgtgtgtcattactagtcttaaccagcgtcgttccgtaccctggcactgcaaaccatatagttgatcgctatatgaataaccatgattgcttatccatccgtacatatgctaccggctcggctcgatgtagatctatgaatgtgtatctatctagaatgagtctcccatcaggaaccaagactaggttgtctgttcaagtacatataagaatgcgtgcccaccagaataaagtcttcatcagttttagtactgatttggttaa

SEQ ID NO: 33120 - DNA, 504 bp, Triticum aestivum
  unsure (1)..(504): unsure at all n locations
  Clone ID: PAT_TA_33120
aatctgtgagttatggtatcgagcctgatgaagaaggctcagctggactacgccttaccgcaaggggctccgtcacaacctatacttaccgcgtggacacggacggtcgcacacacttaaactcggttgggtggaagagattccccgatggcaagaatcttcgtgttggacaggctatcctaattactatcaggaacacccaccgcccaggcttgaggatgatgatcgtatttgatatcatctagaactatatatgtgtgtgtggctatatcatctagaactacatatgatgatcgtcgtcgatatcatctagaactacatatgatgatcgccgtcgatatgaccttgtactgcatatgatggcatgttgactatagatgttatactgcttgaggatgcctgttgactacacatgaaattgttatctagtactccaaccatcccaaattactcgtcgtggttnaactaaaaccacgacgagtaattggaacggagggagtacta

SEQ ID NO: 33121 - DNA, 778 bp, Triticum aestivum
  Clone ID: PAT_TA_33121
ttgaaaaaacaaatcttcagcattgaacttttctcttaagatcagactcttattcataggcagtgatatttagctcggtgcacatcaaaacctaaccaaatattcagtattgaaccttgtgctgagacaggacatcatacaaacttgtgatcgccagcatgccagctactactatatacacacaactcattattcattaatctatatacacatgaatcacactttccacattatgcaacgcgttcttggaacaggcaactgcaaacagaatttagaaggaaacaatcaaagcaaagcaccagttatgcgtgcagcatgaaacatcttccgacatggttgctaagtgatcacaggctcggcgtgaaccagacctccgatggacagattgttccataatgaccaccacccgacagaaaagcatcctccagcttccgacttctcaaatcatagaccttcacaccgctccattggttatggcgatgctcgacgtcccccctgagacggggagtcgtgaagtagatacaatctggccttacctcggggaatttatccacggacaatataccccggctattctgaccaaggaacgccgcgtgtccccttagagccttcgcagggcttactcccaccatttggctgctcttgagatccaatctgtctacatcaaccctgacgtagtgctcctgatacttgtcgaggacgacacgaatctgcagaagatgtccccagggagttgaaactaggtatctcgtgataagttcaaaaaagtaatcatctc

SEQ ID NO: 33122 - DNA, 911 bp, Triticum aestivum
  unsure (1)..(911): unsure at all n locations
  Clone ID: PAT_TA_33122
gattatcactctctttaggctcattatttaggaaaaaaatactttgttattgtcgattctcaaatgctttgatcgcctcacaaagaaaaaatatttcttcaaaaaacctttgaagttatctggctatgttgaggaagccctcgaaatctctggctcagatctgtttcagatatttcttgaaccagacccccatgttgaggaagctctcaaaatccgaccgcggtatgtcgatttcgtgcgtgtcctctgggaacatgatggttttgacctcgcctcctctttctctcagagcccttgcatactgtaggccattggacatgggtacccggagatctgctcctccgagaagcataagcaaaggtgctttcacttttgaaatatgggcaattggtgatttctggtggaagattcgaagatgatcaagtgaaggtgattcagaggcgagacgcctcgcttcagtcccgcaggccacggcgtagcaccagtctgggatgtctgtggtcccaatcatcagtgacaggttacagaccgggtttcgagccgccgccacagcaaatctctcaggagcctgcccaatcaagtgggttgtcaagaagcccaccgtgcgagatcccaacaaccgctactctggatgcatcccnaccagcccttcctcgatcacgtggtctagtgccgcaagacaatcttggacatcctgagatccaaccttcccagggagtgattgcaaagccttcctccccgttgcccgcctgcctctgtaatttacaatcagcagattaaacccaagtgacgcgagaaacgccgatgatttcgagtagcttgagacagatgctgagtgtgggccaccatgaagaattaaaacagttggtttctgtgaactatcctcgcaggacacaaagatggcctcaaat

SEQ ID NO: 33123 - DNA, 667 bp, Triticum aestivum
  unsure (1)..(667): unsure at all n locations
  Clone ID: PAT_TA_33123
cgccggaaattctgaaataaattcaggataaatgcgagcatcaggacttaaaccctagtgggttcgggataccacggtcctcctaaccatccaactacatgttggtttgacgcatatactgtacctacatatagttatacatcgtacaatacgatcccatcgcgtatatacataagcgggcctactcaatcctctacgtttgacgtggcagcagaactaggatactagcacgtggtgggtccgaagccaacgtaaccagtggcggagtcgacggtgatctggatcccctgctgctgtatgttgccgaggatggacagccccgacgtcgacgccgcgaacgccaggcagtacacgccgccgcccatctccaccagcaggttcctcgccggcagcgtcagcgccgcgccgtcccgcccgaagtagagggccaccgtcggcacgcgcacgctcgcgtacccgctcaggtcgtagcacgtgtccagcagcgacacgcccggcgcgcgcgggaggccgccgccaacggcgtccgcgaacgcgtctcgcagcgcggtgtaggcgtccggcgggagccgcgtcacggccgtgccggtgtccaacaccacgccgncgccgncgtcctcgatgaggtcgaagagcccgtcctgcagcgggagcctctcgccgccga

SEQ ID NO: 33124 - DNA, 1725 bp, Triticum aestivum
  Clone ID: PAT_TA_33124
cccacccccctgagccgttgacccgcgccggcctcccattcctccgccccgcccaccacgccgcgaggagcagcagcagcaggaggagatctcgggaggcggcggcgcgcgagatccggcgtcggagcggcggcggcctgattgattgattggttggttgatcgattgatcggttgactcgacgatggtgcgggagaccgggtactacgacgtgctcggggtcagcccggcggccaccgaggccgacatcaagaaggcctactacgtcaaggcgcggcaggtccaccccgacaagaaccgcaatgaccccctcgcggccgagaagttccaggaactgggggaggcataccaagtacttagtgaccccgcacagcgtcaagcatatgactcatatgggaaatctggtatttcaacggaagcaatgattgatccagcagcaatttttgcaatgctatttggtagtgaggtttttgaggattacattggtcaactggcgatggcatccatggcttcactcgacatttttggtgaagatgaaaagattgatgcaaggaagttacaagagaaaatgcgagctgtacaaaaggaaagggaggagaaacttgcagagaaactgaagaatagattgcacatttatgttcaaggaaacaaaaaggagtttatccaggttgctgaggctgaggtggctagactttctgatgcagcatatgggattgatatgctgagtactatcggttacatgtattcaagacaagctgccaaggagcttggaaagaaagctagtccttttgggggttccttttatagctgaatggtttaggaacaaaggtcattttattaaatcccaagtgacagctgcaacaggtgcaatagctcttatgcagttgcaggaagatttaaaaaaacatctcagttcggaatgtaattacactgatgagcaacttgaagcttacatgcagagtcataaaaaggttatggtggattccttatggaagcttaacgttgctgatatagaggcaactctgtcacgtgtctgtcaaatggttcttcaagagagcaatgtcaagagagaggaagtaagagctcgagctaaaggattgaaaactttaggcaaaatattccagcgtgttaagctcaataatgaaggagaagcagcaacaatgaagcatacgataaataatttggatgataatgttggtacctctccggattcatcaccaacatctcccagggtgcagccattcgatgcaaacccaccatattctcagagcccatatgtggaggcccctcggttcggcggcacacatagtccgttcaacttcccgatgcctaccgctccgcctggtgcgcagaggaatcctgtcccatgacccgatccagggccaccaactttttttttccgtgggtcatcttttttgtacaatattattgcttgtgttagtagatgatcacatggcgttcatttgtgccactagtatagtagaacgaagaagcagctgggtattatcaatttgctttcttcggatgtataatcgatcgattaaaatgatccatacgtcgacggggtccccgtgttgtgtacaggcgtgtcgtgctgcttctgatgggttgtcggggcagcgaccggtcggcattgttgtatacataaactatatcacatcacatatattttttccttgtgtctatgggcgcataattgttttaatctatggcccatttgtgcag

SEQ ID NO: 33125 - DNA, 1260 bp, Triticum aestivum
  Clone ID: PAT_TA_33125
ccacgcgtccgcggtgagctgcatttggctgtgcggtttacttgcacggcatgggttgaacatgatggcaatgtatggccgtccgctgctgccgaagatgcactactcacagccaatatcagtgatgcagttggactacctgaggcaccaggcgatgcagattgtttcggcaaggcttagccgtgctgagcctcctctgcggagggaggtggtggagtacacgctcgatgtgggctctcacatgttcagtctccggcgcagcaaggccaacttctatcgcatcacctctctgttctgtggctttgcctcaatggccaagtggtatgatggcatcaggagctggcgaaacccgatcacaacaatgctggtgcacatgttgttcctcatactgatctgctacccggagctcatcctgccaaccatcttcctctacatgtttatgattggactgtggaactatcgcttccggtcaaggcacccaccacacatggataccaagctatcgcaggctgagtttacacaccctgatgagcttgatgaggagtttgacacattcccatccaacaggccagctgacattgtaaggttgcgctacgacaggctgaggagtgttggaggtcgtgtgcagacggtggtcggggaccttgcgacgcaaggtgagagagcccatgcgctgctgagctggagggaccctcgtgccaccgcaatctttatattcttgtccctggtggtgcccattgtgctgtatgtgacgccgttccaggttttgctggtcatcactatgctctacttgctgcgccatccccggttccgcagcaggatgccctctgtcccgttcaacttctacagaagattgcccgccaagtccgattcgcttatttgaggccagagcattcgacagaagataaaatgggggaaccttgtaacattgtcctcctctctcattctgttccttctggttagcatcagatcagatgtgaatatacttgatgagttgattaatttagaggcagctggtggccctgtaataaggtgtcggtttatatgttggtctgcttagctaggcagaaaacgaagggaatgaccgggggttcccttcatagttttggatgaaaaatgttggctttgggatttctggtgtagagctgggcacaggatgagttccagaatgttatgtttatgtattggtgccagttttgttgatgttctgttaattccgttgcgttgatcgatacccaaatcgccctaaaaaaaaaaaaa

SEQ ID NO: 33126 - DNA, 767 bp, Triticum aestivum
  unsure (1)..(767): unsure at all n locations
  Clone ID: PAT_TA_33126
gnggttgcatatttccagtggcgccaaaaatgatagcgtccgttctgcaaagattgatacaaggtatcatttagacttgtgcaaaaatgtttttggggaaggagtttatcctgatgtgtccatgacaaacttatactatggaggcacaagaattgcaggttctaaaattgtttttgcaaatggctctcaagacccatggcgccatgcttctaagcagaaatcatcggaagaactgccatcatacttaattgagtgcagcaactgtgggcattgcactgatatctccggatgccctcaagcaccctcaaatattggaggtgattcatccaaatgctcatctccagaagcagtcaacaaggtaaggaagcagatcgtggatcacatcgacctgtggttgtcggaatgccaagaccaaggacgcgacacggtgacgaagcaggggagcagatggagcatagctacctactgatcacctgtgcaggcgaacacgcaccatattgctgttatttacacgaataatacaggcagacagacgaaacaactacgccatggcggccacgaaatcttactactggggagtggatatgagactccttgtgttgtgtaccttgtatggtcagggatgttatacgtgcagagagtgatatatactacgtgtatgtaaccggattgcccactaaacttactagatacgggtgcagagagtttgaaaatacctgaatatatgacttgggaagcatcttctgagaatgtatgaccatgagagc

SEQ ID NO: 33127 - DNA, 1680 bp, Triticum aestivum
  unsure (1)..(1680): unsure at all n locations
  Clone ID: PAT_TA_33127
gttcaccggacccctcggcaaccctcgccgccctcggcctcgcatccggtgacctcctctntttaacgctctccgaagagttattatggcagccaccgcctcntaaaaaacttccccggaaccctagcccggatacagcctccatcgggcaaattgcttccggttccnaatctcctggggaggccggtggatcctcgtcaccgccgcaaaatctaaacatacagcctgtctcttcgtngctgccgcaaaatctaaacatagagcctatctcttcgccgaggccgcgagccctccacgtggagcctattttgcccgtggcatctgatccgcccgatgtgntgatggcggaggccgtccacgcacccaagnagcttgtcgagccttgtgattgggattctcaagcgggagatggaggcggaggatgctggatgcgcaaatggtacagttatccatcgcctagctgtgtccctgcaggcagctcttgtcgatgctggcttccttgcggagaatccgatggggtctcgccccagattgctgaaggactgggcctcgggtgcagcggcaacactgaccgtaaagtacaccctaccggagcttgtcgccatgctacctgagggtgaagaggggaagacagtggttttgaactgctcattgatgccaaattttgtgatgatatatgggtgtgtgcctggggcatgctcagaagtgcgcagattgtgcttggagttaccaaagctggcgccgctgctatatctggatagcaatgaagtgggtgcaacagaggagaaggagattcttgagctttggagggtgctgaaggatgagctgtgtcttccgctgatgatatctttgtgccaactcaacgggttgcgcttgccgccgtgcttgatggcattgccaggtgatctgaaggctaaagtcttggagtttgttcctggtgttgatcttgcaagggttcagtgcgcatgcaaggaattgcaggatcttgcagcagatgataatctttggaagatgaggcttgaactggagatgagtccttctagcaagggttctggatggagcggagattggaagcataggtttgtggcagcttggaaggtggacaacagtaggaggcatcacaagagaccacccagcccaaggttttcgggctatggttgggggatcggtacacgtaacccacttaacttcccagtaattggtggtgattcggaccgtctgccctttataaatcacaatatccttgggcgtagttttggaaatcagcggaggaacatctcgcccaactgcaatttcgagggtcatcgccaagggtttccttgatttaagttttcactagtatctcaagtatgcaatgcataggctgccttgtacatgtttataagttgcatgccagtgctcttatcctcgtgaacttttttgtctgtatcttagatcctatgtcttgtcgttttccggttatnccttgctatgacaccaaagtacttctgctctgatctagccaacgccatgatcaattatgtataaatagtttggacttatggtactgagagcttactttgctctctatacatgttcggtatcaaaagggggccgtaccaatcgcctaagnagcgatagccgcnatgcgcgttaaacgcgtactggaacctgngtaccactaangctnagaatcccttn

SEQ ID NO: 33128 - DNA, 531 bp, Triticum aestivum
  Clone ID: PAT_TA_33128
tgttgatatgtctgcatcacctgtgctttttcatgtggtttgcatcttgagagaaaacgtgaggtttgccatctcttattttctgctgtttttctatgtgcttagataccggactcagatcttaggggttcgcagctggtgctgatagtcagatgggtcaaccctttgcagcgtccgcaattgctctggagtcaaatggtttaaccagattttccgtttcaaatgtttttctcagaaatttgaattcttctttctcttcctactggcaattgatgatcagatatcctacactcccaatggacaattccatgtgtggactaacaatctccgcttattatctgatgccttgcattagaatgatctaatgtcttcttttttgttttatatagggttgcaaatgatatgatatattctatgctctctgcactattattttgactctgaattaatttgtttgatggctgtgattgagtgttacctgtgcttccgataaacacggttgaataagaggatccaaaaaaattcttgtcc

SEQ ID NO: 33129 - DNA, 630 bp, Triticum aestivum
  Clone ID: PAT_TA_33129
aaagcacataaggtttattagctgggaacacagatcaaaggcccccaaaagagggacagtagatccaccgccggtggttatgagctcatatctatggattaaaggagagcaactaaaatctacaaaaacaaaaattgcattccaacttgtttagtttgcactgaaaacttcacattagcctgcctttgcacatatttactgaatttacactttggacgacagagatgtgcacaatctctccggcactaggaaccttccctagacgatgacgtatatatacaccggcacgttcgatcggccgtattccacacgtcggggtcaagcaccgccgccgacggccggcagcgcgtccaatcagctcccgtctcgcacgtccgtacgcagctgcgaggaatcagcccggcagctagcttcgagtttttgactaatcccccgtcgctttcgtctcccggtccggtggcgattagtcaaacccaagaaccggtcgccgcgggcgcgagcgcaagttccacccttcttccacggctagtcatgagtcctcgatcacgggtcaccgcgacgtctggctccatgcccagggagacggtgtgccgacgacggccgcggcgccggagaccgggatgcccatgc

SEQ ID NO: 33130 - DNA, 574 bp, Triticum aestivum
  Clone ID: PAT_TA_33130
aacggccggccgggactgtacaatccaaagttccaaacgagagctaagcgacacgtgagttgtttggtctctagctacaagtcgacattggtgatgggcccctcgaaccagaacctggcgttgacaacccatgcgccgacgctgagcagcagcacgccgccgacggccaccggcgtgtagttgaagttgtccttggccaccgggtacgccaccggcagcgagaagagcacggtgaggaaggccacccataggacggcggcccagccgacgaccaccccgtatctcccgaggtggaacggccccggcacgaacgacctcctcgccgtcgtcacccggaagaagatgggcagcgcgtaggcgatgtactgccccagcgtcgcgatcgacaccatggcctggaacgccaccgcactccccagcgacgtgagggccatgacgaaggcgacgacgacggagagccagacgacgttgaggggcacctcgttcttgctcacccggagccacacgcgcgacaacggaatcaacctgtacctcaagaaggcgaaccccatactagagatgctggcgatgcaca

SEQ ID NO: 33131 - DNA, 1068 bp, Triticum aestivum
  Clone ID: PAT_TA_33131
gctcgtcgaacgcacccgtccaggaaaaatctcttgccgcacaccgcgtccgcgaccgtgacctccctgcccgacgagcgctctacgatggcatctcaggattccaagcccgcgcaagtcccggccgccgccgagctgacggccccggcggctgccgccgcaggggaggcgccgaatcccacttccccgacagcgcgcccaaaaccctagcgccgccgccgccggtggggcagccacggatctagagaagaagatgcgccgcgcggagaggtttgggacgcaggtggttatgtccgaggacgagaagcgaagcagccgcgccgagaggtttgggactggatcttctaatgaaaagatggtacggaacaggaagaatgaagtccacgggctgagacggtttggaccttcccgcacgcccatccgtctgattggatacctgagggcaaagaaaaaaagtccccgcttagaagcgatttgggccagaggcaagggacgttggcaaggcaggagaagcaagtgcgaaaggcgagggcccttacgtttagccggacaagcccctagtgggtcatctggcaggaaaggacaaagacacctccaagccggacgtcgtctaccgtagctccgcacggcatcatcgaagacagccctggccttttgagggtcgtctcaaacacgcccctcgagacgtcggtgaagccgtagtttgtacaagactaacaacgccaatggggtcgatgttgtcggagccattcgtgtgctgtttactgtgtatcgcttgatgacttccttgctgtactccgctgtgagccatttgagtgctgtttaccgtgtggcactcggagtagttccttgctgtactcgctggcagcatagtttgtttgtggttctgcctggtaacacctgtgtactacagtacttcgtttccctttgtagtgatactacttcttagccatgtgtgtactcgtgtctgtttagtttttgtgcttgcattattcgattctgatgcatgctatatgcgtccacggtaaaaaaaaaaaaaaaaaactcgagactagtctctcttctctt

SEQ ID NO: 33132 - DNA, 1727 bp, Triticum aestivum
  unsure (1)..(1727): unsure at all n locations
  Clone ID: PAT_TA_33132
acgaaaaggcgaagtctagaagcaggantggtaacgcttcagtaccacactgcactacgttgggtgggttagcttgagcgactgatgtccatctgacagctacagttgcatctttgataaccagcgagacttggtatttacacaactaacttcgactcaagtgcggccgcaacatttgcatctccaaggtcctccatcccccatttgatgtagtcaggtgattcgcaagccttgtattcgtcaaccaggccctctataatttctcgagattcgtcgaattcagagagatcattgtccgcaaacatcgggaacttcctgtagttgtcaagaaaggcttgctttttcctcagcttttcatactgccccagacatttgctgaataagtgacggatgctagtatgatttgctaacatcaaaccactaaccctgtgggtggtttgaacatatggtgattttcttgacaatgcaacctgaatgcttgcaggtccccactctacgaagttaacaagcttcctttcacgtatcctttgtaggctctcatggacctgtgttgggtccacctctccttgaatgatgttaagtatggagatgtatttagcctgactagcttccttggtacgagcgtaagatgacaccattatgttcttcgtctgcagaagtcgtctcataacatctaataccgtcgtcttgcgtatcatgttaacctgtcgttcgacggtcaatggagtataacctgtcataagaaaatggcaccttggagtaggaatcaaggaggcaagaaggccagccagatcattattcatatatccaggatacctcagggtggttgtgcttgcagacataacagtggaaacccaaagagtttgtttgtgcaaaagtaggatttgctaaatgaagacgttcaacagcaattctgttaagagccgtattgtcaagaacaaccacacagtcagcattcagtgtcagccgcttcagagttaaaagggagttgtatggttggacaacaacatcactcgtttccatctggtttggaaagacactatatgtctgtacaagcttcttactgtatcgatcatttagggtctccagcacataagaacccatacntgaaccagttccaccagcaatggagtggcataaaacaaaaacccctcaaggctatcacttccatctgcttctcgatctaccatgtccatgatatcatcaacaacttgttcgccctgatgatatccactagcccaattgtttccggcaccaccaccatggctcagacaaatatatattctcatggttgaataggttcttgtactcgctgttctgtattccattgatcactcttggttctagatccataagaagagccctgggtatgtagtgctgatcatctgcctggtagaaaaaaacatctttcctgtctcctccctgcgtggcgaagtcctcgaggaggccgtccttgccgatgccgtgctcgaggcagagctgcttccagaactccatcccgatctggttcccgcattgccccacctgtatcgtgatgatctcgcgcggcatctcgtcgtcctcctcctgctccggcggcggccgatgccgcggctagggttaccgcctcggggacaacgggggagggcggggggctcggccggcggcgcggtggcctagggttttggggttgcttcgtttgggcgcaagggctggctgagccgtccaccaactgcgagtgccgggag

SEQ ID NO: 33133 - DNA, 741 bp, Triticum aestivum
  Clone ID: PAT_TA_33133
taacaagtgagcacaaaatatggcttccactgcacaattgtctttaatttcaccatccattcaaaattacagaccaagcaggtaaaaaggagcactgcatgaatccactgcaattgtgacaacgcagcaacccccagctcaagaactaaagctaatcgatacatactgatcgccagtggtgtgaacttggcagcttcgaggcaggaggagctccccagctcgcggcgcgccggcggcggaccggcagggacgacgccatggtgccgcagtaatcgtcgttgcgttcgctgttgctgaaatcatgaagacctccgccgttgatgtcgcccaggcccagcattgctcgcagagccttccgcgccatgtccttgtgaacgcccgggtccgcttgctcggcgatgaggatgagcggccggtcggcgccggccgctctggcaagcccacggaaccgcgggctccccttgctcatgtcgtacaatgccgcgacgcagcattcttgaagctccgacctgtgtgcgtcgttggaaaggatgacggagaacgtcgccacggcgccggcgtccatgagcgctgtccggccctcagcgcaggcggcgacgttgcagatcaccatgagggcacaccctcggaaggggaaagggctcgtgggaatcggaggagatggagagcaggttcttggcggcgcccggggcgcgcgcgagcttagactggtaacggcggcgagggagaggtggagcagag

SEQ ID NO: 33134 - DNA, 817 bp, Triticum aestivum
  Clone ID: PAT_TA_33134
gtcatagcatagcacactagcaaagcgtgattcacgcctcagcaagaaaaagcaagacgtcccatggagatgcaaagggtggccatcgtcggcgccggcatgagcggcctcacggcgtgcaagcacgtgcttgagcgcggcttccggcccgtcgtgttcgaggccgaggcggacgccatcggcggcgtgtgggcgcacacgctcgcctcgacgcgcctgcagaccccacggccgcagtacgagttcacggacttcccgtggccgccggaggtgccggaattgtacccgagccacgaccaggtcatggagtacctgcgctcctacgcgcgccacttcggcgtgctagagtgcgtcaggtacggcagccgggtcaccgctctggagtactccggcgccgtcaacgaggaggagatgatggcgtgggagcagtgggccggcaacggcgaggcgttcggcagcggtcggggcgagtggcggatcaccgtgcagcacggggacgacgtcgagatacccgtggccgacttcgtagtgctatgcgttggacggtacagcggcatcccaaacattccaactttcccaccggcgaaagggccagaggcctttaatggcacggtgatccactccatggattactccaacatgaacgatgcaaaagccactgagctcatcaaaggcaagctcgtcaccgtcgtcggctatcaaaagtctgctctcgacatcgccacagagtgcgcaaatgtgaatggtccgacacatccttgtacaatgattgttcggacaaagagatggatcatccctgacttatatgcttggggtg

SEQ ID NO: 33135 - DNA, 1025 bp, Triticum aestivum
  Clone ID: PAT_TA_33135
ggggacagcttctggcacccatccgacaccatgctctccgggatgcgcatcagcgtcaacgccgaggtcagggcgcaggtcaggggcccgccggagcggatgctcttcacctcctgggccagcgacacggacccctcgccgggccggttcgcgctcggcctcgacccggccaaccccagccaagccttcatctggagagacggaaacgttccattctggaggtcgggccaatggactgggctaaattttgtaggaattccatataggccattgtacgtgtatgggtacaaacaaggaaatgatccaatcctgggaatgtacttcacttacactgcaacaaatacatctctgcagaggtttgttgttgcgccagatggcagagacgtctgctacatggttaagaagtctacacaggagtgggaaactgtgtgggtgcaaccgtcaaatgagtgcgagcgttatggtgcatgtggttcaaatgcgatatgtacggtggtgcaagatgccaaggcaaaagtttttcgcatgataggttttaagccaaagttagcagatgagtggaatgcaggaaatcggagccagggttgtgttagaaacccacctttggactgtcaggtgaacaaaactggagatggatttctctctatcccgaatgtcaagtggccagatttttcatactgggtatctggtgtgaccgatgagtatgggtgcatgaatacctgccagcaaaactgctcatgtggtgcctatgtctacatgactcaattgacggggtgtctacattggggtagtgaactgatggatgtttaccagtttcaggctgggggttatgccctaaacctcaagcttcctgcttctgagttagcaggttcacatatcgcagtttggaaaatagccacaatagcgtctgccgtggtgctatttgttttgttagcttgtctctttttatggtggaagcgtggtagaaatatcaaagatgcagggctcagaaggtgggggaggtcaagacgtgtatgtaccagatc

SEQ ID NO: 33136 - DNA, 2135 bp, Triticum aestivum
  Clone ID: PAT_TA_33136
gcacgagggcacccttccaatcagaaactgatagggtcccaaggtcagaaaatcaaaatagaaaccataattttaattctgactctccgcccttcgagcaatatacaaataacagtcatgagacagctcctggtttcagcacggacaagaagtcaattgacatgctgacagaggcatcagctgccgaagctgaagctgttagtgctgtatggcgagctgcaaaggaagcatctcatgcatcttcagaagacagtctttcagatggaataggatctgagtcccctctcagtgaaacttcaccaatggctgatgatttagatgaggcgcgcgccatggaaccagatgtgaagttgcattctagagcagttgtagttgctaaagaagcagtaggagatttaggatgtttggtccgacagctttcacttgatcagtttgagaatgaaagcagaagaatgcatcccgcgaacaatgatcaatcatattcatcgaagaaagcattaaatagacaaaggtctccacaaggtttgcataagaaggtcatctcgctcttattgaggccaaggaattggaatgctccagctgataggacctttttcctggactcttatgaagttggcgagctatgctatgccgctgaggtgggttttatgcaggaaccaactgtcttacaactaaaagcaccagttaaagtatttggtgatctgcatgggcagtttggggacctaatgcgccttttcgatgaatatggttatccgtcaactgctggtgacataacatatattgattatctcttcttgggagactatgtcgaccgaggtcagcacagcttggaaacaataacattacttcttgctcttaaaatagagtaccctgaacatgtccacttgattagaggaaatcatgaggctgctgacatcaatgctcttttcggcttccgtcttgaatgcattgagagaatgggtgaaagtgatggtatatgggcttggactagattcaaccaactatttaattatctccctctggctgctatgatagaaaagaaaataatatgcatgcatggtggcatcgggaggtcaataaacagtgtggagcaaattgaaaaaattgaaaggcctattacaatggatgtcggatctattgtcctcatggatcttttatggtctgatcctacagaaaatgatagtgtagagggtttgaggccaaatgcacgaggacctggcttggtaacatttgggcctgatcgagtggcagaattctgtaaacgaaacaaattgcaattgatcataagagctcatgagtgtgttatggatggatttgagcgtttcgcccatgggcagttgatcactttattttcagccactaattattgtggcactgcaaataatgctggggccatacttgtggtgggaaggggactagttattgtcccgaagttaattcatccacttccaccacctgttaattctcccgagtcatcccctgaacgtgccatggatgccacatggatgcaggaacttaacatacaacggccacctacaccaactagaggacggccgcattctgctggtgacaggaactctcttgcttacatatgatacatagccgaccccctccatcttcttgaccctgtatgtttctcgtcagaaatttctttgccagttgcaaggtacatacattatacctcgggacagccagccaacagagcatcatggactcccaatttttcgagacattgcccggtagttaagttgatagtgactcatcagtgttcagtgcagtcagcccctcattgggaagctacatacataacagttctgaagggaagaatggaatgttgtcagataattgtcggagagcgggagtctgtgtgtatcgttgtcgcggtttacctgtaactgtagtgttgtacatggttagatcagccttcatccagagcaagaaggcttgtaatgtgttccgtataccgtgttcgttaccatttaggacgctgcttgcacagcgcagctatacaagttttaccgagttagattggctggaggaaaattacctcctcgtgatgttgtaactgaagtgtgttgttgttgattaaatttgttataggaatgattacaataaatttagtttaaaaaaaaaaa

SEQ ID NO: 33137 - DNA, 1146 bp, Triticum aestivum
  Clone ID: PAT_TA_33137
ttttttttttttttttttttttttttttttttgaaatatttgtgttaggcattatgtacagcaggatattacactcgtttacatatcgacggggggaatgcacatttcaaacccccccccccccccccccccccccccccccccttctaaatgattacaatcttacgctacattgacacaataaattttcattctagttttcgaattcctcttcaagccccaaagaataatgcggcacagttacagaaacagcaacaaaaggtggtcggggaagatgtacaatgtggatagatatcggaaccaaaactgatcctaggtattatgatgacgctgatcgaagttctaccagtgaagcgtacaccccatcttttatgttcatcagcacctcgtgtcttcctttctcaactattgcaccatccttgagaaccgcaatgatatcagcacctttgatcgttgagaggcggtgagccacaacaaccgtggtcctgccgaccatcacattgtctaatgcatcctgcacaattcgctcggactcagcatccaaggcactagtcgcctcatcaagtagtagtatcttagggtccttcaatatggcccttgcaattgccactcgctgcttctggccacccgacagctgtatccccctctccccaactgtggtgtcatatccttggggaaggcttgatatgaactcatgcgcattggatgcctttgcagctgcaatgagctcctcctcagtaacttccccatccttaccataggctatgttggcacggattgtatcattgaagagtacaggctcttggctcacaagtcccgcttggtccctcaaccaattgatgtttaagctcttgatttccactccatccaatgagatggtgcctgaatcaggattgtagaatcgctccaacagtccaattaccgttgacttgccgctaccactctctccaacaagggcaacagtcttgccagagggaatgtgcagggtaaagtcactgaagatctgaatatctgggcgggttgggtacttgaagctgacatgctggaaatcgatgttgcccttgacctcatctaatgtcaaaccctcattgcggcttgagtctatttcagactttcggtccaataaagcaaatatggaaatagctg

SEQ ID NO: 33138 - DNA, 997 bp, Triticum aestivum
  Clone ID: PAT_TA_33138
ttttttttttttttttttgagataaaaactattttattggtgaataagcacgattttatttattagctgggctacttccacgacaacaataaagtatgcaaagggataatctttcaatgttgcagcagccaccgctagtttgacgcagttcgtcagaaatacaaacaattggttattattctagttcctcagattgacacctgcataatctacaggttcatagggaatcagccagtcagccagaaatcccttcttcctcctaggctcacagcccatgtccttgcacagctggtcgttgtgccagataccgatagaagcaacgcaagatcgacggaagtagtcgcccgagtagcgtttcatgtatgcctcccattccttcacattttcctccattgatcttatggcaggcaaacaaaatcccccatcaaggaaatgcgccagccatttggaccgtatctccgaggtgtgtagatctcccatgctctcagagtagccaacgattgctagctgaggaatcctggggtgaacgcatagcctgtagagagggaccgcagtagctggcgtgccaacatcgatctctctgaacagaggtgaggcaaacaactctctgagcttctgatccccattgtacccggtcgcaaagatcacgacatcgctcttgatcggtgcgggctcgccttgtacgatgacaccttctttgcagaagctaaattcgtttgctttcttgaggataatgcttccctgctccaccttgtcgtagaatttgtctggcattattgcaatcagccatgagctgagagcttgaaagaagctgtgttccggcaccatgccatgcttcctcatgggcaccgcccacatgtagtagctctccacaaactttgagagtatccatctcaggggtgacaagaaggtagccagcaggctaaggagcagcccctctcctggcttgtgaactagtagttcggacaagcgattgaagcacaagaaaggaaccggg

SEQ ID NO: 33139 - DNA, 850 bp, Triticum aestivum
  Clone ID: PAT_TA_33139
catgaacagccagaaatggcttcgtgtattgtttcttttatctaagcacttcggtgtgtccataacaaggtggaaccttggatagcaagtcacgatgactgcatgttggctgagatgtgacgtctctcagtctgtgtatgtcggagtgacattcgctgcgacataacctccatcatcttacagttgagcctattagatctcgtcgcggacctcgccctcggacttggggtggatcatcagatccaactcttctgtgatgtcctggaattcgaacctgctgctcttaccggcaacagtaatgttggcaccgtcggtagggagggcaaccacgtaaatgcgatcggtcatctgtcgggcagaagtcgtcaaggcgttctggagacggctgggcaagaatcccaagaactcaacctcgttgaactgctgagtcttatcctggtaaactgacacgccaccgaagggatgatccggtgtcatattctcggcaaccagaaggattgtgtcgttgtatcgctctgggaaatgcagaacgttggcagtcttgaactcgtggtaaggagtctgcttgatcacaacgggagttccaaccttgtcgcggacgtcgaagcgaatgagctgcccaatgatgttgtcgggaacaatcatggcgtttccaacgtgagcaatgccggtgaagccgtagagacgaggtggttcaagcttatcagcaacgtaaaatgtcgagatttccttctcaggtgttactcgtagaatgtttgatgcgtaggttcccaggacatatgtgttcccatcaggtccaagactggcatccgcatagccaacataaaggccgttgtgagcttcttgtatt

SEQ ID NO: 33140 - DNA, 990 bp, Triticum aestivum
  unsure (1)..(990): unsure at all n locations
  Clone ID: PAT_TA_33140
aaaatattcataatagttccaatatatatataacactacacaaacacaggcagagtactgtcatataatacatcactcaagcaccaacaggtacatgccgtatctatatataacgatcaggtatccatgattaacagagaagttgactgaatagctagcagcataaagtaaggtacatgacttcaatcaagcaccaacagcttatcacaacttacccagataactgttgctcatattcggcttcaatacacactatcatcatcagaaacatggacaagtatgagggcttcaatacacaaatattcagtgcccatccgtcaatgactccgagaacaaaggaacatatgaaagataagggcaccttgaattccgtccaagatcacatacaaaacgcagctccctcgaatccatttcgtatgaaaataatttcatctgccaaaagatccctgatgcagattctacaattatgaatatcacattgtcttctgggtgggctgagataacactgtaatgttccctggcgcttgaatactctactccaatcagttgcacgtggctgactttgagcttcaatgtcgaacaattttcactaatagaatcttcaagaccccatgcagacagttcaggaccaccatgatctgcattatacaattgtcctcgtgatacataaacattaggaacaccacgagcagtcaggtgaagtaggaacaggaatgatcctataattaccctgcacgtcgatggctgcaactgtgttactatcagaacgtaaatacaacactccgtcgaaaaatgcgccacctgataagcagagtatctcaattgaattgtcccaaacaatttgatgcgtccaaccaccagctttggaagagtatatccccacctcttcgatgcgataatcatacttattattcagatccaaagccacggcagtnaccaactcgaacacatggaagtgggaggagatggccgggtcgaatcccaggcgag

SEQ ID NO: 33141 - DNA, 711 bp, Triticum aestivum
  Clone ID: PAT_TA_33141
gctcctgccggttactcgggaaaaaaaaacttttctcctaaaaaaatcctgctttctctagatccaatgtacagttctgtagtcactcatcaatacatctcacctatgtatactttgtcctacaccaacgattgctatttctttcaacaccatttcaaggcttccaaaacatgctctaacaggtgacagcatgcactgcataccaagaaccgtatgcctgaatttttctagtacttctgacgcataattccgtctaccgacatgcaccatcatctatctccgtggaaccatttgcccggattcatccttctcaaatatccttgcgatccactcattccaaaccgttctgcgcctgccactgtcaagcagcactggcgatgcctcgctctcatcggggtttgcattttcgtcgaatgttccgtatgttgacggcagcttaacatctgcgatccctagcgcgacagcacgcctcagggccgcctgctgctcctcattgtgatcccttgttgccgcggtttcaccatccatcctttgattctcaggcgctttcatggtcctctcatgctccagcatcaaattcactgctctttgggcttccctttctatccagataatggcatggtcagaaatcgcgttgcaagaaagaactatgtgctcaaatctgccgtcaactggaactgctgttctaacggcaggcggatatcttccaca

SEQ ID NO: 33142 - DNA, 420 bp, Triticum aestivum
  Clone ID: PAT_TA_33142
cgggtccacagggcgtcacactatatcaatcaacaataattcttgccgaatgaaaagttccagtagttcactctataatcctagtattggttacatgcacacacatctcagtgtaatccaacaatatctacacagggtcttgtttttgtgctagtgacaagttgagttagttgcaatggtctagctgctaaacaagcagacctgagttcgacgatgtaccgatcaatcctttgatcccgagaatagtttttttagtggttgatcccgatcacgagaaaagtgaatcgagaaaactgatcgcaattgatgatgagaaaatcgaaaaccggtagggcctaaaaaccaaggattgacatacaagaaaggaaaatgcttgtggctggcaggccagccgaactttaagctggtcatgcacgaggt

SEQ ID NO: 33143 - DNA, 351 bp, Triticum aestivum
  unsure (1)..(351): unsure at all n locations
  Clone ID: PAT_TA_33143
ttttttttttttttttnttntttttntttntaaggagattaataacacaaagtctttatttcatagctgttcttttatccatgaacataggaattttaactttgaggctcatggcctagccaaacacgcaacaagtttaggtacaggacgccatgtttggcatgggcatacttatgacccaattactgaattcaaggcgcttactagcaaggattatgcattcgaggaaactagcaaggattattgtggtgacgtatatataagcacgttgcagatggatcatgcagcggtggtgcggacgctgtggaggaccacagtcttgacggtgagaccggggtcgaaaccaaagag

SEQ ID NO: 33144 - DNA, 414 bp, Triticum aestivum
  Clone ID: PAT_TA_33144
gaccggggaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaaaaaaaaaaaaggggccccccaaaaggttcaaacctaacttacccttgaatgcaacttcaaacccctccaaaagtgccaccaaatttcaattcacgggccttcttttaaaaacttcttaacgggaaaaaccctggcttaaccaaattaaacccccttgcaaaaaacccccttttcccaaccgggcttaaaaccaaaaaggcccccaccattcccccttccaaaaatttccccaccctaaatggcaaatggaaccccccctttaccggcccattaaccccggcggttttggtggttaccc

SEQ ID NO: 33145 - DNA, 593 bp, Triticum aestivum
  unsure (1)..(593): unsure at all n locations
  Clone ID: PAT_TA_33145
cccacgcgtccggctagctatcatccaaagaccaacgagtacgccaacaagtgaagtgcaccgagctgagcagtgagtgagcggccggggacgcggtcgacgagccaagaatggcgacgcaccatcgtgctctcctcctcctgctcgccgtgctgctcccggcggcggccacggccgacccggacgccgtgcaggacttctgcgtgccggaccccgggcgcggccggccggtggagctcaacctgatccgctcctacccgtgcaggagccccgcgaacctcaccgcgggcgacttcgccttctcaggcgtgcgcgccgcgggcaacttctcggcggacacggggttcgcgggggtgtccgtcacgccggcgcagttcccgggcctgcacaccctcggcatgtccttcgcgcgcgccgactctcgggcgccgggggcgtcaacccgccgcactaacaaccggcgcgccaacgagaacggggctcgtcctccccgggccgcgtctaagccggggttcgtcgacaccccggcgcgcgcccccggcccaaaggnccncncgggggggggaaagnncaaggggnttccccccccggga

SEQ ID NO: 33146 - DNA, 1874 bp, Triticum aestivum
  Clone ID: PAT_TA_33146
ttttgaacgccgccgtgcagcctagctcctccttctctcctccaaccttttcccccctgttctgcaagccctttccgtctacttctggctgcttcctcgcgcaggtgctactatttctgagcttccgaggcgacagagctgcaccagagcagagcagagcagacacagctgatcagattgagagatgagggagatcataagcatccacatcgggcaggcgggcatccaggtggggaattcctgctgggagctctactgcctcgagcatggcatccagcccgacggcctcatgcccagtgatacctcggttggggttgcaaaggatgcattcaacacgttcttcagcgaaacgggttcagggaagcacgtcccgagggccttgttcgtcgatctggagcccacggtcatcgacgaggtgaggacgggcgcataccgccagctcttccatccagagcagctcatctcccacaatgaagatgctgctaacaactttgcccgtggacactacacagttggaagagaagtggtggacctttgccttgaccggatcagaaaattggcggataactgcactggcctccaaggtttcttggttttcaatgctgttggtggcggaactggctcaggacttggttcattgcttctggagcgcctatcggtcgactatggcaggaaatccaagctcggtttcaccatctatccttcaccacagatttcgacggccgttgtggagccatacaacagcgtgctctcgacccactcgctgatcgagcacaccgacgtggtggtgctcctggacaacgaggccatctacgacatctgcaagaggtccctggacatcgagcgcccgacctacaccaacctgaaccggctgatatcccaggtgatatcgtccctgaccacgtcgctgcggttcgacggcgccatcaacgtggacataaccgagttccagaccaacctggtgccgtacccgaggatccacttcatgctctcctcctacgcgcccatcatctccgcggagaaggccttccacgagcagcactccgtccccgagatcaccaactccgtgttcgagccgtccagcgtcatggccaagtgcgacccccgccacggcaagtacatggcctgctgcctcatgtaccgcggcgacgtcgtccccaaggacgtcaactccgccgtccactccatcaagaccaagaggaccgtgcagttcgtcgactggtgtccgactgggttcaagtgcgggataaactaccagccgccgacggtggttccgggaggggacctggccaaggtgcgccgggcggtgtgcatgatcagcaacaacacgggccgtggccgaggtcttctcgcgcatcgaccgcaagttcgacctcatgtacgccaagcgcgcgttcgtgcactggtacgtcggggaagggatggaggagggggagttctcggaggccagggaggatctggccgcgctggagaaggactacgaggaggtcggagctgagggtgaagacgacgaggacgaaggcgatgagtactgagttgatcaagcatgggtacgtgcttaattgggtggcagtgttgtgcacttcatgccgtatgttgttcttctctgtccctgtttgcttgccgttgcatctgtgatgttcggtggttagcagagtacaaaaattgtcagattggttcgggtgcactgacggctcggtgccacatagtctgtgaggaggtggtatcgatacatcataataatgaacgaagattttttgtactgcaagttgcaggggtatgtcttcctttgttttgttatgaaagcaaagcatgttagaccatacgatgtctgttaaaagaaaagaccatgcgatgcaaattttattagtcct

SEQ ID NO: 33147 - DNA, 766 bp, Triticum aestivum
  unsure (1)..(766): unsure at all n locations
  Clone ID: PAT_TA_33147
acggtcaggaataccgggtcggccggacctaagttagcaaaaaacgatccatttcacctaaattagctcttaaatgatccatttcacctaagttaggtcataaacgacccatttcaactaagttagctcataaaagctcataaatgatccatttcacctaagttagctaaaaaacaatccatttcacctaagttagctcacaaacaatccatttcacataagttagctcataaacgacccgtttcaactaagttagctcataaatgatccatttcaactaagttagctcacaaacaacccatttcaactttgttagctcatatatgatccatttcacctaagttagctcataaatgacatatacttcttgttctagtcttcttcttgttctagtcacctatttctaactttcttatttaccattttgcagatttcattcacttcatggaagctagcttgctatgatggagtgcttgcntttcctttgatgaaactttgcattgtatctagcttgctatgatggaacttgctatcttgatgaaactttgcattgtaatatatatatnganggaacttgcttatgtatgaacaatgtgtatggatgaaactgatgtgatatgtgatatgtgatatgaaactnatgtgctggatatgtgatatggaaatatactataatgnattatatntaagtgcaatngtgggttaataaancagaaaancagccatangcaggcnctnangctgaacgacggcaagantcttgcgt

SEQ ID NO: 33148 - DNA, 633 bp, Triticum aestivum
  Clone ID: PAT_TA_33148
gtcgacttcttctccccaggctgcggtggctgccgcgctctccaccccaaggtaggagttcttggccgaagccccctgttccgttccggcaatctgattctgaaactgcgacgtatactcaagcgaattcggttgttccgatgtgcagattgcgcagttcgctgagcggaatccggacgtgctgttcctgcaagtcaactacgagaagcacaagtccatgtgctacagcctccatgtccatgtcctccctttcttcaggttctacaggggagcccagggcagggtcagcagcttcagctgcacaaatgcaaccgtaagcctcactgattatgtttcttcttttgtccactacaaaaatatgttcttcagacacgtttaagatgaatgctgacatgcttgctgcaattcgttctgattacagatcaagaagttcaaggacgccctcgcaaagcactcgccggacaggtgcagcctcggcccggcgcgggggctcgaggaggcggagctcttggttctggcggcaaacagggacctggaatttcacctacaacgagaagccgacgctggtgccgatcgccgaggctatccagagggaagctgcctccattggcggcccatgggatgccattgccc

SEQ ID NO: 33149 - DNA, 467 bp, Triticum aestivum
  Clone ID: PAT_TA_33149
cgcctgccggtaccggatcgaccatgcccgggtcgacttcttctcccccggctgcggtggctgccgcgctctccaccccaagattgcgcagttcgctgagcggaatccggacgtgctgttcctgcaagtcaactacgagaagcacaagtccatgtgctacagcctccatgtccatgtcctccctttcttcaggttctacaggggagctcagggcagggtcagcagcttcagctgcaccaatgcaaccatcaagaagttcaaggacgccctcgcaaagcactcgccggacaggtgcagcctcggcccggcacgggggctcgaggaggcggagctcttggctctggctgcaaacagggacctggaattcacctacaacgagaagccgacgctggtgccgatcgccgaggccatccaaatggaagctgcctccattggcggcccatggatgccattgcctgcgggcgctc

SEQ ID NO: 33150 - DNA, 776 bp, Triticum aestivum
  Clone ID: PAT_TA_33150
ttctactccaacggctgcggtggctgccgcgctctccaacccaagcggttcgcgggtcgacttcttctcccccggctgcggtggctgccgcgctctccaccccaagattgcgcagttcgctgagcggaatccggacgtgctgttcctgcaagtcaactacgagaagcacaagtccatgtgctacagcctccatgtccatgtcctccctttcttcaggttctacaggggagcccagggcagggtcagcagcttcagctgcacaaatgcaaccatcaagaagttcaaggacgccctcgcaaagcactcgccggacaggtgcagcctcggcccggcgcgggggctcgaggaggcggagctcttggctctggcggcaaacagggacctggaattcacctacaacgagaagccgacgctggtgccgatcgccgaggctatccagatggaagctgcctccattggcggcccatggatgccattgcccgcggccgcgacgcagccgctcgctctgggatccgagaacggctcgctcatcccctctggaagatagtaatcggagaccaggcccaatccggccattcctgtacagattttcttctttttgttgtgtgttgtgttgaattcgagaggcggaatcgcagggtaaaggttttagttttttgtaaacctgccgaagctctattgtgatcgtgttgctgcaaccagccgttgctcaacatggtaatccttcttgctttaatgacaaatgggatgatgcctccccagaattaattaagatc

SEQ ID NO: 33151 - DNA, 1278 bp, Triticum aestivum
  Clone ID: PAT_TA_33151
gaggcccgcgccccgcccttgcttcgctcccctcccctcttctcttccctctcccctcccggcttcccctccctgcgtctgggcggggggtggctatggcgacgctgcaggcggcggggcagccaacgccagtctcgccttggggcccggcggcggcaggatgtgggggccggccgggcgccccggcggcggcccgccggtcgccctgcccgcccgcgcccgtgcggggcgccccgaggagcccgtctctcgccgccggacgcagggtctgtcccaggggcatctaagctcgttcctccaaatgtagccggctcatgggctgcacaacgaagctttcgttagcggaaatgcaacgaggtgtgggggaaaggtgaggcagcccaacatgagggagattgagtccgcgccaccgccgcgccagacccggcttggcaacggccggcgccacgctcgtggcgcgttcgacttcgccccccgccgcgggggcggcgcactccgctgcacaaaaccccaatgtgctgttcgtgcaagtgagctacgattcccacaagtcaatgtgctacagcctccatgtccatgttctgcccttcttcaggttctacaggggagcccagggccgcctctgcagcttcagctgtactaacgcaaccataaagaagttcagggatgcgcttgccaagcacaatccggataggtgtagcattggcccaaccaggggcctcgaggagtctgagctgctggccttggctgcgaacaaggacctggaattcacctacacgaagcagccagaaccagttccgagtggagacagggaggtcattgctcctgggagcccaaggcttcctccaccggcaaaaccattggttcggcaggggtccggagagaggaccttggtctcatcaggaagatgagattgtgatgtgacgacggtctaaatgggatcgcgtccatcggttctctgtacagtttctcgattgttgttggtgtgtacagattgtactctctcatggttgtgtagagtgcaggcttgatagatttttactacttgtcaagcctgccccgcctgtgtctgctagaagcgtagaagtagaagcaatactgtagtagtaccagcaagtattgtgggtaatcctctgccagtaaattgtatggtagctgtacaagttaatctgagtgcccgtatattcagttatcgtgcctgcgttgctcttctatcaaatactcctatttggtttgttcaatatattcagttaaaaaaaaaaaaaaaaaacacctcgg

SEQ ID NO: 33152 - DNA, 697 bp, Triticum aestivum
  unsure (1)..(697): unsure at all n locations
  Clone ID: PAT_TA_33152
tgcaggnaattcggcacgagggcgccgcgctcacctaccaggnagacctgcctcgacggcttcgccaacaccaccaccgacgccgccgccaagatgcgcggcgcgctcaacgcctcccaggagctcacggaggacatcctcgccgtggtcgaccagttctcggcgtcgctcggcagcctcaacatcgggaggaggctgctaggggaggaggacggggtgccttactggcgggtcgacggcaagaggcggctgctggaggccgagccctccgcaccggagttcaagcccaacgtcaccgtcgccgctgacggcagcggcgacttcaagaccatcaaggaggcgctcgcaaaggtgccgcccaagagcgcctccatgtacgtcatgtacatcaaggccggcacctacaaggagtacgtctccgtgggccgccctatcaccaacctcgtcgtcatcggcgacggcgacgacaagaccatcatcaccggcaacaagaacttcaagatgaacatcaccaccaaggacaccgcaaccatggaggcaatcgggaacggcttcttcatgaagggcgtgagggtggagaacacggcgggggccgagaaccaccaggccgtggcactgcgggtgcagagcgaccaggccgtcttctaccagtgctacttcgacgggttacaagacacgctctacnaccacgcgcaac

SEQ ID NO: 33153 - DNA, 698 bp, Triticum aestivum
  unsure (1)..(698): unsure at all n locations
  Clone ID: PAT_TA_33153
nnnnngntntgttcctagctcgaaatnaaccctactaaagggaacaaaagctggagctccaccgcggtggcggccgctctagaactagtggatcccccgggctgcaggaattcgggcaccagcgcaccctctcctcacacgcctcagcgccctcccctgctccctgtgccgccggccccattccttctccccgcgctagaacagagatgcgcctcagtagggcagcagcagtagcgtctccatggacgcggtggcatgacggctcccaggcacggatcccctcctctgcctccatcctccacctctccggtcgccctgttgcaacgtccgaagcagcagcaggcgacctgcagcagctccttcctaccttccatggacgagctcgatggagacatcgtccagcctgaccacggccatgactacccgacgcacaaggaaggttgattcattttaacatataacaaattcattccaccgaagccatctgctccgtccaccaacccgcccagaaaggcagttacagtgaattgatattcgcactgaggccggaggcgagaggcgagggcacggaggtcggcggcaagtgctcaagagagaagaggaaggcagcggcgctgggcggcttgcggtttacacaagagcgaggtgacctgcccagagaagctctgttgatggataatttctgccatggttatggg

SEQ ID NO: 33154 - DNA, 698 bp, Triticum aestivum
  unsure (1)..(698): unsure at all n locations
  Clone ID: PAT_TA_33154
gccgngcgcacccaggacaacaccggcgcgcccatgcgcgagaatggacggnaaggaggccaccccgttcgcctacggctccggcaacgtgcacccgaaccgcgccgttgacccgggcctcgtctacgacatcacccccaacggctacttcaccttcctctgctccctcggcttctccaccaaggacctgagcaggctcagctccggcaagtttacatgcccggccaagccgcccccgatggaggacctcaactacccatccattgcggtgccggcgctgcgccacaggatgacgatcaagaggcggctcaagaacgtgggccggcccgggacgtaccgcgcatcgtggcgcgcgcctttcggggtcaacatgaccgttgacccgacggtgctcgtattcgagaaggccggcgaggagaaggagttcaaggtgaaggtggcgtcggaaaaggacaaactcgggaggggctacgtctttgggaagctcctctggtctgatgggacccactatgtgaggagccccatcgtggtaaatgccctggattgagattttttaattttgtggtgtgtagctcaagggaaggaagtgtcctgagtttaggaattttatttttcagtttattactgagaatgagaagagtttaggttttagctctcctggttgctaataaacgctatttggctctaaaaaaaaacaa

SEQ ID NO: 33155 - DNA, 1294 bp, Triticum aestivum
  unsure (1)..(1294): unsure at all n locations
  Clone ID: PAT_TA_33155
cccgggtcgacaagactagagtatatgcgcatccattcatccatccatccccactgccgtttcccccactatataaaccccctcccatccccaccactgctcacccctctcctctcctctcctctcctctcctccggcgtcttcctccccccaccccctctcctgatcaaagcgcacgccgagcaagctagctagcaggtggtggtgggcgcatacacatacgcttactgtacgcgacgcggctttgcttgtggccaccaccatgatgtcgtcgcccgcggagtccgagaccagcttcttcccggaccacctcgcggagcagcagcagcagcagccccccttcgccgagcaggagcagctgtgctacgtccactgcaacttctgcgacaccatcctcgcggtgggcgtgccgtgcagcagcctcttcaagacggtcgccgtgcgatgcggccactgcgccaacctgctctccgtcaacctccggaacctcctgctcccggccaccgccaaccagctccccttcagcccgtcgctcctctccccgacctcgccggcgtcgccgcacgggctcctggatgaaatgtcgtcgttccaagcgccgtcgagcctactgactgatcaggccagccccaacgtgagcagcatcaccagcagcagcaacagctgcgccatcaacacgccggccatgtccatgatgccgccgccggagaaacccgcgcagagggagaccccgcagaggaagagcgctgcgtctgggactaagcatccagagaagcggcagagagttccctcggcatacaaccgattcatcaaagacgagattcagcgtatcaaggccaacaatccggacatcacccacagggaggctttcagcgcagctgccaagaattgggctcattttccacacatccatttcggtctgatgccggaccaaggcctgatgaggaagaccagcatccaaagccagctggacggagctggggattgcatgctcttcaaggacaagtctctacgcagcggcggcggccgcagcagccacagcggcatctagcatgggcgccactccgttttagcgtcttcccatagaatatattgccttaatttcgctgcattctagctagggtgctggggggatcatatgagatcttgagatgtatcgtatcgtatctacgagtactcctctagttttcgttgtttcttcctgtcctttgccctttccctagtgcctatatgttcgcctatcagctaatgaggttgctgtgtttgccacctcttatcttangacataaaatag

SEQ ID NO: 33156 - DNA, 712 bp, Triticum aestivum
  Clone ID: PAT_TA_33156
cccagccccacagaggaacagctaaacaaattacgagcgacaccggagcaagttacagccaggttcagcttggaagttaatcccctttataagccgttcttgacagggagtggtaaacggtattatgccggaagaaatggtgctctgcggcacggccagcttcaaggacgttgacaagggcgagccgacgagcggcggaggcaagcaggcgcagaggaaggagaagaagaagccgggcgccgggaagaaggagaacccgtacgcgtcgcgcgggctcgacaagttctccatggtgctcgcggagctcgagtcccggcgggagaaggtcctgcgccgcgtcgacggcggcgaccatgtcatggtccggttcgtgcagtccgagaccaagggctgggtgcccatcgtcgtcaagctgcccgcggaagagcccgccgccaaggccgagcccaagaagaagtgcaagttcaagctggccgtctcgcccacgcctccgcccacgcagccgccgtcgccgcggacggagtccaccagcccgagaggaggagacgacgccgtcatgcacgtcgcggctgcgacggcgccggctgtcgccgcggcgccggcgaagaagaagcttcggccgccgggaggtggccgtgggcggacaggcgatcaggccgagccagtactggccgtttcgtgcgatgctgctgctggtgagcctggtcgtgtt

SEQ ID NO: 33157 - DNA, 888 bp, Triticum aestivum
  Clone ID: PAT_TA_33157
aaatacaggagatcagataatataaatcaacagcaggttttcagattgacccactgcatagtagtcatcacgggattcggggaatgaatgacaacacaagacaaccagtttacacagcgataaatatcgtccaactagcatagaaacatgggtctaaacttgacagagttgaagatccatacatctgctacatgcataaaaggtgtcgaatgacaattggaaccctcatcaaagtttggtgataatcctagataaaaggtgcaacacacgggagcataagctacgggaacaattaagttgggagaccgaaatgatttctgaacatcgtatcactcagaaagctgcagtctcgaacgcatgtcggctagaatgtcgtgaaaccgcacttcaacattaacacatgcttcctgagctatgttaactccctctttcagcctcaagagctctgcatcttcatcttttgtctcccttgcaatctgctctgcttcaccacgaaggcactcaagtttctgctcaagttgaaatatagctccttccttttcaacaagtaatgcatgcttatgagacatggcagactccttccgcggtaccaattctttcaactcgtccagatgtccaagatgcttggtgtgctcccatttggcctcaagcaatttcatcagactgtgctgcagcaacttaacatcaaatccattttcctctaaatgggcaagtgcgttgatctttctttcaaataactcaatattatcttctatgcatgatcgcttgacactttcaactaagctggcatatgtcaccattagacctatagccattccttcacgcagttccggcataaattgctgaagtggaccgaaatggggttcctgtggtccttccgaaaccctc

SEQ ID NO: 33158 - DNA, 1203 bp, Triticum aestivum
  Clone ID: PAT_TA_33158
cccacgcgtccgcgaagctggctggcacgatcccttccatcagtcgtccgcgtcaccaattcctcgacctagagctcgcacctctcagcctcgcaccgccgcacgctcgtgcggccccagccaacccagcgctcccagtcccccgctcccgcacaaagctagggttactgccgccgccgcccctaccccacgcccccccggggcgccctccgccccgccattcccgctccgcccgtcccgccgtccagtacctccgcccctcccgtcccccctcccctccacgagcacagaacgccgcccgccgcccgccgccgtcgttcgctgggtttcctcggaatttgtctgacttctccaatcagagcattgcagagggaaaatagtaatggagttgataaatgctaaccctgtgattcatgagaaaagagagaggcgcacccggcaggcaccagaaaacatagatgaaaatgcaccagaggccatagaccagcttgaaatatttgatcatattagagacataaaggacccagaacatccatactcattggaagaccttaatgtggtaaatgaagactcggtcgaaatcaatgatgaacttagtcatgtcagggttactttcaccccaacagtggagcattgcagtatggccactatcattggcctttgcttacgtgtgaagctcatgcggagtcttccacctcgttacaaggtggacatacggttgacgcctggatcacatgcaactgaagctgccgtgaacaagcaactgagtgacaaagaacgcgtcgcggccgcgctggagaattcaaacctgctggacatagtggaggagtgcctgtcaccgacgctcggcctgagacctgagtaggactggaaaccagtgcgtggatacattcccagactacaagggagaattacatatggcttatgccacccagcctatttttactttccttggtgttggtgaagaattctttaattaggtggcgcaggacgtgtgcatgaattctgaggccctgcgcctctctgagaacgttgctgccgcttaagctctcgtatcgtagtgccagtatgtaggtcgtcgagtgctgctatttttttcttggaggaactgggtgctgctatgtttttgtacggtgctgattgtacatcgagggatgtagtgtggtggtccgtgctgtaaaatttgtcatgtttacggagaag

SEQ ID NO: 33159 - DNA, 1088 bp, Triticum aestivum
  unsure (1)..(1088): unsure at all n locations
  Clone ID: PAT_TA_33159
cacgcgtccgcccacgcgtccgctcggaagctcagttggctaaaaaaaaaaggctcggaagctcagtgtccagctcgactccggcctagcgtctcgccggcgcccggcccccctgcctgtccatgccgccggagaaatcgccgcagtccccagtggcttgtgcacaaagagttctaatttcgaacaaactcggggagaagcttgttggtttattacatgaagcatgctcgaaggaacttgtgatcctttgtcatggattcagagctacaaaggacgacagtatcttggtcgaccttgccgctgcactagcaagtgcaggagttaatgcttttcggtttgattttgctggaaatggggaaagtgagggtctattccaatatgggaactaccgaaaagaggcagatgacttgcgctctgtagtatcttatttctcagaacagaagtatgacataattgcccttgttgggcatagcaaaggaggaaatgctgtgcttttatatgcttccatgtaccatgatgttaccgtcattgtgaatatttctggccgctttgctttagaggaaggtatcgaagggcggctggggaagaatttcctgcagaggataaagaaagatggatacatagacgtcagaaataaaaaaggcaagtttgagtaccgggtgacagaagaaagtctgcgagatcgtctgagcactgataccctgctttcgagccgctccataagcaaagactgcagggttctcacggttcacggctctgaagatgaaacggtcccagcgagagacgccctgatgtttgctgcgcacataccaaaccatgacttgcacatagtcgtgagagccaaccatcggtacacaggccacgagcaagagctgacatcacttgcactggatttcatcaagccccgtcctcgaaaatcatcgtccttgcgtccgaaactgtgatcgtctgaccattgtggagcttgattgatgcaccatttacttgttacattaccggatggccaaatgcctggatagtcgttgtgctgtgctgcagaaacgtcactaatttcagtaaaaatttcttcgtcttacaaaaaaaaannn

SEQ ID NO: 33160 - DNA, 1091 bp, Triticum aestivum
  Clone ID: PAT_TA_33160
gatgaagatgctctcgtcggcagcggctttcgtggagggtggcgtgcaggacaccttcgacgacgcctgcaacatctgccttgaggccttctgcgacagcgagccctccggttagctgcaagcatgatttctatctccagtgcatccttgagtgacaagacaagcagcagcggcgacgccggaccagtcacccccgcacctccagttttccttcagggtaactaaccacggggcaaatgcttctgtcatttctttcgcttgtgattcctctcgttgggaccatggttgttgcctttccctctgcctgtaaaatcgtactgcagaggcatctagcacccaccatgaacatcgggtgtgaggtcttggatcaaggctcccctggaccagcatcgtctgctagcgcacgcgtgcctgcttctgtgcagattgactgatctagcctccacctaaatttcctgcaattacgattcagcaagagatcataggctgtgagccttgtgttgggaggatcccaggccgaatgatgcttgatctccttttggaggagcttgtgtttaccgcagcccgttatagtcgaaggggctatttaagtaacaccatgagttcatttactggtgttcgatcctccgatgaggcagcggcggaagacttgcctttttgaagccatcaggaccatcgaaaatgccacaagaacagtggtcaaagatctgaattatggacgcttaaacaagatggaacaagactttggttatctaaggctcaggctcaatgaagcatttgacacaatagacagggttgccaaaggatatttgtatgctataagatacatgccagctttcttacatcagcttcataatgtgatagcacatacttttcctcctactcgtgttgtggacaagtcaacaaatgaggctctcaagaatattgaggtggtagctcataatctcaggacagaagcaatagtcttgaaaacaagctatatgtgttgagaaggcagagtcaagcgcgcctgaacatgtgtatcttgctttcggaccaaatcctttgtacttgtgtggaccaactttttaatactaacggccttgttccgt

SEQ ID NO: 33161 - DNA, 1221 bp, Triticum aestivum
  Clone ID: PAT_TA_33161
gagaactgcaaagtcaatcatgaaggtctcttttggaattctcgccaccctgctgggcgcctcaagttatgtcgcctcggcagcacccacagatcaatcgtcggcaagcgacctcattctgtctcttaatgaaaaagcgacgtctgcactggagaacgcagagacagagcccaggaagaggtctgctggaccaaagaaatgcacaatcttcaacgccgctgtacgacgtgattggaagacactctccaaaaaagacaaaaaggcctatatcgatgccgtgctttgtctgcgcaagaagccctctaaagccgatccggcctttgcacctggtgctcgaagcagatatgatgactttgttgctgttcacatcaatcaaaccttgagcatccacggaactggcaactttttcacctggcatcgatacttcacttgggcttacgaaaaggctctccaagatgagtgcggctataagggaacacagccgtactggaattggttcgaaaccggtgactttgctactaaccctgtctttgatggttctgaaactagcatgagtggcgacggcaagtattttgagcatgacggcgcctggtctgggaaacaaaacatcttcatccccagtggcaaaggcggtggatgcatcaagaacggtccctttgccggagctgtcgccaatctgggaccgccgagtcctggcatgacggggatggaggccacgacaacgccgctcaactataacccacgatgtctccgccgtgacctgagctcctattctatcgatcagtggctcaatctgccgaacctctataatatcaccctcggcaaagcatcaaacaccatccaggctatgcaggacgaattccaaggccgatttagcgataaattcctaggcatgcatgctgctgggcatttcgttatggggggtgattcggcggatctcttttcttcccctaatgatcctgtctttttcctccatcattctatggttgaccgtatctattgggtctggcaggcgttgcatcccagacgggccaaggatatcgccggtacgatcactatcctcaacacacctcccagcagagacgccgtcaaatctgatgtcctgaacatgggagtcaatgcacccttgatcacgatcgaggacggacttgatactcttgccggttcgcctttttgctacatctatctgtaggatctaatagtataatacagtatgtctag

SEQ ID NO: 33162 - DNA, 495 bp, Triticum aestivum
  Clone ID: PAT_TA_33162
gcttcgtatattgggggctcagtatgaagtcgttattaatttcaagacacgcttgggtaaaaagtttggctgcagcaaaggtggtggcctgctttgacatccaaaacagggttcaggcatagaataaaaaggaggtactactttcttgtcttgtactagagctgcatcaggccacacacaagctatccatccaacttgtgtggatcttaatttctggcattggtttgatctagcatataagtactatatattctatgtaactaaggatgcatgtgacctatctgaggctgttgcttttttggtaaccatccatgtatttcgaaagaagatggtgataatagacgatgtctgtctgtcttctttttttgcgatatactagtgccatctatctgccggagcctgaatatatggcagccagcatgaatatttgatgtgcaagtaaccgaatctgattatgttatgtgggtgacaatcgattcacttactattgagatt

SEQ ID NO: 33163 - DNA, 1125 bp, Triticum aestivum
  Clone ID: PAT_TA_33163
acacgtttgttccggtcctaaggctgaactatccggctcccggctgctgctccattccgcctacgccgccgccgccgccgccgcagctatgggcgcgtacaagttcgggtcgggagctatgcagggaggaagcagttcggacgtgatgaggttcgtgcagcgcagggctctcggctccgaggccacagcagcttggcaagcctattgaggagacccaggaagatgtgtaccaggggaccgacaactcgcctggcaagatacgcataattctgagatctgtaaaaatctgcaagcattatctgaaggagcatgcgccatacgtgcatagcctccggctgtttcaatcccggtttttattcgccttgatgcgctcacctcatattgataagtaatccagggggatattctttacgcatgtgaagaaagtgtttgtggagcaaacagcgaagacgcatgaactggccaagaagttcgtcgggttgaaacggctccgtatgttggtggcgcagtacgcagtcgtttttattttcaagacacgcttgggtaaaaagattggccgcagcaaacttggtgacctgctttgacacacaaaacagggttcaggcatagaataaaaagaaggaacgagcgccggcacaaccgacacactaactagccaccgacaaaagtgctcatttccatcacatgatcccaagtggccaacaagctcctatgccaccagccatatgggaactccttgttccttctccactgaatctcaatgttttcgccaggccgtagttcatgtaagcagtccgaggcatgcaggtcatgtgcgggagtttcgacgtgaggtgccctgaacctgtcccattgcacgccatcttccaagactacagttcgtcgcccgtgtggtggataccttgcgtggaacgtgtcagtgcggaaatcatagctgagctctgcatcatagcatgacatcatgaacccaacatgcccatgctctcggttgtagacctgtgcggggaaccagaacttgccgctctccaggtggagataccacgacatgatggaatcatccagcacagggcccgcggacgtgccggcgccgccgccgcctccgccgtctccagcttggcggccgct

SEQ ID NO: 33164 - DNA, 649 bp, Triticum aestivum
  Clone ID: PAT_TA_33164
ctttttttttttttttttttgagatctgacagccaactttcattcagattgctgatgacaacaagatggtaacatcagacactgcactagaacatcacacacacccaacatagcacgaacacgggatcactccaccacgcaaaacacatgctaatctctacacctgcagaagagacagacactatcctaggccctctcgccccggatgcgtcttgcgagctggatgtccttgggcatgatggtgacgcgcttggcgtggatggcgcagaggttggtgtcctcgaagagcccgacgaggtaggcctcggcggcctcctgcagcgcggagacggcggagctctggaagcggaggtcggtcttgaagtcctgcgcgatctccctgacgaggcgctggaagggcagcttgcggatgagcagctccgtgctcttctggtacttacggatctcccggagcgccacggtgcccgggcggaagcggtgcggcttcttcacgccgccggtggccggcgccgacttgcgcgccgccttggtggccagctgcttccgcggcgccttgccgccggtggacttcctcgccgtctgcttcgtgcgggccatcggggtttgcttggtggattggttgggagggagcctcgccccgtgccgaatc

SEQ ID NO: 33165 - DNA, 563 bp, Triticum aestivum
  Clone ID: PAT_TA_33165
tcgccatataaccttggatggggatgaattgtgtgctcgggggagggggtgtgtgtgtgatgtgtgttgcctctgtgtgtgtgtgtgtcagatattgagagaaaacaaacgggcctaaggagagaaatgtgtgtgtatgtgacagaaagctacatgctaaatagggttttcacgaagagattgtgcgtgcgagatagagagcgatgtgcgggccttgaggtgggcaggggccgggtgagggtgtcaaaatgtgtgccttgatgcatgtgttacatgcgatcgtgcgagggacggacgaatcgagagagatggttgttgtgttacggatgctcctctctctctcactcacatacacacacacaagtacaaatagaagaccgttctctcatgtatacacaacgtatcgacatctctctatgtctcactcatgcatgatcatttgcacattcacacctctctatgtctctatcacacacacagtctccacattgcccttccgccacaacacacatatggacacatacacacattctctctcagtcacacacacaaaatcagtatta

SEQ ID NO: 33166 - DNA, 670 bp, Triticum aestivum
  Clone ID: PAT_TA_33166
gggtcgacgggtatgtggaagagagagtaggagacaaacctacgagacacacacacacacagagagagagagagacagagagaggaagaagttaggtctgtcagaaagatggagacatgtaatatacgtgattctgtatacgtggaaggagaagagacaacatgtttgatgagagagctggaaaaacatggacgagaggggaaggatctcatgggttgagggattgacaattttgtgcggggggagagagggattggtaattttgtgcaagagagagagggtggggggaggagtcagtcagccatcgtcacatcaccctgcttccaaatgaccccgcattctctagcgcagtgtggtcgccgtctttgatctgctcgatgccctctttgacgattgaggtgttgtgcatgttggggtgcaaagaagcacaagcgagagtggtcaccgtataaccttggatggggatgaattgtgtgctcgggtgtgtgtgtgtgtgtgtgtgttgtgctccatgtgtgtgtgtgtgtgtgtgtgcatgtgtgtgtgtgtgtgtcagatattgagagaaaaaacctaaggagagaaatgggtattcacgaagagattgtgcgggccttgaggtgggcagggcccgggtgacggtgtcaaaatgtgcgcgttgatgcatgtg

SEQ ID NO: 33167 - DNA, 973 bp, Triticum aestivum
  Clone ID: PAT_TA_33167
aattggtcggagcaacaagaccaaacaaaactccaaaacaaccaattaaaaaaccaacattttgaacaatacccaattaggttgaaaaaaacatgcaaaaagaccttgcaaagatggagcagatagggtgggaaagattgtatgtatgtggacgagagagttggagacaaacctaacaagacagagagagagagagatagagagagaaagagagagtaagaagttaggtatgtgagaaagatggatacatgtaatatacatgagatgcgtgtgcatctggattctgtatacgtggaaggagaagagacaacatgtttgatgagagagcaggaaaaacatggacgagaggggaaggatctcgtgggttgagggattgacaattttgtgcgggggagagagggattggtaattttgtgcaagagagagagggcggggggaggagtcagtcagccgtcgtcacatcaccctgcttccaaatgaccccgcattctctagcgcggtgtggtcaccgtcttcgatctgctcgatgccctctttgaagattgaggtgttgtgcatgttggggtgcaaagaagcacaagcgagagtggtcgccgtataaccttggatggggatgaattgtgtgctcggggggagtgtgtgtgtgtgtgttgtgctgcgtgtgtgtgtgtgtgtgtcagatattgagagaaaacaaacctaaggagagaaatgggtattcacgaagagattgtgcgggccttgaggtgggcatgggccgggtgagggtgtcaaaatgtgcgcgttgatgcatgtgttgcatgcgaccgtgcgagggacggacgaatcgagagagatggttgttgtgttacggatgctcctctctctctctctctctctctatctctccctctctctctctcagactctcacacacacacacacaagtaaaatagaagaccgttctctcatgtatacacaacgtatcggcatc

SEQ ID NO: 33168 - DNA, 986 bp, Triticum aestivum
  unsure (1)..(986): unsure at all n locations
  Clone ID: PAT_TA_33168
agcgcaaaagcgaaacccacgccctccgaaaggggcaaaccgtcggaaccctagatccgtcgcgcctggtcgcccccagctccaaaaccctagatcccgccatgcaccacccgagggcccggtacccgcccggctacgactacggcggcggtggccgcggtggtaacggcggcggcggcggcggcggtggaggaggtggcggcgggaaccaaaactactacggcggccgaaacccgcatccccagcaccacgattaccagcagcagcagcagcagcacgcgcagaggaactcgttcccgcagcagcagcagcagcagcacgcgcagaggaactcgttctcgcagcaacagcagcagcagcatcagcaacaacagcatcagcagtggctgcggcgggaccaggccgcggcccaggcttcaggagagggtgcggccaggacggtggcgcgactcgacgcggtggacacgagctctcaagattggaaggcacagttgaatattccagctccagatactcgttttaggacagaggatgttactgcaacgaaaggcaatgagtttgaagattattttttgaaacgtgagctacttatgggaatatatgagaagggatttgaaaggccatctcctattcaagaagaaagcattccaattgctctaactggaagtgatattcttgcaagagcaaaaaacggcaccgggaagactgctgcattttgcattccagcactcgaaaagattgacccagagaaaaatgccatacaagttgttatactggtaccaacaagggaactagctctgcagacttcacaagtttgcaaaagagcttggaaaatacctgaaatattgaagttatggttaggtcttggaggaaacaagctttgaaagggacgacatcaatgcgttttgtaccaaacctgttcaatttantncgccggggaacaccctgggnccgtactncctaanattcttaaccaaaaggaaagg

SEQ ID NO: 33169 - DNA, 1806 bp, Triticum aestivum
  Clone ID: PAT_TA_33169
gcaacaactacagggcgagctccccctccccctcgatttccccacagcgcacgcagttgacgggacgacacgaacccgagcgagcaccaagaacaaggaatccgtcctggtgccccagcagcgcaggcccttggcgggatgacgagaaccggatcaagcgccaagaacaaggaatccgtccagaccgagatcgacatggaatcgaagaggtcgtcaacggcggcggggcacatcgctgacctccccgagcagatctggtgggcaatcctcgagcgactcccgcccaagtcagtcctgcgatttcgtgctgtctgcaaatcttggctcaaccgcatcagcaacaacaatttcctcgaagaataccatgggcgccaaaagccacagcacctgatcgtcccagtcgatccagacaacaccaggcataagatgagtcaccgtgtagatgctgttgatttccagcaccccgaggacggtttccgctccataatcagcttcaccagctttggagtatttgaggtctttgatacagatgaagaaaccgcagagcatctaatgtctgccgtacagggctcaattggaggcctcctcctcgtctccttcgagcacaggtgctatatctgcaacccaggtacaaaagaatcacgccgcctcccacagctggatgaccatgaaatcttgggactgtacatgctgggcgatgagtttagggtcctctatctcaaggaagatgaggagggtgatgccgaattcttcgtcctgtcagtgcatcaatctcttagcaataaatccattgggtactgccctgtgtcgcccgcggcgaatctgccagaaattgatggaccgaagaagctggggttcagcctgcagagttcggcaattgagccgcctgccatggtcggggccaacctttattgggcaccgttggagctgtggccacgggaaattacagtttttgattaccagtctgagctttttcactggatgaagcttcccaagaccaaggagcgctccaagagcaacaccaacaatacgatgaaggttcttgagttggacggcgagttggggttgtctctgccccgggcgcgtgccgcaagtgttgagctatgggtattagattctctgaagatgtgggagctcaaacacagtattcagttgccggttgcagatatcactggctttggagcacatacctgggatccctttcttatgtccatggatggaggtgtgatcgtaaggtgcgtgtcccagggccagggccagggaggggaaggccaacaaggcactcaggcgctcctgtactgcaacagacacggagagctagcgcctggaccactgttcgtaggcgatttggctgcgcctgccatacacctattcaagcaaagcattaggcgacatgccctgttccaggggcatcagcaagatgctacgtctcccttgtcactcttccgggacctctagatcagcaacctttcagagagattcagcctgctgccaggtgatttgcttgcacctgctccaggaaagtattatgcgacatgatatgtttccaggtgcataaggaggaggatgccgtttcaccactgcttcaggatttgcagatcacagctcctacttgccgtgctttcttgtatattgggccctctgatgctgatgtctcactaatgttccaagatctgtagattagagcttgtgcctgtcaatgtattttttggagattgaccctgcacatgatttcctttctgaatatccctgtattgtaattgcaacgtctagtgttgacattcaaactgattagcttttcttatc

SEQ ID NO: 33170 - DNA, 1613 bp, Triticum aestivum
  Clone ID: PAT_TA_33170
attcaatctgccaggttttctctacactttcctggagctggtcattcaagtctgtacatgctaacagggaatcctcaagtgatgcttgtggatacggttatcatggcaaaacactagataagctttatgacgaggagcaaaaactctatcagttagttaaggatgaagaatttgcaaggcttgaatacagaaagtacagttcattgctaaagaagctagaatcaggggagcatgataggttgcaggcagagaaagttcgggaaaatatcgaagaactgcaaactcggataatgtccttagaggaagctgtaagcttgacatgtttgaccatatcaaagctcagggatgaggagttgtatcctcaggttattgaattagctgcaggacttgtgcatatgtggagaaacatgtacgagtgccatgaggttcagaaccatattgcccagcaagccagtctccttggcaaccaacctggcagtgagccgacaactgactcccattgctatgcaacatctcagttggaaggcgaagtctctgcatggcacaattccttctgcaatctgatcaccttgcagcgtgagtacgtaaccatccttaacgaatggattggactcaccgattgcctgcctgataatgagggcttcatgagaagttcatctggaatccgtagcctctgtggggaactcgagcatgctcttaagaagttacctgagaaggtagctgcagaagcaataaaagcttttctgtcagtcatacactctatcgtgttacagcaggctgaggagcgtcagctgaagaagaaatcagacaacatcgagagcaagttccacgcccagctggagaaacacagcgaaaacgcaatgcagagctcacgccaggggtcgcacgccaggagctactcagtaccgaaggacgacccgaagcgggacgtgttcagaaagggggccgaggaggagaacgaccggtacgtggactccccgggaaccagtcccgccgaggcgcagacccggcatctgacggccctaccaaacgcggtccctcccctgcaggggctcccaggagcccgcgtgccagcggttgtacagccccgccctaggatccaaacggccgctcaggaggctggctacaccagccgcggttcgcccgccggttcgtcctaggatcaccaccccttgtaagaagtttcccgccgtatgcccgggccacgtgtataaccgtattcaaaaacaacagtctcagaccaaaaccatgccagttataaaaattttaactctggtaaagcttccggatataccaagtccagactggggagaggttacttaaagggtgaatagttatatcacctcttcctatatactactgcatggagttcttctgctgcctggaatggccccccgtatgattgaaagcttgaatagtagtctcacgtcttcacactgttatacttccagtgccacaaggtcaggtcgggaggatgattttctgttcttccgaaaaccccggcctctgcatcattgtgattcacacaaccatctttattgaagttgatgccaaaaacatcaacaaactcactacaaaatatagacaattacagcagaaccattataagacat

SEQ ID NO: 33171 - DNA, 870 bp, Triticum aestivum
  Clone ID: PAT_TA_33171
ctcttaataaagcagaattgatcctgaaggctttcgttcttgatttgcaggtctgctgcaataagagctataatactctgatgagagcttactgtatgaccaggagcagcacagagtcattggacttgcagaacaggatgttggaactgggttttgtcccaagcagtgacacatgtcgatctcttgtttatgggctctcaagaagcattgcttaagttgctaaactgttttaatcatcccatgaattcaaatattcttaaattttcaatgggtggtctacataattgcttaggtgattacagcagtgacgatggcatgatgctatcgccatgcatgatgaacgagaacatttgtggaagagctgaacaaattggattatgcagcagaaagcatttaacatgatactgtatgtaagtgatgtgagcatgctgaggcctatgagtttacttggctggaatgccacggagatgcatgtttggcaaactgctcttgtcctgaccacatggcaccatggagcatggctgacaaattactgtaaacaccctgctttatggaattagagagctaatattgcttgaatattagccctagactaagcggcggacatgattttaatgctaaaatattaagtgttgcatccaattgccacaattgtattacacagtgcactgtttggtaaatctcatgtgtcagttttttgtccaagagttcacatgcatggtgaacaatagcatttgtgaaagggtaggatgcagtatggttagcattgagatggtgtgagcactgagcacaaatgttgatgtaatcttcctcatgcggctttgctgcctgaatccaggtgaactctaatcttcatgatgatagagatat

SEQ ID NO: 33172 - DNA, 820 bp, Triticum aestivum
  Clone ID: PAT_TA_33172
ctcctcagccgtcttcgcatcgcctcgcgcccgcaccccaggaaggtaagctcaagaggctgtcctgagaagctcaaatggctcccaaagttgctgttgccaagaagggcgatgccaaggcccaggctgccaaggttgccaaggctgtgaagtccgggtcaatcaagaagaccgcaaagaagatccgcacgtctgtgacatttcaccgccccaagaccctgtccaaggccagggaccccaagtaccccaggatcagcacccctggcaggaacaagttagaccagtaccagatactcaagtacccgcttaccactgagtctgcgatgaagaagattgaagacaacaacacccttgtcttcatcgtcgacctgaaggccgacaaaaaaaaggatcaaggccgctgtcaagaaaatgtacgacattcaggccaagaaggttaacaccctcatcaggcctgatggcaagaagaaggcgtacgtgaagctgacaccagactacgatgctcttgatgtggccaacaagatcggcatcatataagtcagagggagggtcctgcagtaggcgcttgtgtcgtggtttcttgtgttattggaattttgtagttgttacttagcaaaggggctcagtggctccattgcctaccatatcgctgcacactttcatgaatttgatgcaatcgaagtgacttgttgtgttgagctttgcgtttggtcttaccgtattggttggtttctttaccatccttcgacttactgtatttcctgtataatttcccggttttgctggttgtgtgtttgttgaagtctttgctgctttggac

SEQ ID NO: 33173 - DNA, 957 bp, Triticum aestivum
  Clone ID: PAT_TA_33173
ggggcgccgggcttcgcagctgtcgtcttcgcatcgcctcgcgcccgcacccccgggcagcgcacgtccaaggaaggtttaaggtcaaagctcaaatggctcccagcgtaaatggttcccagaagtggctaggccgaggacgaaggcccatggcacccacacgccctggcaaggtaggctaaggcggtgtcctggaggagaaatcaagtagctcccaaagttgctgttgccaagtaagggcgatgccaaggcccaggccgccaaggttgccaaggactgtgaagtctgggtcaatcaagaagacggcaaaggacgatccgcacttctgtgacatttcaccgccccaagtaccctgtccaaggccagggaacccaaagtaccccaggatcagcacccctggggaaggaacaagtctcgatcaatactcagatcctcaaggtaacccggccttacacaaactaggagaatgcaatgaagaagataagaggacaacaacacacttcgtcttcatcgtcgaccttgaaggccgacaagaagaaagataaaagggccgctgtcaagaaaatgtaacggacattcaggccaaaggaaggttaacaccctcatcaggcctgatggcaagaagaaggcgtacgtgaagctgacaccagactacgatgctcttgatgtggccaacaagatcggcatcatataagtcagagggagggtcctgcagtaggcgcttgtgtcgtggtttcttatgttattggaattttgtagttgttacttagcaaaggggctcagtggctccattgcctaccatatcgctgcacactttcatgaatttgatgcaatcgaagtgacttgttgttgataataaaaaaaaaacttaccatatcggtagctttctaaaccatcattaaaattaccatatttcctgtataatttcccggttttgctcgttgtgtgtttgggttg

SEQ ID NO: 33174 - DNA, 1215 bp, Triticum aestivum
  Clone ID: PAT_TA_33174
agaaaaagtagacatgccacatactgtgcttggcatttcttgtaagctggtcatgactaaatatgttggtaccatcttttactctcctgtttgtttaatgcaatatttgtttcatcaatcaagtgctgcaaaatcttatggtgcacctcatatgcagttgaatgccacgtatacagggttgaagagggtacttgttgctgctggtgttgcattaaagattactggtgcacagagagtgttcttttcccttcctcacagtataggtctcttagcaaatggacgcttggtggctactaacaaggacctaagtcaaatattgcccctcagccactcaacctgtgcgccattacttcacatgcgtgttgtaggatcatcagttacaatagttgcacatgaaaccaatgtctctggggggcacatgaagcccttgttgacttctggtgacgctatcgagttactatcagaccagtctgaagtgaacgacatgtcaggtcggttgatctcagcatgtgcgttctgttcaattagtccaaggttgccgaagcttgaaaaactcctgaagacttggttcagtgagaggaatgggttcaacagaacaatgaacttcttcgaagctagagtgacgtcaatgaccctggtaaaattccgtttggagctcgagagggacattactgaagaggacggcatgtgggacgatgttccagagtggaaaaccttgcctgtggtccagcgaatcacgcttgacgttatcgctagggttgaggaagaggggaggctcaaggctatatcggtgaagaaggtgaggaaatctctacagatagcggacgctacttcgtggagcagcctgacttcgaatgtctccttcgcagacttcacgtcgttggttctgccgcctgatccattgtcactggatgtaaagtggtaacagtttcttcttgtttatttacttctgttagtgataggggctgataggaaattgcacatatacatcaattccgtgtataattgtcggggccggaagtgtacctgcaaatgtggtttgtctgtaacgcaatgttgaaattttgtactgttcttgactacgttgctcccttttctccggaccacagtggggtggttgatttcagcttattacctgaagttgtagatatatctatttgtcagtatggaaacaactactgtatcataatgcaacgtggtgatgaaaaaaaaaaa

SEQ ID NO: 33175 - DNA, 648 bp, Triticum aestivum
  unsure (1)..(648): unsure at all n locations
  Clone ID: PAT_TA_33175
agaatttgcgatgaagagttggtactgcagacctgagaagcgataaagcagacggaatgagagggctcaaaatgagaaggtgtcctacccaagctcagtttaatgaggaaattcaagatgatcaagcagaagctgctctagtaaaaaaattgctcgaagagagtggcaatgacacgaagaggaagaaacaacctgtggatacgacgaatcagggtgccaataaaacaaagcagtttaaggcattgacgccaaaggagagcacgccaagaggagcgaaagaggttgacagttcttttactgaaggtggcttatcctccaaactgaaaaccaagctggcggttgatgcaaatgatatcattctggttaaaaagaaaaatgttcaaggaaaggatggtttaaaggagaagaggcagggagcaaggggggacagtcttgtgtgtggagcttgcggtcagcttggacatatgcggaccaacaaattgtgccccaagtatggggaggatccagaaacctcggaaatggatgcgatttcctacagacctaatcctcttgatgtagcaagtcatggtcaaacgaagacactgggcaggaggttggtagccaaggtttcttctgatgttcctngaaactgagggcaagaaagcattg

SEQ ID NO: 33176 - DNA, 670 bp, Triticum aestivum
  unsure (1)..(670): unsure at all n locations
  Clone ID: PAT_TA_33176
gcacgaggattgatctgtccgttcttcccttctcctctctcgtctagatcggcgtcggcggctcgatcgagcagaggaaaggcgaggacgatgtcggccacgacgggggcggtgccgttctggcgaacggcggggatgacctacatcggctactccaggctctgcgcgtccatggtgcggagctgcctcaaggagccctacaagtccgaggccgccgaagtcgagaaggtccactactcccgctccaagtggtctgacggaaagcagcccaagcccaccatctgcgaagatgataaatgaaagatccggtgccatggtgacacagtccttcctacggacgttttgaaaagctattgtgtttcgtgccggccattctacctaaatctcagttgttttctgttagatttatgtttcacgctcaagaataaattatttctgtgacattggatctgtctcttccgacaacattttattttatacttttaatcgctccacttcttcaatctgcttcattttaactgcctttgtcgtactcaagtcagcatgtttttatacattatgacattgcagacaaaaaaaatccttcatttatcatcttcgcagatggtgggcgtgggctgctggccgnnnnncctcannntngcgggagnnnnngaccatgtcgacngcg

SEQ ID NO: 33177 - DNA, 1073 bp, Triticum aestivum
  unsure (1)..(1073): unsure at all n locations
  Clone ID: PAT_TA_33177
ggcccccgccccccccttcccctgaaccctactccaccatggccgccgcccgcgccgccctcctccgccgccccggcctcggcgccgccgccgccaaccccgtcctcttctccggccacggcctccgctaccgcaagctcgaggtcatcctcaccacgacgatcgacaagctggggaaggcgggggagacggtgaaggtggcgccggggcacttccgcaactacctcatgcccaagatgctcgccgtccccaacatcgacaagttcgccatactcatgcgcgagcagagcaagctttacaagcgtgaagaggaggtggttgtcaaagaagtctcaaaggaggaggatgatgctcggcaagcggaagagaaactgaagcagtgtcaagcagcagcaaaacggctcgataatgctcttttggtgttcagacggttcatctctgaagggatcgagttgcgctctcctgtaacaaaggatgaaattgtttctgaggtggcaaggcaactcaatgtcaacatttacccagacaatttgcacctggtgcaaccattgtcatcccttggcagacctcgaggagccacttcggtgacagatcgctataccgcgcggatatggcaagctacaatggactctcaaggtcaggatcaggagaccctaagcactttcggtgggcgatcttgctctccttccaaggtgctgaattgcactgaaagagcgctgaatcgtacaaaaaggccatttcacccttcgggtgaataaacaccctcaaatagaccttcaaactcaaccttttccctttacaattggcttgggctatcgtcccgggcggggcgatatgatcgggcgttttgaacctgtgaataatcgttgagaggtagtgtacctttcgccgggggtgcggggcctagtcatcttgttcttgtctggctcgagcgccctctcctcgtgtgagtgggcccagtccgggtgtgagaggggaaggttgtgtgtgcaaggnatccttnaaaaggaaangccgggagtgaaagctcctcaaaaatgccaattggggcctcacatcatatgaaaaaaaaa

SEQ ID NO: 33178 - DNA, 861 bp, Triticum aestivum
  Clone ID: PAT_TA_33178
agcagtgcacccccaaattccccaaattaaaccctcgctcgccgttcagttcgattcgtttctaaactaggccactaggtgtgtctgttttgaagaacaaattgtttccgttccaaaatgtgctgaaattgcaaatgactcaaggaacacatgcttagggctgaaattataaatgtataccggaacaaattcttgtggttctgaatttgctgaaattgcaaatgtgtctgagaacagattattaatagaattcttggggttgctgaaattagaatattaatagactgtgttgacgactctgcttcattttactgtgatgctgaattcaaggtataaggggaattcgctgcatgccttcccagaggaggagccaaagcaacaccaagtcgcagtttcacgcgccgcttctaaggggagatatgcgaggtttaaagagaatttgaatgccaagccacaggagacgaagcaacaccaccatcaagttgctgtctcatgcgccgcttcaaaagggaggaatcgagatggttggatgtcccaggagaggagcactcctgaaggtatcaatatggaggaacatgctttgaggtttcagcctctgcccccacccagaggacgcgtgactttgacctggcctccatcggaattacacctgtaatgcgaaagaggaaacctccggaggtgaggaatgcactccgcgaaagaagagtcgctgccaagcaaaaggatgcgcgctaccacgcagaggtggccctgcgtaaatacaaccgagcgaacaacactaagtttgagctggtggaggtaaaagtgatatctatattttacgagtttggagggggcggcgcccattataacttcacagct

SEQ ID NO: 33179 - DNA, 1845 bp, Triticum aestivum
  Clone ID: PAT_TA_33179
tcggcccgggccggaagtcggcgctcgcccctcttatgccacaccgacccactcccccctcacccccgcgcccgagcttcggcaccaatcctccgcactctccccttgccgccgggatggacgtgcagatgggcgagccgcaggcggcccctcctcccgccgccgcagcggcggcgccggccccctccaccatccaacatctgaaggagatcgccgcggtgatcgaggcggggtcgctctccaaggaggtccgccggatctcccgcgccgtccgcctcaccgtcgccctgcgccgccgcctcgccgcccgcgacgtctcggccttcctcgccttcgccctcccgggccaacagcgacgcatacgcccgcctcactcccctcctccccaaggaagatgaagctgagatggatattgatgcagcagctccagcaactcagatttctatcaagcatggccttcctgagattgaaatatattgttctttgcttggtcctgattttcctcattgatcagaagaaatacgacgaggctaaagcatgcgcaactggaagcattgctcgtctgaagaacttgaacaggagaactgttgatgttttggcttctagactatacttttattattcatatgtgtatgaacttacaaacacccttgctgaaattcgtggtaatctccttgggttacatagaatggcaactttacatcacgatgagcttggtcaggaaaccctgctcaacctgcttctccgcaattacctccactataacttgtatgaccaggcagagaaacttaggtcgaaggcaccacgttttgaagcccattccaaccagcaattctgccggtacctcttctacttggggaaaatcagaacaattcagttggagtacactgatgctaaagaaagcctcctgcaagctgctaggaaggcaccggctgcagctcgtggttttaggattcagtgcaataaatgggctatcatagtaaggctgcttcttggggagatcccagagaggactgttttcatgcagaaaggaatgaaggaagctttggcaccatattttgagcttacaaatgccgtcaggattggcgatttggaactgtttagagctgttgcagacaaatttgcaagcacattcagtgcagacaggactcacaatttgattgtgaggctccgccacaatgtcattcgaactggactacgcaacatcagcatttcatactcgcggatctcccttgctgatattgcgaagaagctaaggctagacactgagaatcctgttgctgatgcggagtgcatcgtagccaaggccataagagatggtgcaattgatgccaccatagaccatgcaaatggctggatggtgtcgaaagaaactggtgatgtctactcgacaaatgaaccccaggctgcattcaactccagaatcgctttctgcctcaacatgcataatgaagcggtcaaggccatgaggttccccccgaattcgcataaggagaaggagagcgctgagaagcgccgagaaaggctccagcaggaggaagagctggcaaagcacatggccgaggaggatgacgatgatttttaagttggtctgttttttgaattgttgatttagatccctgaaatcactgaattctcccctctagggagatttgaatcatgtaaactttttacatcttctgtaattctatgttgatcagcacttcattggaccgtaaatgtgttttgagtttatcttttctcttcctcgtcgaaactgggttcgaggatctctgtaccatttgaaatccaccttgtccattcaagacttttggtatgtctgtgcttcctgacaaaaaaaaaaaa

SEQ ID NO: 33180 - DNA, 451 bp, Triticum aestivum
  Clone ID: PAT_TA_33180
gggtggacgacaatggagtcgcccagccggaagattggttcgggctggacccggcgcacggcgaggactcggcggaggagatcgactccagcgacgagggcgaagaggaggaggaggagggtgaagacgccgagccggctggtgaagtagccggccagcctgaccgcgcctccagcactacgtcgcgtgcgagtgcgtctcctgtcgcgggaagcggtcaagccgggaccagctagacggccactccctcagccggcgagctgccttctccgaccaactcggccttcgcgcctttgtcttctttcttttgtttcctgtcttgttacttttgaacaatgtttttggttaagtctgcacaattccacccactgggtgtattcaaacttaagtctgttgccggcctgtgggcggctttatgtacataagttatgcaatcggtctttccttgttc

SEQ ID NO: 33181 - DNA, 741 bp, Triticum aestivum
  Clone ID: PAT_TA_33181
aaaccagtgttttactaaccatcaacgtacattttcatcattcactaactccagtagtgagtaaaaatatataaaactacgtgacttgtaaacttttgtgtctgtcgtgtgtcccaacgattccatcggcatcggccctcccctaccctggtgcggactgcagtattagcggtctccttggagtcctgaagcagctcaagggcatcgtccttggtgcgcctcctcaaggcttgatgctttctacaggaaaaaaaatggttcttttctttgagatgaggaaaattacttccctttctacaggaaaagatggttatgttagataaatgtcttcccaagttaaaggcacatggctccgaagtactaatattctctgaggggcaccataacatatgaaaattttgaagagctttgtgaagatttgtgggagcagctccgactccaattaaagaagttccacgcagcgggcatgaagattggtcacatctatatgtttagttgtgctgcaggacatgtgctattctgaaaatggagcttctctattggatggcagctcatgatggtagtttcagatatgaagctaaggaaagcgtgcctcataattcattagatgtatcccagtagggccaattagatattgttggttgtaaatgacatgagtttttagctttcataaaatctagatttgtactctttaacaataagctgtggaggagagtggtcttaaatgcgctggttgaattt

SEQ ID NO: 33182 - DNA, 635 bp, Triticum aestivum
  Clone ID: PAT_TA_33182
acgggataaacgagagagaaggaagtgcataaatatccgaaagagaaggaagtgcagaatagatgtgttaatctgaacataaaagaagagttagtatgtagttctagcacatcaaatacaacaggtttctcaagctctacatttagtgctttacgaaagattgacaaggacaagatggccatggcgttggggtccctgcagacaagtaatccaactatttcaagtttccagtgcacacagtccttgagtcattcatctgaattatcatgcccttctcgaatatcaacaggatctaccctaccttccaaaactactaaggaactgtttggcattgagactgaatactgtgtggccaaggcttcatgtgcccaggttagtcaactggggaaaccttcttcaagtcaatccaatgaagtctcctggccagcaaacttacgacatcaggttgagcaactcgaccacggaacagtaatagttggcaaaaattggtgcaaccatcaagctatcttcccaaaaggatttaggagtcgagtgacattttacagcgtactagatccgacaagaatatgttgttacatttcagaagttattgatgctggacttctcgaaccattgtttagggttgctgtggagga

SEQ ID NO: 33183 - DNA, 394 bp, Triticum aestivum
  unsure (1)..(394): unsure at all n locations
  Clone ID: PAT_TA_33183
nnnnnnnnnnnnnnnnnnnnnnnnnnnnntcttttcttttttttatagccccaacctccacataaaaatcagagtttttcacaaatttcacactgcagttgctcacaattttcaacctattgctggttggttacatgattaatgcacacttacatctcagcttgcagcctggtgttgttttctcaactcccaaggaacaacattcttcaagtactgatggtcttcagccttcacaattgtaaattcatctgtgaacagaactaaaatatagcttcgggcttcatgtaccaaacacacttttttttccacaaatttaagtgtagtttctttcacaaatttcaatctgaaagttttctcaagtcccaaatagcagcacacatgtaccttttccaag

SEQ ID NO: 33184 - DNA, 1518 bp, Triticum aestivum
  Clone ID: PAT_TA_33184
cagacaatatgcctccgcaatattattatgcttacggttgctcacaaattataagaggatatgctcaggctcggaacttggagcaagtaccctcgccaaaaagaaaatacttccagtaagtagcactaactgacgttgttcaacattcacagttgtaaattcccctgtgaacacaactaaatatagttccaacctccacataaaaaacagagtttttcacaaatttcacactgcagttgctcacatttttcaacctattgctggttggttacatgattagtgcacacttgcatctcagcttgcagcctgatgttgttttctcaactcccaaggaacagctttcttcaagtactgatgttgttcagccttcacagtacatggggcaacgtgagctccggccacacttagttcagagagtcaatagacggggtcatagcagattctgcattgtcaggagaggcaattaattcttctagcgtgcggaacctcttatgatcggctgccggttcttccacgggccccttgcgacgttcatgcttcagttgaaacctaggacttgtcctaggaatgccagtatggtagtccttcctagcatgtttcaccttccccctcaccagctctgcatcagcaccatcagaggtcagagcctcagctggcagctcttccacggacccgttacgacattcacgcttcggttcaaacctaggacttgtccgaggagtgccggtatggtagttcttcctaggatgtttcagcttccctctcaccagcttccgcgtcgccaacttcagaggtcagtgcctcggctggcagctctttcacaggcccgttatgatattcatgctttcggttcaaacctaggacttgtccgaggagtgccggtatggtagttcttaggacgtttcaccttccctctcaccaactccgcatcgccaccttcagaaatcagtgcctcggctggcagctcttccacaggcccgttacgacaatcatgcttcggttcaaacctaggacttgtccgaggagtgccggtatggtagttcttcctaggatgtttcagcttccctctcaccagctccgcgtcgccaacttcagaggtcagtgcctcagctggcagctcttccacaggcccgttatgatattcatgctttggttcaaacctaggacttgtccgaggagtgcccgtatggtagttcttcttaggccgtttcaccttccctctcaccaactccgcatcgccaccttcagaggtcagagcctcggctagcagctcttccacaggcccgttatgacattcacgcttcggttcaaagctagcacttgtcccaggagtgccggtatggtaatccttcccaggatgttgcatcttctctctcaccagctccgcgtcgccaccttcagaggtcagtgcctcggctggcagctcttccagaggcccgttccgacattcaggcttcagttcaaacctaggacttgtcctaggagtaccggtgtggtagttcttcccctcgtgccgaa

SEQ ID NO: 33185 - DNA, 621 bp, Triticum aestivum
  Clone ID: PAT_TA_33185
aggaacttcggtggcgcacacgcgggagctcgaggaggatccgcgggagctcaaggaggacgtgctggagcttgaggcgggcgcgggtacgtggcgacggcggcggaggacttcctggtgggcgacgaatcgcgcagctgggcggcgccggcccctgtcaacggcgaaggaaggtgttcccggaagaccgggatggaggcacttatttgagatggttttaaatctgtgagggctttttagcaaaattacaaatgaactgagtctgcgacatgttttttgggacggagggagtatttcggtagggatggagtagatggtatgctagctcaaaaaagaaaaagagtagatggtatgcaaacagccaaactaagtgcaaccaggctcgctgggaaaggctaccaaacacggccctaggggccacgtgcagccactcaatccacttgcttgttttcactcttgtgttttggtgggcactcgtgcggacgaagcatggaagctcgcgacatgacctgggctcgcacccaacatcagacctctcgcgcccgcacgcacgccccaagacatggctggaggtggtgcccgcaccgcacgccccgacagcttcatccgacacgcgggaac

SEQ ID NO: 33186 - DNA, 1153 bp, Triticum aestivum
  Clone ID: PAT_TA_33186
ggagattttcttcagcagtaacatcgagtcaaattcaggaaatttttctagtaaagtactacctccgtacaataatagcttgagcgaatggaagctccccaattgtttgacacgcattattttcacattgaaaatgctacaataaccccttactttttagggagaaatgatctgggtcttactggctcgcactatgaggtggtggtctagtcggtcatgacttgagcctcgcttctacatattaaactagtgcgtagttcctccacaaatcgagtcggttttaactttacacttaagggagtcacccgccatgcacgacgtttactgaagccatcgccagcctccatgcctcgagcttggacaccttcacgagtctgctcccattattgaacacaaacacatggctatttttgttctccgcatgctcaggatacacccgtgccgtgatgcacgtccgccccccccctccatcgcgtgccgccgccgcacgggcgatctttgttcctaagggtgtgtctgaacactctgaagaagacggccgtgtgctcctgcaggtcgctggaggccatgacgagcagcccgaatgggccgaccccgcctggcacggacgcaccattctcctcgcatagcttctgcgggtccagcagccagttgggctcgaacgtctcagcctcttctagcgatgggatctcgaagatggcatccacgtcagcctgcgcgcccgcgccactgatctcgttcacgccaccggcattcacatgtgctccttgcaatgcggcgactcgtttgctcctcaacgtctcgatctcctcgatcggcccctgtcgtagctgcttaccgtctccgtccagccacaccttcctcggaactatctgaacaccggaccagcctctggcaaggtcatcgtactggctatcggactcgctagcccatgcccagagcacgcgtcggttcttgcgcgtgtcgaagaaggactttgaggcgtatacgtgcccgtagtcgaagcggcgccaggtccggcagtcttcgacgctgcgctcgccatccacctctggcacgaaggtgtctgccacatcatcatacctcccaattgcatagtagtcctgggtcatgtttgtcacgctcagctttagcacatgcctcatagcaccgc

SEQ ID NO: 33187 - DNA, 1018 bp, Triticum aestivum
  unsure (1)..(1018): unsure at all n locations
  Clone ID: PAT_TA_33187
actatgccacgaagtctnncatgagctgagccgcgaaggacttggtggtctgcatgttcatgtcgtagccggcggcgccgctgccaccgctgtcggcgccgttgctgctgccgcctcccannngaacgccgtctggtcgccggcgccngtgggggaggccgagcgtgagcgagacgccgcccgnntgcccggccccggcgaacgcgaacgactggtcggtgccgaactgcnnntcggccccggcgcgaacagagagtacccgccgccggccccgtcctcgtcctgttggtggtggtggtggtccctcgcgcccgccgcgccgccgctctccatcatcttcatgagcagctcccggtgggtcacctcgtcgtgctgctgcctcgctgcggcggccgcggccgccggcggccgcctgcgcgtggtgcaacgcgccgaagtcgaacgccgccggcggttgctgctcgaggccggccgccctcgccttcttgaagccgcgccgcaacccgccatcctcaccctcctcgtcgtagaaccccgcgtgcgcctggtggtctccggcgagctcgagcaaggacgcctggacggtgccgccgccctccgacgtcccggccccagccgccgctctggccatggacctcggagtgccgtcgtccacgccgtcagcgttgctgctgctctttcctccggcggggccggacccggacggcctccccttgtcgtcgccgccgtcctgctgctgctgatgctccttggtctcctccaggtacatctcctccaccatcggcttccacagcctcaccctcgcgttaatgaaccagttcgacacctggctcctggtgaggccggtctgcttggcgagcatgatcttgtccgaatccttggngtatgggtggaggaagtgctcgaagagccatgcacggaggatggagacggagcgctcggggaggccccgctgcgggcgccacgcgctgctctgcatcattcccagctgctgcagcgcgcgctgctgccggagctg

SEQ ID NO: 33188 - DNA, 636 bp, Triticum aestivum
  Clone ID: PAT_TA_33188
gcatcagtaaaccagggatatcagatcagatagtttcaaaatgttgggctacacaagaaatccctcccaacctgccaactattttggctcattcctcttaacaaaaacatgcttctgcgacgcaaacagaggatcatctcacgggatgagtggcaaattctgctaaaagggaagaatgcctgctgcgcacagagcacctccccctatagtgatagaatcttatcttggatccactcaaatagcttgcggatctttttggtcatttcgccgctctttgaaaaataagacttggcattggcaagcatcacagtggcatcatgtttgacagcctccagagttctgtagtaatcgctctgtagtcttgctctgatcacctcaatggagaattggacagggaacctgtttatgaaatctgattttcctgcaacagtatctaacttcagaacaccatagcgatcctgatttctgagagccttttcctgtaaaccgagaactgctggttaccatttgttcctggagctgggattctaatgttaaaagggccatggacccactggcggacgcgcatcatgcacctcccaggggctatgcggatgttcagaaccatcagtttcatactgtatgacatatttctcc

SEQ ID NO: 33189 - DNA, 502 bp, Triticum aestivum
  Clone ID: PAT_TA_33189
gttttgtgcttagcatggaagaggtaattaacaaacagcaatcacacggcttgcgaagccacacgcatgcacaaaaccaaaaggcatgacagattttacattgaacacgcatgcgcagaagcagcccttgaacagcctaaggacgatgcacatgcatgaactaaagctagttaattcactacttctggaagtagtcctcggtcctgcccttgaacccgatctggccgaaggtgagcgcgatgaacagacccaggtgccacgtcaccaaccacagccagaactgcgactggagagccgggggtgaggggaagtgggcgagctcctctaagaagctagctgcggagggatggctccgcatagctagttagcaggctgaggtctcgttcgttaacggaattaaccagacaaatcgctccaccaactaagaacggccatgcaccaccacccatagaatcaagaaagagctctcagtctgtcaatccttgctatgtactggacctgc

SEQ ID NO: 33190 - DNA, 965 bp, Triticum aestivum
  unsure (1)..(965): unsure at all n locations
  Clone ID: PAT_TA_33190
tatctaaactaccttatcatcatcgtatattggacaaaggaaacagctcttggtcatgattttttccatttagaacacggtcccaaagaccaagacagtgttcatgattggttgcataagctacgttaaaaaagaaaagtcatgaaacgccgaagcgcagtcatggactaatctatttcttggaagccttctgggcggccttggtgaccttaccagccttgtcggacttctcaacggacttgataacaccgacggcaacggtctggcgcatgtcacggacggcgaaacgtccaagaggggggtagtcggtgaaggcctcaacgcacatgggcttggagggaaccatcttgacgatggcagcgtcaccagacttgatgaacttggggctggcctccatggacttgccggtacggcggtcgatcttctcgaggagctcagagaacttgcaggcaatgtgggcggtgtggcagtcgaaggacgggcgcgtaaccggcaccaacctgaccggggtggttgaggacgatgacctgggcgttgaagctctcgcagcccttgggggggtcgttcttggagtcaccggcaacgttgccacgacggatctccttgacggagacgttcttgacgttgaagccgacgttgtcaccggggagaccctcgggaagctgctcgtggtgcatctcgacggacttgacctcagtggtgacaccagcgggggcgaaggtgacgaccatgccggccttgatgataccggtctcaacacgaccgacgggaaccgtgccgataccgccaatcttgtagacatcctggaggggaagacggagggccttgtcggtgggacgggtgggggggtcaatggcgtcgatggcctcgaggagggtcttgccagtggccttggcctnggtctccttctcccagcccttgtaccaggggcagtngngagacgtcgatccctcgtccgaattcct

SEQ ID NO: 33191 - DNA, 467 bp, Triticum aestivum
  Clone ID: PAT_TA_33191
ccctcgggcacaccttgggcttaattaattaacattgcgcgcagccagggaggaggtcatctcgctcgctcgaccatgggacaaataaacacacaaagtccgggcagctacacgttgatccacaacgtacaagtacccatgcatatttcgtccaatggacggacggacggacggatggctaaacacattaagcttccgggggcaaagttgggggcaaaggcccacccgttgttgttaactgggtcggcaacggggtcaaaaaggttctaaacgggtccctttccggggacaatggcctgcccaaaaaacccgaacatggaaaacatggcgggggggccgttcttgacctccttgaccttgagctcaactggggggtcggggtcctcggcaaggccaagtgggtcaaaggcccccccggggtaaataatgtcaaggccctccccaagggggcccccaccaacgcggga

SEQ ID NO: 33192 - DNA, 721 bp, Triticum aestivum
  unsure (1)..(721): unsure at all n locations
  Clone ID: PAT_TA_33192
aataaacaaacaggaatcacacgggttgggaagcccgacccatgcccaaaaccaaaagggatggcgggttttacattgaacacccatgcccaaaaacagcccttgagcagcctaagggcgacccacatgcatgaaccaaagctagttaattcactacttttggaagtagtcctcggtcctgcccttgaacccgatctggccgaaggtgagcccgatgaacaaacccaggttgccacgttaccaaccccaaccaaaactgcaactggaaaaccgggggcaaggggaaatgggcgaactcctccccgattctggaaaaaaaaaaccccctcaaactgtttccctttatcaacgggatgcttgacggttccaacccccccatcaacccgaaaccgatcccgtttaggttcctccgcaacccattccccgggaaagtcattcaggggatccttccgtttctttcccggtttcttgtcatcaacgggtttcttgccggcccccgggccccccttgtgaaacttgttgagaaggctggcccgcgggtgaacccggcccccgcgaggcccgaaacggtggaggtggcggcggcccttttttaactggtgttcttcgaagcgaaagggcggttttttttttttttttttttttttttttttttttttttttttttttttttttttttttttttttttttttttttttttttttnnnttnngaattcccg

SEQ ID NO: 33193 - DNA, 696 bp, Triticum aestivum
  Clone ID: PAT_TA_33193
atcataaaaccatttctcagaggagtatgcttttgccatacgattatgtacgctttgacagtaacattggaagatactttacatgaatgaagggagggggagaaaaaaaagaacagagaatcaacctcagattacaattgcatcagttgatgccgccgctagtgtacaattaacaatacacaattgcaatgatggtgcccatcatccttttcacagggcttccttcccagaatccttctatctgtagcaatatttggccagatgaacaaccacgctgcgacgcacgaccaaataatctgtgcatacgggtcatctgctgccattgccaggcaaagaaatggcacgagagaaagagactacaggtgatgtcatgtgtttgcctatgatccactctcaatttcgttgctgaacggtaaccgatcgacacccctctcgactgcatccctccatagccgataccggatgccgagcttgtcatacgacactggccagttccaaacgttagctccattgttcattcggtcttgttggccgagcacaagccgcagatcctcattcaagaccttctcagcgaaatgtgaccacaacaggtgcatgaaaggcatgtgcttcatccagggtgcgaagtcgagagacatccggtacaacagcctggttttattcgtcgatgagggcaagcatacatggagctggtgg

SEQ ID NO: 33194 - DNA, 473 bp, Triticum aestivum
  unsure (1)..(473): unsure at all n locations
  Clone ID: PAT_TA_33194
tagcgtggtcgcggccgaggtacttgttgttgaactcagttttgtgcttagcatggaagaggtaattaacaaacagcaatcacacggcttgcgaagccacacgcatgcacaaaaccaaaaggcatgacagattttacattgaacacgcatgcgcagaagcagcccttgaacagcctaaggacgatgcacatgcatgaactaaagctagttaattcactacttctggaagtagtcctcggtcctgcccttgaacccgatctggccgaaggtgagcgcgatgaacagacccaggtgccacgtcaacacctctacactctactacagtagtttagtccggcggcgattggccttggcattggcactgccggattgctcacgacctacccggacaaaaccaaagcgcgaaacattaaacttagcacatttaagaagccattaacgtctcgatcgacctnnnnnnnncgnnnnntcga

SEQ ID NO: 33195 - DNA, 901 bp, Triticum aestivum
  Clone ID: PAT_TA_33195
tagcgtggtcgcggccgaggtacattgccgggaatgtggtcgagaccaaggggcgatccctggaagagattgagcgggagctaagcccacccagtaaagccgatgctaatgctttcttggtgagtgatcaatgagcaccgagcacaaacgtcctcggacctcgggatgttgtctctgccttttatgtagttcctgaaataagggagccgcaaggtcgcctgacgccattcaaaccggccggtgctcagggtgttgtggcaccagtaaagctcagttatttcttgtcacatctcagaatcaaagagcttatgtgctattgctccaggaggtgcaagatttaggcttgctgctagtccttggatcggatgtcatcgttttcagtgtacattccatttttgatggttcatctgttataatccgttacatggctcatggcagattgctacaaacactttggaacgggtggcccctctgacacatgctgttggcaatgtgttgaaaagggttttcgtcattggtttctcgatcatcatttttggcaacaaaattaccacacagactggaattgggacttgggttgcaaaagctggtgttgccctctactgggacatcaaagctaagatcgaggaggaaaaaagggcaaaggccgcctaataaggtgactcctgtaaaaatggtttaatggtttccggcgctcaagttgcattgcctgggaaacaaaatggagggatttttttttggttatttgttttttgtttttcagttatctgcaaaagtgttcccttgtgaggtcaaacagctacattgcaaatggtaagactggttgtttccatcaaatgaaagagctcaaatgtgcagtaataaacgctgggacttgtaaaggcttttggttttgtgtgtg

SEQ ID NO: 33196 - DNA, 777 bp, Triticum aestivum
  unsure (1)..(777): unsure at all n locations
  Clone ID: PAT_TA_33196
gattttgctggaagctaatctaaactgagcagaccatgcaggccgccaacgacatcgcttcgtgattttcgtgccaaatgacaaaggaaaggtttttggtcaaggaattttttcattgtaaacatgcactgctcctttgaccaaaacagcacacgagtgtttgcataagctacgtcaaaagagaaaagtcatgaacgccggagcgtgatcatggactaatctatttcttaccagccttctgggcagccttggtgaccttgccggcaccacccttgtcggacttctcaacgctcttgatgacaccgacggcaacggtctggcgcatgtcacggacggcgaaacgtccaagaggggggtagtcggtgaaggcctcaacgcacatgggcttggagggaaccatcttgacgatggcggcgtcaccagacttgatgaacttggggctggcctcaatggacttgccggtacggcggtcgatcttctcgaggagctcagagaacttgcaagcaatgtgagcagtgtggcagtcgaggacgggcgcgtagccggcgccgacctgaccggggtggttgaggacgatgacctgggcgttgaagctgtcgcagcccttgggggggtcgttcttggagtcaccggcgacgttgccacgacggatctccttgacggagacgttcttgacgttgaagccgacgttgtcaccggggagaccctcgggaagctgctcgtggtgcatctcgacggactnacctcagngnacaccagcgcctcgtccgaattcct

SEQ ID NO: 33197 - DNA, 668 bp, Triticum aestivum
  Clone ID: PAT_TA_33197
aggacgacgccaggaccccagaccgttatgcatgacacgtttcaaaagtcatcacagcttttccgaagcaaccacatccccagaaccaggtatctagagacgaaagaagagaaacaagcaacccaagaagagagcgcttatttcttggaagccttttgggcggccttggtgaccttgccggccttgtcggccttggcgacggacttgatgacaccgacagcaacggtctgacgcatgtcacggacagcgaaacgaccgagaggagggtagtcagtgaaagcctcaacgcacatgggcttggagggaaccatcttgacgatggcggcgtcaccggacttgatgaacttgggagagttctcaacagactttccggtacggcggtcaatcttctcgaggagctcagagaacttgcaagcaatgtgggcggtgtggcagtcgaggactggggcgtaaccagcaccgacctgaccagggtggttgaggacgatgacctgggcgttgaaggactcggcacccttgggggggtcgttcttggagtcaccggcaacgttaccacgacggatctccttgacggagacgttcttgacgttgaagccgacgttgtcaccggggacaccctcggtgagctgctcgtggtgcatctcgacggacttgcctcgtgccgaatt

SEQ ID NO: 33198 - DNA, 577 bp, Triticum aestivum
  Clone ID: PAT_TA_33198
gctcgttttctggaacctcttagaccgaggccgccttcctcggtttcgtcggccgtcgcggtcgtcatcctcaccgaacagctacagggactgtgacgggctccgctttgtccacatcttctctggaccactgattcgaagccgtggatccctcctacttcttcctgacgctgaccgccatgaccgctgtccagaactcgttgctctgctctgtccgacctcgccactaacagcaggttgtgtgtggggagcgacactgtttttgtttcagtaacttgctggcacaaatgctgtcgtgtactactctacgtccatgttccacagtacatgcattgcatctaatgttgcagcgagtgctcttgttcggtgatgccaatgtttttggcaccatgattgcatctccactgatggtcaagcaaggaaggaagagccttctcataacaagattatctggaatggtgcgtcgatgttactcttgacattgtccttcacctggaaggctttagcaccttattatggcactcttgttgttgttggcactgtcctataagtggtttaaattcacctaaaaaaaaaa

SEQ ID NO: 33199 - DNA, 786 bp, Triticum aestivum
  Clone ID: PAT_TA_33199
gaattcactagtgattagcgtggtcgcggccgaggtgtaacgaggacacacatgaatatatgcataatgtaaccatggcgtgctgcctgaaagtacgtactccctagtctttacaatacacatacttaatatttttttcttacacattttccgtggctcgcttgactcactcgatcggcaggtagagtcctcgaaccaccgccagttttctctcctaatcatgcagacaaacgccacggaagtagcaacggtacacctctacagtctactacagtagtctagtccgtccggcgtccgattagccttgggcatcggcactaccggattgctcacgacctacccggacaaaaccaaagagcgaaacattaaacttagcacatttaagaagccattaacgtctcgatcgagctggagcttgccgtcgccctccggcagctccggccggatcagcgaatcttcccacgctacttcgtcatctatgtggccttgtggcagctagctagccgagacggacggatacagcgcaagtcttcgcatcgcgatctgccaacttgcgttcagttggtggcggccatttccaccttcttctccttcccggcgtcgtcgtcggcatccgcggcgccctgcttgtgcgtggccgtgtggccgaacagcgagctcatgtcctccagcgtgcggccgcgggtctccggcaggtaggcgaagaagaacacccaggcgaacgaggcgatgccggcgaagaggaagaaggcgccgccgatggtcaacctcggccgcgaccacgct

SEQ ID NO: 33200 - DNA, 697 bp, Triticum aestivum
  Clone ID: PAT_TA_33200
ttttttttttgaaggggaatagttgttgatgatggataatgtgtccaagtacaaaggattgctttcagataccttcctttgtgctatattcatctggaaacatgatcttccttgatatgatcatttaagagtgttttacaagcctttccttacataaatgatcaattggaggaaacacaaaaccagacggctcgcctcataagtcataactcataaggatacatgtgaatggtataacatggtagcacaagaaagtgcgacctagctcagaacacgttgaaggggagagttcccaatgatggatagtgtgttccaagtataaaggatcacttgcagataccttactaaattccgtggccaagcatgaatggcttcgctcattcctcgccaattaagatcttgactggtcacctgtctaaatgcattcacaggaatcgcaagcttcgcataaaccattgcaagatttaaaataggcggcgtcgatttggaacaatctctggactgttgttcttcatcatcgcaacaaactcctggtagttaattttcccatcatgatctgtatccacttcagcaatgatatctttaattgttgcctcatcacccatatcatacttcttcagagcttcctccaactcatcaactgttatgtacccgctgtggtccttgtcaaagtattcaaatgctttaaatatgtggt

SEQ ID NO: 33201 - DNA, 558 bp, Triticum aestivum
  Clone ID: PAT_TA_33201
tacctctctagctacctgcccctagttttgtcgatcccgccgtcgatttcttgtgttgttagaggtcacatatcactgtaattcattgctcgctgtgccaccgtgcggcgtctgatgcccccagttttttttacccaagaaatgttccccagtccagttgttgttctacagtaactctacatctgtctggtttgtagtaattggtacatcaaagctaagatcgaggaggagaaaagggcgaaggccgcctgatgaggtgactgctgtgaatatggtctgatggtttccggcgctcgagttgcattgcctcggagacgacatggacggatctcttcttcgttatttgttttttgtttttcagttatctgctaaagtgttcccttgtgaggtcaaacagctacattgcagatggtaagactggttgtttccatcagatgagagagctcagatgtgcagtaataaacgctcgtaccatggatctgatggattcccccctatggccctatctatgtcctctgttgatacttgatctttgtacctgcccgggcggccgctcga

SEQ ID NO: 33202 - DNA, 450 bp, Triticum aestivum
  Clone ID: PAT_TA_33202
gccgggaatgtggtcgagaccaagggggcgatccctggaagagattgagcgggagctaagcccgcccagtaaagccgatgctaatgctttcttggtgagcgatcaatgagcaccgagcacaagcgcctcatccttgggacctggggatgttgtctctgccgtttatgagtagttcctgaaataagcgagccgcaagatcgcctggcgccatgcaaaccggctggtgctcagggtgttgcggcaccagtaaagctcagctatctcttgtcacatctcagaatcaaagagcttttgtggcattgcttcaggaggtgcgagatttaggctggctgttagtccttggatcggatgtcatcgttttcagtgtacagatgaactccttatatgtgtcggaactcggtaataaaactccaatttgccgaatttcaaagcgcgatatttaattaaaaa

SEQ ID NO: 33203 - DNA, 289 bp, Triticum aestivum
  Clone ID: PAT_TA_33203
tagcgtggtcgcggccgaggtactaatgatacacgattcttccatccatttgctcgtgcatctcgtgcttaattaatttacattgcgcgcagccagcgagaggtcatctcgctcgctcgatcatggtctcaggcccaggtgaaggagtcgttggatacaccactggaaatggtgctacacctcatcacgacttgcgaagccccttcaagatcgacaagaatggacgcctgacattcaacggtgttggagccaaagcttgcccgggtacctgcccgggcggccgctcgaa

SEQ ID NO: 33204 - DNA, 677 bp, Triticum aestivum
  Clone ID: PAT_TA_33204
acgtactccaagtctttacaatacacttacttaatatatttttcttacacattttccgtggctcgcttgactcactcgatcggcaggtagattcctcgaaccaccggcagtttttctctcctaaccaaagctcgcgtgcacttgacccatgcagcgcgactatgagacaaacgccacggaagtagctacggtacacctctacactctactacagtagtttagtccggcggcgattggccttggcattggcactgccggattgctcacgacctacccggacaaaaccaaagcgcgaaacattaaacttagcacatttaagaagccattaacgtctcgatcgagctggagcttgccgtcgctctccggcagcaccggccggatcagcgaatcttcccacgctacttcgtcatctatgtggcagagtggcagctagctagccgagacggacggatacagcgcaagtcttcgcatcgcgatctgccaacttgcggtcagttggtggcggccatttccaccttcttctccttcccggcgccgtcgtcggcttccgcggcgccctgcttgtgcgttgccgtggtgccgaacagcgagctcatgtcctccagcgtgcggcctcgggtctccggcaggtaggcgaagaagaacacccacgcgaacgaggcgatgccggcgaagag

SEQ ID NO: 33205 - DNA, 958 bp, Triticum aestivum
  Clone ID: PAT_TA_33205
tgtgaatggtataacatttttttacgggcgtgaatggtataacatggtagcacaagaaagtgccacctagctcagaacacattgaaggggagagttctcggtgatagatagtgtgtccaagtataaaggatcacttgcagataattccgtcgctgagtatgaatggcttcgctcattcctcaccaattaagaagatctcgactgatcaccggtctcaatgcaacaacagaagtcgcaagcttcgcataaaccattggaagacttaaaacaagcgccgtcgatttggaacaatctctgggctgttattcttcatcatcgcaacaaactcctggtagttaattttcccatcatgatctgtatccacttcagcaatgatatctttgatagttgcctcatcacccatatcatacttcttcagagcttcttccaactcatcaactgttatgtacccgctgtggtccttgtcaaagtattcgaatgctttaaatatgtggtcttcccttcttctagtctattcatgtgcattgttgccgatatgaattcaacataatcaatggtcccatttccatcaacatcagccgcctccattaactgtcttatttcttgattcggtaattttggtaccaagctttggtaagccagcccttagttcatcaagggtaattgtcccactattatcagtatccagggacttgaacatttctcttaagcccacgatcccttcctctgacaagctctctacaacaatcttcaaggcaaccttcttaagcttgttcatcgccctgaactgcttcattctactgatcactgtaatatcaagtggtttgtctggggcctctccatcctctctgatccatggatggttcaaaatttcggcagccgtgagccgctccttggggtcctgccgtagcatcctcttgaccaagtctttagccccgtttgaaatcgatggccaggg

SEQ ID NO: 33206 - DNA, 884 bp, Triticum aestivum
  Clone ID: PAT_TA_33206
gcaaaaggggaaccgtcgtcttcctcccccttcttccccatcccatcttcgtccctcgcgagctcgccattaatcccactccactcggctccaaagggccggccggcggcctccgctcgaagtcgaaggtgcgacgacgtcgttttccacccgtccccacgtcagccactccactcccggaaggtccccctctcgccccccgttaagatgatgcggtgcgccgtgaggggcggcggtgctcacgtcgtcatcggcgagcggaggtcgccgtcgtcgtcgcccggcagcggaaggagcgtcgtgcggatgtcggagggccgcggcggggctctgctgcggcggcgtgaggtcgcgcgcggcggatctcgcggggctcgagatgggcaggcccagcgccggcgccgcggggctcttccggtgcccgcgctacggccgcgtgcgcgccaccgcctcagctgatcccgaggatattccatctgacaagcttcaagctaaatcgtccgggagtgttctgccatacgttggcgttgcttgcttgggggcaattttgttcggctaccatcttggtgtggtcaatggcgcacttgaatatctctcgaaagatcttgggattgctgaaaatgctgtgttacaaggatggacgccttctttgtgaatcgcttccaacttacggcacagggaaggaggcaggaaacgaggcgaactacatcgttggcatgtcgacgtgctaccctaagccaggatccatcaaggtcagtgacggtgaggtgctgaccatcgtctccaactacagcagcgtgcgccagcacaccggcgtcatgggcctggtctacatcctcgtggccgagccgcaggagccagctccggcgccatccctgtgcttc

SEQ ID NO: 33207 - DNA, 685 bp, Triticum aestivum
  Clone ID: PAT_TA_33207
gaattcggcacgagacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggtgttgtgggagagcaatacaagcaagttcttcaacaccttcgcccgcgcccttcaccaagcgggggctgctgctcaaggtgctgctgctcggcggcggctcgctgctcgcctacgtcagcgccaccgcctcccccgacctgctccccatcaagaaggggccccagctgccgcccaccccgggaccacgcggcaagatctaaatcccatccttcttcttccctcgtctcgcctcgtgcttgtgtaccatggatctcatctgatctgatggatctcccctatctatgtgttctgttgatacttgatcgttgtacttcgtatcagtaattggaaagatgctgcgtgcatggtgcatgcaatttctaaaaaaaaaaaaaaaaaaaaaaaaaaaaaaaaaaaaaaaaaaattaaaaaaacccccccccccccgc

SEQ ID NO: 33208 - DNA, 704 bp, Triticum aestivum
  Clone ID: PAT_TA_33208
atcataaaaccatttcccaggggagcatgcttttgccatacgattatgtacgctttgacagtaacattggaggatactttacatgaatgaagggagggggagaaaaaaagaacagaaaatcaacctcagattacaattgcatcagttgatgcagccgctagtgtacaattaacaatacacaattgcaatgatggtgcccattatccttttcacagggcttccttcccagaatccttctatctgtagcaatatttggccagatgaacaaccgcgctgcaatgcacgaccaaataatctgtgcatacgggtcatctggctgccattgccaggcaaagaaatggcacgagagagaaagagactacaggtgatgtcatgtgtttgcctatgatccactctcaatttcgttgctgaatggtaaccgatcgacacccctctcgactgcatccctccatagccgataccggatgccgagcttgtcatacgacactggccagttccaaacgttagctccattgttcattcggtcttgttggccgagcacaagccgcagatcctcattcaagaccttctcagcgaaatgtgaccacaacaggtgcatgaaaggcatgtgcttcatccagggtgcgaagtcgagagacatccggtacaacagcctggttttattcgtcgatgagggcaagcatacatggagctggtggagatgc

SEQ ID NO: 33209 - DNA, 720 bp, Triticum aestivum
  Clone ID: PAT_TA_33209
gcatcgatcaacatttcatcatggacattcagaaccacatttgagctatgtttgttcagaataatatagcgctgcttaacataatcattaaaaaaactgttacacaacgcctgttttcatataaatgatcaggaggtagtacgcatatgatcataataccctcggtgtagcaatgaaaccgatcatgtgatcaaggaaatacacgccaaatctaaagatgagggacaataacatcaaagcggcacatccctcaaaattattcttggacgataatggggccaggaagataattagaacatgcgccgccgatttggaacaatctcagggctgttgtttctcatcatggcaacgaactcctggtagttgattcttccatcatgatctgtatctacttcagcgataatatctttaattgttttatcatcccccatgtcatacttcttcagagcttcttccagctcatctactgttatgtatccgctgtggtccttatcaaaatattcaaatgctttaagtatgtggtcttccttctccaatctattcatgtgcattgtcgctgatacgaactcagaataatcaatggtcccatttccatcaacatcagccgcctccattaactgtgtaatttctgattcagaaattttggtgccaagttttggtaaaccagatcttagctcttcaagagtaattgtcccactgttatcagtgtcccaggatctg

SEQ ID NO: 33210 - DNA, 513 bp, Triticum aestivum
  Clone ID: PAT_TA_33210
ttttttttttttttttttgctaagcacactgagaagcagttattattgcgagctcacacgcagactcttttacagaacacaactcgctacacaaacacaacgcgccgcgcgcaaatgcagcgacccagatcgaagatcgtgcgacgcgcgcgcccggcagggcgccacagaacagaacccagatcacgcgccggtgccggttgccccggcgtcgccggcctggcccggctccttcctggcagcgaaggcgctgtcgtcgaccttgcgcgacgcggcatcctccaccttgtcctgcaccttctcgatctggatgttgccctggtcctcccgcgacctcaggtccgtgcgcgtgcggttctccccgccgcccaccgacccgtacgtcgtcggcgtcgtctccccgaccgggtgcgccccctgtgcccccgacatcctgcctgtcttcactacaccgcacacacgtatgtatatatgcgcttgctcctggctgattcgacgtgcgctcctcgtgcc

SEQ ID NO: 33211 - DNA, 546 bp, Triticum aestivum
  Clone ID: PAT_TA_33211
tttttttttttttttttttttttttttttttttttttttttttttttttttttttttttttttttttttttttggtcttgctaagcaaactgagaagcagttcttattattgtgagctcgcacgcagagactcttttacagaacacaactcgctacacaacacaacgcacccgcgcgcggcagggtgccacagagaacccagatcacgcgccggtgccggtcgccccggcgtcgccgggcctggcccggttccttcctggcggcgaaggcgctgtcgtcgaccttgcgcgacgcggcgtcctccaccttgtcctgcaccttatcgatctggatgttgccctggtcctcccgcgaccgcaggtccgtgcgcgtgcggttctccccgccgcccaccgacccgtacgtcgtcggcgtcgtctccccgaccgggtgcgctccctgtgcccccgacatcctgcctgccttcactgcacttcgcacgcgtatgtatatatgctcgctgctggctgactcgacgtgctcttcctgctcgctcgtgccgaattc

SEQ ID NO: 33212 - DNA, 548 bp, Triticum aestivum
  Clone ID: PAT_TA_33212
cgaggtgcaaccgcctcctcctgttcgctcctcggtcctcttccgtccctctccctcctgctgctgacaagatgaaaatggctggctctgctgtgctgctcatttcgctcctgtcggctgtcgcccccctaccctctgaagccctcaacgtgagaggccatctgctgaaatcaaagacgttccgttctccgcccatcttattgggacctggatcagtctcaaacaagtaccaccatgatgtcgacttcccccgaggccaccttgcagtcaagagctttgatgcagaggtcgtcgatgagaatggcgtccctgtcccgctccatgagacttacctgcatcactgggttgcagaaccatactatgctctgaagaacagtcagagccccgatacgcaaaatcttccaaaagggatgcttaaaaggaatgatggagtgtgcaagaccacactaggccagtactttgggctcggttccgagactcgccacactgccacatgggttctgatcctatggaattgagatggatgaagaaagccctgaagcataaga

SEQ ID NO: 33213 - DNA, 722 bp, Triticum aestivum
  unsure (1)..(722): unsure at all n locations
  Clone ID: PAT_TA_33213
gttaatgacacacgattcttccatccattccctcgtgcacaccttgtgcttaattaatttacattgcgcgcagctagcgagaggacctctcgctcgctcgatcatggtacaaataaacacacaaagtacgtgaaagtctcccacctttacgcggcgacggcggtggcgacgacgacggcgagctaggctaccgcggcaccgatgtctctccctccgaccgacggcggcgacgattggttcctcgactgcggcatcctcgaggacctcccggccgctgcctgcggcgctttcccgtgggacgcctccgtctcctcgtccaatccaagtgcggaagtaggcagctatatgaacaattcagatgtccccaaggattccggcagcaataaacgcttaaggtcagagccctgtggtaggccgacatctaaggcttgtagggaaaaagtgagaagagacaagctgaatgacaggttccttgaattgggtactacattggatcctggtaagccagtaaaaagctgacaaagctgctatcctaagtgatgcaactcgcatggttactcagcttcgtgctgaagcgcagcagctaaaggatactaatggaagtctagaagacaagattaaagagttgaaggctgaganngatgaacttcgtgacgagaagcagaagctgaaactagagaaagagacattagagcaccagatgaaacttttgactgcaactc

SEQ ID NO: 33214 - DNA, 658 bp, Triticum aestivum
  Clone ID: PAT_TA_33214
tgttgaactcttttgtgcttaccatggaagaggtaattaacaaacagcaatcacacggcttgcgaagccacacgcatgcacaaaaccaaaaggcatggcagattttacattgaacacgcatgcgcagaagcagcccttgagcagcccaaggacgacgcacatgcacgaaccaaagctagttaattcgctacttctggaagtagtcctcggtcctgcccttgaacccgatctggccgaaggtgagcgcgatgaacagacccaggtgccacgtcaccaaccacagccagaactgcgattggagagccgggggcgacgggaagtgggcgagctcctcgccgatgctggagaagaagagccccgtcaagctgttgccgttgatcagcgggatgctcgacggtgccagccacccgatcagcccgaacccgatcacgttcaggtccctccgcagccagtcccgcgggaacgtcatgcaggtgatcctgccgttcctttccaggttcctcgtcatcagcgggttcctcgccgacacccgggcaccactcgtgaagctggtagagaaggctggacggcgggtgagcgcggcgccggcgaggccggagacggtggaggtggcggcggccatgtctaagctggtgtgctgcgatgcgaatcctcgtgc

SEQ ID NO: 33215 - DNA, 815 bp, Triticum aestivum
  unsure (1)..(815): unsure at all n locations
  Clone ID: PAT_TA_33215
gcccactgtatacgcagtcgcacagctcgatcgcaatggcgtcgctcgtcgccgtccagccggtcgccgtgaggggcctggccggcagctccatctccggccgcaagctcgccgtccggcccgcctccgccgccgtctcccgctccacccgcagggctcgcggggcggcggtggtggccaagtacggggagaagagcgtctacttcgacctggacgacatcgccaacacgacggggcagtgggacctgtacgggcaggcgacggcggcgtcgccctacaacggccttgcagaggcaagttcttcaacaccttcgccgcgcccttcaccaagcgcggggctggctgctcaaaggtcctgcctgctcgggcgggcgggttcgctgctcgccctaagtcagcgccaccgcctcccccgacctgctccccatcaagaaggggccccagctgccgcccaccccgggaccacgcggcaagatctaagtagatctgcaatcaaagccttcttcctcctctcgcctcgtgcttgtgtaccatggatctgatggattcccccctatctatgtcctctgttgatacttgatctttgtactacttcgtatcagtaattggaaagatgctgcttgcatgatgcatgcaattactactagtagatcatttgctctttgatgattgccagtactgttttttgcagtaccatgtttttgctgtactggcggtttaaattactactcccttcatacctgcaacaagtaatccagaacgaagggggttaaaaaaaaaaaaaaaaaaaaaaaaaaaaagnnaaaaaaaaaata

SEQ ID NO: 33216 - DNA, 748 bp, Triticum aestivum
  Clone ID: PAT_TA_33216
ttgttggcactgtcctgtatgtgctgtcattcgctcttggagctggccctgttccagctttgctccttcctgaaatatttgcctccagaataagggccaaggctgtagcattatcaatgggaatgcactgggtatcaaacttcttcatcggcctgtacttcctgagcgtcgtcaacaagtttgggatcagcaccgtgtacttgggattcgcgtccgtgtgtgctctcgcggtcctgtacattgccgggaatgtggtcgagaccaaggggcgatccctggaagagattgagcgggagctaagcccacccagtaaagccgatgctaatgctttcttggtgagtgatcaatgagcaccgagcacaaacgtcctcggacctcgggatgttgtctctgccttttatgtagttcctgaaataagggagccgcaaggtcgcctgacgccattcaaaccggccggtgctcagggtgttgtggcaccagtaaagctcagctatttcttgtcacatctcagaatcaaagagcttatgtgctattgctccaggaggtgcaagatttaggcttgctgctagtccttggatcggatgtcatcgttttcagtgtacagatgaactccttatatgtgtcggaacttggaaataaaactccaatttgccgaatttcaaagcgtgatgtgtaattatattacttaccaattgaaaatgccctatttcatactgtgtaaaaaaaaaaataaaaaaaaaaaaaaaaa

SEQ ID NO: 33217 - DNA, 1013 bp, Triticum aestivum
  Clone ID: PAT_TA_33217
atacacgattcttccatccatttgctcgtgcatctcgtgcttaattaatttacattgcgcgcagccagcgagaggtcatctcgctcgctcgatcatggtacaaataaacacacaaagtacgtgcagctacacgttgatccacgacgtacaagtacacatgcatatctcgtccgatggacggacagatggcttaacacatttagcttccgggggcgaagttggtggcgaagaggttctctacgggcccctttccggtgacgatggcctgcacgaagaagccgaacatggagaacatggcgaggcggccgttcttgagctccttgaccttgagctcagctgcggtgtcggggtcgtcggcgaggccaagcgggtcgaaggcgccgcccgggtagatgatgtcgaggccctcgccgagggggccgccaccaacgcggtaaccctcgatgaagcccatgagcaccacctgaaccgcccagatggcgagaatgctctgcgcgtgcaccaggttggggttgcccaggtagtcgaggccgccctcggagaagatctgggcgccggccttgaaccacacggcctcgccgaacttgatgccgttcttggacagaatctccgggaacacgcaccccagggcgccgagcatcgcccaccgcgagtggatcacctccagctcccggtttttggcgaacgtctcggggtcggcagacagcccggcggtgtcccagccgtagtcgccggggaactcgccggtcaggtacgacggggtctgctcggagaacgggcccaggtacttgggacggtcagggccgtaccagatgctctggggcgcgctcttgacggtccggcgcatggtgatgcggccgccgaagtcgccgacgctgcggacgaggtcatcgcgccgcggggcggtgccgaggaagctggtcgtctggtgcagcgccgacgcggccatttcgctggtggctggggctgcctgcgagctcagtgagatgaactggtggatggtgtgcctgcag

SEQ ID NO: 33218 - DNA, 1629 bp, Triticum aestivum
  Clone ID: PAT_TA_33218
gcgccgagcacacgggcaagcggggacagccggcagcggatcttccagacagaggagaggagatggcggccgcgtccttcaccgccgccaagttcctggcgccggcggcggccagatccggcggcgaccgggcgcggcccttccccgcgccgtccgcgtcctccatgcgcccgctccgccacaggcccgcgcgccgcctgggctccgtcctggccgtctcctccgacgtgctcaaggccgcgcccgccgccgccgcgtacccggcggtgacccgggaagaggcgttggagctgtacgaggacatgatcctcggccggaacttcgaggacatgtgcgcgcaaatgtactaccgtggcaagatgtttggtttcgtccatctttacaacgggcaggaggccgtctccacctgcttcatcaagcagctgaaccaacctgactgtgttgttagcacgtaccgtgaccacgtacacgcgctgtccaagggtgtcccggcccgtgcggtcatggccgatctctttggcaaggccactggctgctgccgcggacagggtggttccatgcacatgttctctgagccccacaacctccttggaggctttgccttcattggagagggcatccctgtcgccactggcgctgcctttgccgccaagtaccgccatgaggtgctcaagcagtctagccctgacgggcttgatgtcacgcttgcattctttggggacggtacctgtaacaacggccagttctttgagtgcctgaacatggctcagctgtggaagcttccgattatttttgttgtggagaacaacctatgggcaatcgggatgtctcacctcaggtctacttcagatcccgagatctggaagaagggcccggcattcggaatgcctggtgtacatgtcgatgggatggatgtcctgaaggtcagggaggtggctaaggaggcaattgacagggccaggagaggtgaaggaccaactctagtggaatgtgaaacttaccggttcagaggccactctcttgctgatccagatgaactcaggaggcctggatgagaaatctcactacgctgcaagggaccccatcacatccctaaagaagtacatcatcgagcagaacctcgcgtccgaagccgagctgaagagcatcgagaagaagattgacgacgtcgtggaagaggccgtggagttcgctgacgcgagcccgctccccccacggagccagctgctgggagaacgtgtttgccgatcccaagggcttcggcataggccccgacggcaagtacaggtgcgaggacccgaagttcacgcaaggcacagcgcaagtctaagggccgctgctgcagaagcagcttgtttacgccttgtttctcatgcactacctctctagctaccccgcccctagttttgtcgatcccgctgtcgatttcttgtgttgttagaggtcatctatcactgtaattcattgctcgctgtgctaccgcgcggcggctgatgcccccagtttttttttacccaagaaaatgttcaccagtccagttgttgttctacagtaactctacatctgtctgggtttgtagtaattgggtacagatattgggaagagatgtgaaacatgaaaaaaaaaaaa

SEQ ID NO: 33219 - DNA, 2257 bp, Triticum aestivum
  Clone ID: PAT_TA_33219
catcgacagcgctccctcggaactatcggatctcgggaagaagatatatccatcgctggcacccgtcgtcttcctcctccgcccgcccccatcccatctccatccaagccacaatccaccggcgagctcgccattaatcccactccactcggctccaggagcgccagcggcctccggtcgaaggaaggtcccccttctgccccccgttaagatgatgcggtgcgctgtgaggggcggcggtgctcacgtcgtcatcggcgagcggaggtcgccgtcgtcgtcgtcgcccggcagcggaaggagcgtcgtgcggatgtcggaggggcgcggcgggctctgctgcggcggcgtgaggtcgcgcgcggcggatctcgcggggctcgagatgggcaggcccagcgccggcgccgcggggctcttccggagcacgcgctacggccgcgtgcgcgccacggcctcagctgaccccgaggatattccatctgacaagcttcaagctaaatcttctgggagtgttctgccgtacgttggcgttgcttgcttgggggcaattctgtttggctaccatcttggtgtggtcaatggcgcacttgaatatctctcgaaagatcttgggattgctgaaaatgctgtgttacaaggatgggtggttagcacaaccctggctggcgcgacagtaggttcttttactggaggggctttggctgataaattagggagaacacggacatttatcctagatgcaatccctcttgctgtatgcgcattcttgagtgcaacatctcaagatgtccgtacaatgattattggtcgattacttgctgggattggtattgggatctcttccgctcttgtgccgctttacatatctgagatctcaccaactgaaatacgtggagcacttggtacgattaatcagctgtttatctgcattggaattcttgcagctttggtagctggattgccattagcacaaaatcctgcatggtggaggacaatgtttggaatttcaatagttccatctattttgcttggctctaggaatggctgtttcacctgaaagccctcgctggctattccagcaaggaaagatttctcaagcagaagcagctataaaaaaattgtatgggaaagagaaggttactgaagtcatgtatgacctaaaggctagtgggcaaggatctaatgagccagatgccaagctggtttgatctattcagcaaacgctattggaaagttgtgagcgtgggagcggcactgtttttgttgcagcaacttgctggcataaatgctgttgtgtactactctacatcagtgttccgcagtgcaggcattgcatctgatgttgcagcgagtgctcttgttggtgctgccaatgtttttggcaccatgattgcatcttcactgatggacaagcaagggaggaagagccttctcataacaagcttttctggaatggcggcgtcgatgttactcttgtcattgtccttcacctggaaggctttggcaccttattctggcactcttgctgttgttggcactgtcctgtatgtgctgtcattcgctcttggagctggccctgttccagctttgctccttcctgaaatatttgcctccagaataagggccaaggctgtagcattatcaatgggcatgcactgggtatccaacttcttcatcggcctgtacttcctgagcgtcgtcaacaagtttggaatcagcaccgtgtacttgggattcgcgtccgtgtgtgctctcgcggtcctgtacattgccgggaatgtggtcgagaccaaggggcgatccctggaagagattgagcgggagctaagcccgcccaataaagccgatgctaatgctttcttggtgagtgatcaatgagcaccgagcagaaaccatccttggacctggggatgttgtctctgccttttatgagtagttcctgaaagagtaactcttcctgaaataagtgagccgcaagatcacctgacgccatgcaaaccgcctggtgctcagggtgttgtggcaccagtaaagctcagctatttcttgttacatctcaaaatcaaagagcttatgtgtcattgctccgggaggtgcaagatttaggctggctgttagcccttggatgtcatcgtttttgagtgtacagatgatctccttgtatgtgtcggaaataaaactccgatttgccgaatttcaaagcgtgatgtgtaattatgcttaccaattgaaaatgccctatctcgtactgtgt

SEQ ID NO: 33220 - DNA, 1319 bp, Triticum aestivum
  Clone ID: PAT_TA_33220
cacaaatgtactaccgtggcaagatgtttggtttcgtccatctttacaacgggcaggaggccgtctccaccggcttcatcaagcagctgaaccaacccgactgtgtcgtcagcacgtaccgtgaccacgtccacgcgctgtccaagggtgtcccggcccgtgcagtcatggccgagctctttggcaaggccaccggctgctgccgcggacagggtggttccatgcacatgttctctgaaccccacaacctccttggaggctttgccttcattggagagggcatccctgtcgccactggcgccgcctttgccgctaagtaccgccatgaggtgctcaagcagtctagccctgacgggcttgatgtcacgcttgcattctttggggacggtacctgtaacaacggccagttctttgagtgcctgaacatggctcagctgtggaagcttccgattatttttgttgtggagaacaacctatgggcaatcgggatgtcgcacctgaggtctacttcagatcccgagatctggaagaagggcccggcattccggaatgcctggggtacacgtcgatgggatggacgtcctgaaggtcagggaggtggctaaggaggcaattgacagggcaaggagaggtgaaggaccaactctagtggagtgtgaaacttaccggttcagaggccactctcttgctgatccagatgaactcaggaggcctgatgagaaatctcactacgctgcaagggaccccatcacatccttgaagaagtacatcatcgagcagaacctcgcgtctgaagcggagctgaagagcatcgagaagaagattgacgacgtcgtcgaagaggctgtggagtttgccgacgcgagcccgctgcccccacggagccagctgctggagaacgtgtttgccgatcccaagggcttcggcatcggccccgacggcaagtacaggtgcgaggaccccaagttcactcaaggcacggcgcaagtctaaggacctccaccgcagaagcagcttgtttacgccttgtttctcatgtactacctctctagctaccctcagcccctagttttgtcgaacccgctgtcgatttcttgtgttgttagaggtcatatatcactgtaattcattgctcgctgtgctactgcgcggcgtctgatgcccccagttttttttacccaagaaatgttccccagttcagttgttctacagtaactcaacatctatctggtttgtagtaattggtacagatattggaagagatgtgaaacataatagtatctgttgaaactgctctactgggtttgtttgggagcctc

SEQ ID NO: 33221 - DNA, 1217 bp, Triticum aestivum
  Clone ID: PAT_TA_33221
gaattcactagtgattagcgtggtcgcggccgaggtcaaagaactacactggtgggctattttgctgctatgatcagacccagtgtcgggtcaaagaagggttcaatggcgaggtgcggaagttgttcttgcagtacaccgtgacgtggctcgactggactgatgcggtggtgcctgtcaagatttacatatttgacgttacggataccgctatgctcgatggaactcctgaacattcttgcaaggttgagtatcaagtcgaggaatgcagcgcagaaaaccgagccaacaatgagtgcatccatactaagactgctagagcggccttgccgcgtggaggagatatcgtgttcagtgttgcgcaccagcactccggaggagtcggtgcttctttgcatggccaggacggacgccttctttgtgaatcgcttccaacttacggcacggggaaggaggcagggaacgaggcgaactacatcgttggcatgtcgacgtgctaccctaagccaggatccatcaaggtcagcgacggcgaggtgctgaccatcgtctccaactacagcagcgaccgccagcacaccggcgtcatgggcctggtctacatcctcgtggccgagccgcagcagccgactccggcgccatccctgtgcttcagtttcccagtcccatggtgcctaccggcatggatgtctagcaacatgtgaagagtagattatcatctacccctagctaatggagtgcaatgcaaatggtgaggagtggagaagctgaaacaatcaccgtggatcaatcgtcatagttatacgatggatgtgtttttgtcatactagtattactagctaatatacagaagcagtcaccagtcagtgagcaatgtcgtttcgatggacctgatgttctataattaattgttatcagtagtcgtgtatatgaagctgagttgtatgagttgatcaccgccataagagaaactagtgtcgatataatagtaagttgttgtagctgacgttggctaaggaggttttagggtgggatactcgctggacgcgaaggttgtagccgtgtagacgttgggttatagggaaaaggactggagaattgaaggggtagaagagagcataggtaggaactcgatatttcatttcttgcttcgggcaaggttgatatgtccttatatagacccttaggtcagttagcgcaatataattcaacacacc

SEQ ID NO: 33222 - DNA, 1840 bp, Triticum aestivum
  Clone ID: PAT_TA_33222
cccagccgcagctcctccgcctcctcctgctcctcggcccccttccgtccatccctcctggtcacctgtgaaagctactgtcttctgtattatcgaattgacacaggggagattaccacgaagcaagctggtctggtgacaagatgaaaatggctggctctgttgtgctgctcatttcactcctatcggctattgctcccctaccctctgaagccctcaacgtgagaggccatcttcttaaatcaaagacgttccgttctccgcccatcttactgggccctggatcagtctcaaacaagtaccaccatgatgtcgacttcccccgaggccaccttgcagtcaagagctttgatgcagaggtcgtcgatgagaatggcgtccctgtcccgctccatgagacttacctgcatcactgggttgcagaaccatactatgctctgaagaacagtcagagccccgatacgcagaatcttccaaaaggaatgcttaaaaggaatgatggagtgtgcaagaccacactaggccagtacttcgggctcggttccgagactcgccacactgccacatgggttcctgatccttatggaattgagattggcaatgaagacaaggcccctgaaggctatgaggagaaatggttgctcaatattcatgccatcgacacaaggggcgtggtcgacaagcctagctgcaccgagtgcaagtgcgacttttacaatgtcacaattgatgagtatgggcgcacaatctcaaagaactacactggtgggctattttgctgctatgatcagacccagtgtcgggtcaaagaagggttcaatggcgaggtgcggaagttgttcttgcagtacaccgtgacgtggctcgactggactgatgcggtggtgcctgtcaagatttacatatttgacgttacggatactgctatgctcgatggtactcctgaacattcttgcaaggttgagtatcaagtcgaggaatgcagcgcagaaaaccgagccaacaatgagtgcatccatactaagactgctagagcggccttgccgcgtggaggagatatcgtgttcagtgttgcgcaccagcactccggaggagttggtgcttctttgcatggccaggatggacgccttctttgtgaatcgcttccaacttacggcacagggaaggaggcaggaaacgaggcgaactacatcgttggcatgtcgacgtgctaccctaagccaggatccatcaaggtcagtgacggtgaggtgctgaccatcgtctccaactacagcagcgtgcgccagcacaccggcgtcatgggcctggtctacatcctcgtggccgagccgcaggagccagctccggcgccatccctgtgcttcagtttcccagtcccatggtgcctaccggcatggatgtctagcaacatgtgaagagtagattatcatctacccctagctaatggagtgcaatgcaaatggtgaggactggagaagctgaaacaatcgccgtggatcaatcgtcatagttatacgatggatgtgtttttgtcatactagtattactagctaatatacagaagcagtcaccagtcagtgagcaatgtcatttcgatggaccatcagtttctgatgctttgtactccctccgtccggagttacttgtctcgaaaatggatgtatttaaaactaaaataggtctagatatatccatttctgcgacaagtaattccgaacggagggagtaattagttattatcagtagtagcagtgtatgaagctgagttgtatgagttgatccccaccgaaagaaaaacttagtgtccaaaaaaaaaaaaaaaaaaaaaaaaaaaaaa

SEQ ID NO: 33223 - DNA, 2399 bp, Triticum aestivum
  Clone ID: PAT_TA_33223
ccgaggttttttgagtaatgacacacgattcttccatccattccctcgtgcacaccttgtgcttaattaatttacattgcgcgcagctagcgagaggacctctcgctcgctcgatcatggtacaaataaacacacaaagtacgtgcagctacacgttgatccacgacgtacaagtacacatgcatatctcgtccgatggacggacggacggacggacggctaaacacatttagcttccgggggcgaagttggtggcgaaggcccaggcgttgttgttgaccgggtcggcgacgtggtcgaagaggttctcaactggccccttcccggtgacgatggcctgcacgaagaagccgaacatggagaacatggcgaggcggccgttcttgagctccttcaccttgagctcggcggcggtgtcggggtcgtcggcgaggccaagtgggtcgaaggcgccgcccgggtagatgatgtcgaggccctcgccgaggggcccgcctagtctcgagtttttttttttttttttttgtccagaataatatagcgctgcttaacataatcattaaaaaactgttacacaacgcctgtttccatataaatgatcaggaggagtacaaatatgatcataataccctcggagcagcaatggaaccgatcatgtgatcaaggaaatacacgccaaatctaaagatgagggacaataacatcaaagcggcacatccctcaaaattattcttggacgataatggggccaggaagatgtctaagcggtattcaagaagttacggtagaagataattagaacatgcgccgccgatttggaacaatctccgggctgttgtttctcatcatggcaacgaactcctggtagttgattcttccatcatgatctgtatcaacttcagcgataatatctttaattgttttatcatcccccatgtcatacttcttcagagcttcttccagctcatctactgttatgtatccgctgtggtccttatcaaaatattcaaatgctttaagtatgtggtcttccttctccaatctattcatgtgcattgtcgctgatacgaactcagaataatcaatggtcccatttccatcaacatcagccgcctccattaactgtgtaatttctgattcagaaattttggtgccaagttttggtaaaccagatcttagctcttcaagagtaattgtccccactgttatcagtgtccagggatctgaacatttctttcaagcctgtaatctcttcctcagacaagttctctgcaacgatcttcaatgcaactttcttaagcttgttcatcgcccggaactgctctcattctacttgataacagtaatgtcaagtggcttatctggagcctctccatcttccctaatccatgggtgattcaaaatttctgcagcagtcaagccgctctttggggtcttgccgcaacatcttcttcaccaaatcttttgcaccattagatattgaaggccaggggtcagatgagaaatctatgtgaccaagcaagacagcctcaaatatgccatcctcattgtctgcccaaaaaggaggaacaccagacagaaggatgtacagaataatccccgcactccatatgtcagcttctgctccatagtgccgcttcagaacctcaggagcaacataatacgcacttccaacgagatccttaaactgctccccgtgtttgaagaagacggagagaccgaagtcagtggccttgagcggcgagtcctccttgttgttgagaaacaaaaagttttcgggcttgagatcccggtggaaaacccccatggagtggcagctgtgcacgacggagaccatctcgcggcagagcagggcggcggctcgctcggagtagtgcccccgcgcgatgatgcggtcgaatagctccccgccctcacatagctccatgatgaggttgaccgagtggcggtcctcgtaggcgccgcggagctcgacgatgttgcggtgacccgtgaggtggtgcatgatctgcacctcccgttgcacatcctcgatgtcatcgcggtggacgagcttccgcgtggcgatggacttgcaggcgaagcgctggcccgtagccttgtgcgtgacgaggtaggtgaccccgaactgccccctgccgagctcgcggccgaaggtgtaggtcgcgcgcacgtcctccatcgggcgtcccagaacgcggcccatggccacctgtcccgcttccggcgtcggggccggggccggcgccgtctggggcttcggcggcggctggggtttgggctgggccgccggcggaggggccgtggccggctggtcggcggcggcgcggcggtggcgcgaggtgcggttgcccacccacgcgtccgcccacgcgtccgcccacgcgtccgcggacgcg

SEQ ID NO: 33224 - DNA, 1891 bp, Triticum aestivum
  Clone ID: PAT_TA_33224
cctcctcctgctcgctcctcggtcctcttccgtccctccctcctgccagttgctaccttccttgctcttcaatggaatatacctgacctgggagctttcacactcctcgactcgtcgtacaagttactgaatagtcagcttgcttcagtagtggctactaatggttcatgtcatggcaggcttgtcttgaattaataaatctgctggtgacaagatgaaaatggctggctctgctgtgctgctcatttcgctcctatcggctatcgcccccctaccctctgaagccctcaacgtgggaggtcatctgctgaaatcaaagacgttccgttctccgcccatcttactggggcctggatcagtctcaaacaagtactaccatgacgtcgacttcccccgaggccaccttgcagtcaagagctttaatgctgaggtcgtcgatgagaatggcgtccctgtcccgctccatgagacttacctgcatcactgggttgcagtaccatactatgctctcaaggacaaccagagctctgatgcgcaaaaggttcccgcaatgcttaaagggaatgatggagtgtgcaagagagcactaacccagtacttcgggctcggttccgagactcgccacaccgccacatgggttcctgatccttatggaattgagaccggcaaccaagagaaggcccctgaaggctatgaggagaaatggctgctcaatattcatgccatcgacacgaggggcgtggccgacaagcctagctgcaccgagtgcaagtgcgacttctacaatgtcacaattgatgagtatgggcgcacagtctcgaagaactacactggtgggttgctttgctgctatgatcagacccagtgtcggctcaaagcagggttcaacgccgaggtgcgggaaggtgttcttgcagtacaccgtgacttggctcgactggactgatgcggtggtgcctgtcaagatctacatatttgacgttacggataccgctatgctcgacgggactcatgaacactcttgcaaggttgagtatcaagttgaggaatgcagcgcggaaaaccgagccaacaatgagtgcatccatactaagactaccagagcggtcttgccgcgtggaggagatatcgtgtacagtgttgcacaccagcactctggaggagtcggtgcttctctgcatggccaggatggacgccttctatgtgaatcgcttccaacttacggcacagggaaggaggcagggaacgaggcaaactacattgtcggcatgtcgagttgctaccctaagccaggatccatcaaggtcagcgacggcgaggtgctgaccatcgtctccaactacagcagcgaccgagagcacaccggcgtcatgggcctggtctacatccctcgtgggcccgagcccgcagcagccggctcccggcgccatccctgtgcttcagttttcccggccccatgggtgccctacccgggcatggatgtctagcaacatgtgaagagtagattatcatctacctgcaatacaaatggtgaggccagaagaagctgaaccaatcaccctggatcaatcatcgtcatagttataagatggatgtgtttttgtcatactattactagctaatatacagaagcagtcaccggtcagtgagcaatgtcatttcgatggaccatcagtttctgatgctttgtaattagttattatcagtagtagtgtatgaagctgagttgtatgagttgatcaccgccataagaaaaactagagtcgatataatagtaaggagaagtacttcggtacaaccccaacgtataaggggtagtattgtccatactaaaaaaaaaaaaaaaaaaaaaacctgcccgggcggccgctcgaaatcacttagtgaattc

SEQ ID NO: 33225 - DNA, 1613 bp, Triticum aestivum
  Clone ID: PAT_TA_33225
aacgcgatcgccccaggcctccccgcgctgctgcagcaatgccggccctcgggacgctctccgcaggcggcgccgccgccggcgtcgccggcctgctccgcctccgccgcggccccgccctcgcctcgcccctgccggccgccgcccgagccggcgcggtgcacgacggcgcccagctcgtctggggccgccagctccgcccggccctcgtcctccccgccggcctgctcccgctccaggcctccaagaggctcacgctccgcccgcccgccgcctccgccgagcccgccggggaggccaagtcgccagggttgctggagaagtacccggcaatcaccaccggcttcttcttcttcatgtggtactttctgaatgtgatattcaacatcctcaacaagaagatctacaactacttcccctacccatactttgtttcggtgatccatctacttgtgggagttgtgtactgcctcctcagctgggccgttggtctcccgaagcgtgcgcctatcaatgcaacgctcctgaagctgctctttccggtggcattgtgccatgctcttggtcatgtcacaagcaacgtgtcctttgctactgttgcagtctcgtttgcccacactattaaagctttggagcccttcttcaatgcagctgctacccagtttgtccttggacagacagttcccttgtctctgtggttgtctcttgcccctgttgtgcttggtgtttcaatggcatccctcactgaactgtcgtttagctggaagggtttcatcaatgctatgatctctaacatctcattcacttaccggagtatttattccaagaaagccatgactgatatggatagcaccaacgtgtatgcttacatctcaataattgctctagttgtctgcataccgcctgcacttattattgaaggaccacaactaatgcagtatggattaaacgatgcaattgcaaaagtaggaatgacaaaatttgtatcagatcttttcctggtgggattgttctaccatctctataatcagattgctacaaacactttggagcgggtggcccctctaacacatgctgttggcaatgtgttgaaaagggttttcgtcattggtttctcgatcatcatttttggcaacaaaattaccacacagactggaatcggaacttgcattgcaatagctggtgttgccctgtactcgtacatcaaagctaaaatcgaggaggaaaaaagggcgaaggccgcgtgatgaggcgactgatgtgaatatggtctgatggtttccggcgctcgagttgcattgcctcggagacgacatggacgaatctcttcttcgttatttgttatttgtttttcagttatctgctaaagtgttcccttgtgaggtcgaacagctacattgcagatggtaagactggttgtttccatcagatgagagagctcagatgtgcagtaataaacgctcgtacttgtaaaggcttttcgttttgtgtgtgaggactgagttatcttctttgtacccttcctttcgttagttcttgtgctatgcaatgttggactctcagaccatcaagtcttctgtgctgtgtcaaaaaaaaaaaaaaaggaccctaaa

SEQ ID NO: 33226 - DNA, 751 bp, Triticum aestivum
  Clone ID: PAT_TA_33226
agccgtttcaaatccttaacagcatccacgatctaagcgtgtgcacgtacgccgcagctccagaaccaggacacgcccactgtatacgcagtcgcacagctcgatcgcaatggcgtcgctcgtcgccgtccagccggtcgccgtgaggggcctggccggcagctccatctccggccgcaagctcgccgtccggccctcctccgccgccgtctcccgctccacccgcagggctcgcggggcggcggtggtggccaagtacggggagaagagcgtctacttcgacctggacgacatcgccaacacgacggggcagtgggacctgtacggcagcgacgccgcgtcgccctacaacggcctgcagagcaagttcttcaacaccttcgccgcgcccttcaccaagcgggggctgctgctcaaggtgctgctgctcggcggcggctcgctgctcgcctacgtcagcgccaccgcctcccccgacctgctccccatcaagaaggggccccagctgccgcccaccccgggaccacgcggcaagatctaaagctctgcaatcaaggccttcttcctcctcccgcctcgcctcgtgcttgtgtaccatggatctcgtcgattccccccttatctatgtgcttgctctgttgatacttgatctttgtactttgtatcagtaattggaaagatgctgcgtgcatggtgcatgcaattattagatcatggtttttgtaccatgtttttgctatactggcggttt

SEQ ID NO: 33227 - DNA, 800 bp, Triticum aestivum
  Clone ID: PAT_TA_33227
ttcgagcggccgcccgggcaggtacagcaatcacaggaaatcacctttctactacgggtatatgttgtacaagcttttttttttttttttggtgacaaattgatttttttttgttgttgttgaactcagttttgtgcttagcatggaagaggtaattaacaaacaggaatcacacggcttgcgaagccagacgcatgcacaaaaccaaaaggcatgacagattttacattgaacacgcatgcgcagaagcagcccttgagcagcctaaggacgacgcacatgcatgaaccaaagctagttaattcactacttctggaagtagtcctcggtcctgcccttgaacccgatctggccgaaggtgagcgcgatgaacagacccaggtgccacgtcaccaaccacagccagaactgcgactggagagccgggggcgaggggaagtgggcgagctcctcgccgatgctggagaagaagagccccgtcaggctgttgccgttgatcagcgggatgctcgacggcgccagccacccgatcagcccgaacccgatcacgttcaggtccctccgcagccagtcccgcgggaacgtcatgcaggtgatcctgccgttcctctccaggttccttgtcatcagcgggttcctcgccgacacccggccgccactcgtgaagctggtagagaaggctggccggcgggcgagcgcggcgccggcgaggccggagacggtggaggaggcggcggcggccatgtctaagctggtgtgctgcgatgcgaatggtcgtacgtctccccgaaccggccggc

SEQ ID NO: 33228 - DNA, 770 bp, Triticum aestivum
  Clone ID: PAT_TA_33228
ctgatcaaagtgtgtgcacgtaccccgcagctccagaaccaggacacgcccacggtatacgcacgtacagctcgatcgcaatggcgtcgctcgtcgccgtccagccggtcgccgtgcggggcctggccggcagctccatctccggccgcaagctcgccgtccggcccgcctccgccgccgtctcccgctccacccgcagggctcgcggggcggcggtggtggccaagtacggggagaagagcgtctacttcgacctggacgacatcgccaacacgacggggcagtgggacctgtacggcagcgacgcggcgtcgccctacaacggcctgcagagcaagtttttcaacaccttcgccgcgcccttcaccaagcgagggctgctgctcaaggtcctgctgctcggcggcggctccctgctcgcctacgtcagcgccaccgcctcccccgacctgctccccatcaagaaggggccccagctgccccccaccccggggccacgtggcaagatctaagtagatctgcaatcaaggccttcttcctcctctcgcctcgtgcttgtgtaccgtgaatctgatggattcccccctatggccctatctatgtcctctgttgatacttgatctttgtactacttcgtatcagtaattggaaagatgctgcttgcatgatgcatgcaattactactagtagatcatttgctctttgacgattgccagtactgttttttgcagtaccatgtttttgctgtactggcggtttaaaattactac

SEQ ID NO: 33229 - DNA, 1268 bp, Triticum aestivum
  Clone ID: PAT_TA_33229
gagtcgccagggttgctggagaagtaccctgcaatcaccaccggcttcttcttcttcatgtggtacttcctgaacgtcatattcaacatcctcaacaagaagatctacaactacttcccctacccatactttgtttcggtgatccatctacttgtgggagttgtgtactgcctcctcagctgggccgttggtctcccgaagcgtgcgcctatcaatgcaacgctcctgaagctgctctttccggtggcattgtgccatgctcttggtcatgtcacaagcaacgtgtcctttgctactgttgcagtctcgtttgcccacactattaaagctttggagcccttcttcaatgcagctgctacccagtttgtccttggacagacagttcccttgtctctgtggttgtctcttgcccctgttgtgcttggtgtttcaatggcatccctcactgaactgtcatttagctggaagggtttcatcaatgctatgatctctaacatctcgttcacttaccggagtatttattccaagaaagccatgactgacatggatagcaccaacgtgtatgcttacatctcaataattgctctagttgtctgcataccacctgcacttattattgaaggaccacagctaatgcagtatggattaaacgatgcaattgcaaaagtaggaatgacaaaatttgtatcagatcttttcctggtgggattgttctaccatctctataatcagattgctacaaacactttggaacgggtggcccctctgacacatgctgttggcaatgtgttgaaaagggttttcgtcattggtttctcgatcatcatttttggcaacaaaattaccacacagactggaatcgggacttgcgttgcaatagctggtgttgccctctactcgtacatcaaagctaagatcgaggaggagaaaagggcgaaggccgcctgatgaggtgactgctgtgaatatggtctgatggtttccggcgctcgagttgcattgcctcggagacgacatggacggatctcttcttcgttatttgttttttgtttttcagttatctgctaaagtgttcccttgtgaggtcaaacagctacattgcagatggtaagactggttgtttccatcagatgagagagctcagatgtgcagtaataaacgctcgtacttgtaaaggcttttggttttgtgtgtgaggaccgagttatcttctttgtacccttcctttcgttagttcttctgctatgcaatgttggactcagaccatc

SEQ ID NO: 33230 - DNA, 712 bp, Triticum aestivum
  Clone ID: PAT_TA_33230
ccgtttcaaatccttaacagcatccactgatctaagtgtgtgcacgtaccccgcagctccagaaccaggacacgcccactgtatacgcacagctcgaccgcaatggcgtcgctcgtcgccgtccagccggtcgccgtgaggggcctggccggcagctccatctccggccgcaagctcgccgtccggcccgcctccgccgccgtctcccgctccacgcgcagggctcgcggggcggcggtggtggccaagtacggggagaagagcgtctacttcgacctggacgacatcgccaacacgacggggcagtgggacctgtacggcagcgacgcggcgtcgccctacaacggcctgcagagcaagttcttcaacaccttcgccgcgcccttcaccaagcgggggctgctgctcaaggtgctgctgctcggcggcggctcgctgctcgcctacgtcagcgccaccgcctcccccgacctgctccccatcaagaaggggccccagctgccgcccaccccgggaccacgcggcaagatctaaatcccatccttcttcttccctcgtctcgcctcgtgcttgtgtaccatggatctcatctgatctgatggatctcccctatctatgtgttctgttgatacttgatcgttgtacttcgtatcagtaattggaaagatgctgcgtgcatggtgcatgcaattactagatcatttgctcttaa

SEQ ID NO: 33231 - DNA, 707 bp, Triticum aestivum
  Clone ID: PAT_TA_33231
gtctcgagttttttttttttttttttgttgtagtagtagttgtcgttgttgaactcttttgtgcttaccatggaagaggtaattaacaaacagcaatcacacggcttgcgaagccacacgcatgcacaaaaccaaaaggcatggcagattttacattgaacacgcatgcgcagaagcagcccttgagcagcccaaggacgacgcacatgcacgaaccaaagctagttaattcgctacttctggaagtagtcctcggtcctgcccttgaacccgatctggccgaaggtgagcgcgatgaacagacccaggtgccacgtcaccaaccacagccagaactgcgactggagagccgggggcgacgggaagtgggcgagctcctcgccgatgctggagaagaagagccccgtcaagctgttgccgttgatcagcgggatgctcgacggtgccagccacccaatcagcccgaacccgatcacgttcaggtccctccgcagccagtcccgcgggaacgtcatgcaggtgatcctgccgttcctctccaggttcctcgtcatcagcgggttcctcgccgacacccgggcaccactcgtgaagctggtagagaaggctggccggcgggtgagcgcggcgccggcgaggccggagacggtggaggtggcggcggccatgtctaagctggtgtgctgcgatgcgaacccacgcggccg

SEQ ID NO: 33232 - DNA, 1066 bp, Triticum aestivum
  unsure (1)..(1066): unsure at all n locations
  Clone ID: PAT_TA_33232
gattggaagtttttcccgcaaaaaagtataggcccgtggtgacaaaattattgttgcggtagtagtagtacttgttgttgaactcagttttgtgcttagcatggaagaggtaattaacaaacagcaatcacacggcttgcgaagccacacgcatgcacaaaaccaaaaggcatgacagattttacattgaacacgcatgcgcagaagcagcccttgaacagcctaaggacgatgcacatgcatgaactaaagctagttaattcactacttctggaagtagtcctcggtcctgcccttgaacccgatctggccgaaggtgagcgcgatgaacagacccaggtgccacgtcaccaaccacagccagaactgcgactggagagccgggggtgaggggaagtgggcgagctcctcgccgatgctggagaagaagagccccgtcaagctgttgccgttgatcagcgggatgctcgacggcgccagccacccgatcagcccgaacccgatcacgttcaggtccctccgcagccagtcccgcgggaacgtcatgcaggtgatcctgccgttcctctccaggttcctcgtcatcagcgggttcctcgccgacacccggccgccactcgtgaagctggtagagaaggctggccggcgggcgagcgcggcgccggcgaggccggagacggtggaggtggcggcggccatggtctaagctggtgtgctgcctcgtgccgaattcggcacgaggcgggctgcgcgagcggtaccaaatcgaggcaaactctgaatactagatatgacccaaaaatancaggggtcaaggtcggccagtgagacgatgggggataagcttcatcgtcgagagggaaacagcccggatcaccagctaaggcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcctcgtgcc

SEQ ID NO: 33233 - DNA, 1730 bp, Triticum aestivum
  Clone ID: PAT_TA_33233
taggggccttttttttttttttttttgcacgaatcacttctagactctctattcctatttttgatttgcacaagatcccaggcttttattttcgcctcatctcgtgcccccagacataagccgagtgctcatgccaacatgatcatttcgtcgtagaagcgagtacatcagcccttgggcgtgagaccagagtcgtaagatcccaccgaaggttgtcatttcagaaataatgcgcttatttcttaccagccttggcagcggacttggtgaccttgccagcagcgccagtggacttctcgacggccttgatgacaccgacggcgacggtctgtcgcatgtcacggacggcgaaacgacccagaggagggtagtcggtgaaagcctcaacacacatgggcttggagggaaccatcttgacgatggcggagtcaccagacttgatgaacttgggggcggcctcagtagccttaccggttcggcggtcgatcttctcctggatctcggcgaacttgcaggcaatgtgggcagtgtggcaatcgaggacgggagcgtaaccagcaccgacctgaccggggtggttgaggacgatgacctgggcggtgaaagaagcggcacccatgggggggtcgttcttggagtcaccagcgacgttaccacgtcggatgtccttgacggaaacgttcttcacgttgaaaccaacgttgtcaccgggctgtccctcagtgagctgctcgtggtgcatctcaacggacttgacttcagtggtgacgttggaaggagcgaaggtaacgaccataccgggcttgatgataccagtctcgatacggccgacaggaaccgttccaataccgccaatcttgtagacatcctggaggggaagtcggaggggcttgtcgttgggacgcttggggggctcgatggagtcaatggcctcaaggagggtctttccggagagcttgccagacttgatctcacgctcccaacccttgtaccaggggcagttggtggaggcagtaagcatgttgtcaccgttgaaaccggagatggggacgaaagcgacagccttggggttgtagccgaccttcttgatgaaagaagaggtctccttgatgatctcctggtaacgggcctcagaccacttggtggtgtccatcttgttgatggcaacaatgaggttcttgacaccaagggtgtaggcaaggagagcgtgctcacgggtctggccatccttggagataccagcctcgaactcaccagtaccggcggcaatgatgagaatggcgcaatcggcctgggaagtaccagtgatcatgttcttgatgaaatcacggtgaccgggagcgtcaatgacggtgacatagtagcgaggagtctcgaacttccagagggcgatatcaatggtgataccacgctcacgctcggctttgagcttgtcaagaacccaggcgtacttgaaggaacccttaccgagctcggcggcttccttctcgaacttctcgatggttcgcttgtcgataccaccgcactggtagatcaagtgaccggtagtggtcgacttgccagagtcgacgtggccgatgacgacgacgttaaggtgagtcttctcctccttacccattttgacggttgtggatggtttgtgtgtacgtttgtgatgaacgtgagattcgcagatcggatgcttgaaccgggtatgcgagacgaggagggaagggcccgacccggccggc

SEQ ID NO: 33234 - DNA, 1135 bp, Triticum aestivum
  Clone ID: PAT_TA_33234
gaattcactagtgatttcgagcggccgcccgggcaggttttttttttttttttgagtgatgacacacgattcttccatccattccctcgtgcacacctcgtgcttaaattaatttacattgcgcacagctagcgagaggacctctcgctcgctcgatcatggtacaaataaacacacaaagtacgtgcagctacacgttgatccacaacgtacaagtacacatgcatatctcgtccgatggacggacggacggacggatggctaaacacatttagcttccgggggcgaagttggtggcgaaggcccacgcgttgttgttgactgggtcggcgacgtggtcgaagaggttctcaacgggtccctttccggtgacgatggcctgcacgaagaagccgaacatggagaacatggcgaggcggccgttcttgagctccttcaccttgagctcggcggcggtgtcggggtcgtcggcgaggccaagtgggtcgaaggcgccgccggggtagatgatgtcgaggccctcgccgagggggccgccaccaacgcggtagccctcgatgaagcccatgagcaccacctgaaccgcccagatggccaggatgctctgcgcgtgcaccaggttggggttgcccaggtagtcgaggccgccctcggagaagatctgggcgccggccttgaaccacacggcctcgccgaacttgatgccgttcttggacaggatctccgggaacacgcaccccagggcgccgagcatcgcccaccgtgagtggatcacctccagctcccggttcttggcgaaggtctctgggtcagccgacagccccgcggtgtcccacccgtagtcgccggggaactcgccggtcaggtacgatggagtctgctcggagaacgggcccaggtacttgggacggtcagggccgtaccagatgctctggggcgcactcttgacggtccggcgcatggtgatgcggccgccgaagtcgccgacgctgcggacgaggtcatcgcgccgcggtgcggtgccgaggaagctggtcgtctggtgcagcgccgacgcggccatttcgctggtggctggggctgcctgcgagctcagtgagatgaactggtggatggtgtgtgtttgggtccccgc

SEQ ID NO: 33235 - DNA, 1157 bp, Triticum aestivum
  Clone ID: PAT_TA_33235
atacgactcactatagggcgaattgggtaccgggccccccctcgagttttttttttttttttttttttgttgttgttgagtaatgacacacgattcttccatccattccctcgtgcacaccttgtgcttaattaatttacattgcgcgcagctagcgagaggacctctcgctcgctcgatcatggtacaaataaacacacaaagtacgtgcagctacacgttgatccacgacgtacaagtacacatgcatatctcgtccgatggacggacggacggacggacggctaaacacatttagcttccgggggcgaagttggtggcgaaggcccaggcgttgttgttgaccgggtcggcgacgtggtcgaagaggttctcaactggccccttcccggtgacgatggcctgcacgaagaagccgaacatggagaacatggcgaggcggccgttcttgagctccttcaccttgagctccggcggcggtgtcggggtcgtcggcgaggccaagtgggtcgaaggcgccgcccgggtagatgatgtcgaggccctcgccgaggggcccgccaccaacacggtagccctcgatgaagcccatgagcaccacctgcaccgcccagatggcgaggatgctctgcgcgtgcaccaggttggggttgcccaggtagtcgaggccgccctcggagaagatctgggcgccggccttgaaccacacggcctcgccgaacttgatgccgttcttggacaggatctccgggaacacgcacccgagggcgccgagcatcgcccaccgcgagtggatcacctccagctccctgttcttggcgaacgtctcggggtcagcagacaatccggcggtgtcccacccgtagtcgccggggaactcgccggtcaggtacgacggggtctgctcggagaacgggcccaggtacttgggacggtcagggccgtaccagatgctctggggcgcgctcttgacggtccggcgcatggtgatgcggccgccaaagtcgccgacgctgcggacgaggtcatcgcgccgcggggcggtgccgaggaagctggtcgtctggtgcagcgccgacgcggccatttcgctggtggctggggctgcctgcgagctcagtgagatgaactggtggatggtgtctcgtgccgaattc

SEQ ID NO: 33236 - DNA, 2591 bp, Triticum aestivum
  Clone ID: PAT_TA_33236
gcggccgcgtccttcaccgccgccaagttcctggcgccggcggccgcgagatccggcggcgaccgggcgcccttccccgcgccgtccgcgttctccatgcgctcgctccgccacaggcccgccaggcgcctcagctccgtcctggccgtctcctccgacgtgctcaaggccgcgcccgctcgccgccgcgtatccggctgttcacacgcgaagaggcattggagctttacgaggacatgatccttggccgtaacttcgaagacatgtgcgcgcaaatgtactaccgtggcaagatgtttggtttcgtccatctttacaacgggcaggaggccgtctccaccggcttcatcaagcagctgaaccaacccgactgtgtcgtcagcacgtaccgtgaccacgtccacgcgctgtccaagggtgtcccggcccgtgcagtcatggccgagctctttggcaaggccactggctgctgccgtggacagggtggttccatgcacatgttctctgaaccccacaacctccttggaggctttgccttcattggcgagggcatccctgtcgccactggcgctgcctttgccgccaagtaccgccatgaggtgctcaagcagtctagccctgatgggcttgatgtcacacttgcattctttggggacggtacctgtaacaacggccagttctttgagtgcctgaacatggctcagctgtggaagcttccgattatttttgttgtggagaacaacctatgggcaatcgggatgtctcaccttaggtctacttcagatcccgagatctggaagaagggcccagcattcggaatgcctggggtacacgtcgatgggatggatgtcctgaaggtcagggaggtggctaaggaggcaattgacagggcaaggagaggtgaaggaccaactctagtggaatgtgaaacttaccggttcagaggccactctcttgctgatccagatgaactcaggaggcccgatgagaaatctcactacgccgcaagggaccccatcacctccctgaagaagtacatcatcgagcagaacctcgcgtccgaagccgagctgaagaacatcgagaagaagattgacgacgtcgtcgaagaggctgtggagtttgccgacgcgagcccgctgcccccacggagccagctgctggagaacgtgtttgccgatcccaagggcttcggcatcggccccgacggcaagtacaggtgcgaggaccccaagttcacccaaggcacggcgcaagtctaagggccgctgctgcagaagcagcttgtttacgcctcttttctcatgtactacctctctagctacctgcccctagttttgtcgatcccgccgtcgatttcttgtgttgttagaggtcacatatcactgtaattcattgctcgctgtgccaccgtgcggcgtctgatgcccccagttttttttacccaagaaatgttccccagtccagttgttgttctacagtaactctacatctgtctggtttgtagtaattggtactaatgatacacgattcttccatccatttgctcgtgcatctcgtgcttaattaatttacattgcgcgcagccagcgagaggtcatctcgctcgctcgatcatggtacaaataaacacacaaagtacgtgcagctacacgttgatccacgacgtacaagtacacatgcatatctcgtccgatggacggacagatggcttaacacatttagcttccgggggcgaagttggtggcgaaggcccacgcgttgttgttgaccgggtcggcgacgtggtcgaagaggttctctacgggcccctttccggtgacgatggcctgcacgaagaagccgaacatggagaacatggcgaggcggccgttcttgagctccttgaccttgagctcagctgcggtgtcggggtcgtcggcgaggccaagtgggtcgaaggcgccgcctgggtagatgatgtcgaggccctcgccgagggggccgccaccaacgcggtaaccctcgatgaagcccatgagcaccacctgaaccgcccagatggcgaggatgctctgcgcgtgcaccaggttggggttgcccaggtagtcgaggccgccctcggagaagatctgggcaccggccttgaaccacacggcctcgccgaacttgatgccgttcttggacaggatctccgggaacacgcaccccagggcgccgagcatcgcccaccgtgagtggatcacctccagctcccggttcttggcgaaggtctctgggtcagccgacaatccggcggtgtcccacccgtagtcgccggggaactcgccggtcaggtacgacggggtctgctcggagaacgggcccaggtacttgggacggtcagggccgtaccagatgctctggggcgcgctcttgacggtccggcgcatggtgatgcggccgccgaagtcgccgacgctgcggacgaggtcatcacgccgcggggcggtgccgaggaagctggtcgtctggtgcagcgccgacgcggccatttcgctggtggctggggctgcctgcgagctcagtgagatgaactggtggatggtgtctcgtgccgaattcggcacgag

SEQ ID NO: 33237 - DNA, 715 bp, Triticum aestivum
  unsure (1)..(715): unsure at all n locations
  Clone ID: PAT_TA_33237
gagaaactcagtccatgaagcagttgtctggagggcagaagacagtggtggcattaacactgatcttcgctatccaacgatgtgacccagctccgttctacctgtttgatgagattgatgctgctctggatcctcagtacagaacggctgtcgggagcgtggtccggcgtctggccgacctggcggacacccagttcatagccaccacattcaggccggagatcctgaaggtcgcggacaagatctacggcgtgacacacaagaacagggtgagcttcatcaacgtggtgtccaaggagcaggccatggacttcattgagcacgaccagacggccaacgccagctgaggccgaccgaggcacaaggagcagctgtgtgtgttgttcctctttgcattttgagttatcttggcagctcatcatcatacgcagtggctcgctgacatcgccatctttagtttgttccctgcagcaagatgtttacacaggaaaggaaagatatgtgggncgtgtgtttggccgttcgtctactcctggacattgtaggccactgttaagnnagctgtgtatatttagttagccttaggacttgagaggtgtaggataagtaggagcctttggattgctaaaacttgtttaagtatatggttagggagcatttgcgtgattggagatgtgtgtttttcgatttgtctatttgtaccgcactgttngcg

SEQ ID NO: 33238 - DNA, 1087 bp, Triticum aestivum
  Clone ID: PAT_TA_33238
cgtccggcaactgaaaaaacaaagggatgatctgaaggctcttgaagctaatttggagcagacggtgcaagatggtgcgaaagatttggaacagttgatgagcagtaggagcacgtatcttgtcaagcaagatgagtgtatgaagaaaatccgagatctgggctcattgcctgccgatgctttcgaaacgtacaagagaaaaaacaagaagcagctacagaagctgctctatgactgcaatgagcagttgaagcaatttagtcatgtcaaccaaaaggctcttgaccaatatgtgaacttcactgaacagcgtgaacaactgcagagaagacgggctgaacttgatgctggtgacgagaaaattagagagttgatatcagttttagaccaaaggaaggatgaatcaattgaacgcacatttaaaggagttgcaaggcacttccgcgaagtgttctctgaattagtgcaaggtggtcacggatacttggttatgatgaagaaaaaggatggtgatgctggcgatgatgacatggatgaggacgcgcctcgtgaagcagatcctgaagggaggatagagaagtatattggtgtgaaagtcaaggtttccttcactggcaagggagaaactcagtccatgaagcagttgtctggagggcagaagacagtggtggcattaacactgatcttcgctatccaacgatgtgacccagctccgttctacctgtttgatgagattgatgctgctctggatcctcagtacagaacggctgtcgggagtgtggtccggcgtctggctgacctggcggacaagatctacggcgtgacacacaagaacagggtgagcttcatcaacgtggtgtccaaggagcaggccatggacttcattgagcacgaccagacggccaacgccagctgaggccgaccgaggcacaaggagcagctcaagatgtttacacaggaaaggaaagatacgtacgggggcgtgtgtgttgccgttggtctactcgtggacattgtaggccactgttaatgtagatgtgtatatttagttagccttggacggtaacttaagaatgcgtaggagcct

SEQ ID NO: 33239 - DNA, 2334 bp, Triticum aestivum
  unsure (1)..(2334): unsure at all n locations
  Clone ID: PAT_TA_33239
ggagagagagaactactcncgagtttttttttttttttttttttttttttttttttttttgcccccanagtanaatctgtgtgtcaatatgtagtaaaaganaacgcctgcatgtcaagtgagggacttcattcgcccctgcacagcatatctaccagactacaacagcagtaacagttctaaaagtacatagagtaagaaaaaacatttcttttgtcttcatagatagacgagacccgggcatgcagagaaacgtacgaacatcactaacttcaaggtaataagttaaaaaaactatccaaaattataggtggttactagagatacacctcatacaatcatggctagaagcctagaatacaaggatcttctgcccgggaacaacgagaatccccgtatgtcctccctcctccccaaaagggggctgtaccactacctcctttctggctccaaatcagcatgtacactggttgacggtgttgtccaataaaaatattgacagggtttccccagaatgtgctagatgtttcatctgaatatacttcactggctgcgccgccaacgttcgatatatatggcccatccttgattttgcttatcactctgattcctcaccagcagcgtttaagatactcgctagatcttggacaatctcagacattggcggcctgaattctggttccggcggaatacagcgactgatgatgtcgacaaaacgagacaacactttctcagaacactctccacgaatagaagggtcaacgatctttattagtgattcaatgtcatgaaactgagactgggcccacctaacaagatgttgttcatgtcgcggacgagaactgtcatatggtttacgaccagtaagaagttctagcatcaccacaccgaaactgtaaacatcacttcgatcagtaaaagttccagattcctggatttcaggtgcctcgtaatttagtagtgctcgcatgcgaccagacaactgtgtaacagaacttgacaacgtcaatacagacagtccacattcagcaacacgtactgagaatctattatcaagaagcacattggctggctcaaaattctgatgcactactggaggctcgcaggtgtcatggagatactctaaggcttttgctgaaccaagagcaacctggagacgggcgccccaagacagtgcactatctagatcctctctttcatgtaacacatcatgtagtgtttttctactgaagtggttataaacaagtaaccgctgtccatattctgcacagtatccaacaagctcaaggatgctagggtgtctaatatctgatatacacgcaaccagctctagaaagtcatctactggtattcttccattggcattgtctatcttcataacttccagtaatttgccttcaggaagttctgccagatatacttttcccagcctactctctcttattaaattttcctctgcaaaactatttgtatattgctgaagtgttgcaacagaaaaggatgttgcagatgtcgagggacctgcccttggtggggtgctagctcttttttctggcttaacaataggattaacaatcactttttcaacaagcggaggtggtggtggggacactggcggcggcggtggcagcggcggtggaggtggtggtggggacactggtggtggtggcggcggcggtggtggaggtggcggaggttccacagcaaaaatatccgactctgttcgctccaagttaattacacgctcttctctcttttcaggaggcttctcaagagcagctggtatggccaaatttatttcacgaacatgcttcctgtcaggaaccccagctgagccttttttaacgtcgttccttggctgcgctgaagcttgcttgactttaggctcttcaactctttggtgcacccttcccacctgacttgttgtataatcatgtcttgactgtctctcttggtacttggacaggcaaaagattaccagcagcacaacaattatgaacagcacaatgccaagaaaaacgtatccaacggtccttagggttgaagacttgtgtttcccggaggatgatctgctgtctcgagctgtggatccaccagaagagctcgagggtgtattagacgatgaaggagttcctgaaggggatgaaggagatgatggtgtttgtgtcggtgtagggcctgtcggtgttaaagagggtgacgtggaaggagcaatgctggtattaaatgggttcccatcctttttcaaatttggtatgttgagcaactttggaggaatcggtccagaaaataaattgttccggacgcgtgggtcgacccgggattccggaccgg

SEQ ID NO: 33240 - DNA, 1581 bp, Triticum aestivum
  Clone ID: PAT_TA_33240
tttagagcaaaattgatcagctataataactgtcgtttgtacctgaataagaatgccgggcattgcccaattacactctggacaatcaaacgctagccggtacaaacagagcattgccttcgcaaaatgattagcctacacctcaacaaaatttggaacatgattctacacaacttattccagggacctatagtggtgagacctgggcaaaactttcaaggaacaacaacaaataatataagatcatacaacaaaagggttacgcgagggaggaagacatgtttagagagggaggtcaggcattactgtcgagagcaccctttagcatatgcaacccttccatcgaaatacttctccgtactcggaatcttgggatctcaatttgagggggtgggtctgctgagaagcatacaactaccgcagttaggttgtcgcaagtgtctcgtctgagcgcttcctgaacaagttctcttgagcacctttccggatcgttgtgggccatcagctctttccgtaccattgacacggcacattggctggtcatcacatcccaaaggccatcacatcctattatcaagaactcgtcttcctcggtgagtctaacctcctgaaattcaggttctggagtgagagggcttatagaccctttagaacctttgacgtgccaatcaccgattgcccttgctacagatagctgaccattgagatagccatcgaagactatgccaccaaggttctcaatcctgagcttttcactcttgcagctgggtttgtgatcttttgacagctcaacagctcgtcctcgctttcctaacacagctcgacaatctcctgcatttgcaacaagcaatgtcctgccaaaaataagggccgtcaatgctgtggtccctgaattgcggtcaagagaatgggaatccgcaatcgcgtgatcagcctttacaaatgcacttctgattgctttctccatgctgttggggaagtgaccatcttcgattatgaacttcagtaagttcttccgaacgaaacagactgcatctgtaccaccatgaccatcaaacaccccatagaaagcgcccggtgcagggatagcaggagtacgcattccgaggtgctcgatgaggctgtcgatgcaaacatgctcgtcctccatgtaggactttggcccgatattggcgcagctcccagaccggaagaccggcaggaagctgggacggatgtctgctggtgagatcaagctcagtgtccccgaatccaagcccaagtctgtggaggccgcggcgatgcgcgcactgctggcgcagtggcgtatggccgtgagctggtgacgcggcggcttccgggccatggggctaccggtggcgctgccgccgctactgggtggggtctccgggtcaacgcctccgctcatgatgtctggggctcttggctactcaccggagaagggccgtcgccgcagccgcgccgtgcgatgcgccgggtaggaggaggagctggtggcgacgatgggggaggagcgtgcaggaggtcgtggatggggaggagctcgtggcggatttggggacgggggcggggcgaggtgag

SEQ ID NO: 33241 - DNA, 1030 bp, Triticum aestivum
  unsure (1)..(1030): unsure at all n locations
  Clone ID: PAT_TA_33241
ccgtgggacnccnacncgtctatcccgttacgggggtcntttccntcggtggaatgntggaggaaacgtcggctctggtattacccggttggganggggttctgcaaggggttaaatggtaanccaggtttcccantcangcgtntaaanggacgcncgtgancgggntaatanggntcacaatagggggattggntaccgggcccccccctngggtgnnttcaattctcaaactttaaaacacgctggaactcatgtgttactagtaatttttgtgacacgagcaatatatgtttacatctgtaatttacacccacaacattaagctttaatcaacacctatcctgtgctactatgtcaaactggatcactccgatccactgctaggtcaggcctgtcttcctatggatacacccatcttgcacatgatacttacatcagtcagtggaaggaacggggtcggcagaccgacaaagtcagtccacgtggtggtgttcattctgtttcaaagtatagccggtatccagcaggctgaactcgcgctccaaaacccacgaagattcgtttgacttggtggtgctgatcgtgtactcgcggaagtatccatcgtgagttacaacatagactacagtcctcacggccggaaatttggaagagttttgggagtattctacactatgtactgctagacagctcttggtttctgcaggggcgatgttgtgaataacatgatgattagctggatccaaagcgtcggaaattgctttggatccaggaattatcgaaccgagtaatttattcgtttggttccttccatttctggcagagtcaagaaaaaacatgtgcaaagagcctgacgaacttgtggcagcaagaacatcaggccgatcgatgcacggcccaaatgagagagagtaaatcgttgatggatatgctccccgccgaaaactatgcgacttagttggcttgtgccacgatatatacccttatcattgtgcccttctcagaagctgntgctaggtacatgcca

SEQ ID NO: 33242 - DNA, 781 bp, Triticum aestivum
  unsure (1)..(781): unsure at all n locations
  Clone ID: PAT_TA_33242
ggttggntatttattttttttngntcttttttatgagatactcctcagcccaattgtaagattttctgttatcttaacacacgccacagagtgatggattacacacacacgcagacctactaatagttccattaattttaacaagaccggccagaaggaaaatatacaggatctaacacaccgccaggaacaaacaacaacaggaaaccatggcacacacacacacacatactactaatttgattaatttaaacatggcaggccagcaacaaaatcggcaggatttattagtcggccacgagcgacgagcagcagttcatcatcagatctagagcagaggacgcggacggggggaggagtaagccgtacgcaagcgatggaggggagcgggggaggcggtcacacgggcgggaggggaggaccctgctcctggctccgtccatccttgccggcggctacggcgggggcgggggcggagtcgtgcaggggctggtcggagggggcggcggcgagcatgagggggcggtcgttggcctcctcctcgtcgtcgtcgtcgtcggtggagaggttgatgcaggagcagcgctcgagggaggcgaagaaggcggaggtgacgccggcgccgaaccagctcgcccagccctgatccatcggcgatctgctcgctagggttgggtgagaggggtgggaggatgggagacggggaggcgactaggcgagagcagagaggactcctggaggggaggggaatggggatttggcgagatccacgggatgaatt

SEQ ID NO: 33243 - DNA, 1412 bp, Triticum aestivum
  Clone ID: PAT_TA_33243
aattcccattttctccttacaaatcttcttgtaaacttgtctggtgccccttgtggcttggacgtactggaagtgttcaggcaggcataagcccgccgtagtcccattcgaaaagaaaatagaagaacatggcaccaccactggtcaaactaaacaggcaaaacaactgccactagaactgaacaacagaaaaatggttgcacgaccaggcttcatctcgatcgaccggatgtagccgtcaagttgatcaggcttcatcctgaccggctgtaggcatcagcttgtgaaattcacaggtgatggtagattctctggtgatgttatagtcagaaacggtgcacgagtctctaagatatctgctagcatacagcaatttatgacgacatccggtcggcatcgacaccttatccttcatcctgctcttgacggtggcaatcgtatcggatctcacaacctgcacggttatggtcttaccccaagagaacttgacaaatatctgcatctcctccagcctgctgatgaacacatcagtcagtgccgtctctgaagtcagcaaagcacgcagcagtgcaacagcctcctgtttcccgacagcaatgcccatctccagtacgttagccttgtctatcccacaccaatgcttcatcacagacatggcggaggtctgatgcacaagtagatcatcgccggacgaatagttcccaccctcaacaagctcaggatgccagcaataatgtttgttatcatccttcggacaccggcagtcaagcgcccggtatgacctgatgttggtaaaaatgtcaaatggcataatgcctggatcaaggaacatcatattggagagaacacctgctaagtgcccaacatcgtcgagatcagtgacgcttctgtatagattgtcgaagcacctgccaagatggcaagtgccagcccccatgttcttgatcacacagctgatagggtaagtcaagaatccgaggagcatgtcgacaaactcatggttgcatttggcatacatgaccttcttttcacgggtgtggtaaaagacctcgatcgtccattctggtgaagaacctgcagaatcttggtccaacggaataatattctgacggatgatcggtgtcacagtggcatgagctgccttatgattatcagttccctttgatagaaatgcatcagtgagtacggtgtctgaggaaagagaggcgttcaacatggataaaacttgtgtcccggagacgctcacttcgacctcctcaaaggcatgaccgataccatcagaaccgaaggcctgaggcagcaatagcatggtcctggtggatgctggcttgattttcatgtcatcactgatcacataccgttctttgccacctacaaacgtctctttgcaccctacttgctcgtagacatct

SEQ ID NO: 33244 - DNA, 1001 bp, Triticum aestivum
  Clone ID: PAT_TA_33244
tttttttttttttttttttcagcgtcatgcttctgcgttagcgtggtcgcggccgaggtcggccgaggtacaatttatttattttgcattcttctgcaagctgtttgaaccaacgggcaccctacacaatctacgggataatcacaaatgtttgaatgataggtgtggccatagcaggggaatgcacaggaccacaatctatgacccaccaaaacctattgaataaaataaaccaaaaaaaaagctaaataaaaactaatatacacactgatggcaacaggccaaggagcacgtccccatttttttcttcttctgacggcgacctgtccgggcggccgctcgaattccgcgagtactgcttctcttatgaaactctcagatgatgcgaaagctaagtgcgggtacccatatcagctgaacgtttcaccttgctatgtttcttcattgtcctcgtccctaatgtcttctatttcttctcggcagtataatgcattaagttcttgctgcaactgaacatgtttttgcttggctgaaatcagttcgtcagtcaaagtaatcattctagactgcagctctgaaattttaacaagtaatgaccgttctttctcagtattagatgtttcaaccactgtctcactttgcatatttcggacttgcgacgacgttccagactgtgcacctgaagaaaatacgagatttaagatttaaccaaagaaaaggagaatttcatagccagaagagaaaaaacatttaccgtcagctttctcattctgttgcatgctactcagtaggttcacgatcagatcttgctgaagtgtagtctgttgcacgaggttctcaaggtggggaatgagaacagacgatgataccgagctattgcagagttccttcagatgatgactgttagacgttggtttggcattgacaatccaatcaccaacacttgcggattttcttagctgtataccctgtggtgatttgcgtgagatgctactcaatgg

SEQ ID NO: 33245 - DNA, 1052 bp, Triticum aestivum
  unsure (1)..(1052): unsure at all n locations
  Clone ID: PAT_TA_33245
gtcgagggacagcggatcctcctacggccgggagcacagctggcggcggtcagcagacggcattctttgactcttccgttccaagcacgccgatgtacaactccagtttctcgccaaggtacagcgaagccggggacgacagctcgttcgacaccttctccacgatgcactcatttggcgcgaaagacagcactgcgtccgcacaaccagctgacagcttcacgccgtccgaagcatcaaggacgaccgcggcggttgccagcgcaaatgacgcattcgggaggtctgactctttcagcagcaatgctgatcaaggcggtggcagcagcttcatgaggtacgattgcatgacccccactgccgacaaaggcgctggtaacaacaggttcatgaggtacgactcaatgagcagcaacgctgagcagggcagcggtggcaacaacagtagcagctttatgaggtacgactccatgagcagcaacgccgaccatgacagaagcaacgtgtttgcgaggttcgactcgatgaagagcacttgactcccatgaccagggctactccttcgacgatgacgaccctttcggcaccgggcccttcaagccgtccaagccgtcgacagagacctccagcccgacgagacatgggaccgacaagtggagcgcgttttgacaggcacctgtactatatagaggtgatgatgtgtgtgtttgtgcaccttactgcatatatatatacacgtacaaggaagggcaagacatttttgcttgggaggagagggagcttgcttgtgtgtttgctttgcgtttgttgctgtttatacctagggtcgggtcggatcggatgttggttcaattgcacatgtttggctgggatgaatcgtgcttataaacattctttataccttgtattgtacaagttagcgtcagtcggtcgatcactttcagcggatattggacaatttctgagctttttctccatgtattggcatttcttttctgttttccttctttttctttctttctttctttcctcctgntgtacacgtgctcctc

SEQ ID NO: 33246 - DNA, 1492 bp, Triticum aestivum
  Clone ID: PAT_TA_33246
gcctcttcgctatacaaccagctgtttaaaggggtttgtttcgactattttttttttttaacgtcactattatggaagcatgtacagatgatttacttattacaagacttcgcttttctacaatctgtacaagtgaatgcaccaacaaacagcctttactgtcaagcatcaactcaataccgacacggcacacctgcaatattatctaagcaggtgtgcgaaacactggctatgattgcagcacgaccttgcaatctcatttttacctaaacactggttgcttgtgtcttggattaaatgcccctcgcccttttcctcagcaacccaagcaatagtatatcaagtctgcgcacactctaaaggatgcaagcttccttcagcaaattcatgcgccccaaatcgttccaaaaactcaaagggcagcaaagtttcacggttgcggcataacttcttctgattgttctctatggcacttaacacatcaatttctggtccatcaaccatagaagtaccttctgcatccggtgtccataactttattgtattgtcaattccactcgttgcaacagcacaatcatagggatgagactgtatacagttcacaacagctccatcccctgcaagcattttaacaagccttcctgttcttttctcccatatgaaccatctaccatcatcacttccgctggcaataaattccccttgttcaccaagaaagctagcttgctttatatctgtccccacgttgcagtgcccaacatatctttttttcatatcaatggcaacatccggctcataggcagaatcgccattacaagtggactcagctgatccattcccaacagactgttcattaggttgatcctctcttcggtgcaattttagacgtaagctacctcgaacggcacctggatcactatcacggctttcgtcacccgatactgatgtatcaaagtctaactccatctcatcatcgtaatctgaatcttcccggccctcctgtgatgatgacccactaacatctgatctgaacagtagatcactcaatgaccgtaaccgtccatgccgtgcatcagtgttagtatttccttgttgatcttttttatttttctcaagttcagcagcagcaagtcgcttctttatattttccacctgttccgcagacaccgaatttggtagaacaagactatgtgcagcttctgcatattcacatgcctccttcagtcttcctaactgtagcagtgcatcagccatgaacaagtgtgcctggaatgatgcgaagtcaatactccttgcttcattgcaatcccgaatagccatgtaaacatcatttttccacctccgctttaggtacaatcctgcgcgggtacacaaacaatcatgcctcgtgctatcatcaatatcagattccatggcctcgagtatttcacagcatgcttcaatgccatgcattaggtttgtgccagtctccagagattttatcacgacttgc

SEQ ID NO: 33247 - DNA, 497 bp, Triticum aestivum
  Clone ID: PAT_TA_33247
tcgcgatctagaactagtatcgttcactagctacacacacatcacgtagtcaggctaagctaggaagaagcactcgccctcggcgagcatggcggcggccggatcagctgctgctggtcgtcccaagttgggggaggagaagctgatcatccgaccggagaaggtgcggttcatcgacatcctgtccctgctgatcctgcgccggcccatcaccagctatgccttcgtcgacgccggcgaccagacgacccgcgacgtcggcatcacgccgggcgacatcttcgtcacgctcaccgagatcatccagaaggccctcgctgctgcctactacccggcaaagataatcggggccatcgtcgagctcctcctcaacttcttcgccctcaacggaggcctgctcggcatcatatggaacatcatcagatgtacgtattcacagtatatcatatgaccatcttgaccctaaaaaaaaaaaaaaaaagggcggccctcgcgat

SEQ ID NO: 33248 - DNA, 2036 bp, Triticum aestivum
  Clone ID: PAT_TA_33248
gtgcccacacgtcctcgatcgtcacccacatcacgtagctaaacttagcaagaaagaaccactcacccctcggcgccctcggcgacgaccggatcagccgctgctggtcgtcacaagttgggggaggaggggctgatcatccggccggagaagccggggttcatcgacatcctgtccctgctgtccctgcgccggccgctccccagctacgccttcaacgccgtcggcgaccaggcgacccacgccgtcggcgacgtcgccgggccgacaggttcctccgtgctcacccagatcgtccagaagcaccagcgctgctgtctactacccggccaagataatcgggtccatcgccgcgtccctcctcaacttaattgctttcaactgagcgcctgctcggtcggcatcatatgataacatcatttaagctggtgatcgcgatcccgcgccgggaggaggccaacttccggacgatgatcgggatgatcgacgggaggacagagctgaagccggcaccagcagcatctgtcggcgacatgcggcagctgcaggtgctcgacgttgtggtctccggcgaggtggcggaccttgagagcggcgggtacgtgacggctgggacgcccctcgtcctgcgccagtacctcatcctcgagatcacagtcatggcggccaagatcgcgtacgagaacgccgccttcgtcaagaacgtggtcaacaacgtgtggaagttcaatttcgtggggttctacaacggctggaacaagtttctcaaggaggacacgacacaggcgttcgttttcacagatcgggccaaggatgcgagcgtggtcgtggtggcgttccgtggcacggagccattcaacatgcaggactggtcgacagacgtgaacctgtcatggctgggcatgggcgccatgggccacgtccacgccggcttcctcaaggcgttgggtctccaggaggaggacggcaaggacaccaaccgcgccttccccaaggacgcccccaacggcgccgcccccatcggcaagcacatcgcctactacaagctccgcgaggtgatccgcgaccagctcaaggcgcacccgcaggcgcggctcgtcatccccggccacagcctgggcggcgcgctcgccgccgtcttcccggcgctgctggcgctgcacggggagacggagatcctgggcaggctcggcaccgtgcagacctacgggcagccgcgcgtgggcgacgccaccttcgtcagcttcttccgggccgaggtggagaaggcgacggccttctaccgcgtggtgtaccgctacgacgtggtgccgcgggtgccgttcgacgcgccgcccgtggcggagttcacccacggcggctcctgcgtgtactacgacgggtggtacgacgggaaggtgctccccggcgacgcgcccaaccccaactacttcgacccgcgatacctgctgtccatgtacggcaacgcgctgggggacctgctcaagggggccttcctctggacgagggccggcaaggactaccgcgagggccccgtctccctgctctaccgcgcctccggcctgctcgtccccggcctcgcctcccacagcccgcgcgactacgtcaacgccgtccgcctcggccgtatcgcgcccaagtcactcctctaaaagtctaactcagacccactgtgtgtgtacgaccacaagagagagaattggtgatgaataagttgttgtttcggttgtgtcgtgtcgtgtcgtgtcgtatcgtgtgtgtgctatattaagcctagtacgcttacgtgttcccctgtgtgcatgcctgccgctctgtctcggcaataaatcgatccaaggcctttatgaatataatgcaattgaaggagctactagttgtggtaattacggcaataatcgaatcactactatgtctttacgaatatgcaattgaaggagctactagttgtggtaattactttcatcaatcaattgtataatttgtcgtctcatcatttataatgcaattgaggtgaaaaccccaaagaaaaatac

SEQ ID NO: 33249 - DNA, 468 bp, Triticum aestivum
  Clone ID: PAT_TA_33249
gggacaaaattaattgggcatggtttcttcataatataaattccaagcttgaagacaaagggtaaagatttatttgggagactcgggcaatatctaaattctatttaatcatgaacggggggagtactagagatttcaactctacagaatcccagtaaaaatcattctaatcagaaggccttacaaagcaactggtggacgcttcctcccaaacaggggagtactctgttttgccaaacctggagcacaatttccatttggaacaaaatgtacaaatgaagggaaagggggcaaccttgattcccaggaaaccacattgaaatccccttggggtcgaactccaggatccatcacaagatctccaagcctcacccttggcagcgatgccctctccgctgtaacctcagtgcggctgctgccactggtgcaggaaggcaccatgcggagcggaaaaccagcaggatgcaa

SEQ ID NO: 33250 - DNA, 707 bp, Triticum aestivum
  Clone ID: PAT_TA_33250
cgagttttttttttttttttttaaaaatcaaaatgctgacatgatcaaactgaagcaacttacgcttgaaacaaccactagatgtttcattaattcagcaattccgactcattatacactgtttcatagggagatccaacccactataatgtttgtttgccacacgaataaagcagacaagaccaaaattaacagagactccgcggcggctggagatctaagaggaggtgaacttggtgacggccttggtgccctcagagacggcgtgcttggcgagctcgccggggaggacgaggcggacggcggtctggatctcccgggaggtgatggtgggcttcttgttgtagcgcgcgagcttggccgactcaccggcgagcttctcgaagatgtcgttgatgaaggagttcatgatggacatggccttggaggagatgccgatgtcggggtgcacctgcttcaggaccttgaagatgtagatcttgtaggtctcgacgctcttcttggccttcttcttcttcttgtcggcgccgccgtccttgccgggcacgcgcttctcggccttgggcttcttctccgtctccaccggcttcttctccgctgcgggcttcttctcggccttgggcgccatggcgatttcggcggaggtggaggcgcgagatcggatttgggggcgcgaggtgggaggactgcgggtttgcccttggttt

SEQ ID NO: 33251 - DNA, 1343 bp, Triticum aestivum
  unsure (1)..(1343): unsure at all n locations
  Clone ID: PAT_TA_33251
aacatgaacagcaaaaattttagatatgggaatgtaactaacctttacatactacataaaattcagacaaatatgggatcaacaaatccggaatgcacagaaactattccagattgctgcagtttgaatctgaggctagtttgataaggatggtacagagcatcacatgaaccaaagcacaaacccaactccaactgacttaatcacacccagttgaggccacactgaggcgacggcgtcatgaaaagctccgaccactgtaggtcctaaccatttccacagaacttgacgacgcagttgtgcgccagatgttttagtgtggtatgcaacttcatttttccttcgcacatcttaagaagtgatgccttaaacgatgatgtaccgccataccgagtcagcaaaattggattatgcctgtgaatacaagtataaaacccatagtattcttttacagcattagttagtacttcaaaaacaagttcaggccattaaacctgttactttctacccgatcaggcaatatctacacttcatgcataagcgaccagggcaacgtttcgctcctccggtgcctgcgctatagcaaaatgacatatccagccactaagcaaacatccgcaactaggtagctagtggagtcagccagcacggtagaagacggtctctttgacaaccccacctgattcggcaaatgtggcaactgaggatcatgtcgaggcaccaccatggcntgctgtctgttgactctgcgtgcgaacaaggtgaatcaacaccagtttcagtcagctcctcggtatggaaacgtagtgccgttgtatgtatagagattgttgtccatagcaactaaaatcataaagtagtgacagcatggagaaaacaacaaccaagaacttgttcaacaaaatataactataacttcttatttttttactaatcacataaatatctgaagcagtttaaaataacttaaaacaatgaagagctgtcaatctcttttcatatgcctgtttgagaatacttctaaattttctctctaggcctacatagaaatctaatactaagacacataacttcagccaatccagaaaattctttattggctactgaatcctagtggtccaaaaccagagtgcgacgaataaagaatattgccaataacaaaaagatgcatgcatagactagaaagttacaatacttcttatctccaatttcatcattcagcacctgtcattttgcatgaaataaactgtatggacacaaattcagaagcaatattctcttaaagaaaaaacatcactaacatagcatgttcagacatttattggggtcaaaaccaaaatttc

SEQ ID NO: 33252 - DNA, 952 bp, Triticum aestivum
  unsure (1)..(952): unsure at all n locations
  Clone ID: PAT_TA_33252
gaccgaccgttgntggagaagatgcnttcttgtggattaactccctngccttctcctttgcccagcagccgtcccagctcccgcggcgtgatgttgaagtagtccacttgacgtccacaagaaaaataaatcagtcgtttccattcagtcatgcattagaggaagtacaacaactaatcttggcatatagtgtcatgcgaattctggtcgaagtaccaacctagacaaaagcggatgcaactccaaacctatcctcgaaaaaagacatcaagctaagtaactaagctaaggatcattcttcggtagaagatgagtggaagttcaagaccatagcaccattgctccttgtaactcctgagcatgagaacacacaaatgcttctagaaaagcttcagaccagcactaacattgcaaagcatgtcagacaaccctgttaacaagaatcagtagaatcagaaaataaacattagctaaccacaagtactcaagactgcaaggcaaaagatgcagcaataagatgatatatcattacactgcaacttcattatttacagctatggggtatatcacccaatcgaaagaaaaaaaacagtatgtgccttgttctagctactaataagatgttagcagttggccactgaaaaagagctaaattaattcatcatacaacactacaacttcatttctttacagttgtggggtatatcacccaatcgaaagggggaaaatagtatgtgccttgttctagccactaacaacatatcagtagttggccaccaaaacagggctaaattaatttgccatacaacatattagctatatcatgtgtgaattgacccgaaaagataattgcagaagaacataaccatgaaactatctagccgccaatgaagaaagattgtagatactgaaaagatatacagaaggtttcttggtgcaccggacgcgtggg

SEQ ID NO: 33253 - DNA, 633 bp, Triticum aestivum
  Clone ID: PAT_TA_33253
ttttttttttttcgaacagcagaattacttatatcccttaatgtgacgagtaatttacatggttcaagcaaatgcaacagtacattggtgagtactaatgccacgttccaagaagaattaatcctcagctaataacaaaatgtatccgtcctaatgtagcaatctagcagtgatcatatcgatggctggaccggccgatgcatgcgccggcgccggtgtggtcggatgagctgctactacatatctagtggtaatccaccgccggggaggaggaggacgagcagccaccgacgatgtcggcgaagtcgccctctgagcaggggatggtgaggccgccgccggcgcggtggtcgaagccgaactcgtcctccacccgcttgagcagcacgaggaaggacgggtgcctcaggtacgccgtcgggatgacgaaccgcttccgctgttcgccgacgtagaccgcgaagtggcccttaggcacgtccgccgacgcccgccccttggccaggtgcagcctggccatgagctggtagagcttccccgccattgatctccttccagcaaacaagactgggctgcttggttgatgtttgtggtgtgtgtgttgctcgagactggagtgatggtgaagagtga

SEQ ID NO: 33254 - DNA, 528 bp, Triticum aestivum
  Clone ID: PAT_TA_33254
agagtgtgtgtgtgcgagatattgagggaaatcaaacttatgatgagaatgtgtgtgtatgtgatggatagaactaaatatattaggctactgacttcgaatgtaatggtttatacaattcaatagttaaaatcattgtcgaattccaagatgtatacgaggtctatagtacttcacaatatgctcaaactcacataatcccagtcaaatgaaaatctaaatgcatttcatagttattactttgtaggatgcaacaaaaccaaccataactctacatgatccattataaaagcaacattttgaacacatcccaatgtgtgaatgaaatgtgcagagagagcttgcgaagatggagcagatagggcgagaaagattgcatgtatgcgggcgagagagtaggagacaaacctaagataagagagagagggggggagaagtaaggtctatgagaaagatggagacatgtaatatacgtgagatgcatgtgcattcggattctgtatacgtggaaggagaagagaccacatg

SEQ ID NO: 33255 - DNA, 903 bp, Triticum aestivum
  unsure (1)..(903): unsure at all n locations
  Clone ID: PAT_TA_33255
agattttcccgcccacctcaaaattttgtgacactggactccccgtgtggcgtgttgagtgattcggctaagcaactagcgagtagtagtagtaaactctgcatattaggtttgaccgaagtcaaacttcctaaagtttgaccaagtttatagaaaaatataaacatttaccataacaaatatgtatgatgtgaaagtacattcaataatgaatctaatggtatttatttgttattgtatatgttaatattttttgttataagctttctgagagtttacaaaacttgactttgaccaatgctaatacgcggacttaaataaaaacggagggagtacacatttgttttcttagtttgtagtgaactaatcatttgttgaaattgtgaaataaatatattaggctattgacttcgaatgtaatggtctatacaattcaatagttacaatcattgtcgaatcccaagatgtatacaaggtctatagtacttcataacatgctcaaactcacacacacacacacacacgcacacacataaagtaaactagaagaccattctctcatgtatacacaacgtatcggcatctgtgtatgtctcactcatgcatgatcatttgcacattcacacctctaagtgcatttcatagttattactttgtaggatgcaacanaaacaaccatagctctacatcagccattatagaagcatcattttgccatatcccaatgtgtgaatgaaacgtgcagagatagcttttgaagatggagtagatanggcgggaaatattgtatgtatgtggacgagagagtangagacanacctaacgagacagagagagagatagatagagaaagagagaggaagaagttangtgtgtgagaaagatggagacatgtaatatacg

SEQ ID NO: 33256 - DNA, 910 bp, Triticum aestivum
  Clone ID: PAT_TA_33256
ctaaagacgttaccaaaattgcgcaaatggtgttgccaccaaatgttaacaaagaggaatgaatattcacatgaagttatttctggcaattcgcagccttttcagttattttgccgttagctgcgcccttgtgaaaaggccagaaactagccagccgttcaagcaccccagcgcccttggagaagtatcctaaggcttgtggagtagccgggggaaagtcctcggggggcatggcgaatggccgcaccatcttctcaaacttgtccagtgtcaggcaagagccaacttcctgcagtctctcaggccccattatcggcagggtgtgctcctggagcaatgaaaatgtttcactggttttgtcctcgagagggctgagatcagcgccacgactgaatgtcatttcgattcggaaccttttctcatcttctaaaggaacctctgtattttcgaacattctaagcacgatattgctcatgtaatcaagttccctggtcccatgtagtcgagccaaactcctttgcaaagtatctttcttggttggtttccagttgccatcaaaggcatcatggcctgatggctgcatcctcttcattggagtcatccacctccagatcgctgcttcaaatgctagtgtggcattctgttccaataactctgggtggttcaacagatcctgcttgatacccttacccatgataccatagttgtagttccagtaaacaggaagggcgcctcgaccatagtactcaactccttcagcacaacggtataattcattgctgtcgtcacagtagctctggcttgggctcatttcatggttgtagcaaagaccccaagccaatgaaccaccgtcagctagactatatccacacgaggtcttggcgccgacgtggccgaggaaggccggacg

SEQ ID NO: 33257 - DNA, 1531 bp, Triticum aestivum
  Clone ID: PAT_TA_33257
attgcgaatcatacgtcgttatgttgtgaatctacattcattatgggagaaggttgcgggctttacataaataggttacagattacacatatgcaacagtcgtcctcagagcttactaataaatactcccctccgtttttattcagtctcgcatattaggtttgaccgaagtcaaactttgaaaagtttgcccaaatttgtagaaaaatttataaccatttactataacagatctatatgatttgaaagtaaattcattaatgaatctagtcgtcttgtttttttattgtataggttgatactttcgtgtataaagttaatcaaagtgtacacagtttgacttccccaaaggccattgtgggggcaaaataaaacttgtggaggtactgccggggaaaagtcctcacgagacttcgataatggcggcagcatgatatcaaacctgtcaagtttcaggcggaatctaaatgcctgcggcctccaacgccccattatcggcagggtgtgctcctggagcaataaagatgtttcactggttttgtcctcgttagctctgagatcagcgccacgactgaatgtcatttcgattcggaaccttttctcatcttctataggaacctctgtattttcgaacattctaagcacgatattgctcatgtaatcaagttccctggttctatgtagtcggtccaaagtactttggcagacaaggctatcctctccatgtagagactcatccaagttgcaataccgaaggacattcatcaatgagtgtatatgggattccgatgtgaaataaagccttgtgcggacatgtcggtctggtgtcttcacatttgcatacttaggatctaagcggtatttagtttctctatcgtcttcatcgttctagttccagtagacttttagggccgttctgctagattcctcttccacttcagcacattggttataattcttgctggtgctctacgtattttgggcttgggaacatttcatggtcttcgcaaaactcccaagccaatgcacaaatatcagctagactatatccacacgaggtacttggcgctgacgtggccgaggaacgcggcgacctccttcatgctcatctccctgccgccggtggtgccgaacccacgaggctcgaagagggccgcggcggtgatgaaggccttgtagtcccagaagccggtggcgtgggcgagggagctgttgcgcttggcgaagagctcctcgaactggtaggccttgaagtagtcggtgatggtctcgttgcagcagaacctgctgccgctgcactcccaccccttgtcgcacgccgtctcgccgcccttctgcctccttgcgtccgccgccgcgagcagcgccaacaggagcagaaaccacgccgcccgcaccatccccatggccgccgcaggaccggcgccggaggaggggaagctggaagagcaggaggagtttgtcggtggtgggcttcgttcccgcgccgcctgttccgctggggaggtgagaggaggaaggggagctggtt

SEQ ID NO: 33258 - DNA, 971 bp, Triticum aestivum
  unsure (1)..(971): unsure at all n locations
  Clone ID: PAT_TA_33258
ataatactaccacgcgtccgcaaaggtccatagtcaaagcttgaattgcagagaagagccgacgatacctcgacggcgtcggccatggccgccgaatacgaccgcacggccgacctccgcgcgctggacgccacctgctccggcgtccgcggcctcgtcgcctccggcgtcacacacctcccccgcatcttccgcgtgtccgacggcgtccaccaaccacaaccaccgccaccgcaagttccatcccaagaactaccgtcctcctcagcgccgtccgtcccggtgatcgacctcagcggctccgaccacgcggccgtggtcgcggccgtccgccgggccgcggcggagtgggggttcttccaggtgacgggccacggggtgccggaggcggcgatggcagcggcgacggacgcggtgcggggcttccacgaggccgacggcggcgagggcagcgacaaggccaggctctactcgcgcgagccggcgagggctgtcaagtaccactgcaacttcgacctgtaccagtcgccggtggccaactggcgcgacacgctctacctccgcatggcccccgaccagcccgacgccggcgacctgccggacagctgccgcgatgctctgtttgaatacgccgaacaagtgaagaatttggggagcactttattcgagctgctctcagaagctcttgggctcaaaccgagctacttaactgatatagagtgcaaccaaggacagatcatactctgccattattatcctccgtgcccacagcctgaactcgccatcgggacaagccggcattcaagactcctggcttcctcaccatacttctcccaagacgaaatccgtggcctccaagatttctcccaacgaaggaccaattgggttaaacgttaacgccaacacctgggaggattcaatcngtgaacatcggngatttcccttaaagctgatttcccnaacgacgggtt

SEQ ID NO: 33259 - DNA, 1568 bp, Triticum aestivum
  unsure (1)..(1568): unsure at all n locations
  Clone ID: PAT_TA_33259
gcacgaggatcgaaacccagttctgcgtgggccgggagggttggagtggggagccgacgaggcggcagcggagggggatcgccggagacgggatggacgtgccgtggctgctggtggcgcacgggtccgtgacggcgctggtggttgtgtcgtttctctgcgggcagtggcccatcttcgagggcaccttcgttcagagcatcaaccacttcctcacctccggagcctaccgccactttctgcggctcgtgcaggcggcgtgcggtactggagccagggatctcgtgctcggcgtcgagcagtactgctgcgaccgccctaaccctatcctgcaggttttgtatgttgccataattggcggaacatattttataatagtgcagtcatctttcaagtacattcctgggtattacgtgagtgtattgcacaggtacctgagcattgtgccacgcgtccgtggtgctatactctttgttctcactagcttctctgatcctgggactgttacttctgagaacgtgtctcagtatgtatctgcctatccttttgacaacattatttatgtagagaaagaatgttcaacatgcaagattaccagaccagctagggcaaagcactgtagaatatgcgatagatgtgtggctcgatttgatcaccactgtggatggatgaataattgcattggggagaagaatactcgctattttgtggccttcttagtttggcattttcttttatgtctgtatggagcaattatccttggcttcattgttgctggtgaattgaaagacaagaaagttgtctacatactgacagtttattatggcattgataattcattctctgccctgtttccccatgttgcacagtggttgcttgctgtccataacacacagatacttttggttgtatttttgggtataatagcgttgcttcttggggggttttgtgcttatcatgtacatctttgcttatccaacacgaccacaaatgagacattcaaatggcaagactacattttctggatgaaaaaggagaacgcagtgaaagctagcgcatacacactgaaggcgagcatcaacgcagccagcagcgaagcgcagaaatcgccgcaaagcaaatgggaagaagttcttctcaaggtcgaaaacacgggccgaggagccggtcgtgaagaataacatatatgacgttggctggatccaggaacctgtgttgaggtgatggtacctgcccccgcggccgcgccgttctcttgcaagaagtccgaatgaagtgaaatgctgttgcaactgttgtatgacttaactgttgtanatccatggcgttgtaaaattttgggaanatttcccctcccccctcatanactgacatggngttanggcccttantgggnncaaantaattactgtnatgacatccgtgcaatccgttttgcttgaacatcctgaanaatantttggnatttgaaactcattancgggnanctccgttaccggaaacataataattttgcatttgaaatncaaagtnaccnatgtttcnacaanccaaatcagngtatnttg

SEQ ID NO: 33260 - DNA, 447 bp, Triticum aestivum
  Clone ID: PAT_TA_33260
gcgaggaggcagcagatcgccagcgtggcctacaacggcagccttggacaagccaacaatcccttcgaaacgaacgaccctttcgccatgtccaacagctttgcgcccccttccaacatccggctggcaatggtgacccagcagcagcaatacttccaggctcaacaacatcagcagcaatactactaccagcctcagctccaatactaccagccccagctgcagcagcagcatcagcagcagtatttccaggctcagcagcatcagcaccagtatttccagcagcagccccagtattgtgtgcatccggccggaacttacaatccgtttggtgaccctttcactgaccttgtaactctggctgctccttcaaaacaaggcgatttaagtttgctctgaattgcccggccctgtttctgatctcagtcaatatagatgggtactccc

SEQ ID NO: 33261 - DNA, 1035 bp, Triticum aestivum
  unsure (1)..(1035): unsure at all n locations
  Clone ID: PAT_TA_33261
ccctccgccgccgcgtccgcggacgcgtgggcgccgtcgccctccgcgccgcgccgcgggcaggcgaaatctgccttctttgtcagcgttccggggggacgccgcgggctgcgccgggtggtggccgcggcgctgggggacatggacatgcgcccggccattgacgagaaccccgagggcgtgctctccggcgagtggcccggcaacttctccctcgccagctacgacgacctccgccagtacctcgagtcccagatcgtctccaccgacaagatgagccccacggcgaagctcggggaggtgatgtcgcgcccggtggaggtggccacgccggaccagaagctggccgagatcgacgccctcttcgccacccagtccggcctgcccgttgtcgacggcgagggcaggtgcatcggggtcgtctccaagaaggacaaggccagggcatccaatgggttggactcaaccattggagaagtcatgtcctcacctgctgtaactctgactctggagaagaccgtcttggaagctgctgcattgatgctcaagcataaagttcacaggataccagttgtgaatgaacaacagcaagtgatcgggatcgtcacgcggacggacgtgttccaggccttggaggccagcaaggcataagaagatcctgcatccttagtcctcactgtacatttcgacggcggcagcagactatttagcctacgggagtgccgctcctgtacagtaataaccctagtggtgtgatgtgtacatgccaaggccttcctatagcgtgctcttggggtgtattgagtcgcgccatgtgttgttggacctgtgtgaccttgaatagttgttctggcatgggtttgtttgctctctcttttgtgatgaaatcgtgagtatttgtgcagttgagaactttgccttgcttggagctgctctgctatctctctttcatgtaacagatgctctccgaagctgaagttcatttgaactttgatcgttntagcatgtatatatgggtttgttttgngaaacccc

SEQ ID NO: 33262 - DNA, 1057 bp, Triticum aestivum
  unsure (1)..(1057): unsure at all n locations
  Clone ID: PAT_TA_33262
ccacgcgtccgttagttccacgctcctcctcctgcgccgccgccgccgccgccaccatgctccgcaccgtcctcaactccggcggcggtcgtctatgccgcctcccctccctcctcccccaccatcgcctcatgtccggctcctccgtcgctgccatattcttccaaccatccctgccggcggatcccgccaccgcgatccagtcagccggcatcgacctctcccaccccaacaccatccccgccctccttgtccacccggacctcgcctccaactaccccgccgcctcccgcttcttctcctgggccgcatcccacgacgccgccgtcctcaactccaagtgcttcaactccatgctccagctcgccgccgccaacagcgacgccgccaatttctggtcactcgtctcctcgatgcgttccaagggctacggcatctcgaagaccaccctccaggccgccacggagagcttccggtccaatggcatgtccaaggacgccgacatgatccagaaagccttctccgcgcacgccaggaacgcagcggtggcggaggcgtgcaagattctccgctcagatgcggatgagatatctaagctggacaagttgaatgagttgggcgttgaggtgaccgatgagatggtggcactggttgtggagaaggtcggacagtttccgcgacaggcaatggtgttcttttattgggtggagcagtcagctggggcagggatcaactggggcaaggtttacaatgcaatgggaaagatnaatttggccgggaagattcattnnaanatttcccggagnccctccggagatgattattaagagtttggatgtaaggagggtatgttatcccatngacagttcccaanaagaaattttttagatcaatggctnttcccgttnaatggggggacggnaacaaccgtcaagttttctctatgaanaactgtntnaggatatatgatcgaacgggataattgtcgttacaaaagtggaatangtaatctcctttancgtacantctaaactaaggttgaaatgaggntagcagg

SEQ ID NO: 33263 - DNA, 529 bp, Triticum aestivum
  Clone ID: PAT_TA_33263
gagaaaatcagcgagacgcgaatcagcggcggcgatggctctcccggcgtccagctccaccctctcccgcttcctctcctcccgccgcatccagcccacggacgtcaccgccctcgccacctggggcatcttcgccggcagcgccgccatctacctcgtccagccattcgactggatcaagaaaaccttctttgagaagcccgagccagaggcatgagtgtcgtcctgggcatggacggctgcaacttttgatgcgtacattttcaggatgattctctgagcttggatgacaacccagccaataatatacaagaccctcgtgttcccttgtttgattttccatccagatgtaggtttcctcttgcgttgcatgtaaccctcaccatgggaggggaatgatcatgtaaatttattttccgtcatcacagagaaaagaaactgtgctcgtgtttatttctcctctcttgctacggtcaccaaagagtgagcttttggctcacgctcttgcgtggtgttttgtgttcaaaaa

SEQ ID NO: 33264 - DNA, 543 bp, Triticum aestivum
  Clone ID: PAT_TA_33264
cgcccaaatttcctcacctgcccccgagaagagagagagaaaagcagcgagacgcgaatcaacggcggcgatggctctcccggcgtccagctccaccctctcccgcttcctctcctcccgccgcatccagcccacggacgtcaccgccctcgccacctggggcatcttcgccggcagcgccgccatctacctcgtccagccatttgactggatcaagaaaaccttcttcgagaagcccgagcctgaggcataagtgtctatgggggtgcacggctacagcttttgatgcgtacattttcaggatgattctctgagtttggacaacccagccaataatatacaagaccctcgtgatcccttgtttgattttccatccagatgtaggtttcctcttgcgttgcatgtaaccctcaccatgggaggggaatgatcatgtaaatttattttccgtcacagaggaaagaaactgtgcttttgtttaaaaaaaaaaataaaaaaaaaaaaaaaaaaggcccctatgagctttggctcgctcagccgtgg

SEQ ID NO: 33265 - DNA, 971 bp, Triticum aestivum
  Clone ID: PAT_TA_33265
gccggccaggtcaccgacgcgtccaggtggaaccggccgtcggtgggcgagaaggcgtgcgccaacgtgcccagcggcccgtcgaaggcctcgccgtcgccgtggtcgcccgagtggacccgatggtgatgtcggcgtttgtttaaaatttctttcctctggagaattaacaagtcttctacttcctctcgcccaatctcctcacctgcccccgagaagagagagagagaaaagcagcgagaacgcgaacgcaacggcggcgatggctctcccggcgtctccgctccaccctctcccgcttcctctcctcccgccgtcttcagcccacatccagcccacggacatcaccgccctcgccacctggggcgtcttcgccggcagcgccgccatctacctcgtccagccattcgactggatcaagaagaccttctttgagaagcccgagccagaggcatgagtggcatacacggcaactttttatgcctacttcttcttcaggattatccgcggtttgtaggacccacgccaaccaaatatatacacctcgtgctccctagcctttatttcccattccaatctatgagtgtccgtctcctcgttcaggtaaccctgatcaacggtcagcgaaagggtaaggtgaatattattcgactgttacatgagttaaccagttgaacagtacgtttacaaggatgattctctgagcttggatgacaacccagccaataatatacaagaccctcgtgttcccttgtttgattttccatccagatgtaggtttcctcttgcgttgcatgtaaccctcaccatgggaggggaatgatcatgtaaatttattttccgtcatcacagagaaaagaaactgtgctcgtgtttaaaaaaaaaaaaatgctacggtcaccaaagagtgagctttggctcacgctcttgcgtggtaaaaaaaaaaaaaaaaaaaaaaaaacaaaaataaa

SEQ ID NO: 33266 - DNA, 442 bp, Triticum aestivum
  Clone ID: PAT_TA_33266
atgatgaggacacggacgacgacgacgacgacgacgaggaaggcgacagggaggaggatgaggagggcgtgacatcagacggagattcgggcgatggagaagacgacgaggggggcggcggcgccgaagacatggacgacgacgacgattgatcgtagcggcctcatagcaccccttaccagttacctcaaacaagggtgggcgtccttttgaccccacagcattagctttcttgtacataggcactctccagtccaggatagttgagtggtggtgatagtggtgttggtgtaaatgtttgctgggggtaaaatgcattcatctgatactatggtttatatccctgtttttggccaaagaaagaaagaagacgacgatgagatcgagcggtttcgcgcgcttttcgaaacgcgcccgcccggtctcgttcgattcgcatgac

SEQ ID NO: 33267 - DNA, 356 bp, Triticum aestivum
  Clone ID: PAT_TA_33267
taccggtccggaatttcgggtcgacccacgcgtccgcggacgcgtgggagaggatgaggggaatttccagaatccacgaaggcgacgggctttcccaccttctggcaacaggagtgctacgtaccattagttagttgagagatgtactatccgaccgaggcattgtatttgtaacctaaagagtacagggggaagtggaacaacgcgcatgatttggcattcgtcggtaagtcattggaaatgctcttatgtgagatactatggaggcctgcttgatgaccaacacaaaagtgatcgcctccaaccttcttctggttgtttgattaacacacaagaaaaattctcattgaaacaaa

SEQ ID NO: 33268 - DNA, 569 bp, Triticum aestivum
  Clone ID: PAT_TA_33268
ctaggcgcgagaagcaggttataaggggagccagagaggtgagggaggtgaccaaagcggcagcggccttggggtgccgaagaagagtgcgcgggaggatggaaaggggctcgtatacgacggctggaagagtggttgtgcagaaggaagatgttggttgaatgagtcccttggagcctagcggtgctgctcagccctgtacatgccattgcccgcctctgtgagtaactgggatcctcacgctaccaatttggtcatccctgggaaacatcaagcagatcatgagactgcatcttgagaagaagcattatttacaactcagtattatgtcatgcatggaagaagcactcgaccttattactaactacttcctctgtacacaaatatatgacgtcttagactgaacatacaagcctctaaaacgacttatatttatgtacagagagagtaataacatgtaaacaggtgtgttgcgttcctattctgatcgtggatttcaagcatactgctaacaaatgttggagagcgtggcaagtttcatctaattcaatactgaatttctggccttc

SEQ ID NO: 33269 - DNA, 680 bp, Triticum aestivum
  Clone ID: PAT_TA_33269
ccacgcgtccggtaacattgagtccatgcaaggtattgtctcaattggagtgacagctgcaaaggtgcttgttgaagatatatcccatgaataccgccgtaggaggaaagaagagactgatgtagctcgaagtaggatagaaacatatgtaaggtcttcactccgtacagcttttgctcaaagaatggaagaagcagattcaaagcgatcatcgaggaaccctaccccagttatgtctatccttgcaaaggacattggtgacctagcaattaaggagaaaaatctgtacagtccaatattgaagacatggcatcccctcgcttcaggtgttgctgttgcaacccttcattcatgttatggaagtgagctgaagcagttcatagctgggcttacagagttaaccccggagacagttcaagtgctcaagtctgcagacaaattagaaaaggatcttgttaatattgctgtcgaagattctgtggatagtgatgatggaggcaagtcattaatcagagagatgccaccatatgaagctgaaaatgcaattgctaatcttgtgaaagtgtggataaaagaaagggtggatagactcaagggatgggttgaccggaatctgaagcaagagacatggagtccaggtgccaacagagataactttgcttcctcgtctgtggagatgc

SEQ ID NO: 33270 - DNA, 573 bp, Triticum aestivum
  Clone ID: PAT_TA_33270
gaattcggcgtccgctcccgcgtaccaagccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctcgtctccgtaagctgactaatccattctattgccgtccatggccgtttactccactccagtccagctagctagagtgacaggcgtgggtgcagggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccagaagaacgagcc

SEQ ID NO: 33271 - DNA, 616 bp, Triticum aestivum
  Clone ID: PAT_TA_33271
gatactaattcatgaagagtgttatcctatggaccatttgtttcatcttgcttgcaaagctgaacaggaaataaaacgacgtgttggccacgaggagaacaagcgcacggtgcacattccaagagttgatatgattgtaaatcatcaaagcgatactatgacaaccacatccgttgttgtcaggactacatcacctccaccatgtgacacatcgcccccgagagtggctacatcatctgagttgatcataagaggtaatgacaaaggtactgatcttccatctctacatgagaatgatgaatgccttgtcaatttgaatgcaccatctgatgagctacccactactttgatcacaccacctattttagaggactacgttgataatttgactttgccatgtgatcaaacaactgaaataccaacaattttgagtgcacccattgaattaactattgatgcaaaagaaccaatgtttaatcattttgatatgacctctaatcttggtgatgattctgtgttgaatgacttattgcatgtttgcttatttaagcatgttgtagcatgtaaatttgatgcaagtaaggtttattcaccaatgttgggatggtttaatgat

SEQ ID NO: 33272 - DNA, 1274 bp, Triticum aestivum
  unsure (1)..(1274): unsure at all n locations
  Clone ID: PAT_TA_33272
ccacgcgtccgcaccacgtccgggtccagggcattcagagccgagatggcgtccgcgtcgccgtcgtgggtcatcctgggccgcgtggccaaggtgtcggccgccgacgccgatcttcctccgggcgccgacctctccctcgcgctgccgccgccgccgcgcgtcgcgctcctcaccatccccccgcgcatcttcccgggccaaaccacctccgacaacttcccctccgtcctcgccgtcgaccgctccggcctcctcctcctccacgcctcccagggccccgccgcgggccccgccatcgtcgacctccccggccgccaggaggtctgctggcgcccattcgtcgcgggctacttcgtcctcgactccaaatccgcctcggccttcccgctccccaaccccgagcgcatcatgaacccgggccgcctcggcctcatcgcctcccccgagggcgcaggccgctacatggtcgctgagctccagccggtcgccggcggcgagcaggccgacctcctctgcttctcgtcgcaatccgggcagtgggacaggaagaccgtcgcctacccgcttccatcccgccccttgacccccaacggcgtggtctcgcactccgggaggctctggtgggtcgacctctcctggggcctcatcacctgcgaccccttcgcggacgcgcctgtgctgagcttcgtcccactcccgccgcgcaaggcgctcaagtacatggaagattgtgcagtgctcgacaagtaccgccgcgtggctgtcagccgcggcaagctgcggttcgtggacatgtacaagaaccgtagcagcttcggctctgcacagatcagcgtgtggacgctcgccgatccggactccaccgagtggacgctgcagtatgaagcgaccttttcggagatctttaatgatgcgagcttcaaggcgactcgtctgacaaggcagctcccggtgctcgcgctcatccatcccaaggacccgacgtggtctacttcttcctggacangcacctgttcagcgtcgactgcctgaccgcaaggtcctgcaatgcgactctacaactggtcgaggactatccaacgaaccatcgcaaccgtttcgtcangcntggagntgcaacggctctccgctcangtaatatacgttgccccttgtaatctgtacaattgnaagtacggaatgggtgttcgttaactgcanaattaatgcactgggtgaaanaacgattatcaaatatataatgggaaaagatcaagtgaattngcgttatt

SEQ ID NO: 33273 - DNA, 513 bp, Triticum aestivum
  Clone ID: PAT_TA_33273
ggagcaaaggaaggagcacgtcagcgaggtaaccatccgtatcagcaaccggcagctgcaggagctggtggacaagagggccgccgacgacgggcacggtcacatctggaagagcgggcggtcggcgtcggagcttctggtcgacatcatgaacgccggggaggtccaccaccacgtcgagcactgcagggcggcgcactggaagcccgccctgcagagcatcccggaggcggtggagtcgtgacgctacgcccagtgacgcgtcccggccatggctttcgccgggcttgggtttctcctctctttcttggttgcttctccgccgtgtcttttgttagaacacagcttttacgcggcctttctgtgtcattctttggtttggatccaacgaacaatgtatattggtagggaaagtggtgatacacaccacggtgatgtaaattgtaaagtagatcgatgttcttctgtccatacggctttttgtgtgtggaacaaaccaagcattctcagttg

SEQ ID NO: 33274 - DNA, 764 bp, Triticum aestivum
  unsure (1)..(764): unsure at all n locations
  Clone ID: PAT_TA_33274
atctctctctctaatccgaaaccagaggcagcgccggaagcagcagcggcagtagctagcgacacacaacaactacagcaagcacacgggaggaggaagaagaaggctctgcagttctacacttctacttctgcacgcatggggaactgcgccatcacgcaccaggccacctcgtgggcggacgacggcgagtgggagctgccgtcgcccggcgacgaggacgaggggcaagcggagcagaggaaggagcacgtcagcgaggtgaccatcaggatcagcaagcggcagctgcaggagctggtggacaagagggccgacgacggcgtctggaagggccggcggtcggcgtcggagcttctgacggacatcatgaacgccggggaggtgcaccaccacgtcgaccactgcagggcggcgcactggaagcccgctctgcagagcatcccggaggcggtggagtcgtgacgctacgcccagtgacgcgtcccggccatggctttcgatcgccgggtttgggcttctcgtctccttcttggttgcttcttcgccgtgtcgacctttggtagaacacacagcttttatgcggcctttttgtgttattattctttggtttggatccaacgaacaatgtatatagtagggaaagtggtgatgtaaattgtaaagtagatcaatgttctcctgtccatacggctttttgtgtgtgggacaaaccaagcattctcagccgatctgctgctttggccgcgcaaacaanattttca

SEQ ID NO: 33275 - DNA, 835 bp, Triticum aestivum
  Clone ID: PAT_TA_33275
tctacacttttcaacccaagttacattgtaccatatgccagtttgtttcatacctcgtccatcctggatttttagacgcaaagcatctggattttaaaacaagaaataacatgtctttaacaaaattattcactcaaagaccatgcccaagattggatctctcatctttacagtaaatttggacagcagggatctctcatctttacagtaaatttggatagcagggatgttcagtagaaacgctataatagcatggaggcattgtttctgaactcgagcacacatgtgctctttatctgggcggttcgtcatagcgttgggatgcggtgcatttactttctgtgtcaggctgttgttcactggaaaagggggaaatgcagaaatacggccgacgggtatcttgtatggtgggccaggtttgtggtggaggagcacctcctttaacgattcaaaacagggccgtggctcatgccgtcattcccgtcctgatccgtggctcgtttagacctcagtagccgagtaaatggagggatgggttgctgggcagagttctctcctacctccggctcctggtttttcctattatcgagtgaggctagatgggcggcggagcttctattcgaaggaaacaaaggctagcgcagaagatggaatttctgatgcaatcgattaaaagaaccaccgtgctggaggacgttaacgatggcaacgtactcatggagccactacactgccagtggtcgcaaccgttgcagacccgctgccgcccatggcggcagtgagtgcggaaggccagatctgtgcggctgatggcatggtcgatactgaaatcgat

SEQ ID NO: 33276 - DNA, 712 bp, Triticum aestivum
  Clone ID: PAT_TA_33276
ccacgcgtccgcccacgcgtccgcggacgcgtgggtcttcttcaacccgtcctccggactcgaggaatcctcctccacgatggcaactcctccgccctcctcctataagaacctcctcctcgcgcgagccacctgatttgctgagatcgcggtaacacgcaagtgcggcgcggagctcgctcaaggtcgatgcgccccgtggtggtggcgttcgaggcgggtcggcccgaggttcaacaatttctcgatctccggggttcaacaatttcttgccggatccgctcgtcggcatccgtggactgcatgagccggatgtctcctgtgccctagcagtggtcactcgatctccctctcccgaacgaccccgacagtaggtgcatgagcccatggccggttgcaccggcgatggggttggagcgcataatagtgacatcaacctgactgctggctgttaagcatcttctttgacgtccatactaccacatatcttatttagtttgaccttctgtgaggatgagggcttcgtgtctcacatgatagtgttctctaccaatcttacgaggctaccacaatcataagccatcatgttcattagggaaataaaggttcaggaaaagaagatggtttggggaaacacaaatatgctgggggcatagtaaagctgcagatctaaatgcatggacaatatctcctgcagttttgattattttta

SEQ ID NO: 33277 - DNA, 1432 bp, Triticum aestivum
  Clone ID: PAT_TA_33277
ccacgcgtccgacccacgcgtccgaaaaagagggtgtcatgctgattaagaaaactgcagaaaatattgacgaggctgcaaaagaacttccagatgctaatttgaggccggaggacttatgggccaaccactcaaaagtagttttaccgaagccacatatgaaggattctgcgtcatggagagccgtccaaaaagttcgtgagggtggagaaaacattgatctgaaacatttcaggcctgtaaaacctttggggtctggtgatactggaagcgtgcacttggtggagttgctaaacacaggtgaatactttgccatgaaagcgatggataaaaatgtcatgcttaatcgcaataaggtccatagagctactgctgaacgacagatccttgatatgttggaccacccgttccttccaacattgtatgcatcatttcagacaaagacacatatatgtctcattacagattactaccctggtggggagctctttctgctcctagataggcaacctctgaaggttttgcgggaagatgcagtcagtttctatgcagctgaagttgtcattgcacttgaatacttgcattgtcaaggtataatctaccgagacttgaagccagcgaatatcttacttcatagagacgggcacatatccctgacagactttgatttatcttgcctgacatcttgcagaccgcaggtctttcttccagaagaaggtaataagaaaagcaggaggaaaagcaggagttcacccatattttttgcggaacctatgcgagcatccaattcatttgttggtacagaggagtacatcgcacctgagattattactggagctggccatacaagtgctgttgattggtgggcgctagggattcttctgtatgaaatgctgtatggctacacacccttcagaggtaaaaccaggcaaaggacctttgccaacatcctacacaaggacatcagattccccgcgagtatatcggtgagcctcccagcgaggcagctgatctacaggttgctgcacagggatcctgcgaatagaatgggatcgtatgagggatcgaatgagataaaacaacacccgttcttccgcggcatcaactgggcccttgtgcggggcacggctcctccaaagatggacgctccactgttgtcggacgacgtggacaagggattgggcgacgctgctgccgccgctgataattacaccgacatgttctgaacgaagaaggtggatggacagacagagatgccaaagatgtatcctggccgtgctagctcaatcatgcgtgtttcgtttgctgttgctggctgtttttgctgttcgtacctcggccgcgaccacgctaatggaataagcgctggagttgttgagcgcaatgtagtagtcctgtatcgggatagtattaataagcaattaaggtgcgt

SEQ ID NO: 33278 - DNA, 913 bp, Triticum aestivum
  Clone ID: PAT_TA_33278
ccactccgcagccagactttttcctccccaccatcccgtacctttcctcttccttcccgatccacccacgcgtccgcgctgctctcatactctgacctacccaagctccattccagttccaatccaaacccaacgagtttctaaaatcttctcccgtactccaccgccgccgtgccctagagctgccgccgtgccgagctaagcttcaccgccggcgcctcacaccccccaactccttcgcctctcacgcgcttcgcctccatcgccgtcctcgttctaccccatcgcgtcgccgctgactccacccccgcctgcatattggacatcggtttttgagatccgccctggcctcctcggcggccgagaggagccgctccgggctcgggtcaggtttccggtacctcaccggagccgccaccgggtggtgggaccggtggatggtcatgggagccagcggctccaagctcgagaaggccctcggcgaccagttccctgaaggcgagcgctacttcggcctcgagaacttcggcaacacctgctactgcaacagtgtactccaggcactttatttttgcactccattcagggagcagctactggaatattatatgaataataaaaatccgggagatgcagaggaaaatcttttgacttgtttggcagatcttttcatgcaggtaagtcaatcaaagaaaaagacaggcgttattgctccaaaacgttttgtccaaagagtgaagaaacaaaatgaattatttcgcagctacatgcaccaggtaactcgacacttcttatagcagtacatggtcagtggttgtgccatgatatcctcatgatgatcttattgatgcaacttaaggcagcctttgtaaatatacagtggctaaatgttgcagtgacttatccaagtgat

SEQ ID NO: 33279 - DNA, 601 bp, Triticum aestivum
  Clone ID: PAT_TA_33279
ttcggcacgagggtcgagtatggcctccgaggcggcgaaggtgccggtgccggagtcggtgaacttcaagaggtctgggccgccgcgaagaagcagaaggtcgccgacgagaagaagaaggacgcggagaacaccaaggtcatctacgcccgcgccaaggagtacgccggggagtatgaggctcaggacaaggagctggtgcaacttaagcgtgaggcccggatgaagggtgggttctatgtcagtcctgaggcaaagctgctgtttgtcgtccgtatccgtggtatcaatgctatgcacccaaagaccaagaagatcttgcagcttttgcgtttgaggcagatttttaatggtgtgttccttaaggtcaacaaggccaccattaacatgctgcgtcgggttgagccatatgttgcttacgggtaccctaacctcaagagtgtcagggagctgatctacaagagaggttacggaaagctcaacaagcaaaggatccctctgaccaacaacaaagtcatcgaggagggtttggggaagcacaacatcatctgcattgaggaccttgtgcatgagatcttgaccgtcggcccacacttcaagg

SEQ ID NO: 33280 - DNA, 834 bp, Triticum aestivum
  unsure (1)..(834): unsure at all n locations
  Clone ID: PAT_TA_33280
ctctctccctctctctcgcctcctccctccccctgcaggaagctcgtcgagatgtcgtccgaggcggcgaaggtggtggtgccggagtcggtgctcctcaagaggaagcgggaggagctctgggccgccgagaagaagaccaaggccgtcgaggagaagaagaaatccagcgagaacgtcaaggtcatctacgcccgcgccaagcagtacgccgaggagtacgatgcccaggacaaggagttggttcagcttaagcgtgaggcccggatgaagggtgggttctatgtcagtcctgaggctaagctgctgtttgttgtcagaatcagaggtatcaatgccatgcacccaaagaccaagaagatcttgcagctgttgcgtttgagacagatattcaatggagtgttcctgaaggttaacaaggccaccatcaacatgctccgcagggtcgagccatatgttgcatatgggtacccgaacctgaagagtgtgagggagttgatctacaaaagaagttatggcaagctcaacaagcaaaggattccttngaccaacaacaaggtcatcgaggagggtctgggaaagcacaacatcatctgcattgaagaccttgtgcatgagatctttgaccgtcgtccttactttcaggaggccaacaactttctgtgggccttaaagctgaaagcgccgcttggaggcttcaaaaagaagaagaaccccttcggtcagggtggggacccggcgaaccgcagaaactcataaaccaatcgttagggaggagaaaacagggggcaatccgagaacccttgttttttggaaaagttttgttgtaaaccc

SEQ ID NO: 33281 - DNA, 866 bp, Triticum aestivum
  Clone ID: PAT_TA_33281
ctcgccgtctcctctcccacgaagcgcagctcgtcgagatggcctccgaggcggcgaaggtgccggtgccggagtcggtgaacttcaagaggaagaggggagaggtctgggccgccgcgaagaagcagaaggtcgccgacgagaagaagaaggacgcggagaacaccaaggtcatctacgcccgcgccaagcagtacgccggggagtatgaggctcaggacaaggagctggtgcaacttaagcgtgaggcccggatgaagggtgggttctatgtcagtcctgaggcaaagctgctgtttgtcgtccgtatccgtggtatcaatgctatgcacccaaagaccaagaagatcttgcagcttttgcgtttgaggcagatttttaatggtgtgttccttaaggtcaacaaggccaccattaacatgctgcgtcgggttgagccatatgttgcttacgggtaccctaacctcaagagtgtcagggagctgatctacaagagaggttacggaaagctcaacaagcaaaggattcctctgaccaacaacaaagtcattgaggagggtttggggaagcacaacatcatctgcatcgaggaccctgtgcatgagatcttgaccgttggcccacacttcaaagaggcgaacaacttccttgggccattcaagcttaaagcacaactcggtggccctgaaaaaaagaaggaacccttaccttgagggtggtgacccttgtaaccgggaaaactacattaacccacttggtagaagggattaactagggtggaggagctccttgataataccttgggtggaaagaataaactggttcacctttaggaaccggtggatgaatatgcctgcgttttttgt

SEQ ID NO: 33282 - DNA, 918 bp, Triticum aestivum
  Clone ID: PAT_TA_33282
ggccaccagaattttcctgacgccgtcgttgctcccacttccacttcccaagtggctgcgtaggcggcggccaagcatcggcccagcgaggagagccttcgcgatggcggcgtctggattcggaggcggcgaggcgttccggctgtcggctgcgtcgggggccggcgcgctgaagctgcacaagggcgacatcaccctctggtccgtcgacggcgccaccgacaccatcgtcagtgctgctaatgaacgaatgctaggagggggaggtgttgatggagctatacatcaagctgctggaccacagcttgttctagcatgccgtgaagttccagaggttaaacctggagtccgttgctctactggagaagctagaattactccagcttttgagcttcctgtgtcccgtgtgatccatacagttgggcccatatatgatatggacaggaagcctgaggtatcactaaagaatgcatacgaaaatagcttaaaggttgctaaagagaatggcattcagtacgttgcattccctgctatatcttgtggtattttccgttaccctccaaaggaagcatcaaacatagctatttcagctgctcaacaaatttcaggggatattaaagaggtgcattttgttttgttctcggatgagctctacaacgtttggcgtgagactgcccaggagatgctgacgcaatttgagaaataaataactatgatatcagtgtagtatgcgcatgttagccagcgtctaatatgaccactagagtctgttgcccatgatcgtatgtatggcccagtttgaatgtgtttatttgaaagatagttagatggatatgccggatgagtgccctgaataatattttcccgttctttatgcttcattttcatatctataagatggccggcaagtgccagccc

SEQ ID NO: 33283 - DNA, 901 bp, Triticum aestivum
  Clone ID: PAT_TA_33283
gatgtcgtcgcgtgcggccaccagaattttcctgacgccgtcgttgctcccactcccacttcccaagtgactgcgtacgcggcggccaagcatctgcccagcgggaagagccttcgcgatggcggcgtctggattcggaggcggcgaggcgttccggctgtcggctgcggcgggggccggcgcgctgaagctgcacaagggcgacatcaccctatggtccgtcgacggcgccaccgacgccatcgtcaatgctgctaatgaacgaatgctaggagggggaggtgttgatggagctatacatcaagctgctggaccacagcttgtgcaagcatgccgtgaagttccagaggttaaacctggagtccgttgccctactggagaagctagaattactccagcttttgagcttcccgtgtcccgtgtgatccatacagttgggcccatatatgatatggacaggaagcctgaggtgtcactaaagaatgcatacgaaaatagcttaaaggttgctaaagagaatggcattcagtacgttgcattccctgctatatcttgtggtattttccgttaccctccaaaggaagcatcaaatatagctatttcagctgctcaacaattttcagcggatattaaagaggtgcattttgttctgttctcggatgagctctacaaagtttggcgtgagactgcccaggagatgctgacgcagtttgagaaatgaataactatgatatcagtgtagtatgcgcatgttagccagcatccaatatgaccactagagtctgttgaccatgatcgtatgtatggcgcagtttgaatgtgtttatctgaaagatagttggatggatatgccggatgagtgccctgaataatatttcaccgttctttatgtttcacaaaa

SEQ ID NO: 33284 - DNA, 1000 bp, Triticum aestivum
  Clone ID: PAT_TA_33284
ctccagcgacactcacgctcgctccccacgaatgtcgcgtgcggccaccagaatattcccgacgccgtcgttgctcccacttccactttccaagtggctgcgtaggcggcggccaagcatctgcccagcgaggagaaccttcgcgatggcggcgtccggattcggaggcggcgaggcgttccggctgtcggctgcggcgggggccggcgcgctgaagctgcacaagggcgacatcaccctctggtccgtcgacggcgccaccgacgctatcgtcaatgctgctaatgaacgaatgctaggagggggaggtgttgatggagctatacatcaagctgctggaccacagcttgtacaagcatgccgtgaagttccagaggttaaacctggagtccgttgccctactggagaagctagaattactccagcttttgagcttcccgtgtcctgtgtgatccatacagttgggcccatatatgatatggacaggaagcctgaggtgtcactaaagaatgcatacgaaaatagcttaaaggttgctaaagagaatggcattcagtacgttgcattccctgctatatcttgtggtattttccgttaccctccaaaggaagcatcaaacatagctatttcagctgctcaacaattttcaggggatattaaagaggtgcattttgttctgttctcggatgagctctacaacgtttggcgttgggactgcccaggagatgctgacgcaatttgagaaatgaataactatgatatcagtgtagtatgcgcatgttagccagcgtctaatatgaccactagagtctgttgaccatgatcgtatgtatggcgcagtttgaatgtgtttatctgaaagatagttggatggatatgccggatgagtgccctaatattttaccgttctttatgcttcattttcatatctataagatggccggcaagtgacagcacatttactacttattaaaaaaaaaaaaaaaaaactcgaactgtt

SEQ ID NO: 33285 - DNA, 1119 bp, Triticum aestivum
  Clone ID: PAT_TA_33285
cgtccggctctctctccctctctctcgcctactccctccccctgcaggaagctcgtcgagatgtcgtccgaggcggcgaaggtggtggtgccggagtcggtgctcctcaagaggaagcgggaggagctctgggccgccgagaagaagaccaaggccgtcgaggagaagaagaaatccagcgagaacgtcaaggtcatctacgcccgcgccaagcagtacgccgaggagtacgatgcccaggacaaggagttggttcagcttaagcgtgaggcccggatgaagggtgggttctatgtcagtcctgaggctaagctgctgtttgttgtcagaatcagaggtatcaatgccatgcacccaaagaccaagaagatcttgcagctgttgcgtttgagacagatattcaatggagtgttcctgaaggttaacaaggccaccatcaacatgctccgcagggtcgagccatatgttgcatatgggtacccgaacctgaagagtgtgagggagttgatctacaaaagaggttatggcaagctcaacaagcaaaggattcctttgaccaacaacaaggtcatcgaggagggtcttggaaagcacaacatcatctgcattgaggaccttgtgcatgagatcttgaccgtcggtcctcacttcaaggaggccaacaacttcctgtggcccttcaagctgaaggcgccgctgggaggcctcaagaagaagaggaaccactacgtcgagggtggcgacgccggcaaccgcgagaactacatcaaccagctcgtcaggaggatgaactaggttgatcatcgatgatctcttgtattcggaagatgttttgtttgttaagcctgctttacattaggaagtggatggtggatgcagttttgatatttcggaaccatgatatgcatgtttggaagaatctgactctgtatgtggaggttttgagaccgtgtttaatgcctcctgctatgtgcctagaatacgtttctcgttgctgtctacatagtatgtggggctttgtaatttttactttgaacttgctggttctgcgtaaatttttctgttgtttagagcaactccaaaggggtgacacagcgacccatttctaaaaaaaaaaaa

SEQ ID NO: 33286 - DNA, 1036 bp, Triticum aestivum
  unsure (1)..(1036): unsure at all n locations
  Clone ID: PAT_TA_33286
cccacgaagcgcagcccgtcgagatggcctccgaggcggcgaaggtggcggtgcccgagaaggtgatcctaaagaggaggagggaagaggtctgggccgccgagaagaagcagaaggttgccgccgagaagataaaggccgccgagaacaccaaggtcatctacgcccgcgcggagcagtacgccggggagtatgaggcccaggacaaggagctggtgcaacttaagcgtgaggcccggatgaagggtgggttctatgtcagtcctgaggcaaagctgctgtttgtcgtccgtatccgtggtatcaatgcaatgcacccaaagaccaagaagatcttgcagcttttgcgtttgaggcagatttttaatggtgtgttccttaaggtcaacaaggccaccattaacatgctgcgtcgggttgagccatatgttgcctacgggtaccctaacctcaagagtgtcagggagctgatctacaagagaggttacggaaagctcaacaagcaaaggatccctctggccaacaacaaagtcatcgaggagggtttggggaagcacaacatcatctgcattgaggaccttgtgcacgagatcttgaccgtcggcccacactttaaggaggcgaacaacttcctgtggccattcaagctcaaggctccgctcggtggcctgaagaagaagaggaaccactacgtcgagggtggtgacgctgggaaccgtgagaactacatcaaccagcttgttagaaggatgaactaggttgaatgagctacttgatgataatagcctgtgttggaaggataaacttgttttcacattaggaagtggatgatgagtatgcatgcgttttttgtattcagaactagacatgtttggatgaaatctcacatttcctctagagggttcgattcattattaatgcttttactgtgggtcgcaaacgtgcttttgtttctgttatcaaggatatactatttgtattatgatagtcggttacacattctgcccggctgcctttgccatatttnagctataga

SEQ ID NO: 33287 - DNA, 1865 bp, Triticum aestivum
  unsure (1)..(1865): unsure at all n locations
  Clone ID: PAT_TA_33287
gtgattgctgactatggtgttccacttatggtgatactgtggaccgcgttgtcatattcgttgcccaccaagataccttcaggtgttcctaggaggctgttcaccccacttccttgggaacccaagtcactgcaacattggacggtagccaaggagttattttctgtccctctagcctacatacttttggcaattgtgcctgctgtgatggttgcggggctctatttctttgaccatagtgtagcctcacagatggctcagcagaaagagttcaatttgaaaaacccatcagcataccattacgacattttggtcctgagcttttcggtgctgatttgtggccttcttggcattcctccatctaatggagtccttccccaggcccccatgcacacgcgaagtcttgctgtcctcaggaggcaggcgctccgcaaacagatggtccgaaccgccaaggaaggcatgatgaacaatgctagcagctcagaagtttacggcaagatgcaagaagttttcattaaaatggacgacaaaggcaacgaggattctgctcacaaagagctcaaggaattgaaagacgccgttatcacagagggggaaaaaatcacagaggggaatggggcagtgactgcgcctgaggtatttgaccctgaaaaacatctggaagcttacttgcctgtacgggtgaatgagcagagagtaagcaatctgcttcagtccctgctggtcgcgggttgcattggagttgtgccggtcattcagaagatacccacatcagtcctgtgggggtactttggctatatgtccatcgacagcctgcctgggaaccagttcggggagcgcttacaacttctgttcatcgcccctcggcggcgctacaaggttcttgaaggcgcccatgcgtccttcttggagtcggtgcctttcaaccagatattggccttcaccgttttccagctgatttatctgttgatcgtctgggggatgacatggataccggtggcgggaatcctgttcccgctcctcttcttcttcctcgtcatcatcagggagcatctgctcccgaaattctttgacacacgccacctgtgggagctggatgcgtccgagtacgaagaatgcgagggggtgcaccgtgatccatcgataccagagggcgatggcgaatccatcacacgaggcattgaagatccctctgaatatactgccgaggtgatggaggagttcacgactcaccgtggagaattgaagcacagggctccaagcttccgtgacgagcggctgatacggctgaactctgtccagatgacgagacagttctcccggatctcttcttttgctcctacacggccctgactacgagaggagattgttcaacaaagacctttttactggcatgaatctcctgacggagggtgcaaaaaatgcggcagctcgtaagtgaacgtacggatgattttttggggccgaagacacgtcgaggaaactgggcacagcaagtgccagtcgctgcaggggagaaatggggaatttgtgtgggtgcgcgagtgttgctacgtatgtggtgttgtgcataaggcaagaaatgggaggggataggggcagtctagttagggcatctccaacgggagacgcttatagagaaaaaaaatgctattaaattcgagaatacataagcgcttgacctcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaangggggggggcccgtttttaagggaccaaattttatgcccggggggggggaaggaaaaatttttttaatgggggccccaa

SEQ ID NO: 33288 - DNA, 1151 bp, Triticum aestivum
  Clone ID: PAT_TA_33288
cccacgcgtccgcccacgcgtccgcccacgcgtccgcccacgcgtccgcccacgcgtccgctccccataccctcgccgtctcctctcccacgaagcgcagctcgtcgagatggcctccgaggcggcgaaggtgccggtgccggagtcggtgaacttcaagaggaagaggggagaggtctgggccgccgcgaagaagcagaaggtcgccgacgagaagaagaaggacgcggagaacaccaaggtcatctacgcccgcgccaaggagtacgccggggagtatgaggctcaggacaaggagctggtgcaacttaagcgtgaggcccggatgaagggtgggttctatgtcagtcctgaggcaaagctgctgtttgtcgtccgtatccgtggtatcaatgctatgcacccaaagaccaagaagatcttgcagcttttgcgtttgaggcagatttttaatggtgtgttccttaaggtcaacaaggccaccattaacatgctgcgtcgggttgagccatatgttgcttacgggtaccctaacctcaagagtgtcagggagctgatctacaagagaggttacggaaagctcaacaagcaaaggatccctctgaccaacaacaaagtcatcgaggagggtttggggaagcacaacatcatctgcattgaggaccttgtgcatgagatcttgaccgtcggcccacacttcaaggaggctaacaacttcctgtggccattcaagctcaaggctccgctcggtggcctgaagaagaagaggaaccactacgtcgagggtggtgatgctggcaaccgcgagaactacatcaaccagctcgttagaaggatgaactaggttgaatgagcatgataatagcctgtgttggaaggataaacttgtttcacattaggaagcggatgatgaatatgcatgcgttttttgtatcgagaactagacatgtttggatgaaatcccacatttcctctagaaatactaagttttttagcttgtttttactgtggatcccaaaaatgcttttggtttccgtcctctactattttatttggtcttatattggccaagttccttgccatatttgggctataggcacgcaaatcttgtactacctccttcccaagatataaggtgtgctttgactttt

SEQ ID NO: 33289 - DNA, 1185 bp, Triticum aestivum
  Clone ID: PAT_TA_33289
tgcggccaccagaattttcctgacgccgtcgttgctcccacttccacttcccaagtggctgcgtaggcggcggccaagcatcggcccagcgaggagagccttcgcgatggcggcgtctggattcggaggcggcgaggcgttccggctgtcggctgcgtcgggggccggcgcgctgaagctgcacaagggcgacatcaccctctggtccggagtcggtgctcctcaagaggaagcgggaggagctctgggccgccgagaagaagaccaaggccgtcgaggagaagaagaaatccagcgagaacatcaaggtcatctacgcccgcgccaagcagtacgccgaggagtacgatgcccaggacaaggagttggttcagcttaagcgtgaggcccggatgaagggtgggttttatgtcagtcctgaggccaagctgctgtttgttgtcagaatcagaggtatcaatgccatgcacccaaagaccaagaagatcttgcagctgttgcgtttgaggcagatattcaatggagtgttcctgaaggttaacaaggccaccatcaacatgctccgcagggtcgagccatatgttgcatatgggtacccgaacctgaagagtgtgagggagttgatctacaagagaggttatggcaagctcaacaagcaaaggattcctctgaccaacaacaaggtcattgaggagggtcttggaaagcacaacatcatctgcattgaggaccttgtgcacgagatcttgaccgttggccctcacttcaaggaggccaacaacttcctgtggcccttcaagctgaaggcgccgctgggaggcctcaagaagaagaggaaccactacgtcgagggtggtgatgccggcaaccgtgagaactacatcaaccagctcgtcaggaggatgaactaggtttatcatcgatgatcccttgtattcggaagatgttttgtttgttaagcctgctttacattaggaagtggatggtggatgcagttttgatatttcggaaccatgacgcatgtttggaagaatctgactctgtatgtggaggttttgagaccgtgtttaatgcctcctgctatgtgtcgcgaatatgtttcttgttgctgtcaacctagtacttcatgtggggctttgtaattttttcttcttacttaaaaaaaaaaaaaaaaaaaaaaaaaaa

SEQ ID NO: 33290 - DNA, 1066 bp, Triticum aestivum
  Clone ID: PAT_TA_33290
tcgagcggccgcccgggcaggtgtctcgcctcctcctcccccctgcaggaagctcgtcgggatgtcgtccgaggcggcgaaggtggtggtgccggagtcggtgctcctcaagaggaagcgggaggagctctgggccgccgagaagaagaccaaggccgtcgaggagaagaagaagtccagcgagaacgtcaaggtcatctacgcccgcgccaagcagtacgccgaggagtacgatgcccaggacaaggagttggttcagcttaagcgtgaggcccggatgaagggtgggttctatgtcagtcctgaggctaagctgctgtttgttgtcagaatcagaggtatcaatgccatgcacccaaagaccaagaagatcttgcagctgttgcgtttgagacagatattcaatggagtgttcctgaaggttaacaaggccaccatcaacatgctccgcagggtcgagccatatgttgcatatgggtacccgaacctgaagagtgtgagggagttgatctacaaaagaggttatggaaagctcaacaagcaaaggattcctctgaccaacaacaaggtcatcgaggagggtcttggaaagcacaacatcatctgcattgaggaccttgtccacgagatcctgaccgttggccctcacttcaaggaggccaacaacttcctgtggccattcaagctgaaggcgccgctgggaggcctcaagaagaagaggaaccactacgtcgagggcggtgatgccggcaaccgcgagaactacatcaaccagctcgtcaggaggatgaactaggttgatcatcgatgatcccccttgtattcggaagatgttttgtttgttaagcctgctttacattaggaagtggatggtggatgcagttttgatatttcggaaccatgatgcatgtttttggaagaatgtgactatgtatgtggaggttttgagaccgtgtttaatgcctcttgctgtgttccgcgaatacgtttcttattgttgtcagcctagcacttcatgtggtgtaatttttttcttctagcttgttagttctgcgtaaaaaaaaaa

SEQ ID NO: 33291 - DNA, 441 bp, Triticum aestivum
  unsure (1)..(441): unsure at all n locations
  Clone ID: PAT_TA_33291
agcaccaagatgacttgcgagggaagaaaaaaaaaatccnccatgtcttgtgtgcaaggggaaaagcccccgtggaccgctccaatggggagctcaaggtgtttgcaaggagccaagtttgttactgatcagcttctcaagtatattgcagaaaagatcgccgtctcttaagagcctcagccttgactattgcaatgtcaccaacgaagcattcactgagctgataatcaaagcttcctctgctcgaaagaacttctcatttccctatgtccatttgttgatggtgacgcatatgaaggtcaccagcagagcatgtgcgcagctgaagcgtctcatgtttgcgcgaggagggcctttgggtgggtgagaaaaagcaggggcactttgggtgatggaaaatcagtcaccaaacccgcgagtcactagtaatatcacgacaga

SEQ ID NO: 33292 - DNA, 414 bp, Triticum aestivum
  unsure (1)..(414): unsure at all n locations
  Clone ID: PAT_TA_33292
ccggcgcggcgcgtccgaggcgccgcgctccggtgaacacagccactgactaggccgtggccgaggtgtttcgccatcgtttcacctctgccgccggccgcccttccccacggcgtccgaggaggtcaaggacggggtcctgagttcgagctcgaccatcacacacacactcacaaggccacagctggcgttggctccgtctacaggtagcatctcacctccccctttcacattgctgacttctaattattccctacatcatgataaccctccttttgattttttttgtttgatgccaatccaacaaaatacgaatgatacccttttgtgcttgtgcatacgccctttgtccacttctcaagtcctttttccaaaacggcaatgttaagtccaagagaagnacaacanantttg

SEQ ID NO: 33293 - DNA, 959 bp, Triticum aestivum
  unsure (1)..(959): unsure at all n locations
  Clone ID: PAT_TA_33293
ctgcgcgtccggcttggcgtctgcccccctccccccctttccaatcgatccgcttcccctttcccgaatcgccaaatccgctcgccgccgtcgccgtaaaaaccctctccccgcctccgctaaccccaccgccgcggagagatggtgctgcctgcgctgccgcccctgaccgccgattccctcggagtccgccgccatcaccgcctaccgccccgggctccgcgccgcctcctccggcccgacccgcccaggctccgccatctcggctacaggccaccacgttctacatgagacggcctagtctcagtgcccaagaatattcaacggagggatttggaggttggacggaacgtcggaaacgggacccttcgctggctcgaccgcatgaagccctcggcacagctccgcccccaccctccacgcccgccaggttcccccccggagcaactcaggcacctttggaccatgaataaggacgcacggagctaagaagcatgcgtcaaacgcccccgaggaactcagtcgcgcggccctacgctgtcctcccccccttgaagctccggcccaagttcttcgcgaagcaaccactgcaggcgcctctccagctcgccgttcccgtccgtcaccgccaggggggaaggtcatgatggacggcgtcttccggaagcacatcgcccagctaatggtgtaagggatgtctgtaggtagccgttctgctttctgtgactctgaataatgtctactcgactggaatttggactggagcacaacctatcactagccctgtaataatggtagagtgctgaacataatcgctgttgctccgcctgtattggtgcagtactgaacttctaccctgttactacgcctgttttgtggccaataaaaacatgtgaccaagcagactggggcacagancaanttctgaacaacnncnacaaagacacacacaaaccacg

SEQ ID NO: 33294 - DNA, 836 bp, Triticum aestivum
  Clone ID: PAT_TA_33294
cgtccgcggacgcgtggggtctcgccatcgtccgattccctcgccgccgcgccgccgccgccgccatgctccgcctccggagctgcgttctctcccatctcctctcctctcccgccacctccccgctcccctctctccaccgcctcctctcaagcgccgccgcgcccacgtctcccccagctccggcttctaagtggaggagtacctcgtctccacctgcgggctcacccgagcgcaggccctcaaggcctcccccaagctctcccacctgaggtccccatccaagcccgacgccgtcctcgccttcttcgccggcctcggcatccccggcgccgacgtcgccgcggtagtcgccagggaccccaagttcctctgcgccagcgtggagagaaccctgtcccccatcgtcgccgggctcaccggcctcggactgtcgccttccgagatcgcgcgactcgtcccgctcaccgccaacaacaaccactcccgcaacaaatccgtcgtctccaaggtggactactacctgcgcctcttcggctccttggaggaattcctccgggcattcaagcataaccacaatctcctctcacacaacctcgagacggtggtcaagcggaatgtcgggttgctgcaggagtgcacgctaggtgcttgcgacattgccaagcttgccatctctatgccaaggatgctcaccgccaacgtggaacaaatccgggggatggtggccggtgctgagcgtctaggtgtgcctcgcggctctgggatgttccggcaagccatgcggagtgttgcgttcgacagcgaggacaagatcgccgccaaaatggaataca

SEQ ID NO: 33295 - DNA, 1238 bp, Triticum aestivum
  Clone ID: PAT_TA_33295
gaccccgcatgtgagaacctactggtaaacatgtgagatccacagcgaccgatctgcaagatgggtgatcttggcctatcaactgagaggcagcgtaccttggtctcaggtgctggcagccgaacttaaccggggcggccaccccaactctcttctggcacaaatgctttcttggtgtggcacggaattgtcttctgggatggatattgtccagtttgatctaccatctgagaagcgacccttcaccgtgagatctctacgaccgcggatttgctgggttgcaaatcttggccaatcacaggcgaagcagattactttgttgtatcggggtgttaagagggacctgatcagtggtgggtaccaagcttaagagaagcaagacgtaatagtccgtcggatgatagtgatgtctacggatttggcatagtgctaagcgagatatcttaaaggcgttccaccccatattatggataagcgcgcagcagaattaattggctgtgaccagaccacagctgttattcgccttaacgttccatatttatagcatctgtggaaacctttgaacgggaatagttgggcttgtgtaacatatataaggctatccctccctggactatctcaaaggttgcggaaaatggcaccggcaatgaatgttaaataaagggctctatttattacaacgcgaagaggcatgtaaggaatcccatgtccagttccctgactagaggaaggcaaacccggaatatatgttacatgtgtcttggcagcgtctcggtttatcctagttgaaatgagattttatgaaggccttccatgggaggagaaactcatcacggacggttctaaagcgtatttgatgtgagcctcccctgttccttcgacaaaattttgaagtggttctagcaaacgtgacttctccatttcctgcctgcaggagtcgtcagctgccgccgtttgccttcaagtacgatatatatattgcatctgtccattcctcatgacgggaactgttggggtttgtaatgtaaataaattttggcccgctccgtccggcgcatgttagatgttgcacgggactagacacggtgcaaagctggacgcagttatccctttttctttcatacgattgtgtcctgagaaaaagagggaacgaactctgaacaagagatatccttattcagattgtacatagttcacgaataagatttgcgggccgccttgaaaatgttctttcctgt

SEQ ID NO: 33296 - DNA, 619 bp, Triticum aestivum
  unsure (1)..(619): unsure at all n locations
  Clone ID: PAT_TA_33296
ttnggccacgcgtccggtatgttactagatcttaggattataattgtccatcaaattgcttctcgcggaagaatctcatcatcaaattgagagcttgttgtttactttttgggatcgggttccactatgaaaatataactgaagaagaaccaaaaatatcacatgctactgtgtttttctttcctgtgaagtggatcgttaatgctttgctcatattgctttaggaaaatggcgccaccaccaccaccaccatgtcgactgtgcaagtcaaggtgcgccagcagccttgcaactggcaagctgttcggcttctacttccagccgagttttcgtcatgcggcgatcgtcccatgcaatgtgaggttgaaattcaacaagctgacaggagacattgtgacatttgaggctcctgggggccatacacaatggaggtcgagaaaggacgcaatatgtcgcagattagaggagatggatgggcccatttcctcgcctgcatgcgtcttactggtggtgagttgatcagcttttcaaagcagaaagacccaagctggctgtcatttatatcaacctggtgggagatgatgaagatgacaaagatgatgaagatgatgaagataat

SEQ ID NO: 33297 - DNA, 1207 bp, Triticum aestivum
  unsure (1)..(1207): unsure at all n locations
  Clone ID: PAT_TA_33297
cccacgcgtccggttttgcagctagacctcctcaccagcttagatcgggagcggcggcgatgatgctgagggcgcggcgagcggcggggccgcttctccgcctcgccgacgcaggcgccgctggcgagaggatttgcggcggcgcgcagccctctcgcgcggtgttcacccgtggattcctggatttcttcaagacgtggagcaaggagaccgccgaggatgcggagaagaaggcaaaggcaaaggccaggcttactgatgagatgagcagggggtacttccaggacatctccgagatccgtaagaacgccggcaagattgcggtggcgagtaagaccattatcccagaggtcgctgctgtgaagttccctaatcttgctttggagtcccctgctggcagagcattgcaactgccgcttgttgcgtctcctatgctagacggtagtcatggggctggtggtacagtgccggtggttcctgatgcggtactggtgtgcctttcgtttcgtgcaagctcgcagaaaatggcagagtcgtggagtctaccttttcttgatgcatttggtgctactggaaaagttgaagcgtatgaggctgctagctgaaaggaaaacactatgttccaggtctcatttatagattcatggctgttatcatcaagtcccgtgaggcgtgcattcctgaagacgatgaggaaatcggacaatccacaaagacatgccgtctatgcctttggagaccactatgactttaggaaggagcttcaaattgtaaaccttcttaccgggtacatatacctgattgatcgcctgggtaggataagatggcagggctttggagctgcaacgcaggaagagttgtcatcgctaacagcgtgtgcctccatcttgttagatgagaaatgagattaaaaggctttttaaacattggccattttaggctggagaaattttgtttcgttgtggtttttaggctgtttcgcccttttttccccctttctttcctgcacgaggggcagttttttctctgacagatgacacatactatatggatttgcttgttttctgcaatccaagtcacataataatgtattaatgtaacagagtgaattctcagcatggattggatgccccagaaataattgaactgaaatactagccttcttagatcaaatagtgaagttgcttggatatagcatgacctgcnn

SEQ ID NO: 33298 - DNA, 962 bp, Triticum aestivum
  Clone ID: PAT_TA_33298
gggtccaggcgaaagcagcactctaggttattcttcgcaggctcctatctttcctcaagccagataccttccagggtgctgtcaaggcaatgaacgaaagaattctctcggtccttgatgcgtctggctctggccgcgttgatcttgggatgttctttgctattattgctccaatctgttctggtcctgtggataggcgcaagcgtgtcgtcttcgatgcacttctttggcgtcctgcaagcgaaggtggcaggggccagatcaggaggagtgacgcgctaagttacattaaacttctccgtgccgtttacataccaacccatggggctagtgatatgcttgaaatgcatggggagtctgaccctaccatggtatcgtacatagagttcctcgagatgttcaatgatcctgattgggggtttggaattctaaccacactggtgaagcttgaaggcagtgatcatgttcgccacggcagccacacctgctccatatgcagatatcctatcatcggttcacggttcatggaaacaaaacactcctttagcttgtgtaaccggtgctacagtgaagggaaggttccatcagccttcaagttggaggagtacaggttcaaagaatacagcaacgagtcggaggctcttatagacaagtgcatgtgctttaatttgaattctaagaagctggaagctgatgcttgattgttggagcatcggcgttgagttgttgagcatgaatctgtgtatgccctttgtagttgtgaagatgcctagttagctctcctgcccgccctcttgtaaactaaggtgctgttctttttggagttcgccaaatgtgttccaaccctaagctgtcagctattgttcgttccaagtgtatgggagcaagagcatgtgaactccaaatacactccctgtaaccacatcccaaatcaatgctaccaaggctttgaagtgtttctg

SEQ ID NO: 33299 - DNA, 726 bp, Triticum aestivum
  unsure (1)..(726): unsure at all n locations
  Clone ID: PAT_TA_33299
gaccccgcgtccgccccgatcccctttctcctttccttgttctctccgttcactccaaaattattgatactaaatcaggcccggcttgtaccgctggtaattcttaatctcccatcagtttgctgtgttgatttgtgccttgagcctgctagtcctcagctgcaggcatccccgcagctcgactcgctggtgcggcaacatggtgacagtctttgacggctggtttggctcatacgcctcctctgtgtcctcggtttgtaagaggcgatggatcatggatgtatagcagggcccgagtagcagctccaatggaggaggcgagatcgttgatctgcacgttgtcgtcgctgtcagcatccgtgtaggggatccttggtcgtggatctcgactcgcacagccagcgtggattcagcttttgtatgaggatatttgggccattgtcttcctcaatcgtacaagccagacttcgtcgttgttcccactcgaggaatcccgacatctcgtcgtcttcctccacaacagcaacatgtttcgacctacagagggcaaagcatatagttggtaatgggtgccagcacaagattctgggaggatacttggctcgggaggttatcttcagagctacggcactttaatccgttcttggtcgctactcactccgacggaggccagggagcttnttggttactggtgctatccgatgggaagacggtagctcggatatc

SEQ ID NO: 33300 - DNA, 704 bp, Triticum aestivum
  unsure (1)..(704): unsure at all n locations
  Clone ID: PAT_TA_33300
cccacttgtccgacacgactcaaatgcggagggttcgtcctgggttttcacatttgccataacctcgccgacggtttcggcatggctcagttcatcaaagctgtgtccgacatagcacgtggagaagcggccccgaccattttacccgtgtgggaaagggagctgctaacatcacgcggcttattacctgcagtcaaccgactctacccagtgcaccaaccaccagtgaacggctcagggagcgcagctcgcgacatgatgctctcggttccgccggagagcatggtcgccaagtacttcctcttcgggccaagggaggtatcagccctacgagaccgcataccggcgggccatcccgcccgctccgccacgatcttcgagctggtgaccgccgtgatgtggcggtgccgcacggtcgccctcgggtacgagcccggccagcgggtgcgcctcatgaccaccatgaacgcccgcgggaggtggaacaaccacacccccatcccgtgggggtactacggcaacgcgcacgtctcccccatagcggaggtcgtcgtcggcgagctccgcgggcagccgctcgccgacacggtggaactcgtgcgcgagaccaagcgcggcatgaccaaggagcgcatggagtcnatggtggaggcggtggcgttgctgcgggagtggccgccttccaccatgggcaggatatacga

SEQ ID NO: 33301 - DNA, 1520 bp, Triticum aestivum
  unsure (1)..(1520): unsure at all n locations
  Clone ID: PAT_TA_33301
tgctcaggtctatggggctcccccggcaagcaatgaaaacaagcttgaatccacttctcagactgaaaatagtgttgctggccatgttaggccactctcgcaaaccattgtgcttggaggtgttggctatcatatggtgaactgcggtctgatattgttgaaaatgctatcagaatatgttgacatcagtaaatgtttgccatcgttatcttttgaggtggtccaacgtgttgttgagatattaaagcatttcaataccaggacttgccaactggttcttggcgcaggtgccatgcaggtatctggtctgaaatcaattacttctaagcatttagctttagcaagtcaaattatcagtttcatacattctttgattccagatattcgtcgagtacttttcctgaaaataccggaagcacgcaaacatctgttgatgtctgaactggatagagttactcaggactataaggttcatcgagatgaaattcacaccaagctagtccagataatgagagagagattgctagcaaatcttagaaaattaccgcaaatcgtggaaagttggaatggaccagatgataatgattctcagccaagtctattcgccaaagctgttacaaaggaagtcacttacttgcatcgcatcctctctcaaatactgcttgaggtagatctgcaagcgatattcaggcaagtagtccagatattccattcccatattacagaagcattttcaaagttggaagtcagtagtcctcaggcaaagaatagattatgtcgagatgttcaacatattcttgtatgtattcgaaagttccctgctcagaacttcagcgcagcacctgttcgaaattatggtcttcgtgatgagttcttggctgagaagttcgggacggatgtcgacgcgtgattgacatgtacattagggactgactcctgtctgcaaatgttcagtggtggtacatatggtaaatgtgaagttatgaaagacaccactgttggcataaaatcctatgcaggtattgctgcggagggtatcggaaacagagcgctcttgatggcaatgaattaccatgtcaatacatccaatagcgctttgtgggatcacatgccaatggttttccacatctgacctgagccgaaatttttgcaccgtacttccgccatgttaggccgcgtttcatcttttgcttgttatgatagtatttcaaccctttttgtgggaaaagctgatattggttagatgttgggtatagaagagccatagagggaacctaacaaagacattttcggcagcacggcccattctttgcatattgccctgccgtttggtgcagtgtgttattaattggatatcgtgtcgttgatgcagccgagtgtatcttgttcctgtaaggtttgtataactattcttgtcagtgcagtaataagtaattgtgaaatgtttagtacaggcaaatccatacanacaggtattaacaaatttgggtattttttttgaaacctggaaaaaaaaaaaa

SEQ ID NO: 33302 - DNA, 790 bp, Triticum aestivum
  Clone ID: PAT_TA_33302
gccggccgggtcgggatcacctcctcatcccaaagcagcttagcttaaccaacttggctcagctggttgatcgctctgtccgcttcaacttcatcgcagcgaggcgcgcgctctccttggcttcgtcccattgctgctgtacgtattcgatcgagattgtggggatggacaagctgagcgtgcaccacgggcagcacaacggcatctccaagccgccggtgcaccaccacggcaagggcggcgggaagggcaagggtggcggcaaggggatcaaggtcgtctacatctccagccccatgatgctcaccgccagcgccgaggagttccgcgccgtcgtgcaggagctcacgggccgcgactccaacgtggccgaccacgacgccccgggcgtctcgtcctactactcgtcgtcgtcctcatcctcctactcctcgttcgggcgcgcctctccgacggcgggggctacggccgctgcgggcgcccgggctttgcctccggcgatggcgtccacggcggactacgcgaccggcgccggagccatgcctccgccgttccagagcatgtatgatcaaacgggaggcgccggcctgctttacggccaagactactggtaggatcggagatcggtcacctcgtggcggtcgacggttcggcatgccgtgtgaatttgctgtctacagtcatgcttcatgtttcttcgattttcgatcgacttgtactggagatggtaatgtcatgttgatacgagagcttagtacatatttttcgtttacttgacaaaaaggcccta

SEQ ID NO: 33303 - DNA, 779 bp, Triticum aestivum
  Clone ID: PAT_TA_33303
ccggccgggccggcatcccaagcagcttagcttaaccaacttggctcagctggttgatcgctcagtccgcttcagcttcatcgcgcgctctccttggcttcgtctcattgctgctgctgctgctgtacgtgttcgatcgagattgttgggatggacaagctgagcgtgcaccacgggcagcacaacggcatctccaagccgccggtgcaccaccacggcaagggcggcgggaagggcaagggcggcggcaaggggatcaaggtcgtctacatctccagccccatgatgctcaccgccagcgccgaggagttccgcgccatcgtgcaggagctcacgggccgcgactccaacgtggccgaccacgacctcccgggcgtcccgtcctactactcctcctcgtcctcctcctcctactcctcgtacgggcgcgcctccccgacggccggggctacggccgctgcgggcgcccgggctttgccgccggcgatgccgtccacggcggactacgcggccggcgccggagccatgcctccgccgttccagagcatgtatgaccaaacgggaggcgccggcctgctttacggcccagactactggtaggatcggagatcggtcacctcgtggcggtcgacggttcggcatgccatccaatccatcacttgcatatgtgtgaatttgctgtctacagtcatgcttcatgtttcttcgattttcgatcgacttgtactggagatggtaatgtcatgttgatacgagagcttagtacatattttcgttcg

SEQ ID NO: 33304 - DNA, 806 bp, Triticum aestivum
  unsure (1)..(806): unsure at all n locations
  Clone ID: PAT_TA_33304
gccggccggtaccgaatcacctcctcaccccaaagcagctagctataaccaacttggctcagctggttgatcgctcagtccgcttcaacttcatcacagcgagccgcgcgctctccttggcttcgtctcgttgctgctgtacgtattcgatcgagattgttgagatggacaagctgagcgtgcaccacgggcagcacaacggcatctccaagccgccggtgcaccaccacggcaagggcggcgggaagggcaagggtggcggcaaggggatcaaggtcgtctacatctccagccccatgatgctcaccgccagcgccgaggagttccgcgccgtcgtgcaggagctcacgggccgcgactccaacgtggccgaccacgacgccccgggcgccccgtcctactactcctcctcctactcctcgtacgggcacgcctccccgacggcgggggctacggctgctgcgggcacccgggctttgccgccggtgatggcgtccacggcggactacgctgccggcgccggagccatgcctccgccgttccagagtatgtatgaccaaacgggaggcgccggcctgctttacggccaagactactggtaggattggagatcggtcacctcttgtcggtcgacggttcggcatgccatcgaatccatcacttgcatatgtgtgaatttgctgtctacagtcatgcttcatgtttcttcgattttcgatcgatctgtactggagatggtaatgtcatgttgatacgagagcttagtacatatttttgtttacttgtttaaaaaaaaggggccctan

SEQ ID NO: 33305 - DNA, 849 bp, Triticum aestivum
  Clone ID: PAT_TA_33305
accacgcggccaccatccatcaccggagagcagagcaaggaaatctgtggacgttctgcccgtccaccaaatcccttcagcgcgccgcctccctcgcccgcgaggactctgcggatctctcagcggcagcagcaagcagagcggagagagcaatccgccatggccatggtcgcctccacctccatcgcttaccacaagccgcgtttgtcggtggtgtgcaggaagaaggaccgggacagggagctggagcgggagaaggagcacaagtaccccttcaaggtcgtcgagatcacgccgccgccgcgatgcctcggcgtccgctgcttccccacgaacatccactgcggagagagcgtgacgatcgaagggcaggcgtacaccgtgtcggcggtgacgcaccggtaccagctgcgcaaggggcggtacgagccgagcgagaagcgcctcgacgtcctctccaccggcagatacatcctcaacctctacctcgacaacctcctcgacaagccgcacacgcaggcccccactcggtcctatgcaccctgtgccctatcctcccaatccgcccaatcaagtccccgcctctatatgctctactctagactacttgtacaaatctatttattctacttctccagctaatttctttttgcctctactgtacgctacttctgtgaaggccgcgcacgcatgcacgcatttggtcctatactctttgtgccctggcatctcgggatgggcaggctgtggggcaaggtgagtcccctgtgtatgaggatattttttaaagtcctttgtcaacacatatctttatcaagtcttaataaaaaaaaaaaaaaaaaaaaaaaa

SEQ ID NO: 33306 - DNA, 726 bp, Triticum aestivum
  Clone ID: PAT_TA_33306
cccgcgtcgaccccgcgtccgcccacgcttccgctacctgtccgtgtggggcccggggggtgtcaattgttcctctgtcattctccgtctctccgtctcccaagcaaggggagcatgcctctatgtccacggagagggagagactcgacgagatcggtaagaagatcaagcgagagccggaccccgccgccgccatcgcgggcgtcgtagtcgccgtctcacagaccgagcaccacggccctcgccgcctaggcctcgttggcccaggcatcggcggcgccgcgaacatagcgaccccgtgcgccgcgtgcaagctcctccgccggcgctgcgcgcacgagtgccccttcgccccctacttctccccgcacgagccccacaagttcgccgccgtccacaaggtcttcggcgccagcaacgtctccaagatgctcctggaggtgcccgaagcggagagagccgacgcggcgagcagcctggtgtacgaggcgaacctgcggctgcgcgacccggtgtacggctgcatgggcgcgatctccatgctgcagcagcaggtgaacgcgctggaggccgagctgcaggccgtcagggccgagatcttcaagcacaggtaccggcaggccggcgtcggcgtcggcgtggcaaacctcattgtcgacgacgacgtcagtgccgctgcagccggcggcttcatggctcctgccacgtcgctggtgcacaccgctg

SEQ ID NO: 33307 - DNA, 1041 bp, Triticum aestivum
  Clone ID: PAT_TA_33307
gccggccggttccaggaagtgcggccctcatctcgggcgcacctcatcaacaccaagtgtcttcctttccttcaccacctaatcccaagttaccagccaggagagtcacaatgtcggcgaagcccacgagcaagaccttcggaaagtcgacccgagaggtccctgcctctacggagaaggctaagaagtggtaccccgctggcgacgatgccgagaacaagaaggttcgcaaggctgtccgatcttggactcctcgctcctccctccagcccggtactgtcctcatcctcctcgctggccgcttccgtggcaagcgtgtcatcctcctgaagtccctcgaccagggcgtcctcttggtcaccggccccttcaagatcaacggtgtccctctgcgacgagtcaactcccgatacgtcatcgccacctcttacaaggtcgacatctccggcctcgacgagagcaagattgaggagatctctcagcccaagtacttcaccgccgagaaggccaaggagaaggctggtgaggaggctttcttcaagcagggagagaagccccagaagaaggaggtcaacagcagccgcgccgccgaccagaaggctatcgacaaggctctgattgccaacatcaagaaggtcgatatgcttgcctcttacctctccagctctttcagcttgaggaagggtgacaagccccacgagatggcctggtaaatgtgcaatcttgtgtgccgggggtgatgggagtaccggggttgcgacacaaagggttgtagaacggcaagggtctccgaaatgggctggttttggccatgcatttgaaagtcgacgggcatcggtcacattttggcgtctgtaatcaggttttacagtcaaaaacaaacgagcatacaaaattctagaggcttccggtgagaggccgatgatgatgaaaaaaagaaaaaaaaaccaaaaaaaggcccctaaagaaaaacaactggtgtgagcgatcatggtctttcccggtctgaactggtcaaaaatggacattgttttacgaatc

SEQ ID NO: 33308 - DNA, 867 bp, Triticum aestivum
  unsure (1)..(867): unsure at all n locations
  Clone ID: PAT_TA_33308
cccgggccggaataacgcgtcgaccccgcgtccgccccgcttccgcccacgcgtccggccgccggcggncgcgttctcgtccgcctccgcaccatcgcgcagcgcggcctctacggggagcacgacgtcgtgcccatctccatcttctggcaggtgccgcagtacttcatcatcggcgccgccgaggtgttcaccttcgtgggccagctcgagttcttcgtcgaccaggcgcccgacgccatgaggagcatgtgctccgcgctctccctcaccaccgtcgccctcgggaactacctcagcacgctcctcgtcaccgtcgtggccaagctcaccaccaggggaggcaagcaagggtggatccccgacaacctcaacgtcggccacctcgactacttcttctggctgctcgccgcgctcagcctcctcaacttcgccgtctacctcctcatcgccagctggtacacctacaagaagaccgccggagatgatcacccagacgccatagccaaaggaggagctcatgattgatgcacatgaccagtgaataagtgagtgactatgtctgcggttggtgtatgaatgttgaaagaggaagaagaaagcaaggattgagagttcagataggtgaaattaagggaggacaatgaaatgcatggtgtgatttgtgacttcaagattcaagagtgttgccttgttgattaatatactagtgtcttggaaaaatctggcagaaaaaagttcagatgttatgtactttattagattggtgtgcaatgcgacccaaagcttctacagtgacagtgagcagaaaaagtacaagagtttaataggatttacaacagcttcatttggcgtgcaatgcgaccc

SEQ ID NO: 33309 - DNA, 602 bp, Triticum aestivum
  Clone ID: PAT_TA_33309
cgggccgacaattggacacagccacagaaattgctgcttcaaagggcgatgtccgcttggcaatcctgctaagccaggcaggtggatcgatgttaaatcgctcggatgttgctcagcagctggatctgtggaaaataaatggtctggacttcgattatattgaggaagacaggttaaagatatacgagttgcttgctggtaacatacaaggcgctttacttgattcaccaatcgactggaaaaggtaccttggtttaatcatgtggtatcagttgtcaccagatacatcacttgatattatcattcggtgttatcaccaactacttggtgagggcaaagttccaaatcctgttcctgtatacatcgatgaaggacctctcgaggaagcacttcagtggtccccaggtgaccggtttgacatatctttttatttaatgcttcttcatgcaaaccaagatgagaagtttgggcttctaaagactatgttcagtgcattctcgtcatcgtatgatcccatggactaccatatgatctggcatcaacgatctattctcgaagctattggtgctttcagtacaaatgatcttcatgtactggatttg

SEQ ID NO: 33310 - DNA, 1511 bp, Triticum aestivum
  unsure (1)..(1511): unsure at all n locations
  Clone ID: PAT_TA_33310
ctcccgccgcgccgctgccccctctgctggcaaggccaagtccaagggcgggaaaggtggcgccggggcttctaacgacgcgccgccgactctccagttcgatgtcgactgggtcgccgagcacgcccgacaggtctcaaggatgctccttggaggaatgagtgtcataggtatctatatatggtcttctgaaggctccttcaaagctactccttctgctgttttatcacaggttatcagagtggtttctcagtcagttccctggtacggcagtgacttcgatgagaggctgctccttcatctctcttacagcccaagaaggtgggcctgtcgcatatgtgagatggcatcaggaagtctaaggccgtgtgacttcaaatatagcaaattattagcttcgcttcaaactttcagatgcacatacaattttgagacgagattgacagttgttcaagctgagccttttaagaaagcttgttccatccctttcggccagcgcgccaagggggtgcagaatgcctgagccttaattgatggagatctgttttcggatgatatgaccatcacttcagagggcccacacgaagtcgatttgcttgtacctttcaagaacaatttgcctgccggagaatgcagtttagagggggttgctgggttgcttctctttgctggatctgtcagtgcgttggcatacttaggcccaaaagaatctatttcggaagctatatctgatctgaaggtggacatcattgcgagcctacgaagcagattagatatcatccttgatgaggcagatgatgactctacaactaatgatatggagaattcagcatctcagaaggttacccaagttaattttcatgagctgagagaaccttatagtttctcattccctagaaggattctgattccttggttagctggctcctatatttgtgactacttgcaacaatcagaaacgacaaaggatgcaatggagcgttgcaaggaagtgatatcactggaaacagaagtagagaactcaatcctagaaccagaaaccgcagcatctactgccacactagaatcgttttgggatgtggtgcctggagcttcatcacgtgctcgtgcagggcctggtccgaaagatgagcgccctgaacaggcgacgggttcggggagaacacaagacaacagtttcagcatcctagctgccttgtttgtgctcctggttgctcttctagttggatttatgtttgcgttccctgccaattcgaaaacctgagtaattcatgctgcatcagccgaaccaagatgttgacatgttttgtgtatcttatattttgtccaaacctcagctgtggatgtgaaaagtgtagagtttctttccgtcngtgaacagtttgtaggtgctgcacatacattgaacatgatccatccttttccacgatantgacaattggatgggatatttagagtgatgtaagccctgccttgtttcnattgttggctaccanaanaanggggggggg

SEQ ID NO: 33311 - DNA, 999 bp, Triticum aestivum
  unsure (1)..(999): unsure at all n locations
  Clone ID: PAT_TA_33311
gatgaagaagacttagatgacattaaggagctaggacagagcaaatggtcaaaagattttgatgaggatactgacaggtccaagcatgcagatggaagtacacatactctttctgtgctggccaagacatatggcacccatcaaaaaacacttacttggggtgatcggcttgaaaagggtggattttctatcggtgcagccaaaaggagacccacttcatctttaatcataggacctggatcagggtacaattcggtctccaaccccttggctgaagataattcccaggcgtgaaggataaagtaaacaatgaaacaaaaagacggttcagtgagcaacttcgtgatgaaggtcaatccttcagggcagttttcgaccagagaaaacagcngcattggggttttcgacaacggaaaaaatgagtaatccgtgactgagaagcctggatggcaacctgcagttgtatgggcctctgggtactcacgttgcccagggtcaagcagagcacaggtagctcggaatactggcttgttagtcctgttgctccattgccattggatatntgcagttctaagatttgccggacacagataggctntcacgttactgcctgctatcagtccccacaaggcgcaattgaaggaagcattactttctgcttgtgctatttgtcttttggcccacatgaagaagtggtgagaagttggttcccttgatttgttgcaggcttgtagctgcaaactcactatgatcctcttggcaatgcgaaatcctttttttgggactagccatttcaagagcaaccccacaagatgtatgtattgtgaacactgaataatgacatagtccttgaacaaggtatggagcacataatgactgggagggaatcggacatcagtgggtgtgttcttaacatgagatggaaacgtttaaatattgaatgaaacaacctcagtttttcaaaaaaaaaaaaaaaaaaaaaaaaaaaaaaaaaaaaaa

SEQ ID NO: 33312 - DNA, 1521 bp, Triticum aestivum
  Clone ID: PAT_TA_33312
cctcatttcgtctaaaaaaagagccttcctcaactgcatcggggctcacttggcggaggcggcgaccccttccagatccgctccgacgccggcgtgcaggcaactccggggtctttgaaaatgccaaggaggaagaagagccggttggatccagttgcaggcggcaggcagatagccagtaaggctcagattgatggaactgagcagacatcgccactcgccatttgtaagctctacgagcacatcaacgaaggtcaacgcgttgctgtcagagccatggggactgggcagctcctggacatcaagtgtgcatacttacacaacaccatcctgacatggttcacaaggttgtaccactcaggaaggagagggtttgtcgtgccaggacgcgggttcattccactgaccgaggagtctgtacatcagattttgggcatccctcatggagacattgaggtcaagtatgaaaccgactatgacatggaacaggagttcgcagctactttgtttccgggcaatggcagcacgccaaacatcacgacagttgctactgcaatcattaaccataacgaggctgatgatagattcaagaagttatggcttatttacattgtctcaaccgtgttggcccctacgaccgatgcacggatcagcaacaagtgctaccccatgctggcggatatcaaccgggcagacaggttgaacttgtgcaaatttgtcgtggaccagctccacgagcacctctcaaaggggaagtacacaaatgggtgcttactgtactgcatgctaaggtacctcgatgctttggattgtgatggcatggagcttgagttaactgacacaccatatagagtaaacgcatggtccaggacccaggttgatgttgtcgctgagctggacatgttagagcatgatccaccctgttttggtaaacttcagctaaaggaagaattcagagaggaggctgctagtggatcaggcacaagcatattgagtctgttcggaggccctggtggcttcgaaacctggatgaagcaaaacacccacccaagttgttctgaaaataacaagcttaaagtacaggggatcatccacaagtttgcatcagggttggagactctccttggtgatctcgtacaggggatgacagccccaacagcaagtaattcaaccaaaagtaggaggggcaggcgcaacgaaatagaaaaaaatgatgatacgttgtttgaagattcgtcatcatcagaatctgacggcgacacggatggggacgatgatacgtcgtttgcgtcatcttcagaatccgtagtgctagcagaatgaaatattttctggtttactttgtactggttgctatatttattttgatatttttctcggatctatcaagtgtgatgcaatctgttcaatgcgatttgcgcgctgtcccctctatgctagtgattgataaccaacaatactggagcattttcagacttcgtttatcaacacaggattataataatcgtcgtttgacatcgc

SEQ ID NO: 33313 - DNA, 1362 bp, Triticum aestivum
  Clone ID: PAT_TA_33313
ttttgtcagctattgagactaatctgaagccaaagccgttgatgttcctttgcttcacgccaatacttcttttccttgccttcttatttttcactacacagcaaaaccctcgatttggaaccttcttgtttgttactgtggtctgctacatagttgctaatggtttcaccattttggtaacactaagttcgaaattgattctgtatgtggctgccattctacatgtcttcgccaaaagacgctggcaatcttgggaggacggtactcattctccacttgttcgccagttcctcgctttctcgttctcatttcagtctctcaagattgtgcagatgatcaagaacaatacaaatatagctgtagcatttgctacaattactcttgtctgcttcgttcatccagcaattggtcttggtcttttacttctttcacattccttccatgcccattcagccctctgcagtttcttaggagcttcgtttcgtaacatcgctcagaaaaaggacctgtataaatccaagatggataataatcctattctacaatccaaaaataaaccagatggactcgagcaacttctgccaatggatgacagcccaacagctgctaaaagctttactgacagccagctagaagtgtttgactgtcggcatgggattatgatcctgcatcttctagctacactcatgtttgtgccttcacttattgcttggatacagagaatcggagtgggtcagagatttccgtggtttgttgattctgccctttgtgttggtgttattctgcatggacttttgggatcgcagccaactgccagctttatatcttttaagttacccggaaggagagggcgcgaagttggaatgagctttctctacctcataggtggcttttattcctttattagctccatggcattggcaccttacagagcgctgtatgcgatggccatcattggtttcatctgttttgcttccagaattcttgagactagaggtaaggtgagaggtgatactagctctagaaaaaggcactggcatagacattgacactagcttggaaaggattaattttgcgagaacgggcgacacagtagtgtaggataccagctcttagtctttgtggatgatgactgcaaactgcaaagaacttggctttgcttatgattgcaaactgcaaagtgttaccgaattttggtgtagccagatcttgatggtcgacccataggtgaggtatatgaatgtgagatgactggatggatcagtaactgtacaatctggaattcaagcatgatgtactgattttgtgatagaaaaactcgtgcctgatcttattaggctcaaaaaaaaaaaaaaaaaaaaa

SEQ ID NO: 33314 - DNA, 903 bp, Triticum aestivum
  Clone ID: PAT_TA_33314
attcggcacgagggcgaaaccacgcattggtttcactccagcgatgcctaacagcgaccgaagggataggcctccagtccaccacatggtcacacgctttcgatcacatcatattcgctttgctggacgacttgctggaaatcgcccagaaccactcgcagaaggaccacaggaacatggaaggatccctcgtgctcgccgtgaaactggtagcaaaggtctaccttcagctgttaccagacctcttcgggctgagcagcttctgcaagctgtggctgggggtcctcagccggatggagaagtgcatcaagaccaaggtccggggcaagcgcagcgacaagcttcaggaactgatcccggaccttctcaggaacatcctggtcgcgatgaagagcagggggatcctcgccaagaggagcacgatagggggcgacagcctgtgggagctgacgtggctccatgtgaacaacatctcgacgggcctgcagtcggaggtcttcccgagccaggagtatgagccgccgagcaatgccggtagcccgagaggggggctgaacgacgccgagattaagaactagaaaaagctcatgggtcggctcatccattgagacgtaaggttttgatattgtaacccgcatttcgccgcctccattgtatgtatatttattctgtccgagttgctgttgttgcgtaaaactgtggcagcaatgtgagcagattgacatgtttgcgctgctgacctgagtggctgcgatgcacgtttcatcatcagcactggaaatgctgttgtttcgcagaaagttcaagtttgtgtgctggtttgtataaatttggctcattttctaattgggactcgtttggaagatatgttttatgttttttgcaccggtttcacatgaaaaa

SEQ ID NO: 33315 - DNA, 1874 bp, Triticum aestivum
  Clone ID: PAT_TA_33315
ttcggcacgagggtcagatgctaaacccaagggatcttttacacagctggattccagcctgatgctgagatcagcagcggcattgcgacctgtacaatccaactgggcaaggctcattacaatgccagaaaagcgtctgcacagttggaagtgtatgaaaagaagttgggctatttcgacacagatccagcaatgcagcaaatcatggaattaccacaagttcagtggtggtcgacgcatggggctcgcgtgcccgacctgcagaccctggcgaggcgtgtcctgagccagacgtgcttcggcgccaccaggtacaacatcgactggagcctgtcggagaagctgcacgccgagtgggaggagatgacgccgcccgaacaggagaggttccggcagaaggagtacgtccactacaaccgcgtcctcgccggcgccgccccgctcctgcacggctcctccgtgaggcagcacgacagggtgaccatggtgctgcaggactggatcagaccgcagaaacaggccgctggttcgccactgactgagtgacggccttcaattgatgctttcgcctctcctccgttctgttatgtgtatgtgtgtgtatgctgctgtaatggtgtgcagcagtaatctgtcggatgctcactagtcgcactcccttggtactgtcggggccggtggtgctgttgagcccctcctgtctgtcctttgtggttatgttgttgaaaccctgttgaattccttctgctcctgctgggctggtgcagatgttcagctcgcctgaatgggttccctcgggttgggcttgtcttgatttgttcgagcgtatccagagcatagtaaagacagacgatgcattttggcatgctgctgccaaagtcgtgaaggttacaagcccacttgtcagagtgttgtataaactggaatctgatatctgtccgatgggtatcttgtatgaagccatgcatggtgcaaaagaagagatatgtgtcaatattggagatgaaagtgagttttatttgcgtataattgacaagatatgggatggttacttgcataaccctctccatgctgctggtccgatgctaaacccaaggatcttctacgcagctggattccacccttatactgtgatcagcagtggcatcgcggcctgtataatccaactgggcaaggctcattacaatcccgtaaaagcattagcacaattggaagtgtatgaaaagaaattgggctatttcgatacagatcctgcaaagcagcaaataatggaattaccacaagttaaatggtggtcgaagcacggggcttgcgtgcccgacctgcggacccttgcgaggcgtgtcctgagccagacgtgcttcggcgccaccaggtacaacatcgactggagcctgtcggagaagctgcacgccgagtgggacgagatgatgctgcccgaacaggagaggttccggcagaaggagtacgtccactacaacagcgtcctcgcccgctcctccccactcctgcacggctcttccgtgaagcagcacgacagggtcaccttggtgctgcaggactggatcagaccgcagaaacaggccgcctgtcgccactgagtgagacgcccttcagttcggcctggagcaatgctttatcgcctcctcggttttctttgctatctgtgtgtgctgctgcaatggtgtgcagaagtaatctgtcgagcggcaatgtcgtactggtactatcgtcgtctctgccaaatctccaagtttttcatttcttgaactcccgctggattaccaagtttgttatgttgtgttgaaaccctgctgaatttccaagttattataagtatggtcgtggattagtctaaaaaaacaaaaaaaaaa

SEQ ID NO: 33316 - DNA, 619 bp, Triticum aestivum
  Clone ID: PAT_TA_33316
gccgggccgggcggggaaggcctccttcttcccctttcccgtcgagcccccgtctgtccgctccgcgacgccgcgattccatcctcgcctccgatctccagcttcctcccagccgacgagatggccgagattgagattaaaacagcacctgctgacttccgctttcctacaaccaaccaaactaggcattgttttactcgctatgttgagttccacaggtgtgtgagtgccaagggggatgaagctgctgaatgtgagaaatttgccaagtactaccgatctctttgcccagctgaatgggttgagaagtggaacgagcagagggagaacgggacatttgcagggcccctctaaatcatctgtttgagagtctcctcaattgctttcgcgtcagcgctactactgtcttctggcttggaatttatgctcctgccatgtagtactattcttccagcaaatcgctgcagaacagcaagtgatgcttttctctatgttgcactaataattcagcatgcttatatattctgtcattgagacatgccttttcacatttattaaatggattatattctgaaatgaggttaaaaagcccgaaaaaaaaaaaaaaaaaaggccccta

SEQ ID NO: 33317 - DNA, 1409 bp, Triticum aestivum
  Clone ID: PAT_TA_33317
cgtccccccccgcgtcccgtcgagcccccgtctgtccgctccgcgacgccgcgatcccttcgacgcctccgatctccagcctccgacgagatggccgagattgagattaaaacagcacctgctgacttccgcttccctacaacaaaccaaactaggcactgttttactcgctatgttgagttccacaggtgtgtgagtgccaagggggatgaaggctgctgaatgtgagaaatttgcccatgtctgacgagttcgctacgccgcgagtccttcctcgcctcggatctccagacgccgacgagatggccgagaataagattaaaacagcacctgctaacctccgcttttctacagccaaccacactagactgtgttctacttcactatgtttgagttccacaggtgtgttggtgccaagggggccgaagctgctgaatgtgagaaatttgccaagtactacagatctctttacccagcggtatgggttgagatgtggaacgatgcatgagggagaccggtatattttgcagggcccctctaaatcatctgtttgagtctcttcatttgctttcagtgtcagcgctactgctgtcttgtggttggaatttatgctcctgtcatgtactctcttccagcaatcgctgcagaacagcaagtgatgcttttctctatgttgcacaaataattcagcatgcttatgtattctgtcattgaggacatgccttttcacatttaattaaatgaattacattcgattaagttagtacaaataatggaggaaacccatttacagatcagatgctcactcgcctcaaggaggtgcatgatagagagaaggaggttcatgatgctctgggatattcagaggaccaaatatctgaattgaagaaggagatccacagaactcgggatgaacagcttgcaaacattactgccatggtggaggaaaagctgaatatcacggtggagaagctgcaagtccaactcatggaagaacagaatgcaaggctggaagcagagagggtggcggcggaggccaggctgaaatccgacgaggagatctgcaagctcaaggagaggctcgagaaggctcaggaggagaatgaggagttccggaggctggcggcgacgaacaagtgcgccattctgtaaacagttgtctcttgggaagagttgtcggatgtcttgttaataggagggggtgaacttaagtctgtctagtagcaacagatatactgtacttggttgcgtcgtctcgtatattggtagaagttgaatgcctggggagtcaaaggataactatatgttagtgacagttatacttgtcctctcatattagtagcacttgcgacttgcgagtatcaaaaaaaatctggcaaaaaaaaaaaaaaagaaaatgtaatagttac

SEQ ID NO: 33318 - DNA, 756 bp, Triticum aestivum
  Clone ID: PAT_TA_33318
cgcgtcggtggtgactagcagaccgcctgtcacgacactatcctgattctgcacgcatcatgtgcgctcagtttagcgccttcatgggcattcctttctcatggatcctccttacggtcattcctcagtcaaccgactactggcttgcctacgccatcacactattcctcatgggtatcaccatcagctggtgtgctacttcggcaaacaaccctatgttcgcggaggtagtccctcccaagcaccgcaccatgatctatgccttcgaccgggcttttgagggctcattcgcctcattggccgctcctgctgttggcttggtcactgagaagatatatggctacgacgccaagaccgtaaacatcgccaacggatcagcacaaggggcgtatgcgctgtcgagagggctgctaaccatgatgatccttccttttggcatctgtgtcctattctacagccctttgtaccttgtgttcaagcacgacagagacaatgccaaggtagccagattcaagggccaggagctaacctgaagagataccttggtctcccgactgccgaggaatctcatattcaggcttctttaggctggcagatcagaaaggttgggttcgttcttcaggttgatagattgattcgggctgcttgcgacgagccactcgttttcttcttttcttgtggggaaaccactcgttttcaatggcgatacattcatccgaagaagaaaatgccaaaatattcttcagattccaccca

SEQ ID NO: 33319 - DNA, 1052 bp, Triticum aestivum
  Clone ID: PAT_TA_33319
acgagaggggccgctatgcagacgacgccgggcgcggcggcggcgatctccggccagatccggtcggggaggcgaggcaggggccagatcctgttccggggacggcgtggaggcgatctacgaggcacgggaggaggtcaggcggcggggcttgaactccagtaggcccccttttgatggatggggccgcccacatcgctagcgactcctcggaggacgacagggcctcctcctccgcgtcctctaccggttcggcctcctggcgctcccggccgcacaagtggattcacctgcgggggcgccggcgccggcgaccgttgtccgctcggagaggagagggtggtgaagccaacggcaagggcgacggtgacgacgtgcaggacctcgcgctgccgctggggagatgtccttcgcggcggttcttgcccaggtcttaccggcggcattgggcaccacatgggaagcggaaggaggagccgcaactctccatgcaagctcgggtcaatgtcatcgcaagttcgtgctcgacgttgctgttcaatgtcgcctcagctgatttcgcccgccgtccgcccgatgcttcacactttgccgtaactcaatctgccagttctccgcttgagtgcgtaccaatgtacagtttaccgatgtgtatatatgcggagtcgatggaaaacattgaagccagtagttgtatacctatttcaaaaatcagcaagtggttagtaacattctacatcaaggttatcatatgacagaacgtctggggtgaaagctaagctacttccaatggtcccaaatgagaaggcaagaaggtatcagctgtatgagaagaccccctcacatgcccattccattccctatgaagtcaaaagtttcccactgaatatatttgcaacaaagtacagtcaagatcagggtgtgtgagggttaaacatgttaatttatgtggcatcaagctatgtatgttaatagcatgctctactttcttttgctttgcaaaattattctcgacactggagatatatgctaatctcctagctttgctaaaa

SEQ ID NO: 33320 - DNA, 849 bp, Triticum aestivum
  Clone ID: PAT_TA_33320
ggcgatactagtcaagaagagagagaactggccatggaccagtttaacaactctgctgatgcaaaagttctgtttggctctatcagggcgtgcggggagggcatctccctcgtgggcgcatcaagagttgtcattctagatgttcacttgaacccctctgttactcgtcaagcaatcgggcgggctttcaggcctgggcagcagaagaaagtgttcgtgtacaggctcgtggccgccgactctcaagaggaaagcttccatcaaaccgcattcaagaaagaagtcataccgaagctgtggtttgaatggagtgagcagcactgcacgtcggacgacttccggctgaacaaagtcgatatcgatgactgtgaagacgagctgctggacaacaaagcgatgcggcaggatatcaaggtcttgtacaaaaggtgaaagcaggttggccgctgtgcgccatgtacatatgcattgtcgatctttcgaggtcggcattgctctgaatgaaggtgttgcagctgctccgtcgtggtggaaacgccaagccaagggtttgctgccagcaagggttttctgctgcctgtgtcattgcccccacctatgtgtatccatccggtgacctgtttagtagtatgtgccgacgactttggacggaaattagctagggaactgatcctcgtcgtgtttcttgttcaagacttccagggctagcagctaggtttgcttgtctttaccttttcgcgaaacaataatgtccaaataatatgttactgtacttgttgccgcccttgggctgcactctgttatctagggtaaaaaccgacaagtgtttgctgcggacagaaagcgcag

SEQ ID NO: 33321 - DNA, 662 bp, Triticum aestivum
  Clone ID: PAT_TA_33321
acatcgcggcgcggtacgaggcgatggagcggcgggcgccggcggcggcgctgctgcggaagcggcacgcggcgagctgggaccacgcggcgtacgcggcggcgagggaggcggcgctggcgggcgcggggctcgcggagagcggcgtgcgcgggtggaggcggccgttcgtgacgcacttcacgggctgccagccctgcagcggcgaccggaaccgggactactccggggacagctgcgacgacggcatgcggcgcgcgctcaacttcgccgacgaccaggtgctgagggactacgggttccggcacgccggcccgctcagcgacgacgtgcggccgctgccgttcgattatcccgcggcggccgggaggcgctgacaaccaaacaggcggggcggcggcgagtcggtggagtttttgtctttgtgctgctgtgcgtggctgctcgctgtcgctggtgggtttagcagcgaaagtcatgtacttcagccgtggggttcagtacatttgatgtctggcgttatccattttcttgtaccaataaaaagttgcgcagtaactgtcaaaaaaaagttgcacagcatacaccaggccgttcgagggtttatgcagtgctagtactagcaaagcagtttccttccagaagaaagaaaagaaccaggg

SEQ ID NO: 33322 - DNA, 552 bp, Triticum aestivum
  unsure (1)..(552): unsure at all n locations
  Clone ID: PAT_TA_33322
ggcataccctggaccgaggaggagcacaggatgttcctggaggggctggagaagtacgggcgcggggattggaggaacatctcgcggtggtcggtgaagacgcggacgccgacgcaggtggccagccatgcgcagaagtacttcatccgccaggccaacgccgccacccgcggcgacagcaagcgcaagagcatccacgacatcaccaacccgtgatgcgtcatccgtcgtggacaaggcaccaagaatccggtccggcccgagcctagccgatacccgccgcccgtcgtcgtcgtcgccgccgccgccgtctgctctccctcggccgtccgcccgtgcaaatgtatgtaggggaaaggcgtggctcggctggaacctgcgattcggaaccagtaatctgtagtaaactagctgtgtggtcgaataaatcctgtctgtcctcacctctgtcgtgtgtgtgtgggtgacatgtcaaggaagaaacagagtcagtcagtcagtcagttcggaaagggttatagcaatccaccgcatgttttttttttanaaaaa

SEQ ID NO: 33323 - DNA, 1431 bp, Triticum aestivum
  Clone ID: PAT_TA_33323
gcgcgcgagggcagccgcccggcgccgcccagccagccaccccgtccacgaccccgcgcaacgccgccccccacccgcgcgcgagttacttgccccagcgccgcgcacccgccacctgggcgtcgcgtcgtcgccgccgggacgagagcccgagcgacccgaggccacccatggacctgcactaccagcagcccgcgccggcggccaggagcccgtgggccaaggtggaggacacagcgttccaggcagcgcttgtgacgctaccccacccgacgcccgcccgccgtgagcgcgttccggcgcgcctcccggcgcgcaccctgcctggggcgcccgggcactaccaggtgctcgtcgcccgcgccgggtttagcaagcgcggtgcggtagccacgatcggttgctgggacgacgtcgggtcgtgtacatccagacgcaccccccgccgttcctgtggctgtggatgacttgtcaaggctggcagggctgcactcggtcatgcagttccgaaggtgttatacctttacgggctggtggttagtatgggcggggggactggaggaacatctcgcggttcgcggtgcggagccggacgccgacgcaggtggccagccacgcgcagaagtacttcatccgccaggccaacgccgccacgcgcgactccaagcgcaagagcatccacgacatcaccaccccttgaccacccaagtcgacggcgacgcactcccttgtttaatcagtcgccactactcccacaatcttatcctagtttacttacatgacgacgtgtacattatatcctactactaccactagtacttagacttagccttaagaagactctgacgaacagcttggctcgggcggacggaggctgtggctcccggccagcaaatggtttagtgtctagctagattttaccatcacggtggaacaactaatggggtttgacgtggcaaaaaatgtccgtgtcgatgcagatgcagtgcaggcgtcgctgtttctatggatcatgattctgtgtcatgctgtcagggctgggctggataatcttgtacagtgatgcgttccgctccatgagatgaatgacaggtgtcgccggtgatggacacgcgcgcagctgcgacatgtgtttcgtcgtcggcgaactcctctgtgtcataaacggcagggcttcccgggcacgtgtgttactggtgcgcgccacttgtcagtgtccaacctttcagggattcttcttgtctgcaacgcaccgccgtacagcggtcacgactcaaaacaaaagaaaccccaccgcttccgcggctcctccgtcgtcgattgtctctatgccattcagctgacctgtggggcgtggactgcaccgcattgacaatatgctttcttggtcttccacaagaaatggttgcaatattttctacctcggtaata

SEQ ID NO: 33324 - DNA, 828 bp, Triticum aestivum
  Clone ID: PAT_TA_33324
gagctggctccctgtctgcctccttggaggcccccccttcgggcgcgtccaaacgaggaagcattgacccctatgattctaagaggactcacagaggcaacgagggctatctgtcatattggagagcatttcatcggtatcaaccaaagtggatggaaactcaagatcttcatcaaaacgagcgaagttgttggtcatgaggatgggtcctcagattaagaagctctccatcaagcaacaaaatgaacgtctggagattgagaacaaaatactggcgattgagaaccacaaaatgcgcgaggagttgaggacataccgatgtgttgcttgcttgaagattgaaaatgcctgcctgaaagctgagcttgcacgctcgtttcgtaatgctgctgcaattctagaagctgaagcacaatctgaactggaggttgggttttcctctacagcaccccagattccagcggatactagcgcaactggaccactccagccaggtgcagcagggggccaagatgaacaacgcgagtaatcagctggcagcaatttatttgctacagttacaaaaatctatatacatacagaataaaagtttcaaagactcgatgtgttagtcatttcaatttcaataagtgacactacaagtccattgtgtcttgtagttaagcaccaaaacctttttatgtgttactggtacttgagaaggttgtatgtcttctcatctctatcatttacatttgaaacatgggatattatattgtgtttgtacaatctcctgtcctataaatatgttacttatttattttatttgtgaggaaatttgttattccc

SEQ ID NO: 33325 - DNA, 378 bp, Triticum aestivum
  Clone ID: PAT_TA_33325
acctgtcgttcgacgccgaggaggcctcggccatgagcggcgcggagtcgagcggcatgagcagcgactcggaggggtcggctgccggcgccgccgaggatgatgacgaggagtgggagttcatgcgcgggctcaccgtgtgagggcgagctctttctatatctatcaccggtcgaaccggccggtgatgttgtatcgtgtcactcatggtcgtagcgaggtcgtcgggcgtctcgtcgccgtttagtttcaccgccggagtttgttttggcgccatcttttttatttcccatgcgtcagtccactgtttctttcaacttttttctcttggaataaataacaaaaggaaactatcagtactatgtttctttcgattgc

SEQ ID NO: 33326 - DNA, 949 bp, Triticum aestivum
  unsure (1)..(949): unsure at all n locations
  Clone ID: PAT_TA_33326
agcgcctccggagcggcccgccgtggacggcgtgctctcggacctgacctgcgacagcgacggcaaggtggaccagctcatcggcggcaggagcagcctgcccctgcacgagctccccgcccacgggacccgcggctactacctgggcatgttcctgggcggcgcctaccagaggcgctgggcggcctgcacaacctgttcggcgggcacagcgaggggtggtgcgcgtgtcccagagcgacggtccgcactgcttcgccgtgacgcgcgccgcgccggggcccgtcctgcgccgacgtgctccgcgccatgcagcacgagccggaggtgatgcccgaggtgctcaagcagaggaccaccgacgacggcgccaccgccgcggccctcgccagggcgttcgggtcaatgccgtacctgtcgttcgacgccgaggaggcctcggccatgagcggcgcggagtcgagcggcatgagcagcgactcggaggggtcggcggcgggcgccgccgaggatgatgacgaggagtgggagttcatgcgcgggctcaccgtgtgaccacggcgagcttatactctcctgtatctgtcgccggtccaaccggccggcgatgtttactttaccagccagcaagcggcagctgctgccggtgttgtatcgtgttactcatggtcgtagcgaggtcgtcgggcgtctcgtcgccgtttagtttcgccggagtttgttttggcgccatctttttatttcccatgcgtcggtccactgtttctttcacccttttcttcttggaataaataacaaaaggaaactagctgtactatgtttctttcgattttatttcccatgcgtcagtccactgtttctttcaacttttttctcttgggaataaataacaaaaggaaactatcagtaagacggaccaaacacctgagtnccaactaanccctnnaaa

SEQ ID NO: 33327 - DNA, 734 bp, Triticum aestivum
  unsure (1)..(734): unsure at all n locations
  Clone ID: PAT_TA_33327
ggaatggtacttttactcccgaaaggatcgcaagtaccccaccgggatacgaacgaaccgggcgacggaggccggctattggaaggccaccggaaaggacaaggagatcttccacccacctttcacactcatcggcatgaagaagacgctcgtcttctacaagggtcgggcgcctaggggggagaagaccaactggatcatgcatgaatataggctcgagagcagcaagaagctgacatccaacccatccaccaccacccgcaccgtcaccagaaccaacatggcttccaaggaacagtgggtggtttgcaggatcttccataagagcaccggactaaagaagatggtgacgctgtcatatgacatgccaatgtacacaggagcagaacatcaacaggngctttgtcgacttagatacattgcctcctctcatggaatatgacatgtcgtcaacgtgtgcgcatgcccccgctgtttcctggagcttcttcgtaccagttgcacgatgttggggctggctcatcgatgatgggcagtgtggcgcttcctatgatgaattaccactacatcaggaataaccaccaccaccaaatgatggccaacccaacactgcctctgccgctctaccagcaccaacaacaacatcaacagatgatgatgcatatgggtgcagatcagggtcttatggttgaggctcagcctganaggggggttggcatcgatgctggcacagg

SEQ ID NO: 33328 - DNA, 1532 bp, Triticum aestivum
  Clone ID: PAT_TA_33328
gtcgctgcggcgattgcggatgtgaacctcaacaaggacgagccatcggagccaccggcgaaggcgcagctggggcaaaagcagtggtactttcactgccgaagggatcgcaagcaccccaccgggaaacaaaccaaccacgccaagattgctggcaattggaacgccaacggaaacgtcaccgcggccattcaagcggcgaccctgggcaccgcccccgcgatggcggttccccccgacaggcgaagagcacctaggagggagtgggccccctacgccccgcaggagcgcaggcgtcccagcggcaagcgaccaactccccccccgccagtcggagcccggaccgccaccagaaacgacgaggatgcgggagaacgggtggtacttttaatcccgatagaaaagaaagtccccctctagaatacgaacgaaccgggcgacggaggccggctattggaaggccagcggaaaggacaaggagattttgcagccacctttcaaactcatcggcatgaagaagacactcgtcttctacaagggtcgggcgcctaggggggagaagaccaattggatcatgcatgagtataggctcgagagcagcaagaagctgacatccaacccatccatcaccacccgcaccgtcaccagaaccaacatggcttccaaggaacagtgggtggtttgcaggatcttccataagagcaccggactaaagaagatggtgacaccgtcatatgacatgccaatgtacacaggagcagaacatcagcagggctttgtcgacttagatacattgcctcctctcatggaatatgacatgtcgtcaacatgtgcgcatgcaccgctgtttcctggagcttcttcatacaagtcgcatgatgtcggaactggctcatcgatgatgggcagtgtggcgcttcctatgatgaattaccactacatcgggaacaaccaccaccaccaaatgatggtcaacccaacactgcctttgtcgctctaccaacaccaacaacaacatcaacagatgatgatgcatatgggtgcagatcagggtctcatggtcggggctcaacctggaggtgggttggcgtcgatgctgtcacaggaggatgctgtggccgggctaaggaacaactacccagggaacaccgctgcaacagcagttggcgagacctcattgatgaacatgggtatggatgacatttggcagaattgatgatcaaataacccaagacaacatatatatgtgtgtgcatgcataaattaataatccatcagacggtcagttgatatatgccaacccgtatattggttggtgccgcatttttatttgttagtgtgaccttgagagagtttgcaatcatggcatggcttggcatgccactcttgtgctagtttttcaattgtgtgtatgtgtattggcttgtatatgcactacccaccagggtatacctagctacatatgcatgtgttgtaaatgtgtgtacataatgcatcttttaaacccatatagaataagctactttgtttat

SEQ ID NO: 33329 - DNA, 756 bp, Triticum aestivum
  unsure (1)..(756): unsure at all n locations
  Clone ID: PAT_TA_33329
tcggagcactttttgcttccattccattcacaatattcgctgccatatactgtgttatgtttggcattattgcggcagtggggctgtccttcctgcagttcaccaacatgaactctatgcgcaacctcttcatcgttggtgtttcactctttcttggcttatcgataccagagtacttttctcggtatctgacaggtgctcaaaatggcccggcgcacacgaaggctggatggttcaatgactacatcaacaccatcttcgcgtccccgccgactgtcgctctcatcattgctgtagtccttgacaacacgctagatgtcagagatgcggcgaaggacagggggatgcaatggtgggagcggttccggacattccgaggggacagcaggaacgaagagttttacaccctccccttcaacctcaacaggttcttcccaccatcttgagcagaagcttccaaagtccgggtactgcaagcagagtaccaaatgaagaaacctttgcatcccaatacggcatgtttctgaattctgatagaggagaagaggagaagagaagtagagatgataagacccgcatgccgttttactagcgaaggatggaggaatttcccttcgagctgtccgattgtacatagatattgtattggcgtagactatgaattaatgctagtttttgctgtgtgcaatgntaagatctcatgaaacatttgcggacagatgaggcacattgttagccggtaggtgaacccaccgt

SEQ ID NO: 33330 - DNA, 756 bp, Triticum aestivum
  Clone ID: PAT_TA_33330
gtcaggaatggcagatacgttggtggtatgttccttattcttaattcatgagtggtttcttatttggaggtgagtcaagtaccgtgatgcattgagtgtcttttattacccacattttactgattgttgatgtcagaaatgggaaaccctgatatatgtttggttggtgctagtttcatgtataactcaatctacaactaacccaggttggccggtgacaaaaaaatatgaaggtttctttttctttaatcccctattagataattttgcatggcccagatattcttttaaatgcacatatgctacatatattatacaagtagcattcgataatttggacctcaacattcaagagtcatacactcaccgaaaaatcctgccactcctcacatatacctagcatattatagattgatatttgtcactctgtcagtctctccatctcaaagaattgtaattcacaaatgttgtctgaaagcatattttctcagtccatctgttatgaagatctagttaagtgatttttctcttttctttctggagtagttagaatttctaatatatgcacatgctatagtatatgctgcccccatgattctgtgtgatgctcttagaaaagtctgagaatattgaatgcagtcaactaacatatcaaatttgcttcagtcatgtttttgttgaagtacgaggttactgtgcttcctcctgcatctgcatctttagccactaaccttgcattatttccctcgtgccgaa

SEQ ID NO: 33331 - DNA, 1217 bp, Triticum aestivum
  Clone ID: PAT_TA_33331
gtcgacccacgcgtccgtgggctaacattttctccggggggatttccgactttaatccggtggagatatggggagccggagggaggaggagaggaacgagaagatcatccgcggcctcatgaagctgccgcccaaccgcaagtgcatcaactgcaacagtgtggggccacaatacgtatgcaccaatttctggacctttacatgcttgtcatgtagtgggatacaccgtgagttcactcaccgtgttaaatcagtgtcaatgtctaaattcactacccaagaagtgcgggctcttgaacagggtggtaaccagcgagcacgtgatatctacctaaaagattgggattggcagcgaatgagattgcctgacaacagcaaaccagataggataagggaatttatcagaactgtttatgtagacaagaagtatgctggtgcgaagtccaccgacaaaccagccactgatagtgagagtgtaaagggcaatgaaagtgaaacaagaagacctgactcctatcattcatactcgcaaagcccaccttatgattttcagtatgaggatagacgatatggtaagcaagttaacacgcttgctcggaggccttcggatagggcactctttgatgggaaactcggcagcctattgtacagtccgggtcgttccagggatcagatgcatgaagatcgatttgctaatgagagtcatggatcaagattttctgacttttcagcctcaagcaccagtgactttagaaacgatgtgctttctcctagctctcaggatacagggtacagcagcccttctgttcaccattcaagaaatgtatcagctgaaaatcctcaatcccaaagacatccaaatgcagtttcacaaatagaatctaatggaggtcgtcgttcacagcgaacagcttcttctggaagttttggatcgtttgatggtagctcaccatctaataaatcagttgattcaggtgtcctacctgatgcacctacagaaaggccagtgccctctgctgcaaaccgtcagagtggggcatcttctgtagctcattctacacaaccgtatgccttgcagcagagtgcgaattcttcagccagccaaattgccccccaagaatctctgcggcatttgcctgtttcagcccaatcacaaccacaaccaacggctttcacatgtcaaagaggtcttgattagtcggacgcgtgggtcgacc

SEQ ID NO: 33332 - DNA, 1790 bp, Triticum aestivum
  Clone ID: PAT_TA_33332
gcaattcagcatataatggagccaaagcaatgctatacaacttcttgaagttgctgattccttggaagccaaagagctcaagaagcactgtgaggatacagctattcgcaaccttgattacatcttcacagtggcagctccttcaattatgaatgcttctcctgaaattcttgcaaatttagagagattgctggatgaaaaatcctcggagccctggagtcaccgccgtcttcccacaatgacagctacttatcctgctgtcattgatagcgatgcagagggagataatgcaggaggattccctaggctcagggacaatcagaagcctgcatcaaagttgtatggaatgtcaggttatggtaacttccttcagaaagaaagcaatgctgagcaatttgtctccaaacagatcagggcaattcgcaagaaactgcagcagattgagatgctcgaggctaaacaactggatggtcatcagcttgatgatcaacagctagcaaagctcgagtctagggcttcccttgaaagtgaacttgcagagcttggctttccaacagaagcattttcaagaccttcagtttatgtgccaaacaaaaaatctgagggttctaagaaacagaagaagaaaatcaagcaggcagcacaatctgatattacctctataaagcatgaggacaaggagcaaaaccacattaaggagcttccagacgtgataccaacccatggctcttcagaaaaggaaccagtcaaaccatctgatgatggcacttcgagtaacacaaaagccatcttttgtccattaggggacaaagcttcccggctaacttcatcaaagaagaagaacaagaaaggtggcttgtcattgtttttgagtggtgctcttgatgacacctcaaagctaagcttgcctactcctgctgtgcctgtgacaccaaagcaagaaggacctgcctggggtggagctaagataacgaagggacctgcttcccttcgtgatattcaaagcgagcagaggtcgaaaacgaacgagctgatgacgacgaaagcaaaagaccgccatgaggattcacctgacagtgctgggcttttgcggctttcttcatttatgcctgatgcgtgttcaagtccaatatctgttgcacctgctcgtgctgttcctgctcacgaaggggataagagcacacctccttggtcatcttcagctacctcacccaacctatcacggccttcactcagggacatacagatgcagcaggagaaacggcaccacggcgttgtctcccacagtccgaaaacccggacatcaggctttgccataccatccctgggcgcagcgccagaggttgttggcgtgaaggacaacgttcccaaccgctggtttaagccagagactgacaccccgtcctccatccgctcgatccagattgaggaacaagcgatgaaggacttcaagcgtttctacaccaccgtgaggatcatgaagccacaggtctaggatgagctgctgcggcctggcctcaatcccggaagagttagtcatcttgtttaggctcaccctcccgttgcaatgtacattcaagtgtacagtcagtttctgttaactgtaggttccttgtgtcgaataaagttcaaagcttctcctggctttcattttttgccctgctttttttattttaactttggcaacctttattaaacgatgatcatgtctgttacaagatggaggaataagaaagtcaggagtgtttccttctaaaaaaaaaaaaaaaaaaaaaaaaaaaaaaaaaaaa

SEQ ID NO: 33333 - DNA, 691 bp, Triticum aestivum
  Clone ID: PAT_TA_33333
tgccgggcccccccgcccccccgtggcgcctctccttccttccacgtgagttcacacccggcactcgcttccccctgaggggtatgctgcaccagtcccgcagccacgggcaggattgtcgagtgggcgctggaactgtcaagctttggcctcaagtttgagagaacttcaactatccaaagcagagcattggcagaattcatagcagagtggacgccaacaccagatgaagaaattccagagacgagcatccccgtcaaagaggcaagcaaagagtggctgatgtactttgatggtgccttctcgctgcaaggcgccggtgcgggcgtgctgcttgtcgcgcccaccggagagcacctcaagtacgtagtccagatgcactttcccaaggagcaagcaaccaacaatactgcagagtatgaaggattgcttgccggtctcagaatcgcagcagaccttgggatcaagaagctcattgtcaggggtgactcacagcttgtcgtctgccaagtgaacaagaactaccagagtccattgatggaagcatatgttgatgaagtgaggaagctagaagagcactttgacggcctacagatggagcatatcccaagagctcagaatgtcgttgctatggcctgtcaaagtgcgccgcactaaagttacctgggaaccaggcctcgtccgaattcct

SEQ ID NO: 33334 - DNA, 973 bp, Triticum aestivum
  Clone ID: PAT_TA_33334
cgaattcggcacgagcagggaacgggtatgacgaggccggtccggagacgagaccgactccgagccgaggcagctagggttggcctggctcccctccctccccaccgcccctgatcagatccagctgagagaaatccccccccctccggaaccctaaccctagcaacgagaggcgaggaaagaggcaaggcaaatccaaaatccctcggcgtcgagaagatgcagtttctcagctacgggagcttgtcgcccacgcccatcaccgcgacccaggcggagttggaggcggaggcgattctcaagggcaaggcggaggcggacatcatcaagggcaaggcggaggcggacatcatcaaggccaagtcggaggtggagaaggaggaggtgtccctcaaggacacggcggtggaggagacggcgttcatcgtcaaggccaaggcggaggaggaggcggtgatgggactgaagggcgccgatgcgacctcggactcggaggtggaggacttgtacgacaactgcccctacgactcagacgatgatccagacaccgtgtgcgccaagctcgctgcatggtacgaggagcaggtcaggaagcggcatgctcgccttccctggttgaagtatgactccgccgccgatatcctcaagatgcatggggaggcttccgctttgtacaacgggcagcagcccgtggctgatgatggggttgctccagtggtaccagtctgagaaccagagacgaaggaggtcaccaaagctatccatgtagttatgtatctatatctgtagttgatcctgtgaacatctatgttatccatgcacctagatgtgtgctctcattattgttaagttattagccacccatggatcaatgtcatgtgcgactgataatttatcttatgtaatctgctagtgttcatcatttgggtctccgatcatatgtgagtccctcgccggcccggccacgaattcg

SEQ ID NO: 33335 - DNA, 788 bp, Triticum aestivum
  unsure (1)..(788): unsure at all n locations
  Clone ID: PAT_TA_33335
cgcactccaaccatttcgaccacaacaaccatatccacaaccgcaaccacagtattcgcaaccacaacaaccaatttcacagcagcagcagcagcagcaacaacaacaacaacagcaacaaccacaacaacaacaaatccttcaacaaattctgcaacaacaactgattccatgcagggatgttgtcttgcaacaacacaacatagcgcatgcaagctcacaagtattgcaacaaagtagttaccaacagttgcaacaattatgttgtcagcaactgtttcagatccccgagcagtcgcggtgccaagccatccacaatgtcgttcatgctattattctgcatcatcatcaacaacaacaacaacaaccgtcgagccaggtctcctaccagcagcctcaggaacaatatccatcaggccagggctccttccagtcatctcagcaaaacccacaggcccagggctctgtccagcctcaacaactgccccagttccaggaaataaggaacttagcgctgcagacgctgccagcaatgtgcaatgtctacatccctccatattgctcgaccaccattgcgccatttggcatcttcggtactaactgagaagagaagaactctagtactagatatatgaaacaccgttttcttaatcgacagtttgatcgttgtagcggtgaaaaaataaagtgtcatgcactatcatgtaagaacccgaactatactagttcaaacttgggaataaaagaatacacatgtcttgtctgcatatgattatttgnttgaattc

SEQ ID NO: 33336 - DNA, 1494 bp, Triticum aestivum
  Clone ID: PAT_TA_33336
gacatttcagccatgtcgagcgtatacgcttgcatgttgttcttattctttgtcgtgctaaatccggtgagcctcgccgccggcgccaccaacagcagcggtgcggctggattcagcctgcccctcgtgccccactaccgcactgaagccggcgtactcgaggagctcctgccggaaggtgatgccgagggcggcgtgaacatcacgtccatacgccccaagatgatcccattgacggggcctgtctacagcgtccgcgtcggcgtcggcagcggcgaaacccagcacttctacaagctcgcgctggacctcgtccgccccctgacgtggatacggtgccgaccatgcatactggagaagaagcaggagggctctatcttcaacaccgccgtctcccctcattaccacgccattgcgtccacagaccgtcgctgcacggccccatacaagcgcggcagccggggccggtgcatcttcgacgtcaagtaccagtaccacggctcaagcgcgccgggcttcctgagcaccgacaacttcgccttcgacggtagcggcccccgggagccacatccagcggtgtggacggcctttgtcttcgctcgcgcgcacttcacgcaccagttcgacaaccatcggtctttgacgggggcgcccccgccagccccaggagccccgtcgctgcttcgttccccggctgcgcgcactccacgcaccagtttgacaaccacggcgtctgggccggcgtcatgagcctcaacaggcacccgacctccttgatccggcagctctcggaccgcggcctcgccgcctcgcgcttctcctactgcctcgtcggcaaggagcacgagcacctccaccggcgtggcttcctccggttcggcgccgacatcccggaccaaccgcacgcacggagcacggcgctgctgcacggggaactcgcccaaggagggggcatgtactacgtccacctcgtcggcatcagcctgggcgggcgaaggctcacggcgatcacgccggcgatgttcgaacgcgacccgcgcaccctccgcggcgggtgcaccgtcgacgttgggacgtcgcacaccttgctggccccggacgcgtaccatatcctggcggccgaggtcgtggcgcacctgcagagccgcggggtgcaccgcgcgcccgggccggtgcagaatctcaagctgtgcttccgcggggcgtgggacagtatccgcgcgcacttcccgagcgtgacgctccacttcgacccggaatcggccgtgctctttatcaagccggagctgctgttcctggcagtgacgcatcagcatacccactatgcgtgtttcaccgtcgtgccgtacgctgagaggtcagtgatcggcgcggggcagatgttggacacacgcttcacgtttgacctccaacacaaccgcctcttctttgctccggaggattgccatctagacactagcgcagtggggatgacctaactagctacatccctat

SEQ ID NO: 33337 - DNA, 2227 bp, Triticum aestivum
  Clone ID: PAT_TA_33337
gccggccgggccgggacgagaaggagctggcgcggatgttcccgcagaaggaggcgacgttccaccacctcggccggtacctcttccacccgacggacagggtgtgggggatcgtgcggaggtactacgaggcgtacctcgcccgggtggacgagaagatcgggttccagatcaggatcttcccggagaagccggtcaagttcgagaacatgtacgaccagctcaccaggtgcatcagggagcagcgcctgctgccggagctcggggagccggcgtccccggcggcgaacgcgaccggcaacgacgggaaggtgaaggctgtgctgatcgcgtcgctctactcgggctactacgacaagatccggggcatgtactacgagaacccgaccaagacgggggagatcgtggcggtgtaccagccgagccacgaggagaagcaggagtacgcgtccaacgagcacaaccagaaggcgctggcggagatctacctgctcagctactgcgacaagatcgccatgagcgcctggtccaccttcggctatgtcgcctacggcttcgccggcgtcaagccctggatcctgctccggccggactggaacaaggaggtgtccgacgtcgcctgcgtccggtccacgtccgtcgagccgtgcctgcactcgccgccgatactcgggtgccgggccaagaaggaggtggacgtggcccgcgtcaagccctacgtccgacactgcgaggacgtcgggttcggcctcaagatgttcggtagctaaacaatgacatggagctataagtaaggtttttcagtttttcttcttcccccagtggattaattaggtgtttgggggatgccctcttacattcgtttcgtactgtattcaaattcgttctttgtacaacatgtcgcatccgtacgtacacgcctatacacagaccgctatttgacctccgattacatgctcaagaacggcgtgatccggcacgacacgccggcggcgtcgctgccggcgcacgtgtacctccacgtcgagcagacccggttgcggctgtcggacaacatcttctgcgacgacgaccagcggctgctccgcaagttcacctggatgatcctcaagtccgacagctacttcgcgccggcgctcttcctcacgcccatgtacgagaaggagctggcgcggatgttcccgcagagggaggccgtgttccaccacctcggccgctacctcttccacccgaccgaccgggtgtgggggatcgtgcggcgctactacgaggcctacctcgcccgggtggacgagaagatcggcttccagatcaggatcttcccggagaagcccgtcaagttcgagaacatgtacgaccagctcacccggtgcatcagggagcagcgccttctgccggagctcggcgacccggcgtccccggcgatgaacgcgaccggccacgacgggaaggtgaaggccgtgctgatcgcgtcgctctactcgggctactacgacaagctccggggcctctactacgagagcccgaccaagacgggggagatcgtggcggtgtaccagccgagccacgaggagaagcaggagtacgcgtccaacgagcacaaccagaaggcgctggccgagatctacctcctcagctactgcgacaagatcgccatgagcgcctggtccaccttcgggtacgtcgcctacggcttcgccggcgtcaagccgtggatcctgctccgcccggactggaacaaggaggtgtccgacgtcgcgtgcgtccggtccacgtccgtcgagccgtgcctgcactcgccgccgatactcgggtgccgggcaaagaaggaggtggacgtggcccgcgtcaagccgtacgtccggcactgcgaggacgtcgggttcggcctcaagctgttcgatagctaaacatgacatggagctaggatcgtcttcggttcagttctacgttccgaaaacagcataagtaaggtttttcaattcttcttcttccccctgtggattaattaggtgtttgggggatgccctcttgcattcgtttcgtactgtattcaaattcgttctttgtacgacatgtcgcgtacgtacacgcgtatacacattacacagatcactatttgagctccggctatacacctacacatatcattttctttaccgacatattcaaaaaaaaaatctgacactagatttttaacgaaaaaaaaaaaaaaaaaaggccccta

SEQ ID NO: 33338 - DNA, 1755 bp, Triticum aestivum
  unsure (1)..(1755): unsure at all n locations
  Clone ID: PAT_TA_33338
agaangnngttgntcccctgctcgaaatnaaccctactaaagggaacaaaagctggagctccaccgcggtggcggccgctctagaactagtggatcccccgggctgcaggaattcggcacgagcggtgacgtgcgcgatcgcggcggtgatggtggcgcggcgggtggcggccagggcgcgctggcggcgggcggtggcgctgctgcgggacttcgaggagggctgcgccacgccgccggcgcgcctgcgccaggtggtggacgccatggtcgtcgagatgcacgcggggctcgcctccgacggcggcagcaagctcaagatgctcctcaccttcgtcgacgcgctccccaacggggatgaagaaggtgtatattatgccattgatcttggaggaatggactttagagtcttgagggttgaaattgatgttggatctacagccgttattaatcagagggttgaaactcatgccatctctgaggagttgatgggcacaagtcaggatttattcaactttgttgccttgacactcaaaaattttgttgaaagagaagatggaaaagatgcccaaaagccacttgggtttacattttctttccctgttagacagaattcagtttcttcagggtcattaattaggtggaccaaggggttttcagttggagacacagttgggaaagatgtctctcagtgcttagatgaggcgcttgctaggtgtggatcaaatatgcgagttactgcactggtcaatgatactgtggggacattagctctagggcattattattacaaggatacagtggctgctgtgatcattggggccggcaccaacgcttgctatatcgaacgcactgatgcaattatcaagtgtcagggtcttcttacaaactctggaggaatggtagttaacatggaatggggaaatttctggtcatcacatttgccaagaactgcttatgacatctctttggatgacgagacacaaaatcgcaatgatcagggctttgagaaaatgatctcaggtatttaccttggggaaattgcaagactggtactccaaagaatggcccaagaatcagacatttttggtgatggtgccgaaagtctgtcaaccccttttattttgagcacaccatatctggcagcaatttgcgaggacgattcacaagatctgagcgaagtcagaaggatactgcaagaacacctgaagatccccaatgcccctctgaagactcggaggctggtggtcaaaatctgcgacatcgtgacccacagagctgcccgtctcgccgctgctggcatcgtgggcatactgaaaaagctgggccgagacgggagcgccagcgcggcctcctcgagcggaagaatgagagagcaaccaaagaagacggtggtggcaatcgagggcagcctgtaccaggagtacccggtgttcaaggagtacctggatgaagccctggtggagatcctgggcgaggaggtggcgcagacggtgacgctgcgtgtgatggtggatgggcctggtaccggggccgcgcttctggccgcggtacattcgtcgaatagacagcaacaacaaggaggaaggggaggaggttccatatagggaagtggtggatcagagagacatggtgatacagcttggccctctgtgcaaatgtaaaaagggacattatttgatatctataattcatataatatatatatgaaatcgggtcatgtgcagagatgtctccccgttcggctcaataata

SEQ ID NO: 33339 - DNA, 2015 bp, Triticum aestivum
  unsure (1)..(2015): unsure at all n locations
  Clone ID: PAT_TA_33339
gattncgccaagctcgatattaaccctcactaaagggaacaaaagctggagctccaccgcggtggcggccgctctagaactagtggatcccccgccccgccgcgcctcggcccgacagtccgtccccggccgcgaaatctcaaaaccctagccacgacgctctcccctcccggcccccctcgccgctcccagactctgcgcgcagcgtgacccccgggctctgttggtaccacacggggtaccggcagaggagagggttagggcgccctagctgaagcggcagccatggcgtcgtctgtgctggaggccacgcgggcggcgcacgaggacctcgagcggttagagcgcctggcggtgcgcgagctgcagcgcgaccccgccaacgcgcgcgaccgcctcttccagtcccaccgcgtccgccacatgctcgatctcgtcgtctccacttccgacaagctggtggaaatctatgaagacaaggacggtgctaggaaggatgagatctccacccatcttaccgcgccggtgcaaagtgacatcttccccaagtactatgaaaggctgaaagagattcgtgattaccatagacggaatcactctgcccgtttcgtcagtgaaactgatgattatgaggagctactaaaggaggaaccagctattgaattcactggcgaggaagcatttggccggtacttggacctacatgagctctacaacgagttcataaattccaagtttggatcactaatggaatactcggcatacgttggcacttttgctcagactgaaaaaatcgcacataatctaaaagctaccaggccatacaaagaatatttggagcatattttggaatatctgatgtcgtttctgtatcgtacagaaccgttgcaagatattgagaagatttttacaaagttggaaagtgagtttgaagaacagtggaccaatggcgaagttcctggatgggagaataagggcacagagaaagaatctgtgttgcaagagtctgcagtagaccttgattactatagtactgttgaagagcttgtagagcttggtccggaaaagttgaaggaggctttaactgctcgtgggttgaagggtggcggcactgttcaacagcgtgctgagcgacttttcttgctgaagcatacacccttggaaaaactggatcgcaagcattttgccaaaggtgatgatctgaagaaggaaattgctttgattgaaatgaagatgaagcgcttatgtgagattctcgatgaggtcattgtaagaacaaaggaaaacgcggagaagaagctgaccttgacctatgaagaaatggaagcagagcgggaagaggaagaagtacaagctgatagtgaaagtgatgatgaagaccaacaaatctacaaccccctcaagttaccaatgggctgggacgggaaacctatcccttattggctctataagcttcacggtcttggtcaggaattcaagtgtgaaatatgtggtaaccacagttactgggggcgaagggcttatgagcgccatttcaaggagtggcgccatcagcatgggatgcgatgccttggcattcctaatactaagaacttcaatgaaattacatccatcaaggaggcgacggcactctgggagagaatacaagcaaagcaagggcagaacaagtggcggccagacttggaagaagagtatgaagataaggatggaaacatctacaacaaaaagacctatactgatctgcagcgccaaggcctgatatagaattctgcatgtgattctcgtgctttggaaggaacgcgacgctaaaatcgttggtctactgttctattgatacctgctgaacttgatggtcgttgtgactttttattagcttacattatatgtagccagatggcacctcggagttacaatttccttctttgggttacattgcatattatgctttactggccgatcttcctgagctccccgtgccgattccccaaatctcctgtctcaaaaaaaaggggggg

SEQ ID NO: 33340 - DNA, 1736 bp, Triticum aestivum
  Clone ID: PAT_TA_33340
gtggagctctcgcgcacgccatgtttacgctcagtctggggaacacaagctggcgcacgcccgcgccggcgggcgccccaccactaggggcccccccgcctcgcgggcagtgggactgaagaactcctaagaacgcctagtcaggggacgtatcttgctccgtctaccatggccgaggtggtggcggcaacggcagccgcgaccatgggcaaccacaactctcgcgcctcgcacgcgagggactggcataatggggcagtgcggccggttcgtgagcccgtggcccctcggcgcccggagtccgaggcgcggagcctcggcatcgcagggatttgttcgtcccacggcggggaactcagcctgtcccacggaccccccccgggggacggcgcgccggacggggaggggcagcgcgccggcgaggccgagcaccggcccgaagccgcaggccaggtggccgtcgcgcgaggcgggagtgcgaaaaaggccaaaaaggcggaaaaggggaacaagaagcagacggtcaaggtcgggaacctgcgggatcggcgatcggtcagcagcgccagcgccggctggcgagccgggcaagttggcggcgcccgtcgcgacgatctggacggccctcgctggggggaaggaggcggccccggaggacctggagcggggatcgtccggtgcagcgtcgggggccggagtattgcgctggcgcatgcagaccggaggctggctccgtctcttcggcgattttgacgtcttcgaccccagggccacttcaatcctgacctggaagtggtaccttaacgccaggaggtaggtaagcccggagcccggcggcccagccagggaccccatcgccacatcgctcgcccccgtcgcgctcgcaggagtggcgtcaaccctgtgcacctatcccatggagctcgtcaagacccgtctcaccatcgagaaggacgtgtacgacaacctcctccacgcgttcgtcaagatcgtgcgcgacgaaggcccgggggagctgtaccgcgggctggcgccgagcctgatcggcgtggtgccgtacgcggcggccaacttctacgcctacgagacgctgcgcggcgtgtaccgccgcgcgtcggggaaggaggaggtgggcaacgtgccgacgctgctgatcgggtccgcggcgggcgccatagccagcaccgccacgttcccgctggaggtggcgcggaagcagatgcaggtgggcgccgtgggcgggaggcaggtctacaagaacgtcctgcacgccatgtactgcatcctcaagaacgagggcaccgccggactctaccgcgggctcggccccagctgcatcaagctcatgcccgccgccggcatctccttcatgtgctacgaggcctgcaagaagatactcgtcgacgacaaagaagacgagccccaggaggagacggagaccggacaggcaggaggacaggcggcgcccaagagctccaacggtgctcgcccatgaacgcgatgaagcattatggtgaccgtcaaaatcagaagaaaatgcgtgatttgaaattttgaagtgtagagcctagtgcgattgaatcctaagctggaagtggcgccttagaagttgaatttcgttttgttcagggaacatgctctgtttcagtaatgccgaagattgatttatggcacctttctgatcaattcaataagaaagaagtccacttttggaccttcaactttgccccaatctc

SEQ ID NO: 33341 - DNA, 934 bp, Triticum aestivum
  unsure (1)..(934): unsure at all n locations
  Clone ID: PAT_TA_33341
tctattgatgattataatgcatgtgtggtggatcatgctgcagtcagcacacataccagcacagcaacagtgctgcacggcaattgaggcgaaggtgcagctgtcataagttgagaagcaaattgacaggctgtttgaagatgctttgccgccaattgttgagacttgggatgcagttagtgattcttgtctccttaacaagattgtaatggatttagagggttatgctactccaaaatgatttgatccattgttggcaacaaatggagcatggtgcgcaatattcttgctgcctaatgggctttgccagcaagactgttttgtttcttgactataaatagagtgtgctgcagaggcctgagcaccaacaaagcacatctgctcttctctttctcttccatttcaaacagaaacacatcatcacttcatccattagaaacatggcttgccatcaaagatctgcaagtttgccttctattgctcactccagtgaatccaaagtggaggtggagctgcagggcctgaagtcatgcatctcttcaccctccgcaaccatcgacacaatgtgtggtggttacgcaaggcttggagacatctacaagtgcatagaggagatcatgggcttgcccagcaaccaagttggcctctccttcccccaaaacaagaaaatggtggaagaggaactggagcgatccctcctgctgattgatctctgcaactccatgcaangagaatttagcaagagctgaagatgagtacccaggaagctgcaactggttctcaaaaagaggagatgatccggctgttcaactcaaaggttgagtccttcatcccccgcgccaaccaggcgcggaagcctttcaagaagttcgcaagcagcaaagctaggggtggggattgcaggctggccaggctacgggcggcccaaaaaatt

SEQ ID NO: 33342 - DNA, 943 bp, Triticum aestivum
  Clone ID: PAT_TA_33342
ggatcttttgggcatacaagtgacagtatcaaaagagtgaattcagatggcagcatcctttctgtaagcaacacatctatatctggctgtagtggctgccataatgaattgttgactgcagcgcaacctgatgtcagtactgagttgcaaccttcaaaaatggagtctgatttggtgtatgaaaatgagattacgtcacccattgaaagtaaaatgtcaaattcaagatacacccccacactgcctcatgatcatatacatgatgtcccaagcagtcaacttgacccttgcaattcgggcgattcaaacttcctggatcttgaatggctttcaaattcaggcaattcaagtgatgaaaggtcgcttgcagttagcacaccagatgctcacctttcaaccgagaatgtcattagtgacataattcctgaaactatggaaaaccaagtcgcgggggtccaggctcagaagctacccgagcaattcgtgcagtgggttaacgatggcgacagcttttggttttgagaccactctggtgctgtgccatgcatgcctggttgcttggaaggccaagcatctcttttccaaacagtcgccagagcgctttgagttagcagattaggaggtgggaagtgatggtgggttcaagtacttcagtcgggttgccgtgtcataccatcccggatttcgcccattccacctgaggggcaatgtgcttaaaagggacaatgttgtcgcctaccatccccggtccccttgagggaagcatacagttttgtttatttgttctatgtttgtacttagaggagagtagatagagttttttttcattttgaatagaaaatagatatagggtatgataatgtgcttttcttttaaaactgtgtattgtccgatgggagtataaatattcatgtgtaaatatataatatgcgagaagtgcatg

SEQ ID NO: 33343 - DNA, 721 bp, Triticum aestivum
  Clone ID: PAT_TA_33343
cagtgttttgctttttggatacatgaacattgaaacttgtttagcatttcgtttcttatatgcttcatgccaataaaactgcagtaaaatatgaactgagattttgcttggcatgtgtatgtatgcatgccctgaatttgcttagtctttttatgcatacaactattggaagcttttacatgtcctggaactgagcttttgcatgccctgtgtattctgaagattagtcttttgttattgggcagtacttgaaacagagtcgttggcctcctgccatataaccatttatgaagtgcatatgtgatgccttatcttgtattcctacaaatagtccagtatttttttcatgtgtaaaaagtggctgacctggcattacactgttttgtgttttgtacgcattatgaaccttgctatagatacacactgagctgaaaatgatgctagcagaaattggtgttctgttagctacgcatctgttttaaaacatgacatgactatatgaaccgagttcactatctgatcgaattttttgtcatggagggttatttctagacaaatcttttcgaaccaagttcatatacaactcaaagtcttgtgcatggaggagaattgagatacttgctcattccgtactagtcgatacgtatgtgtagattatctgctcattctggttgatgctactacttgattaatgtcttctttacgagcttctaccttgtgt

SEQ ID NO: 33344 - DNA, 957 bp, Triticum aestivum
  Clone ID: PAT_TA_33344
cgacgacctcgacgagggcggcggcaacgccgacgacaggtgcgagaggatgtgccagcactaccacgaccggcgggagaagaagcagtgcatgaaaggctgcaaatatggcgagtcgggcctcctcggctccgacgacggccatgaacacggagaccgctgccaaacacagtgcaagcgcttccggcccgggtcatacgacaggcagcagtgcgtcgaaaagtgccagtgccagcagaaggaggacgaggaggcgatggaccaccacagcggcggtggccatggccacggagaccgctgccaggcacagtgcaagcgcttcccgcgcgggtcgtacgacagatggcagtgcactgagaggtgccagagccatcagcaggacgacgaggaggtgatgaaccaccacggcggcggtggccatggccacggcggcggcagctgcgagcagaaatgccagcagcgataccgccatgagcacgacaagcagcagtgcgtgcgagactgcaaaagcggcggtggcggcggcgccggtgggcgtggccgcgagggcgacgagcgccagcacggcagggagatggtggtcgaagccatcctcgaggaggtgtagtgtaacgcctcgatgaaagtagccagctcagctctttccaggatcctcgacctttttaccgctcctgcatcttgctatgcgtacgtggtaggtgcatgtgtgaactagaataaattgcggtaactagaagtggctctccagccttggagagagcctgtgtacgaggaatcaatctggaaagcaatgtggtgatgtgtcacgtgtgataaataaaataagcaacgtttcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaatacaatagagaa

SEQ ID NO: 33345 - DNA, 1033 bp, Triticum aestivum
  unsure (1)..(1033): unsure at all n locations
  Clone ID: PAT_TA_33345
cctcaacctgttttaagctagggcagcagccatgggtgtcaagtgtggtgtgggcgtgtggtgtctcctgctcgccgggctccttctcctggccgtggcctccgcggcggagcgggacacgaggagaaggaggaggagatccggtggtgcaaggaggactgcgactggaaggcgggggaggacaccgggaaggccagggagtgcaaggagcagtgcgagcgccgccgccacggccacgagctgctccaggaagacggcgacagcttcgacaggtgtgtgagcaagtgtcgcggccatgggggctggtggggaaaggagcggtgggaacggtgcaggcagatatgcaggcaacgccaagaaggggaggggggcgacgacgacttcgacgagggcgacaacgccgacgacaggtgcgacaggatgtgccagcgctaccacgaccggcaggagaagatgcagtgcatgaaaggctgcagacatggcgagtccggcctcctccgctccgacgacggccacaaacacggaggccgctgccaaacacagtgcaagcgcttccggcccgggtcatacgacaggcagcagtgcatcgaaaagtgccagtgccagcagaaggaggaggaggaggtgatgaaccaccacggcgggcggtggccatggccacggagaccgctgccaaacgcagtgcaagcgcttcccgcgcgggtcgtacgacaggtggcagtgcactgagaggtgccagagccatcagcaggacgacgaggagctgatgaaccaccacggcggccacgaaagcagcagctgcgagcagaaatgccagcagcgacaccgccacgagtacgataggcagcagtgcgtgcgagactgcaaaagcggcggtggcggcggcgccggtgggcgtggccgcgagggcgacgagcgccagcacgacagggggttggggggtcgaagccatcctcgaggaggtgtaacggctggatgaaagtanccagctctttccaggagctcgacctctttaccggtcttgcgtcttgct

SEQ ID NO: 33346 - DNA, 1475 bp, Triticum aestivum
  Clone ID: PAT_TA_33346
ccccgccgggacactcctcaacgtgtgataagctagggcagcagccatgggtgtcaagggtggtggtgtcgtgtggtgtctcctcgtcgccgggctccttctcctggccgtggcctccgcggcggagcgggacacggaggaggagatccggtggtgcaaggaggactgcgaatggaaggcggggcaggacaccgggaaggccagggagtgcaaggagcagtgcgagcaccaccgccgccacgaccacggccacgagccgcaggacgaagacggcggcatccctgaccgctgcaagagggagtgcgagagccatgaggacatggatatcaagctgcggtgcacgctggaatgctggcgacagcaaaagcgggagggcgacgccgacggcttcgacgagggccgcaacaccgacggcaggtgcgagaggatgtgccggcactaccacgaccggcgggagaagaagcagtgcatgaaaggctgcagatacggcgagtccgacctcctcggctccgaccacgacggccacgaacacagagaccgctggcaaacacagtgtaagcgcttccggcgcgggtcgtacgacaggcagcagtgcatcgaaaagtgccagtgccagcagaaggaggacgacgaggcgatgagccgccacggcagcggcgaccgaggccacgggcaaaactgccagggaaaaggcgtccagcggttggcccgcgaggatcgtgcgagagggtgcaagggcagtggtggctgagccatcagcaggcggacgaggaggggatgaaccgccacggcgggcggcggtggccacgaaagcagcagctgcgagcagaaatgccagcagcgacaccgccacgagtacgataggcagcagtgcgtgcgagactgcataagcggcggtggcggcggccccggtgggcgtggccgcgagggcgacgagcgccagcacgacagggggatggtggtcgaagccatcctcgtaggaggtgtgacggctggatgcaagtagccagatctttccgtggagcgtcgacctctttaccggtcttgcatcgggctatgcgtacgtggtaggtgcaggtatggtgtagaataaattgctgtaactagaagtggctctgcatccttggtgagagcctgagtctgaggaattattctggaaaggcatcttgccaagtgtacgtgacgggtgcatgtgtgaacaagaataaatcgcggtaactagaagtggctctccagccttggtgatgagagccgatgtacgaggaatcaatctggaaagttatgtgctatatataacgaggctatgaaaactaagatgatgtgtgataaaaaaaaaaaaaaaaaaaaaaaaaaaaaaaaaaaaaaaaaaaaaaaaaaaaaaagaaaatctcctatagatgatgtaaatttggagatgtagaactaggtattgtataatttacataatccaaaagggccttttacatcttaaaaaa

SEQ ID NO: 33347 - DNA, 691 bp, Triticum aestivum
  Clone ID: PAT_TA_33347
ccggcccagcgccacgcggaaggtttgaagtacacttaaactcttccgcactccttcaacgggaacaagctttgcagggtgcggaagagtttaagtgtacttcaaaaacaagcaaatatttttgaaaaggcatccacacagttggatagttatttgcaatcaaaggttgatgaatcggaagaagagccgtggtctcttgaaattcaggaattttcttattggattgctcttacccctttatctgacaatcatggagggaccactgaagaaaacaataggactgaaaaaattaattcatctaaagttggatgttccaagcggtggagtagagtgccttctttgccttcatatataccatttggtgagctttacctgttgggagattcatcagttactacactttcagattcagaatactcgaagatgacgtcggctgtgctggtcactctccagcgatttctctcatgattttcgtcggtggtgatgattgctctacacctacttctataggtcacacttcagcgactcctcttgcgacctctgcacatggtgcagtctgttataatggagttaagagagcgtcttcagtcacactcgatgaaatcctacagagcccgcttccaaaaaatgtatcatgtgtgcatgtgtgcaaatgcccccctatgtacgggccacgagcactacaacattt

SEQ ID NO: 33348 - DNA, 858 bp, Triticum aestivum
  Clone ID: PAT_TA_33348
ctccaccacccaccagcacagccgccacccaccatgcatcatccctcgcccttcctcttcctccccctcctcctcctcgccgccgcgcctctggtcgccaccgcggcgacgttcaactgcgtcggcggagtatacaaggccaacagcacctacgaggccaacctccgccgcctggccgccgtgctcccggccgagaccgcctcctcccaggacctccaggcgacccgcggcgtgggctactggcccaaccggccgcgggcctcctcgcggtgctactggggcgtcggcccttcctcctgcgccgcctgcgtcgccggcgccttccgggaggcggagagggcgtgcccgtacggcaagaaggcggtcgtcttcgcccgcaactgcactctcagcctcgccgattttcctagagctctcggcttccgcaccatcagttggtttgacctcttgggtccgggactcatatttcaagcaattggatttgcatggcttttcttcatgcttctgcaagaatggcgtgataaatgaatagcctctatgatgcgttgtagctctcttccatctggagatcagtagctgatcgacttgggtcagactattggacatcagcctattcccaacaagaggaaacactaaaatcgggctctacaacaacgctcacacgattacctgaatcaagatctaactcttaagcaacagtgatatgactacatggtattgtgatttgatggtttgttctttgtggtgggagtgtttaatattgtcctccaatttgaatgttcgcattggttacgaataatttgcaaggtccacttcattcgttgtgttgctttcaaaaaaaaaaaaaaaaggccccta

SEQ ID NO: 33349 - DNA, 205 bp, Triticum aestivum
  Clone ID: PAT_TA_33349
cgcaacactatactggttctgggccggcaaaactgatgatgctgaggcttgaacttattaggaagactttaggacgcgatattggttcgtgcatgaaatttgtttttttcttcttatacatgtagatagtcttgtttttgtcatggtaatatcccctgatggtagcgtcgtggaggtcaataattcaacttgtgacttgagaaaa

SEQ ID NO: 33350 - DNA, 429 bp, Triticum aestivum
  unsure (1)..(429): unsure at all n locations
  Clone ID: PAT_TA_33350
aacacaggagaagcaaagagatcactggcccgctttcatgaaattcaaggaatcggaattagctcaggaacggtcgagaataaacaagatcaatgccgcgaaaaaggagcattaccataagctggggctaggtgtctacgtggtggcccggcctaagtgggataaggctgagcaacagatggtgtatgcaggggtcattccagttacattgagctggccccccgggtccaagacttggttctatatgcatgggaggatattggacccaaagacaggccaggttttggagaaaggcaagtcctaaaggagcccacctcaaaatacttgttgcaatagaagaagctcgaacggggggtgttcacgcccaacagagagaacgacgagcttatgggcgccctgngaaatcatgaacacccggggaagaacacg

SEQ ID NO: 33351 - DNA, 315 bp, Triticum aestivum
  Clone ID: PAT_TA_33351
cgcccccagagcaaggacggcaatgaacccaacgaaggccaagtggtgctttacaagccccgtgctgatgtcttcctcagcttcgttgacaagggccctgaaagcgagaagggtgtcagcttgaaccgtgttctcaagcgcttccaccgagagcgtgaggccaacggcagtgagctgggcaagggcaaggaagagaaggagctttggagatcactccgactccgacagaatgaccaaggcgagatcgtcctgttctctgtcgagtaagcgccaaccgagcctgggcaaaaccaaacaaggtaaaaacccaccaac

SEQ ID NO: 33352 - DNA, 634 bp, Triticum aestivum
  Clone ID: PAT_TA_33352
ttgacacctgaataatcatgctggccaaatggagcaccttctcattctgccccctcaatgcttttcccccgttcataatactgctgttggcggctgcgtacatacatgtgccagccactgctattgttgctgttccaagtgctcattgatataccttcgacagtgatagccaccttgttgacttcacacacctgtcccggaaggatttggaatacaatgaggagggctcagtaacttctgacttggttgtccagttgtgcaaagatgtgcagacaaggtctcaggcgggtggtttcattgactttggccgctttaccaatcatcgctcttttgagaccggttcaaagccgattgactacatccagagatttcacaatggtgatttagcgaaatgtgaaactacgtttgaagagatgggccgtactgcacaggtcaacattatgtgtggacgatgctcaaataaagtatgcaaagatgaacatggatgcatttgcggcgtatcctatgatgaaaggatgtgcaggacggttgttgagctagccattccttgtcctaaaagaggtccaagagtttttacgggtttcactcgtgggcttcacccccggtcagcacaagtggtttacaatggattgac

SEQ ID NO: 33353 - DNA, 716 bp, Triticum aestivum
  Clone ID: PAT_TA_33353
ctttttttttcttttttgcatttaaccggataatttagaaagggatgtaacggacagggttgcatgtatacataaatgtaggcccaaacgagtgaccgggttcatctgcggatgtttggggatcaaaattaggcaatcctggttgtagatgctcttacactagtgccgtctactaggcattcttcaataacaagtgcatgaaatacaactatacgttaataaaacaaccgaattaaatgcatcacggcttccgcagggctgatgcagctcccattattacagccattacaatccccaggcctgcaccaagtgatgcacctactgcagcagctgtgacagatccatctctttttcgtgtgttctgcttagcttgacgagacaccgccttctctcttgcaagctccagggacaatttctcacgagcaagctcctcaaaagctggttcttcattactcacaatcacttgatgtagatgctgttgaagggcagcaacaccctccacatgcataacaatgtccttcctatgaaatggtgacaacgcaaagtttactgggtgaaaagcggctctgccgaaagaaacctactccaaatcgtcactggtagaactgatgggatgcagactatttttagcacttggcattagaaatggtgaagggtggtctacccgggtgttgtcaggagaagctttatatgcttccatagctgaactgattaat

SEQ ID NO: 33354 - DNA, 1074 bp, Triticum aestivum
  Clone ID: PAT_TA_33354
gcggccggccggggccgggatcaactcctaaacttcaacacccaagtcgtcgttgagccaataccgtcaagatgcctttcaagttggtcaagaacagcgcgtactacagtcgctaccagactaagtacaagcgccgccagcagggcaagaccgattactacgcccgaaagcgcctcatcacccaggccaagaacaagtacaacgcccccaagtaccgcctggttgtccgcttcaccaacaaggacatcatctgccagatcgtcacctctgagatctccggtgacaaggtcttcatctccgcctacgctcacgagctcaaggcttacggtatcgagcacggtctcaccaactgggccgctgcttacgctaccggtcttctcgtcgcccgccgtgccctcaagaagctcggcctcgacgaggacttcgccggtgttgaggaggccgatggtgagtacaagctcaccgaggccgccgagaccgacgatggtgagcgccgccccttcaaggtcttccttgatgttggtctgaagcgaacctccaccggtgcccgtgtctttggtgccatgaagggtgcctctgacggtggtatcctcgtcccccactccgagaagcgattccccggttacgacatggagaccaaggagctcgacgccgacaccctccgaaactacatcttcggtggtcacgtcgctgagtacatggagaccctcgccgatgacgatgaggagcgtttccgtagtcagttccagaagtacgtcgacgacgacgttgaggctgagggtcttgaggacctctacaccgaggcccacgccgccatccgtgaggaccccttcagaaggttgagagtgacgctcccaggagaagcgtgtccaggagcgcatccaggagatcatgcagcgggattaaaaagttgctttatctcattgggtcacgggcatttgaggattgttggcctttgcattgggtttggagtttcgaggaaagggacggtccataaaaagggccatatgaatgaattaccaaaaagataccttccagccaaattccatagttctggtgaaacggcatctcatt

SEQ ID NO: 33355 - DNA, 633 bp, Triticum aestivum
  Clone ID: PAT_TA_33355
gcacgaggccatcggagttggagctaggagaaggagttctcgccgcaaagcatcctgcaggctaggaaagaaaggaagaagggaggggcacatgacgtgcgcgctggcaccgggctcgccggtcttctcgccgtcccgcctcggcctgttggagcagctgcagctccacaaccaccacggctgctccagcggcggcgcctgcttcctcccctcctcgcctctccgccccttcgcccacctccgcgcgcgcatccaccccgagccctccccgtgcgccgtccagccgccgcccgccgccaaggccgcggacccttcctcttcccctgctgttaaagccccggtcaagcgtcgccgcccggcgcctctgctcgtgccggccgcggccaccgtcgcgccggcggtgctggaggccgccgcggcgaccggggtggaggaggtggccgagcagggcgagggcttcgcggccttctgccggaggggcaagggccgcaagcgggtcgagatggaggaccgccacgtcgctgccgtcgcgctcggcggggaccgcgcgcaggccctcttcggcgtgttcgacggccacggcgggaagggcgccgtggagttcgccgcggacaacatgccgcggatcgtggc

SEQ ID NO: 33356 - DNA, 1241 bp, Triticum aestivum
  Clone ID: PAT_TA_33356
gagttttttttttttttttttaaggcaatcaaccaagccttaggaaggcagacatagtgaacaggccatttgacacacacttcccatgttacggtacaattttacaccccaaaagggcgacatccacgtgtgatccacatgagagatccacattatggttctctttttctagtcacggaacagtaatggccatccagatgctttttctctcgtctcgcaacaagccatgggcttcacctggctctataccaggtccccaccggcagttgccatcacaatggccagctgtcagtccactatgcaaggtgtctacgggacacccaggctggggtctggtgggcttactggctatgccaacctccagctgtcttctcatggactcacagcttctgccttcctccatctgtatctcaagtccctgctgttgcttgtgggttagtttccattcccattccctgttctttagcttcaagtttaagcagatcaatttgattctgtagatcaacacagggcagcttgaatagccatgtttttctgacacagttcctgccattctactgtcaaggcatggagttgtccaccagtgttttgctgatgaaatttcctctcacggttgacagtttctatcttttcattgtattccagagtcattttttgtgtcctagacaaaactgattccatttttctgttctggagcttccaaacctcaacaccgtgcttcagcataagctccagattctcaatccgcacaatttgatgctgcagctggctctgggcattccgtaaagcctgcctccaagcaagaacatcattcctcttgttcgctgggggtggctccaaaccatagcgggacatctctatggtagcaggtggcttgccagctctaacacgttcgtactctttcgcaagcataggatgattctcgaatccaatgatgggaacggggggcaagtcacggaggaagtcggcgggcttgcggtgagcccggcgcatctcctcctcgacgaggcggtcaacctcgcgcttcaccgcagggtcgccgtagtccccgtcgatgtagggcagcgcgtccaccgtctcagcgtccggaggcgggcgccaaggcacacccgcagcctcggacggtggcgcctccagcataagcacctccctcgtcgccgacgaggccatcacggcggccgcgcgtgagcaggtagccgcgagccagagagagagggagagagggagccctcgtgccgaat

SEQ ID NO: 33357 - DNA, 898 bp, Triticum aestivum
  unsure (1)..(898): unsure at all n locations
  Clone ID: PAT_TA_33357
gcatgtcacattactaatggatcaagtgatttctaccaagaatccattcaatatagatgacaccaggagtgatgacttatttgagcttgcttctggttaccgtttagaggcaccaaatgtttttgaatcagagcaggaagttgactctacatctaagacagtttccaaccaaaccagcgttgctgatgggaaacactgtccgacctcagatgatcgcatggtagctgtgtcatgtaaaaatggatatgcagttgatgcagaagatgcgtcggtcagtagcagtgcagatcctgcgaagaacgttttcttgcatgatgccttggtgaaccatgacaagaaggaaggtgaatcacatacaaatggcatcatcgatgcaccatctcaagtatttccgacagaatttggcacaatgcccgtctctcaggagatcaatgcagtcagcacacatgttgaagaaaagactggcacggaagacaccaaagcaaaagatgagactccggtagagaatatagatgactcagaagaaaagaaacagactgaagatgctagtgcgaaggagatgactgcagtactgcactcagataatgtcgaagaggataaactggctaaggatactggttcaaaggaagtgacagcagtgcaaagcacagaaaatattcatgaaaaggttcagactgaagacgatcgtgcaaagaagattgatggagaatttaacacagctgatgttggcaacaggcagactgatgtcgccagcaaagaagagaaaacagatgaagtgcaacagacagataatgctgaagaaaagagcaggctccagaaactactgcaaaggagacgaacgcggtgcaaagcagggatcaagctgaagagcgaagcaggctganaggacagtcggtct

SEQ ID NO: 33358 - DNA, 1253 bp, Triticum aestivum
  unsure (1)..(1253): unsure at all n locations
  Clone ID: PAT_TA_33358
attcggcacgaggggatatgtcaactattgactctgcaacggtttcacggaatgctcatggaagaattgagagagttgcttcatttgatcgtacagtatggactgctgattgtaattctgatggcacacaagtagttctaggtacaaacactggcgctggtttgcttaatttggagacagggacattatcatggctgtatcgttgtaaaagtgacattctttcccagcaatttgtgcactcgggaaatgtggtgctatgtggcctacggaatgggagcatagtccctgtcgatgtgcgggaaaggcacagtagtcgccctactggtcgatcttcacctagcactgctagggggacagttcccatgctgtctgcaaggcataatgccagagggagaaaccaggctgataaggcaaaatcatctagggttatctctatgccttcagcagtttgcagcctggtttctctgtcatcggatgaacactacttcttagggagttccatggatggatcgatcaagctatttgatctccgtctcattcagaagggggctatacagtcttatgcagggcatgtgaattcacacaataatttaccacttgttgttgatccatctgaaaccctacttatgtcaggtggggaggactgtaccgtccgtatttggagcatcaaaacaggcgagcaaatatttgcgaagagcgtggctgacactctcttcactgcactttgctggccagaaagcaaccttgacttggatggttcttcttcgctgtttgatctaaaccacagttggggggcttggatgggatcacgtgatggcctgttctacatgcatggtacttaaactggctgtgcactgatacaaactctggagcggacggatgcaattactgctttttcttcgggaagatgcatcgaagacgattgatcctgttggttggttcaccgaaaagtgtgctcaagctggtgtcgctggagggatctcagcagtcgtagttgatcctgttggttcttgaagcgagggttagttatatgggatctgctcctcttagagtaatagtgatgatgatcatgttgtttctcttagtgataggtaagtcacctgtctagtttggtatctgagttaccttaggaaagcagacaatattgtatcatatgcttttttagcatcgctagttagtcagcaatgtgatattttctgcaatattagcaaacnaacatatttctgaactctgtttgtattgcnagcatcata

SEQ ID NO: 33359 - DNA, 261 bp, Triticum aestivum
  Clone ID: PAT_TA_33359
tgggacacttgtatcattcaattcttaatttctcctccagctgttgattacacatggtgatgctggtacaaagggtgccctaaaagacgagcatgtatttgcatccgcgaaatgtcaggccttagcagagcttctaccttctttagcaaatgatggtcaccgagttcttatattcagccagtggaccacaatgcttgatatccttgaatgggcactggaagtaataggaattacatataggcgtctcgatgggagcacccc

SEQ ID NO: 33360 - DNA, 918 bp, Triticum aestivum
  Clone ID: PAT_TA_33360
cccgccgcggttccgcaggtcttcaacttcctcgcctccttgcgcgatctgcttcacgtttcccctcaccgctccattcgcgctgcacgtttgcacggcgagcaggcatggccgcaatggcgaggagcacgcggtcggtggcgacggagcgcgcgtaccaccacttcgcgccggcgtcgacgcgcggcctcatggggtacccggccacggcaggcggccccgtcacggccgacgagttcgacgagtcagacgtctgggggtcgttcaacccgggagaggaggccgaacaaccggcaaggtcgggtgccgagctaccccgggtccgtgcagtcccggttgcccgtcccgggaggaagacgaagccggtggacagggccggcgggggcggcgccgcgcacgggtcgctgcccgtggccataccggactggtccaagatccttgggggcgagtaccaggggcaccaggccggggactgggagctggacgacgcggacgacgaggacgtcgagggcgccccggtggtgccgccgcacgagctggcgtcgcggcgccgtgccgcatcgctgtcggtgaacgatgggatgggggtcggcaggatgctcaaggtccgggacgcggtctggaagaagacggggttccaggcctgacgcgctctcgggccggcgtcgtcgcccgccaatacaaaatgttttcttttgacagatcgaatcggataaagctagctgctactcccacaagttgggccatctattttagaatggagggagtagctcgtagaagttgtggttattttgacagagctttggcctccggggtagagagaggagtggatgctgaggagtgatcattgttcttcgattgttcgttcctgctgtgcagtgtttccggagagaacgcggaacgtttctgatcctgcgc

SEQ ID NO: 33361 - DNA, 773 bp, Triticum aestivum
  unsure (1)..(773): unsure at all n locations
  Clone ID: PAT_TA_33361
agtctcaaaagcntaatgaagtcatggcagatgtagttccaaagtgcttggggagataatttgttgggcatcagaagaaaaagtacaggaatagaagctgaccaagtcaagtccacggaaccagtaactgatcttgaaaaccaatctagtgtgtcacaagataatggccagggcaacaactcgtcttctaatcagcaagactggaagctgaacgagtatgtggtgagttgcttgttatccctttgtgtcacagtgtgcgacatgttgatcagtgcagatcaggacttgactcctcagtttgaatcaactacccctatggatggtgtatctagcttcccaatgaagctcaagcagattgtaggaaaaaatatgcatcacaggtctgaccgcctggcaattctgaagcttacatgtaagatggtcatatcaatgatgaaacacaggggcagctatgtcaaggaagacctgcaaagtttgatggatacactgtccaccgcttcgaaagatatgtttcttattgatggctccatggtttttgacattaaggaagatggtggcggtgcaacgaagccggagcctttcaggagtctcgtttcccttgtgaaagaagcacaggaactggtgaacaaaagaaatgaactttgatgttgaaactttatcattggggaaccctgtttaagttggaacttattattcaccttctgtcggtagccttcatgtattgtgagttcatctgtataccatctttgaaactttgtgagtattgcccgaat

SEQ ID NO: 33362 - DNA, 315 bp, Triticum aestivum
  Clone ID: PAT_TA_33362
ggttcgagcaggacgtgctgagcgagatgggctgggacctgtactacgcgagcctggcgcaggcgatgctcatggcgccgcccgccgcggctgcggcgctcggcgattacggggaggctcacctcgccgacgtgccactctggagctaccagagctagccggctagttcgcgctgcttcgagttttagctttcctttctgtcgtcgtcttggcttccgatcgatgccaaaattttggtgctgctgtagggtcactgcttgcggtttctggtaatgtgatggtgcgaattggggaaaaaaaaagaaaaaaaaaaaa

SEQ ID NO: 33363 - DNA, 1102 bp, Triticum aestivum
  unsure (1)..(1102): unsure at all n locations
  Clone ID: PAT_TA_33363
caccggccttgctagacttccanaaactctgataaaactagagaaacttgagcgcttgttcttctcccagaaggatgtctggtctaccatgtggaagccacctcagggtctctggaaaatgaaggcgctgcgggaggtgggctggatattgctggaagatgatgctgttgaggttgcccaagaggtaggtgaactagaaaatctgcaaaggttaagtatctacgtcgattgtgagaggcccaatggtcccaaggttcttgaagagcttgccctgtccctgagcaggacgcactctctccggtcgctcgacatgggcaccatgagttatgaggccaatgcgttgaactttctccttgagctcccctcgccgccacgcctcctccgattcctcaggatcgctggtggcattgacaaattgcccaactgggttgaatcgctcacatatcttgttgagtttcacatgtcatgggcacactttatcgatgaccaactatttggggttctgtgtaagttgcccaacctgaagagcatctggatgcagcggaactgctacaccggtctagagctgattgcacgcgctgcacacaactttccagcgctcaagaatctcagagggacctgtgataacgaaatgcccagagtctacaaatttgaggaaggatccatgacaaagctcgagaaactttcactgaatttcgacaactggagtgagaagagcattgtgggcattgagcacttgacaagccttaaagaggtgcagctcgcaggtaagagagggaaccctgcgctggaccgaactctggagcagctaaaggtggagagtggaaggcaccccaatcagttcacagttggagtgaagtacgactaaccttgtcgctctgcttgcttgctgtaagtttgttgttaccctttctgttcctgttggtgtttgtggtgtggttgcttcttgctttgtaaaccttggagcctacagcagtttaagcattgtggtttgtaataaataataaacctggaccaattggactgtggtctaggaaaaacaaaaacaagcgatccatgtaccagtatgcattataactgcatgttcttgttcccagaaaaa

SEQ ID NO: 33364 - DNA, 857 bp, Triticum aestivum
  Clone ID: PAT_TA_33364
gccgcaccggcgagctctgtggtacatgcgaccatgccggcgcagttattcaagattggatgtctgcacttgctggtgataacagccatcttggacgccttcttcgaggacctcggcttgcttaaggcgatgattgatcgtccgacttactctggttgtggcatagcatgcacactaggtgtttgttcatttgtttgtgctgcctttgataggttccctgcctgtcgattttttttctctgccaagaagtgcatattgttgattgttccttcctaagtctctcgtactggcatttgtttctctgtcaagttgttagctttgagatgcactgtgcagatacatatacttctctttttttattgaaaggatacatatacccctacttgtctttataactgtagccccgtctatcaggtgattctttgacttgttgagttaacacctgctgttttttctgaatgttatctgaatctaggaacctacgtgattgcataattgtggctaaatatatattgttcaattcatgtgttgtgctcctacctctctgctcttctcttgtgtgcttacaccttttatactactcaactgtcttctagattcctgtgcatattcatgaatgatttcttattttcagtttaattccaacagaatacgaggagcatgcccctggacaatttcatatggtcaaagcatgattgcatgagtataacctacatcagccatgagggtcttcaggtctgctctaaaattataacttgtagttattctaaattgataatgctggcatgtatgtggaatcaaaaatcatagcttgaattgcttctgaacaataatattgtcttccaattctataaaaa

SEQ ID NO: 33365 - DNA, 458 bp, Triticum aestivum
  unsure (1)..(458): unsure at all n locations
  Clone ID: PAT_TA_33365
gcacgagggccccgccccgcctcgcctctccgctcgcactcaccgcgcggcgcacgcccgtgatccgcctcgccggcttccgccgctgccccgccgccgcctccgatctcggcaggagggcgcgcggaggaggcagagggagatggcggcggaggacggcgcgaggtcgcccaccaggatgctggcggaggggcatctgcggatcgccacaggcgggcgggcgccggcggacggttttatcntcttncnccncatcccacactcccagcaccttaacaaagatgtcgccccgactagttaacatgacaagctatgagactcaactgtgttaccttcccactagttgtgcacattggagaatggaactgaaatgaaacctctgctgtgagtaactcctgaagcttctctctatcctccttgtggagctttatctctcaagagatgtgttacagtaagat

SEQ ID NO: 33366 - DNA, 798 bp, Triticum aestivum
  unsure (1)..(798): unsure at all n locations
  Clone ID: PAT_TA_33366
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcattaaaaccggattcaggagggcattacagccatttccatctccccaatgtcacaccggtcggtttagggcctaaagtacaacttaccatgatcgcaatctttgtctagactttttttactagagtgaacactgctgcttattattattattatcatcgcgagttgaggatttcatcagagtacaacaaactcatgcaacaaagatttgcagccaacgacagttttaaccaaccatacacgattaaggcacaaggatccgcagatgctgcgagcaaacagggtacaaacgcatggcaatcgtggtggcgccggcgtcccatcccggtggcgggggcgggatccggcggcgcctctcctactacttcttgccgtccttgcccttggcgtccgtggaggtgctcccggaggcctgcgccgccttcttggcgttcttctcctccagcgccttcttgtccctctcgcggcgctgctccggggtgaggccgtcgccgccgttcttggagttgggcttccgcgccgccgcgcgctcgcggtcgcgctccctctggctgccccgagtcatcttcttgcttgattcccttccgccggcggcgactctgttcttgttgggggttctttctctcctctgtctccccctggacgcctcctgcttgccgccccggccggccggc

SEQ ID NO: 33367 - DNA, 790 bp, Triticum aestivum
  Clone ID: PAT_TA_33367
ggccgggccgggattttcatcccgcactactaccaaaccacgtgtagacgacacagaagcaaagcaacttgaaatggcttcgtcccacctggcagcagccgcctccatggtcctcttccttgccgtgttcgctgccagcacgaacgcggcgacgttcaacatcaagaacaactgcccctacacggtgtggccggcggccaccccgatcggcggcggtcggcagctcaacaccggcgagacgtggaccctcgacgtccccgcgaacacgccctccggcagggtgtggggccgcacgggctgcaacttcaacggcaactccgggagctgccagactgccgactgcggcggtgcgctgtcgtgcacgctgtccgggcagccgccgctgaccctggccgagttcaccatcggcaacggccaggacttttacgacatctctgtcatcgacggcttcaacgtgccgttgtcattctcctgcagcaacgggcccaacctggtgtgccaggccgacaagtgccccgacgcctacctcttcccgaccgatgacaccaagaaccacgcctgtaacggcaacaacaacagctaccaggttaccttctgcccatgaggaagaaggtatcatcgtagctagtagcggacgataccaccaccagcataaatacgcgtacatacaatgagtgtggagaataaagtttgttacataagatgaataagacgatgtcgtgaaaataaggctgtccgtgcgtgcagtgtacccatttatactatatatagcttataatttaatttataa

SEQ ID NO: 33368 - DNA, 958 bp, Triticum aestivum
  Clone ID: PAT_TA_33368
tcccggcggccggcctgcggccgctcgaggccgcggccgggccggtcacaatcatcccgcactactaccaaaccacgtgtagacgacacagaagcaaagcgacttgaaatggcttcgtcccacctggcagcagctgcctccatggtcctcttccttgccgtgttcgctgccagcacgaacgcggcgacgttcaagttcgctaatgacatttcccaaccataccgcgaagtgaaggatcagagagtccgcagctaacatcaagaacatacatgtggccggcgaacggccacccgggtcgcccacgcagctcaggcgagacgtgacccggaccctcgacgtccccgcgaagccctccgggtgcagggtgtggggccgcacggtgctgcaacttcaacggcaactccgggagcccgtgccagatctgccgaccgccttctgcggcggcgcgctgggcctcgtgcacgctgtccgggcagcgcgctttgcgccgctgaccctccgagttcaccacggcaacggcccttttacgcacatctctgtccatcgaccggcttcaacgtggtccgttgtcattctcctgcagcaacgggcccaacctggtgtgccaggccgacaagtgccccgacgcctacctcttcccgaccgatgacaccaagaaccacgcctgtaacggcaacaacaacagctaccaggttaccttctgcccatgaggaagaaggtatcatcgtagctagtagcggacgataccaccaccagcataatacgcgtacatacaatgagtgtggagaataaagtttgttacataagatgaatataagacgatgtcgtgaaaataaggctgtccgtgcgtgcagtgtacgcatttatactatatagcttataatttaatttatgtaccagagccctcaaattaaatatgtcctatgtttaacaaaaaaaaaaaaaaaaggccgcaacg

SEQ ID NO: 33369 - DNA, 706 bp, Triticum aestivum
  Clone ID: PAT_TA_33369
cgtcccgcggcagccacctccaggacagcagccgccgcgcccccataggtccacacctcgcagccatcggacgtcgccgtccgcgcggagtgccgccgcccgaacctcccaccacagcacgccgcaatggaggccgaccgcccatggcatcgcccgagctcacctcccagcagtcattctcctttgaattcgtcgggatccggctggatccggacgccagcgccccgttcctacctccccgcctcgcttgggtcgtcggccagctcgacgatgtcagactgctcgcgggatccagcgccaccgctggctggccacttcctcctggaggagacgcccccacatcggcgcctccccatatgagcagcagcagcgaatgcctcgctaagggcatctctggtggtgtttttttataaattgttttaaagaagtttgccagatctgtgactgaaaaacaatggcgttgaactccgattgacgtcccgcgaaggctggcggcgcttgatgtggtggctggagaatatctctgggcaaaacagtaggccagatctagggggaaaaatctgtaattccaagtttttgattgtgtatttcttccttttggtaaaaataaaatttagttatctagtatgtttatgcaattttcctttttatctactgtataaggtaatgagcatatataataaaaaaaacttactgactcaaaaaa

SEQ ID NO: 33370 - DNA, 2179 bp, Triticum aestivum
  Clone ID: PAT_TA_33370
ccgcgccgcctccaccgagctcgcccagactttggtgcagctgtcggtttcgctgctgctgtgctcgcgctgacggatccgtgacagcgaggcgaggcgtggccgcgacctccaaccaacccggccgtgggccggtgctgccgttgatgcgcgaggcgcggactcgcccggtcctttgatgggcaacgcatgcggcggttcccttagatccaagcaccggcacacgatcacgcacgcggcctcccagcgccaggaccccgagaccgcctaagaaaacaccgttcccctctccggctcaccgaaattgctgtcggtatcgacgccgccggtgggaacagcagcaggctcaaagacggaatggcattcatcgccggaacattgcgcctggataaactggagcgtgaggaacatctcgtggcacccttttcatctttggcctcaaagatggaagtggttacatcacggtggatgaactgcagcaagcttgcctaagggagtaacatgccagatgcttttcttgatgatgtcattaaagcacctgacccaggacaatcgatgggcgcaatcgactaagggagattttcgttgccatgatgaccgacgggcagtgtagggagttgcgggctaaggaacaatggagaaacagccctagaatatgcagacatggaggagacgcacgttggtgcaatctaggacttgcccacatgatgtacatacagcatggtggctttagtttgcgttcctttgtcagcgcgggctctaccaagaagtgcctagcgatttacgaaatctgagtaaaatgccggtgcggaggtgcgtgtctggggattgtgatttagctccgtcaattgatgcagacggaccgcatgctcgacaaaagagagaaggaccttccctttcaggcggatgaattccagcaagctgtccaagtgaaataacaccccagtttctcttatcttgtggatgatgtatattaaaagaacctgacctactgaccaaaagataggtccccattggacttttgtgaattgctggccataaatcactaaaggctgcatagggggtgtgcccccataataggcatgagaaaccgcaaggaaaatttgatgctgtactgcacggtgtgatcgattttgattctgaaccctggcctgtgatatctgacagtgcaaaagattctggataacaagaatgctcaatcctcgcccagctgaacgcgttgacagcacacgaagttctatgccatccatggattcgtgatcagggagttgctcctgatcgtcctcttgacacagctgtcttatctcgcattaagcaattctctgcgatgaataagttgaagaagatggctttgcgggtaatagctgagagcctctcagaggaggaaattgcaggcttgaaggaaatgttccagactatggacgctgataacagtggtgcaattacatatgatgagctcaaagaaggcttgagaaaatatggctccacattgaaggatactgagattcgtgatcttatggatgcggcggacgtggacaacagtgggaccattgactatatagagttcatcgctgcaacattgcatctgaataaactggagcgtgaggagcatctggtggcagccttttcatattttgacaaagatggaagtggttacatcacagtggatgaactgcagcaagcttgccaagagcacaacatgccagatgcttttcttgatgatgtcattaaagaagctgaccaggacaatgatgggcgcatcgactatggagaatttgttgccatgatgaccaagggcaacatgggggtggggcgaagaacaatgagaaacagcctgaatatcagcatgagagacgcacctggtgcaatctagacttccacgatgtacatacagcttgtggctttagcttcttcctgtcttcatgctctacaaagacttcctgcaattttcgaatcttgtaaaatgcctgtgtggatgtgtgtttctggggattctgatttagctcgtcaattgattcgacggaacgcatgctaagctgggttgaaatgatctcacacgttgctgccgcttaatccctgcaaaatgttcagtgaaaaaaaaaaaaaaaagctcctactatatctccctggaattgttaactcttaaaatggcttgtcccaatgaagcatgtccagtttg

SEQ ID NO: 33371 - DNA, 1008 bp, Triticum aestivum
  Clone ID: PAT_TA_33371
cgtggcggtaggaaccagccaagctttgggtgtgtccaagatcctcgtgagccgtgaccaccagagaattcttggagaaatggcttccgccgagcttgggtcggacgcgtgcggcttcccctgcggcggcgacgacggcgcgatggcggcgctctcgccgacggtcgtcgtgtcggtgctcgcgtctctgctggagcggcacatcgcgcgcaacgagagggccacggccggggcgacggccggccatggccccgaggcgtccggcgaggacgcgaggagggccgcggccttcgacggcggcacggtgctggacatgggcatgcgggagttcctggagcgattctcccggtacgcgcacgtgtcgccgcaggtgtacgtggtggcgtacgcctacctggaccggctccgccgcggcggcgacggcgccggggcggtgcgcgtcgtggcgaccaacgcgcagcggctgctcactgcggccatcctggtggcctccaagttcgtggaggacaggaactacaagaactcctacttcgcggcggtgggcgggctgagcgcggcggagctgagttcgctggagctggacttcctcttcctgatgcggttcaggctcaacgtgagcgtgagcgtgttccggagctactgccggcacctggagagggaggtgggccacggcggcgggtaccaggtcgagaggtgcctcgagaaggccctcctcgtctcctccggggaggcgcggcggcagcaccggcagacgccagcggcggcagcagctcagtaaaaggccctcgccaacctggacacactaaagactaaggtagccgcagccattgccggcagccgcacgagctcatcgccgtggcgtgtgccgcgtcatgacaagatcgagtgccaagtgcccacacgggctgtacctgtacgtacataatcgtagaaagtttgctaacttgcatgtgttaacagttgtacacacaacctcggttggaaaataaacccgatgcgaggatttgt

SEQ ID NO: 33372 - DNA, 936 bp, Triticum aestivum
  Clone ID: PAT_TA_33372
atataactattgtttcaaagagcatttgttttgtcgatgtattttttgatgctactccaccactgtaactgtgcagtaaagaataaccttgtactgacgcagcaatgacttattttttttctgatctcagttacaagtgtgattgtttcaaaaaaaaaaaaaaaaaaaaaaaaaaaaaaaaaaaaaaaaaaaaatttaaggtaaatataaaaaaaaaaaaaaaaaaaaaaaaaaagagatttgcaacaaaaaaaggagctggagaggataaggtgaaatcggcggcaccgccgccgccgctacggggcacgagcatggaggcggctgggatagtgtggtgccgccgccgctacggagcacggaggcggctgggaacaggggggagacgatggcggcctgagcgggcggcgttgggcgccatggggttcaacatctcgctggccttgactcacgcacgtcccgttccgctcagggcacatcctgcctcagcagccacacctctccctccaagcacagagcatgctgcccccacccccgtacaatgaacgagcatgccaaggagaggaactccatgcgtatgggaggccagccgctccccaatcttcagatctgaccaacgtgggaggaattgttggagcacaaccaaatccaaacgcctcaccgtttgcaatggatcaaccttgaagacactcggaacatttacttcgagtgaagactctagcggcgctattgccactgccccgacctcgccgattgttgacctcgctggcttgacagcgtcctttttgattctgaacataggtgctactctcctggacaccgccgactcaggtcctactctcctggacgccgccgactcaggtggataacggtggcactaaggcctgcagtagcgagtggagagcgccccagccgagctccccacgttcatgtcgt

SEQ ID NO: 33373 - DNA, 438 bp, Triticum aestivum
  Clone ID: PAT_TA_33373
gatgccagcatttaccataatctccatgagcagcttcagctgtcatcgtgctacaaactgatggaggagagcaacgatgaagcggagaagagaattcgcgaaggagccttcgccaaaggggtgcgtgataccgccttcgaggacctgctggccgtggagaagaaggacgacgctttctggcgccgtgacgggaagctgaggtcgatctcggacagcatgtaggcagcgaggcagaagacaaggcgatcgcaccgactgtgtcatcttcgtggtcatcagtctagactgcagcaactagaaactgaatctgtcccttggagaacttgtgtgtgttgaaaccattggcggtgtgatcgtgctcgtcgagctctcgatcctcctcctgtgtcttgaactcttgagtcgtggctttcaataagatctgaactgggcagatcc

SEQ ID NO: 33374 - DNA, 1061 bp, Triticum aestivum
  unsure (1)..(1061): unsure at all n locations
  Clone ID: PAT_TA_33374
gggacctgcgcctccggctccgggttacccctcactggagggttcccatgcgggagctccgccgcggtgccggccgccctggcccgagtggatcccacgcgcggaacgcatcccgccagagctacaaccatgcgggtttcccatctcgtcctccttgctattagtgtcatcctgtcccgtcaggtcccacctcaatcaccccaaccatcattgccacttgctggtggcggtgggaagaagagaaaaaacccgaggaggaagcaggagggcatggatcgcacagctaagttgggggctgttgaggaggaaaaggggccaacaccgaacaccttgctcctcccccggttgagtggtccaatgaaacaaaggatcaccgaggagtatcgtcggttgtttggggcttttggtggtattgaagaattctttcaccaggtccatgagtttcttagcactcttgtagatgcgagggacgaactactacaaaagtctgagaacacccgaagaagcatcacaataaggaaggccatgttatctaacagtcgtaatggtaggtcttcacatgaccaccttcgcctatgtcaacaggtggataagttggaatttgaatatgaaagactaaagaaagatgccagcatttaccataatctccatgagcagcttcagctgtcatcgtgctacaaactgatggaggagagcaacgatgaagcggagagagaatccgggaaggaccctcgccaaaagggtgcgcgataccggcttcgaggaactgctggccgtggagaagaaggacaacgctttcttgcgtcgtgacggaaagctgaggtcgatcctggacaagatgtaggccacgaaaagaccaaccaagcaattgcattgattggcatcgtcgccgccggctataactccaggaaccccaaaacgaaatttgcccttggaaaacttgtctgtgttgaaaccatggacagtgcgtgttgaaaccatggacagtgcgatcgtgctcgtcgagctctcgggcctcccccctgcgccttgaactcttnagtcaggcttttaataagatc

SEQ ID NO: 33375 - DNA, 642 bp, Triticum aestivum
  Clone ID: PAT_TA_33375
ttttttttttttttttttttttagaccaaacaacatacgtactacaaagtcaggtggcgatacatcaaaatcgcactgatccaaagcatctcaactgcgttttttttcggcagcatcaggtgagataccagaccatcttaacttgagtgattatctacacgaacatgacagtagttcgggtggcatatgtttgcaagacataagcttatccagtcctcacgcaaatatactaaaaagggtgccacggattcaaacaagatgcgcatggcgtatgtagaaagaagatcgtagctgaggaagaatgaatggcagcatcagtgcacggagtggcagcagatgaagggcatccacggctgcttcctcactttggatctcttgtcgacgttgttgttgtcatggggcatcttcgcgggggagttccagtactggtcgtccgaaccggctgcccctggcttcgccgatgaggcgtcgtccttcgacgctcctcgccgcgtgaatgacaggacccgctccttggtgctgggtttcttctctttgccctccaggctcgcctcggcgaggaggaccttcaagggacgctgatccttgctgaattcagcctcgagccaacggcagcgatctctccattctgcttgtttccct

SEQ ID NO: 33376 - DNA, 602 bp, Triticum aestivum
  Clone ID: PAT_TA_33376
tttttttttttttttttttttttttcggaaccgatatagagttggatacttgtatagcttaaatctcaagtatggacgaaatgttaaaacgttaataatatctctaccatacagtttcaacttcagctattctccatttcattaataccaggatgtacttccaacatttcatccagtacaaaagtaggatgtctgttctgagacttctggtttcagcactttctaaaatctacagcctacttcgagctatgctaaacttatacagtatgtcaccctgatcaagcacagcgaagagaagcagtgcggctatccagtaggttgcagaagatcatcagtagatcctaatagtagataatgtggatgccaacaaactgagagatctaatgcaaaaaggcaccagcatcatcatgcaaagaagcttaagaccccatggataaacctgagtggtgcttgaatgaagcaaataattatcccaaccaagaacatcgccgcaggtggaaaagtggaaccaagtaccttggaagccactccatgaagtttctcacaccagaagaagagatgccagaatctctcccatttctgctcaggtacatcagttctat

SEQ ID NO: 33377 - DNA, 465 bp, Triticum aestivum
  Clone ID: PAT_TA_33377
aaagtaccaactttctcactctgccaaaactcaggagtaaagcaaattgtcattgtatatgggtttcacatttaaaattacgcctctacatacttcaaggataccaattcctaaacattaacgaacagcatcctcatgccacatattggttaagattagcacatcaacactgatattacaaactttgcaatagccacagatcaaggaaacgaacaatgacctagagcaatgttcatctaaactgaaatgaccaatcaactttacctagaggcttcctcaacatcagaggtatgcagggttggagaggaaaggcagcgcagccacggaggaagccagctccactccaatggtaccattggctgcagaacctccattcttcttggcctgcttcattcttgccagcttcacctgtgcctccacgaagttctccatgcccttcacctccagctgcttcatgaagttgat

SEQ ID NO: 33378 - DNA, 497 bp, Triticum aestivum
  unsure (1)..(497): unsure at all n locations
  Clone ID: PAT_TA_33378
ttnatgggtagtgctctagttataggaggtctanacatatacctctatggaaaggccaatgaacaacacgagaagacggcatcggttacagggatgcaaaaggagggggacaaagagattcagcggtctggtgttggtgtgacgactgaggagaggccacaccctgtgctgttagagagctccgttatccagcttgacgaggagctggacgcaggggtctccaagtgaagtggttgtaatcatggtagctactagttgtttttttgtcttgatctatctgggtctaagattctaaaatacattcgcccatacatcagtactagataggggtgtggcttgccacgcattgcccagccaacggtaagccatcggatatgataatcggttcaatatatagctgaattagatattttattattgtgttgggagctgtcttaagcacatagttagaaatcatgtttgtagttgctgaaagaaaaatagagcttgcacataat

SEQ ID NO: 33379 - DNA, 526 bp, Triticum aestivum
  Clone ID: PAT_TA_33379
ctgctcctcgtctacccgcggccacacctagactcgctccctcgagatcatctgttccatccttttgaggctgagatggcggctaccttcaatgttaatgctgaggcaggccttaaaaagcttgatggctaccttctgtctcgcagttacatctgtggataccaagcttccaaggatgacttggctgtgtattcagagttctcagttgctccaccatcaacttgcaccaatgttgcaaggtggtacaatcacattgatgcactcctgaagctgagtggagttactgcccctggtcaaggtgcgaacgttctgacatcatgcgtccctgacacctcaactactgatgttgctgatgctcctgcagctgatgatgacgatgacagcgatgttgacctttttggagacgataccgaggatgagaaaaaggcagctgaagagcgcgctgccaaagcaaaagcttctaccaagaagaaagtatatggccagtcctcaactgtgcttgatgttaagccatgtgacgatgaga

SEQ ID NO: 33380 - DNA, 805 bp, Triticum aestivum
  unsure (1)..(805): unsure at all n locations
  Clone ID: PAT_TA_33380
cctcctcctcctcgcctccccgcggccacacctcgactcgctccctccctcgagtagatcatctgtgtcatccttttgaggcgagatggcggctacattcaatgttaacgctgaggcaggccttcaaaagcttgatggctaccttctgtctcgcagttacatctctggataccaagcttccaaggatgacttggctgtgtattctgagttctcagttgctccaccatcgacctgcaccaatgttgcaaggtggtacaatcacattgatgcgctcctgaagctgagcggngttactgcggccgggcaaggtgtgaaggttctgtcatcagttggccctgaaacctcaactactgatgttgctgaggctcctgcagctgatgatgacgatgacagcgatgttgacctttttggagaggaaaccgaagaggagaagaaggcagctgacgagcgtgctgccaaagcaaaggcttttaccaagaagaaggacattgggaggacggcagttttgcttgatgttaacccatgggaaggagcgaccgacatgggcaagcttgggggaagctgtccgaaacctaacaaggggggcccttttgcgggggcctttcaaagctaatgcccgctgggttttggactaaaaacgtttcgcatttgtggtacccccctttgccgacccgggggctgccggacccttccatggacaaaccatttttggtgtaaccccctccttctttgcgcttcccaattccgtatacttcgctcccccactaccttttcttaatcatcccccttccccaacgatatgggc

SEQ ID NO: 33381 - DNA, 633 bp, Triticum aestivum
  unsure (1)..(633): unsure at all n locations
  Clone ID: PAT_TA_33381
ttcttgtaacgtcacggaaatcaagacggtcaagaatgttgaccagtatgtcgttgggcaacttgctgatcctaccatcttcattgcctttcagcttgtcgagggaggattccgccttaaccgatggtttgcccatcaatttggcagcctgtcgccggcgactagtcctcgccatcgcctgagttgccgccggtcagtctgaaaactgatgtctagggagttgctgctgcgcgtcttctccaaagattgacgggcgacgcagtgcggcccggccaaatatatatatagctgctgggttcccgccaccaatggaaactcggagactgaattcgaaagagggcctgtttctgattgtaatccggaaaggactgctttgattccggattagccactaaaaaagggaggcgcttcgatttccgactgcggctcggagaggagccgcttgattgcggatcgctgcttcgattggggactgcggctcccaaagggggagctgcttatttggtcgcctactcgcaagcagcactggatcctcattcgaggcatccgacggcgagaggggggagatgggcgcacggcaggaggcggcggcgcataactgacccccgatcccctttcctctnctggggaacc

SEQ ID NO: 33382 - DNA, 830 bp, Triticum aestivum
  unsure (1)..(830): unsure at all n locations
  Clone ID: PAT_TA_33382
tcctcctcctcctcctcgcctccccgcggccacacctcgactcgctccctccctcgagatcatctgtgtcatccttttgaggcgagatggcggctacattcaatgttaacgctgaggcaggccttcaaaagcttgatggctaccttctgtctcgcagttacatctctggataccaagcttccaaggatgacttggctgtgtattctgagttctcagttgctccaccatcgacctgcaccaatgttgcaaggtggtacaatcacattgatgcgctcctgaagctgagcggngttactgcggccggtcaaggtgtgaaggttctgtcatcagttgtccctgaaacctcaactactgatgttgctgaggctcctgcagctgatgatgacgatgacagtgatgttgacctttttggagaggaaaccgaagaggagaagaaggcagctgaagagcgtgctgccaaagcaaaggcttttaccaagaagaaagaatctggcaagtcgtcagttttgcttgatgttaagccatgggatgatgagactgacatggtcaagcttggaggagctgtccgaagcatcaagatggagggccttttgtggggcgcctccaagcttaagccaattggatatggcaataagaagcttaagatatgatgaaccatattggggacccttgggctggggacactctgaatgaagaccatttttgggtggagcccgcccacgaggaccctccgaagtggaacattgtggcctttacaaaaactaaatctttctggagcaaaaggatgggcggcgggggaccattgcggcacaccaaccatttttttaccg

SEQ ID NO: 33383 - DNA, 514 bp, Triticum aestivum
  Clone ID: PAT_TA_33383
ccttccaacaaaatttaaatctttccttgaggcaggtgatggcggtgggtggacaatgcagcagcacaatatatctacagttttccgttgccgtgatggtgtcgtagctaaagcaagcataacatatctgccctgtgaggtttttggaccttaggtcgagttgagtcgtagtgttattactgagtgttatttgcttcgtatgaaatgagacaatgtggttggattcctgttgctattctctttctctgcaaaaaaaaaaaaaaaaaaaaaaaaaaaaaaaaaaaaaaaaaaaaaaaaaaaaaaaaaaaaaaaaagacgaaacaaaaaaaaagaaaacaaaatataaaaacacaaacaaaaaaaaaaagtggctctttaataaaagggccctaattttaattgacccggccgtttaacaacaaacgcttttttaaagaaaaccctgttttaaaccaactgaactttctttaaaaacacccttttttaaaaaaccgtggttttaaaaaatttggcc

SEQ ID NO: 33384 - DNA, 810 bp, Triticum aestivum
  Clone ID: PAT_TA_33384
ccaattcagcattggacatcctgcattggccaaagtttcggccacagctgctttggtcctccgaaccaatttaccattggtctttttggttttagtttctgagggcaggaggtccggagcactgattacaagccgtgggagcattgcaggaagctgactccaccttctcgagaggacactggttctcgcagcgttgcagacatcgagtcggtccagaatgttgagcaggatgtcattgggcaagctgctgatcctatcatctggattgacttcccccacggtcgaagccgatggcctgtccatcgatttggcagcccgtcgccggcgcctagactctccccctccccagagttgctggtcgctccgaaaactgatgtccacttagggagttattgctcgcctcctcttaaaattgtccgccaggccagatgtatatatatagctgctaggttcccgccaccaatggaaacccggataatgaattcgaaagaggatctgtttctgattgtaatccggaaaggactggtttgattccggattagccactaaaaaagggagccgcttcgatttccgactgcggctcagagaggagccgcttgattgcttcgatttccgactgcggctcggggaggagccgcttgattgcttggattgccggaccagagctgcttgattgcggatcgccgctcccaaaagagctgctgctcttgctgcttcgattggggactgcagctcccaaaaggggagctgcttatttggtcgcctgttcgcaagcagcactggatcctcatccgaggccggacgcgtggg

SEQ ID NO: 33385 - DNA, 629 bp, Triticum aestivum
  Clone ID: PAT_TA_33385
gttatgataattttgagagcatagcagggatctgcttccaacgtctcgagaggatggtggttcgtgcaacgtcagtgatatcaagtcgctcgacaatgttgagcaaaacgtcatcgggcaacttgctgagcctatcaacttcattgtccgtcatgtcgagggaggatgtgccgaggccgatctggtaaccggtcgctgggaagagagagttgctcgtctcctcttaaaattggcgggtaccgtggttaccgccaggccagatttatatatagctgctaggttgccgccaccaatggaaacccggagactgaattcgaaagagggcctgtttctgattgtaatccggaaaggattgccgtctgcggctcggagtggagccgcttgattgcttcgattgccggtcgctgctcggaaaggagctgctgctgctgctgctgctgcttggattgggggctgcagctcccaaagggggagctgcttatttggtcgcctctgctcaagcaccgggggatcctcattcgaggcatccgacggcgacggcgacggcgacggcgagatggtggagatcggcgcacggcaggcggcggcgcataactgactcccgatccccttttgctccggacgcgtgg

SEQ ID NO: 33386 - DNA, 802 bp, Triticum aestivum
  Clone ID: PAT_TA_33386
gattgcattgatcgacgcaaatgtattgttttagccaatttttcatccaattcatcatcagatacgctagcttgtgagtgcattaaatcgcgagcacttattttaagccatgagagcttggcagaaagctgactccactgtctggagaggacactggttcttgtaacgtcacggcaattgagacggtcaagaatgttgaccagtatgtcgttgggcaacttgctgagcctatcatctaaattatatttcagctcgtcgaggaaggattccgccttgaccgatggcttggccatcaatttggcagcccgtcgccggcgactagtcctcgccatcgcccgagttgccgccggtcagtctaaaaactgatcgtctagagttgttgctgcgcgtcttctccaaagactggcgggtgccgcggtgccgcccggccagagattatatagagctgctggattcgaaagagggcctgtttctgattgtaatccggaaaggactgctttgattccggattagccactaaaaaagggagccgctttgatttccgactgcggctcagagaggagccgcttgattgcttggattgccggtcgcagctcggaaaggagctgctgctgctgcttcgattgggggctgccgctcccaaagggggagctgcttatttgggcgcctcttctcaagcaccggtggatcttcattcgaggcatccgacggcgacggcgacggcgagagagtggagatcggcgcagggcgggcggcggcgcataactgacacccgatcccctttcctctctcggacgcgtgg

SEQ ID NO: 33387 - DNA, 856 bp, Triticum aestivum
  Clone ID: PAT_TA_33387
aacagaacctgagggcgattgcgcttcagaaaatctcatctcagatagaccaattccctccctcccgctacgtcgcaaatgaaggaatggcacctcatcacacaaacacgctcccctccatttccatcacccaatgctaccttctaccatgccagtttagcataaacatcgtcatccaattaatataggtcagggccatatatcactacaaaaaacaaaaacaagaacacacgcacggcagtgccagatccatttagctgatttgcattgcagccgagtggtacttgtccaagtcggcgtcgagatctgcagcagaaagttccaggttgccaccccctcccttccctcgcccacggtccgtacgccctcggccacgaccaccgaacccacctgcgccacgaccaccaaacccaccgccgctgcgaccactgaagccacctccgccaccagtacgacaaggacgagctgtagttgctgccgtcttctcatcgcccatttagctctcagtagaagtgttggactggaaatgtgatggtttcgagggacgtccattttttaccgcgcgaaaacgcaaatcattgtgatacgaggtttttgtcagtgtaatgtactactgtacctagtttttttaaaagttaaatgataccctagctagttcaaattagcatgcctggtttctgtccgaagtgcccttttgtacacttgctgttttggtttcctcacagtggtgtacgtagttacagaaatgaataatggggttacgaaggtagtctggctgtactgagttttatccatgcagggttatgagggtagttcccaaggttgagttaccacgcggcaagcgtggttagccgct

SEQ ID NO: 33388 - DNA, 592 bp, Triticum aestivum
  unsure (1)..(592): unsure at all n locations
  Clone ID: PAT_TA_33388
gtcgtcctcctcctcctcctcgcctccccgcggccacacctcgactcgctccctccctcgagtagatcatctgtgtcatccttttgaggcgagatggcggctacattcaatgttaacgcctgaggccagggccttcaaaagcttgatggctaccttctgtctcgcagttacatctctggataccaagcttccaaggatgacttggctgtgtattctgagttctcagttgctccaccatcgacctgcaccaatgttgcaaggtggtacaatcacattgatgcgctcctgaagctgagcggggttactgcggcccgtcaaaggtgtgaagttctgtcatcagttgtccctgaaacctcaactactgatgttgctgaggctcctgcagctgatgatgacgatgacagtgatgttgacctttttggagaggaaaccgaagaggagaagaaggcagctgaagagcgtgctgccaaagcaaaggcttctaccacagaagaaagaatctggcaaagtcgtcaatttttgcttgatgtntaagcccatgcgatgattgagaactgaccatggntcaagccttgaaggaagcttgttccca

SEQ ID NO: 33389 - DNA, 549 bp, Triticum aestivum
  unsure (1)..(549): unsure at all n locations
  Clone ID: PAT_TA_33389
tcttcaccgaccccgtggacgagtacctgatgcagtacctgatggactacgaggacaagaagttccagaacgtgtccaaggagggactgaagctgggcaaggactcgaagctcaaggagctcaaggagtcgttcaaggagctgactgactggtggaagaaggccctggagagcgagaacgtggactcggtgaagatcagcaaccggctgcacgacaccccctgcgtcgtggtcacctccaagtacgggtggagcgccaacatggagaagatcatgcaggcgcagaccctgtccggactccgagcaagcaggcgtacatgcgcggcaagagggtgctcgagatcaacccaagcacccatcatcaaggagctccgcgacaangtcgcccaggacaacgagagcgaggagctgaagcacacggcgaagctggtgtacagacggcctgatggagacgggttcaacctcccgacccaaggagtccgtccaacatctacaantcgtgcaaaaggctgaccnagccccaccgacgttggagaggacaagccaggac

SEQ ID NO: 33390 - DNA, 1037 bp, Triticum aestivum
  Clone ID: PAT_TA_33390
ttgcagtgatacatgtgagcctgtcatacagtaacatcccctagattcaccgttgctttcatgacacgcctgacatgactcaccatgtactcttcagattggaagcagaagaaggttagcttggtgagacaatggtgcttgaaatttgatgtaggtgattcccactggacacccttgttcctgctataggacttctgcctcctcaccttctggtccatttccatttcacatggatgatcaattaccgtcaatatgagctccttcagggatggcgccgcttccaaaaagaacattgtccaggtgagatcatacccttcaggaatgctaagtagattgagaatccttagttggcagaacacatatgcctgccttctggtcaaacactctggttgaacccaaatcttttcacatttaaaccccaacttcaggtctagaacagaggtctcgccaagaaatgtacttaacttgaccattttgtgccgattataagcaacatttgaaaggctcagaacctcaagcaatgggacatagccaaatgacagtggtggttcgttgaaagcgatccaaatctcaaacgccagacaggtgagcttcggaagccaggtgagttcgaccatgtcaaaacggcaattgacaatactgagctcactgagttgtgcgtgctcaacttggagcgttatccaactctttgtgtcgcaattgagaaaacctaaataattcaactgcttgcaagtgacgaggatgttggagacaaagtcagattcagcgaatctcaagttctgcaggcagaggcgcgtgagaccagcgaatgcatttagacacttgttgaaaaacaacacaaaccgtttcccataggtcagcatatcgccaatggtgcactctaggcgtttcttctgtgtcaaaactctgaattcggccttctcaattttgtgtgtcaccatggcactgccaacagcatgcccaactgataagggtgcatcgtcgctcaagtagaacgtcgcactgaagaagcggatggtgcattcgactggatcctg

SEQ ID NO: 33391 - DNA, 928 bp, Triticum aestivum
  Clone ID: PAT_TA_33391
tgattcgcctaacctcaaattctctagtgtgaggcgtgcaagaccaccaaatgtgactggacaagaatcaaagaatgacatgaactgactcccataagtgagcagctcattattggtaaaaacattgcgcaacttcgttaagattataaactcaactgaagcaaccttttgtgttgctatggtgttggcaacagtctggccaatgaaaatggactcatctcccaagtagaattccatgcgcaacaggtgaatactgtatggatttcccgccctcctttcaagtatgcccctggttgcttccagcatggcagtattggcctgaagtatatcatctgaggttaacttcctcccttcgtgcttgggctgaaaagaaccaaccattataacaacctttgagagtatcgcagggatctgcttccaacgtctggataggatggtggttcgtgtggcatcagcaatatcaagtcgctccacaatgttgagcaaaatgtcatcaggcaacttgctgagcatatcaacttcattatcctacacaatgttgagggaggatttgctgaggccctgcacggatgatttggtcatcgatgtggtgtgcaactcggagatcaattccaaagaccggtttctggatgtatctaaaaaaggactggtttgattgcggatttgcgacagaaaaaggggaaggcttcgattgcggactgcggctcggggaggagccgcttgattgcttcgattgccggttgcggctcggaaaggagctgctgctgctgcttcgattggggactgcggctcccaaaggggggtctgcttatttggtcgcctcttcgcaagcaccactcgatcctcatacgaggccttcgacggcgacggcgagatgaggcagatcggaaaacggcaggcggcggcgcataactgacctccgatctcc

SEQ ID NO: 33392 - DNA, 640 bp, Triticum aestivum
  Clone ID: PAT_TA_33392
atgaaatttaagtggatcatgaaaattcttgaattcacagacaataatgctacaaaacaacattcaactaaatttagctatacaaggataacctccagctaatcttcaatggcacccaaagaatctacagctatccttggccaatgttcagcctttattttattagatgacaggaagtggattttggcaagtgacccaatgccccggggcattcgcttctgcactgcacgctggtcctcgtttgtacatgggaactttataggcagattcacgcctgggcatatgccacgtaccagtgcatcatacctgcgcgcattctttactttctcttggcacttggcacataccagtctatcatacaggtagacatcctgtagattcaccgctgctttcaggacacgcctgacatgactcaccatgtagtctttagcttgaaagccgacgaggatgaacttggccagacagtggtgcttgaaatttgatgtaggcgattcccattcaacgcccttgttctcactatacaactgctccctcctaatctcctgattcatttccatttcacatggatggtcccataccgacatgtagagctcctccagggacggcgccgcttccaagaagaacattgtccaggtgagat

SEQ ID NO: 33393 - DNA, 729 bp, Triticum aestivum
  unsure (1)..(729): unsure at all n locations
  Clone ID: PAT_TA_33393
ttttaactggttgtatcgacttcttgaattncggacaatagtgctacaaattacttcaactgaatttagtttatacaagcgttgcaaccacaaaagaagagcaaccaagaaaagctcgcaactccaaccgactggtattaattaaatacgctgccctagcctcgacaacatccagttagctcccatgacacccatccttcgacgatgttcagccctcatttccttagatgtcacgaagtggattttggcaagtgacccaatgccccggggcattcgcttctgcactgaacgctggtcctcatttgtacaagggaactttatcggcagattcacgcccgggcacataccacgtaccactgcatcagacgtgcgcgcattctctaccttcttgtgacacttggcacatgccagactatcatacaggtacacatcctgtagattcaccgctgctttcaggacacgcctgacatgagccaccatgtagtctttagcttgaaagccgacgaggatgaacttggccagacagtggtgcttgaaatttgatgtaggtgattcccactcaacgcccttgttctcgctaatctcctgatccattttcattttacatggatggtcccataccatcatgtagagctcctccagggacggcgccgcttccaagaagaacattgnccaggtgagntcatacccttcagnaattttaactagatttagaatcnttaattgctg

SEQ ID NO: 33394 - DNA, 1103 bp, Triticum aestivum
  unsure (1)..(1103): unsure at all n locations
  Clone ID: PAT_TA_33394
gagttccagaacgtgtccaagagggcctgaagcttggaaaggactcgaagctcaaggacctcaaggagtcgttcaaggagctgaccgactggtggaagaaggccctggacacggagggcatcgactctgtgaagatcagcaaccggctgcacaacactccctgcgtggtggtcacctccaagtacgggtggagctcaaacatggagaagatcatgcaggcgcagaccctgtcggacgcgagcaagcaggcatacatgcgtggcaagagggtcctggagatcaacccccggcaccccatcatcaaggagctccgtgataaggttgcccaggacagcgatagcgagggcctgaagcagacggcgaggctggtgtaccaaacggcgctgatggagagcgggttcaacctgccagaccccaaggacttcgcctcgagcatctaccggtcggtgcagaagagcctggacctgagccccgacgcggccgtggaggaggaagatgaggttgaggagccggaggtggaggagaaggagtcgggcaaggcggaggagccggagcacgagcagtacgacaaggacgagctgtagttgctgatggtcttgtcatcgcccatttagctctcactagaagtgttggactggaaatgtgatggtttcgagggacgtccatttttaccgcgcgaaaacgcaaatcatcgtgatacgaggtttttgtcagtgtaatgtactgtacctagttttgtttttaaaaagttaaatgataccctagctagttcaaattagcatgcctggttccagtcagaagcgcccttttgtatacttgctgttttggtttcctgccagtggtgtacgtagttacaaaaatgaataatggggttacgaaggtagctgggtggtacagagttttaccaatgcagggttattaagggacagattaatcctgtattccactgaaccatcgatttacaaatgttacagatacatataccccctccagggaagaagagcaagcgctccctgaaaatgttggacgagtgtttgctggtttcctatancctaagatngctttngtttacaagaactggaaaaaaaaanaaaaaaaaaaaa

SEQ ID NO: 33395 - DNA, 1005 bp, Triticum aestivum
  unsure (1)..(1005): unsure at all n locations
  Clone ID: PAT_TA_33395
agctttttgaggggattgttgactcagacacactgcccctgaatgtgtcacgagaaatgcttcagcaacatagcagtctcaagaccatcaagaagaagctgatccgtaaagctcttgatatgattaggaaacttgctgaagaagaccctgatgagtacagcaacaaggataagacagatgaagagaaaagtgaggtggaagagaagaagggccagtacgccaagttctggaacgagtttggcaaatcaatcaagctgggtatcattgaagacgcaactaacaggaaccgccttgcaaagcttcttagatttgagagttccaagtcagatggcaaacttgcctcccttgatgagtacatttcaaggatgaagccagggcagaaagacatcttctacatcacgggaagcagcaaagaacagctggagaagtctccattccttgagaggctaaccaagaaaaactacgaggttatctacttcaccgaccccgtggacgagtacctgatgcaatacctcatggactacgaggacaagaagttccagaacgtgtccaaggagggcctgaagctgggcaaggactcgaagctcaaggacctcaaggagtcgttcaaggagctgacggactggtggaagaaggccctggacacggagggcatcgactcggtgaagatcagcaaccggctgcacaacaccccctgcgtggtggtcacctccaagtacgggtgggagctccaacatggagaagatcatgcaggcgcagaccctgtcggacgccgagcaagcaagcgtacatgcgcggcaagcgggtcctggagatcaaccccaagcacccatcatcaaggagctccgcgacaagtcccccaagacagtgacagcgaaggccctgaagcaaacggcaaggctggtgtacagacggcgctgatggagacgggtcaactgccggatccaaggacttgcgtcaacatctacggtcggtganaaaganctggactgacccgtcggcggg

SEQ ID NO: 33396 - DNA, 1174 bp, Triticum aestivum
  Clone ID: PAT_TA_33396
tacaagtgcagatgcttcaaccgcttgcaggagactaggatgctggatatgtccgattcaccaaatctcaaattctgtagttcaaggctagtgagaccaccaaatgcatttgaacaagcatcaaagaacaccatgaattttctcccacaggtgacaagttcatcatcgtctatttcagcaatgtcatccgtccctgtcctaacactgaatttggcaacctcaaccaagtgcgtcgccatggcatgaccaacagcacgtccgatggataggggggcatcatctctcaagtagaatgtcgtagatagtaggcggatggtgtgttcacctggatttctgcgtgctagtatgctctctgtcgcttggaccacagccgcattggtccggaccaattcatcaacagagacgttgctgtgtaacacaccctcggggaggaagtcctgcacgcttattataagccgagacagcttgccgcaaagctgaccccaccgtctggccaggatgctggttcttgcagcctcagggacattgagtcggtcaagaatgttgaccagaatgtcgtcaggcaatgcgctgagcatatcatctctactgcctttccccatggctcctgcgtagatccgccgaggcccgagaagaattggataattggtcaccgtgaattggctcacgagttgccgtctcctccgaagattggaggcgagaagcgcggtgtccgcccggccagatatgtatatatctgctgggttgccgacaccaatggagactcggataatgaattcaaaacaggacctgcttctgattgtaatccggaaaggactgctttgattccggattagccactaaaaaagggagccgctttgatttccgactgcggctcagagaggagccgcttgattgcttcgattgccggctgcagctcggagaggagccgcttgattgcgtatcgccgctcccaaaagagctgctgctcttgctgattcgattggggactgcagctcccaaaaggggagctgcttatttggtcgcctgttcgcaagcagcactggatcctcattcgaggcatccgacggcgattgcgacggcgagagggggaagatgggcgcacggcaggaggcggcggcgcataactgacccccgatccccttttgctctctggtggaaccctaggcggacg

SEQ ID NO: 33397 - DNA, 608 bp, Triticum aestivum
  Clone ID: PAT_TA_33397
gcgccgtcctcctcctcctcctcgcctccccgcggccacacctcgactcgctccctcgagatcatctgttccatccttttgaggctgagatggcggctaccttcaatgttaatgctgaggcaggccttaaaaagcttgatggctaccttctgtctcgcagttacatctctggataccaagcttccaaggatgacttgggctgtgtattcaagagttctcaagttgctccaccatcaacttgcaccaatgttgcaaggtggtacaatcacattgatgcactcctgaagctgagtggagttactgcccctggtcaagggtgtgaaggttctgtcatcagttgtccctgaaacctcaactactgatgttgctgaggctcctgcagctgatgatgacgatgacagcgatgttgacctttttgggagaggaaaaccgaggaggagaaaaaggcagctgaagagcgcgctgccaaagcaaaggcttctaccaagaagaaagaatctggcaagtcatcaatttgcttgatgttaagccatgggacgatgagaccgacatggtcaagctcgaagaagctgttccaagcattaagaaggaagggcctctgtgggtgc

SEQ ID NO: 33398 - DNA, 1683 bp, Triticum aestivum
  Clone ID: PAT_TA_33398
tccacatcctgatcataaacacgcttcccctcaaggatactattcgcccaaagaatagtatcaactgatgcactcatcagcaattagagatcggtagatacaatatgactctacaaactaaggtctaaaatttaactgattatcaaaaaaattaattcaccaacaatacaagtgccactttcaactcatcttaattatacgaggcattgcagctacacaaatagaccaaataaggaaacgcagacttgcatgactttctgctccaaccgagtactcagtccaaccgactggtattgaacaaactgcctctaatagcctcgaggtatccttgcaagatgatcgtcccttattacatcagtcgccaggaagtgaactgtggcaagtgactcaatgtcccccctgatttgcttctccacccaacacctctgcctacttgcctccgggaaccttattggctttagaggctccacgtctcggcatctgctacatgtcagtctatcatacaagtagacatcctctagattcaccgctgcttccatgacacgcctgacatgactcatcatgtagttttcagactgaaagcagaagatggtgagcttggtcagacgctggtgcttgaaatttgatgacgatgattcccactcgacgcccttgttatcacaataatagcccttcctccttttctcctcatccattatcatttcacatggatgatcaattaccgtcatgtagagctcctccagggatggcgccgcttccaagaagaacattgtccaggtgagatcatacccttcaggaatgtcaactagattgacaatccttagttggtggaacacagatgccagccttttggtcagacactctggttgaacccaaatcttttcgcatttaaaccccaacctcaggtctcgaacagaggtctcatgaagaaatgtacttaacttgaccatttcatgccaactaagaccaacatttgaaacactcagaacatcaagcaatgggacatagccaaatgacagtggcggttctttgaaagacatccaaaactcaaacaccatacgggttagcttcggaacccaggtgagtttgaccatgtcaaaacggcaattaacaatactgagctcaatgagctgtgcgtgttcaacttggagtgttatccaatcctctgtgtcacaattgaaaaaacctaaataatttaattgcttgcaagtgacaaggatgttagagacaaagttggattcacggaatctcaaattctccaggtagaggcgcgtgagaccagcaaatgcattgtggcattcattaaaaaatgacacaaaccgtgtcccatagttcaccacatcatcaatactgcacttgcgtcccttcttctctgtcaaaactgtgaattcggctttctcaaccttgagtgtcgccatggcattgccaacagtatgcccaacagatatggggacactgcctctcaagtaaaacgtcatgctgaggcgaatgggccatccacccggatccctgcgtgccagtatgctctttatcactttggctacagctgtattggccatagctttggctacagctgctgcattggccaaggctttggctacagctgctgcatcagccaaggctttggcaacagctgcactggtcctccgaacaaattcagcatcgcctcgtgccgaattcctc

SEQ ID NO: 33399 - DNA, 1832 bp, Triticum aestivum
  Clone ID: PAT_TA_33399
tcgagcggccgcccgggcaggtactctgagttcatcaacttccccatctacttgtgggcaaccaaggaggttgatgttgaagtgccagctgatgaagaggaatcaagtgaagaagaggaatcaaccacagagacgactgaggaagaagagacagaagatgaagagaagaagccgaagacaaagactgtgaaggaaactactactgaatgggagcttctgaatgatatgaaggctgtgtggcttcgtaaccccaaggaggttactgaagaagagtatgcaaagttttaccactcactagctaaggactttggtgacgacaagcctatgacttggagccacttcagtgctgagggagatgttgagttcaaagctttgctctttgttcccccgaaggctccacatgatctgtacgagagctactacaatgctaacaagtcaaacctcaagttgtatgttagaagggttttcatctctgatgaattcgatgatcttcttccgaagtacctcagctttttgatgggtattgttgactcagacaccttgcccctcaatgtgtcccgagaaatgcttcaacagcatagcagtctgaagaccatcaagaagaaactgatccgcaaggctcttgacatgattaggaaacttgctgaggaggatcctgatgagtacagcaacaaagaaaagacagatgatgagaagagtgcaatggaggagaagaagggccagtacaccaagttctggaacgagtttggcaaatcagtcaagctgggaatcattgaagatgcaacaaacaggaaccgtcttgcgaagcttctgagatttgagagttccaagtcagatggcaaacttgtctcccttgatgagtatatttcaaggatgaagtcagggcagaaggacatcttctaccttacaggaagcagcaaggagcagctagagaaatctccattccttgagcagctaaccaagaaaaactatgaggttatctacttcaccgaccccgtggacgagtacctgatgcaatacctcatggactacgaggacaagaagttccagaacgtgtccaaggagggcctgaagctgggcaaggactcgaagctcaaggacctcaaggagtcgttcaaggagttgaccggctggtggaagaaggccctggacacggagggcatcgactcggtgaagatcagcaaccggctgcacaacaccccctgcgtggtggtcacctccaagtacgggtggagctccaacatggagaagatcatgcaggcgcagaccctgtcggacgcgagcaagcaggcctacatgcgcggcaagagggtcctggagatcaacccccggcaccccatcatcaaggagctccgcgacaaggttgcccaggacagcgatagcgagggcctgaagcagacggcgaggctggtgtaccagacggcgctgatggagagcgggttcaaccttcctgaccccaaggactttgcgtcgagcatctaccggtcggtgcagaagagcctggaccttagccccgacgcggccgtggaggaggaagaggaggtggaggagcccgaggtggaggagaaggagtcgggcagggcggaggagccggagcacgagcagtacgacaaggacgagctgtagttgctgatgtcttcatcgcccatttagctctcactagaaatgttggactggaaatgtgatggtttcgagggacgtccatttttaccgcgcgaaaacgcaaatcatcgtggtgatacgaggtttttgtccgtgtaatgtactgtacctagtttttgtttaatgataccttagctagttcaaattagcatgcctggtttcagactttc

SEQ ID NO: 33400 - DNA, 754 bp, Triticum aestivum
  Clone ID: PAT_TA_33400
cgtccggtcctcctcctcctcctcgcctccccgcggccacacctcgactcgctccctcgagtagatcatctgttccatccttttgaggcgagatggcggctaccttcaatgttaacgctgaggcaggccttaaaaagcttgatggctaccttctgtctcgcagttacatctctggataccaagcttccaaggatgacttggctgtgtattctgaattctcagttgctccaccatcaacttgcaccaatgttgcaaggtggtacaatcacattgatgcactcctgaagctgagtggagttactgcccctgggtcaaggtgtgaaggttctgtcatcagttgtccctgagacctcaactactgatgtggctgaggctcctgcagctgatgatgacgatgacagcgatgttgacctttttggagaggaaaccgaagaggagaagaaggcagctgaagagcgtgctgccaaagctaaggcttctaccaagaagaaagaatctggcaagtcatcagttttgcttgatgttaagccatgggacgatgagactgacatggtcaagctggaggaagctgtccgaagcatcaagatggagggccttctgtggggtgcttccaagctcatgccagttggatatggcatcaagaagctccagattatgatgaccatcattgatgacctcgtctctgtcgacactcttattgaagaccatctctgcgttgaaccagccaacgagtacctcggccgcgaccacgcta

SEQ ID NO: 33401 - DNA, 2828 bp, Triticum aestivum
  unsure (1)..(2828): unsure at all n locations
  Clone ID: PAT_TA_33401
ggaattcggcacgagcacccagttttggttggcagagtgaagcggcggccgtcgacgatgcgcaagtgggcgctctcctgcgcgctcctcctcgtcctcctcctcaccaccctccccgatccagctaagaagctccaagtcaatgccgaggagagcagcgacgaggttggcgactttcccaaggtagaggagaagcttggggccgtcccccatggcttgtccaccgactccgaggttgtccagagggagtccgagtcgatctcgaggaagaccctcaggaactcggctgagaagtttgagttccaggccgaggtgtccaggctcatggacatcatcatcaactcactctacagcaacaaggacatcttcctgagggagctcatttccaatgcatctgatgctttggataagattaggttccttaccctcactgataaggaggctttgggcgagggtgacactgctaagcttgaaatccagattaagttggataaggagaacaagattctctctattcgggataggggtgttggtatgaccaaggaagatctcatcaagaaccttggaaccattgccaagtctggtacttcagctttcgtggaaaagatgcagactggaggtgacctcaatctcattgggcagtttggtgttggtttctactcagtatacttggttgctgactatgttgaagtggtcagcaagcacaatgatgacaaacagtatgtgtgggagtccaaagctgatggatcattcgctatttccgaggatacatggaatgaacccctgggccgtggaactgagatcaaactgcatctccgcgatgaggctaaggagtacttggaagaaggcaagctgaaggacttggtgaagaagtactctgagttcatcaacttccccatttacttgtgggcaaccaaggaggtcgatgttgaagtgccagctgatgaggaatcaagtgaagaagaggaatcaaccacagagacgacagaggaagaagagacagaagatgatgaagagaagaagccaaagacaaagactgtgaaggagacgactactgaatgggagcttctgaatgatatgaaggccgtgtggcttcgtaaccccaaggaggttactgaagaagagtatgcaaagttttaccactcactagccaaggacttcggtgatgacaagcctatgacttggagccacttcagtgctgagggagatgtcgagttcaaagctttgctctttgttcctccgaaggctccacatgatctgtacgagagctactacaacgctaacaagtcaaacctcaagttgtatgttagaagggttttcatctctgatgaattcgatgatcttcttccgaagtacctcagttttttgatgggtattgttgactcagacacattgcccctcaatgtatcccgagaaatgcttcaacaacatagcagtctgaagaccatcaagaagaaactgatccgcaaggctcttgacatgattaggaaacttgctgcaggaggatcctgatgagtacagcaacaaagaaaagacagatgatgaaaagagtgcaatggaggagaagaagggccagtacgccaagttctggaatgagtttggcaaatcagtcaagctgggaatcattgaagatgcaacaaacaggaaccgtcttgcgaagcttctgagatttgagagttccaagtcagatggcaaacttgtctcccttgatgagtatatttcaaggatgaagtcagggcagaaggacatcttctaccttacaggaagcagcaaggagcagctagagaaatctccattccttgagcagctgaccaagaaaaactatgaggttatctacttcaccgaccccgtggatgagtacctgatgcaatacctcatggactacgaggacaagaagttccagaacgtgtccaaggagggcctgaagctcggcaaggactcaaagctcaaggacctcaaggagtcgttcaaggagctgaccgactggtggaagaaggccctggacacggagggcatcgactcggtgaagatcagcaaccggctgcacaacaccccctgtgtggtggtcacctccaagtacggatggagctccaacatggagaagatcatgcaggcgcagaccctgtcggacgcgagcaagcaggcgtacatgcgtggcaagagggtcctggagatcaaccccaggcaccccatcatcaaggagctccgtgacaaggtcgcccaggacagcgatagcgagggtctgaagcagacggcgaggctggtgtaccagacggcgctgatggagagcgggttcaacctgccggaccccaaggactttgcctcgagcatctaccggtcggtgcagaagagcttggacctgagccccgacgcggccgtggaggaggaagaggaggtggaggagcccgaggtggaagagaaggagtcagccaaggcggaggagccggagcacgagcagtacgacaaggacgagctgtagttgctgccgtcttgtcatcgcccatttagctctcagtagaagtgttggactggaaatgtgatggtttcgagggacgtccattttttaccgcgcgaaaacgcaaatcattgtgatacgaggtttttgtcagtgtaatgtactactgtacctagtttttttaaaagttaaatgataccctagctagttcaaattagcatgcctggtttctgtccgaagtgcccttttgtacacttgctgttttggtttcctcacagtggtgtacgtagttacagaaatgaataatgggggttacgaaggtaaaaaaaaaaaaaaacctcggccgcgacccacgttaatcantagtgaattc

SEQ ID NO: 33402 - DNA, 2812 bp, Triticum aestivum
  Clone ID: PAT_TA_33402
cgcgtccggcgacgacgagctcacccagttttggttggcagagtgaagcggcggccggcgacgatgcgcaagtgggcgctctcctgcgcgctcctcctcgtcctcctcctcaccaccctccccgatccagctaagaagctccaagtcaatgccgaggagagcagcgacgaggtgggtgactttcccaaggtagaggagaagcttggggccgtcccccatggcttgtccaccgactccgaggttgtccagagggagtccgagtcgatctcgaggaagaccctcaggaactcggctgagaagttcgagttccaggcagaggtgtccaggctcatggacatcatcatcaactcactctacagcaacaaggacatcttcctgagggagctcatttccaatgcatctgatgctttggataagattaggttccttaccctcactgataaggaggctttgggcgagggtgacactgctaagcttgaaatccagattaagttggataaggagaacaagattctctctattcgggataggggtgttggtatgaccaaggaagatttgattaagaaccttggaaccattgccaagtctggaacttcagctttcgtggaaaagatgcagactggaggtgacctcaatctcattgggcagtttggtgttggtttctactcagtatacttggttgctgactatgttgaagtggtcagcaagcacaatgatgacaaacaatatgtgtgggagtccaaggctgatggatcattcgctatttcggaggatacatggaacgaacccctgggccgtggaactgagatcaaactgcatctccgcgatgaggctaaggagtacttggaagaaggcaagctgaaggacttggtaaagaagtactctgagttcatcaacttccccatctacttgtgggcaaccaaggaggttgatgttgaagtgccagctgatgaggaggaatcaagtgaagaagaggaatcaaccacagagaggacagaggaagaagagacagaagatgatgaagagaagaagccaaagacaaagactgtcaaggaaactactactgaatgggagcttctgaatgatatgaaggccgtgtggcttcgcagccccaaggaggttactgaagaagagtatgcaaagttttaccactcactagctaaggactttggtgatgacaagcctatgacttggagccacttcagtgctgagggagatgtcgagttcaaagctttgctctttgttcccccgaaggctccacatgatctgtacgagagctactacaatgctaacaagtcaaacctcaagttatatgttagaagggttttcatctctgatgaattcgatgatcttcttccaaagtacctcagctttttgatgggtattgttgactcagacaccttgcccctcaatgtatcccgagaaatgcttcaacaacatagcagtctgaagaccatcaagaagaaactgatccgcaaggctcttgacatgattaggaaacttgctgaggaggatcctgatgagtacagcaacaaagaaaagacagatgatgaaaagagtgcaatggaggagaagaagggccagtatgccaagttctggaatgagtttggcaaatcagtcaagctgggaatcattgaagatgcaacaaacaggaaccgtcttgcgaagcttctgagatttgagagttccaagtcagatggcaagcttgtgtcccttgatgagtatatttcaaggatgaagtcagggcagaaggacatcttctaccttacaggcaagcagcaaggagcagctagagaaatctccattcctcgagcagctaaccaagaaaaactacgaggttatctacttcaccgaccccgtggacgagtacctggatgcaatacctcatggactacgaggacaagaagttccagaacgtgtccaaggagggcctgaagctggggcaaggactcgaagctcaaggacctcaaggagtcgttcaaggagctgacggactggtggaagaaggccctggacacggagggcatcgactcggtgaagatcagcaaccggctgcacaacaccccctgcgtggtggtcacctccaagtacgggtggagctccaacatggagaagatcatgcaggcgcagaccctgtcggacgcgagcaagcaggcgtacatgcgcggcaagcgggtcctggagatcaaccccaggcaccccatcatcaaggagctccgcgacaaggtcgcccaggacagtgacagcgagggcctgaagcagacggcgaggctggtgtaccagacggcgctgatggagagcgggttcaacctgccggatcccaaggactttgcgtcgagcatctaccggtcggtgcagaagagcttggacctgagccccgatgcggccgtggaggaggaagaggaggtggaggagcccgaggtggatgagaaggagtcgggcaaggcggaggagccggagcacgagcagtacgacaaggacgagctgtagttgctgcggtcttctcatcgcccatttagctctcagtagaactgttggactggaaatgtgatggtttcgagggacgtccatttttaccgcgcgaaaacgcaaatcatggtgatacgaggtttttgtcagtgtaacgtactgtacctagttttgtttttaaagttaaatgataccctagctaattcaaattagcatgcctggtctcagtccgaagcgcccttttgtatacttgctgttttggtttcctgccagtggtgtacgtagttacaaaaatgaataatggggttacgaaggtaaaaaaaaaaaaaaaaaaaaactcgag

SEQ ID NO: 33403 - DNA, 1218 bp, Triticum aestivum
  unsure (1)..(1218): unsure at all n locations
  Clone ID: PAT_TA_33403
ctcgaaattaccctcctaaagggaacaaaagctggagctccaccgcggtggcggccgctctagaactagtggatcccccgggctgcaggaattcggcaccagcctcctcctcctcctcgcctccccgcggccacacctcgactcgctccctcgagtagatcatctgttccatccttttgaggcgagatggcggctaccttcaatgttaacgctgaggcaggccttaaaaagcttgatggctaccttctgtctcgcagttacatctctggataccaagcttccaaggatgacttggctgtgtattctgaattctcagttgctccaccatcaacttgcaccaatgttgcaaggtggtacaatcacattgatgcactcctgaagctgagtggagttactgcccctggtcaaggtgtgaaggttctgtcatcagttgtccctgagacctcaactactgatgtggctgaggctcctgcagctgatgatgacgatgacagtgatgttgacctttttggagaggaaaccgaagaggagaagaaggcagctgaagagcgtgctgccaaagctaaggcttctaccaagaagaaagaatctggcaagtcatcagttttgcttgatgttaagccatgggacgatgagactgacatggtcaagctggaggaagctgtccgaagcatcaagatggagggccttctgtggggtgcttccaagctcatgccagttggatatggcatcaagaagctccagattatgatgaccatcattgatgacctcgtctctgtcgacactcttattgaagaccatctctgcgttgaaccagccaacgagtacatccagagctgtgacattgttgccttcaacaaaatctaaatcttcctgaggcaggtgatggcggtgggtggacaatgcagcagcacaatatatctacagttttccgttgccgtgatggtgtcgtagctaaagcaagcataacatatctgccctgtgaggtttttggaccttaggtcgagttgagtcgtagtgttattactgagtgttatttgcttcgtatgaaatgagacaatgtggttggattcctgttgctattctctttctctgccgtcttcatcgcagctacctacttgtgtgtgctcgcctactttctcccttaacagatgcatggacgctggagctgttttgtcgtttgaattacaagcatggcgncctgtgccgcgttctcca

SEQ ID NO: 33404 - DNA, 1111 bp, Triticum aestivum
  Clone ID: PAT_TA_33404
aattcggcacgaggtcctcctcctcctcctcgcctccccgcggccacacctcgactcgctccctcgagtagatcatctgttccatccttttgaggctgagatggcggctaccttcaatgttaatgctgaggcaggccttaaaaagcttgatggctaccttctgtctcgcagttacatctctggataccaagcttccaaggatgacttggctgtgtattcagagttctcagttgctccaccatcaacttgcaccaatgttgcaaggtggtacaatcacattgatgcactcctgaagctgagtggagttactgcccctggtcaaggtgtgaaggttctgtcatcagttgtccctgaaacctcaactactgatgttgctgaggctcctgcagctgatgatgacgatgacagcgatgttgacctttttggagaggaaaccgaggaggagaaaaaggcagctgaagagcgcgctgccaaagcaaaggcttctaccaagaagaaagaatctggcaagtcatcagttttgcttgatgttaagccatgggacgatgagaccgacatggtcaagctggaggaagctgtccgaagcatcaagatggagggccttctgtggggtgcttccaagctcatgcccgttggatatggcatcaagaagctccagattatgatgaccatcattgatgacctcgtctctgtcgacactcttattgaagaccatctctgcgttgaaccagccaacgagtacatccagagctgtgacattgttgccttcaacaaaatctaaatcttcctgaggcaggtgatggcggtgggcgcacaatatatctacagttttctgttgccgtgatggtgtcgtagctaaagcaagcataacatatctgccctgtgaggtttttggaccttagatcgagttgattcgtagtattactactgagtgttatttgcttcgtatgaaatgagacaatgtggttggattcctgttgctattctcttctgtctgccgtcttcatcggagctacttgtgtgtactcgcctacttttctcccttagatgcctggacgccggagctgttttttggtttgaattacaagcatgcccctgtgccgtgttcccc

SEQ ID NO: 33405 - DNA, 2905 bp, Triticum aestivum
  Clone ID: PAT_TA_33405
aaatcgatttcggcagtcacaaactgcaaatcatacttgcgcctttttgaagatataatctctccgtccgcaaacatatcaattttctccgggagtggcagctagccacgctcaccacgtggaaactccaaccccttcataaccccattattcatttctgcaactaacaccaaaacagcaagtatacaaaagggacttttaattctaaatgatgaaacccaggcatgctaatttgagctagctagggtatcattgatgaaaagactaggtacagtagtacattacacggacaaaaaccccgtatcatgatgatgattaagcgttttcgccgcggtaaaaatgggacgtccctcgaaaccatcacatttccagtccaacacacctctagtgagagctaagcaggcgatgagaatacaagacggcggcctacagctcgtccttgtcgtactgctcatgctccggctcctcccgccttgcccgactcctcctccacctcgggctcctccacctcctcttcctcctccacggccgcgtccggggctcaggtccaggctcttttgcaccgaccggtagatgctggaggcgaagtccttggggtcaggcaggttgaacccgctctccatccagcgccgtctggtacaccagcctcgccgtctgcttcaggccctcgccatcgctgtcctgggcgaccttgtcgcggagctccttgatgatggggtgcctggggttgatctccaggaccctcttgccgcgcatgtaggcctgcttgctcgcgtccgacagggtctgcgcctgcatgatcttctccatgttggagctccacccgtacttgggaggtgaccaccacacagggggtgttgtgcagccggttgctgatcttcaccgagtcgatgccctccgtgtccagggccttcttccaccagtcagtcagctccttgaacgactccttgaggtccttgagcttcgagtccttgcccagcttcaggccctccttggacacgttctggaacttcttgtcctcgtagtccatgaggtattgcatcaggtactcgtccacagggtcggtgaagtagataacctcgtagtttttcttggttagctgctcgaggaatggagatttctctagctgctccttgctgcttcctgtaaggtagaagatgtccttctgccctgacttcatccttgaaatatactcatcaagggagacaagtttgccatctgacttggaactctcaaatctcagaagcttcgcaagacggttcctgtttgttgcatcttcaatgattccaagcttgactgatttgccaaactcgttccagaacttggcatactggcccttcttctcctccattgcactcttctcatcatctgtcttttctttgttgctgtactcatcaggatcctcctcagcaagtttcctgatcatgtcaagagccttgcggatcagtttcttcttgatggtcttcagactgctatgttgttgaagcatttctcgggatacattgaggggcaaggtgtctgagtcaacaatacccatcaaaaagctgaggtacttcggaagaagatcatcgaattcatcagagatgaaaacccttctaacatacaacttgaggtttgacttgttagcattgtagtagctctcgtacagatcatgtggagccttcgggggaacaaagagcaaagctttgaactcaacatctccctcagcactgaagtggctccaagtcataggcttgtcatcaccaaagtccttggctagtgagtggtaaaactttgcatactcttcttcagtaacctccttggggttacgaagccacacggccttcatatcattcagaagctcccattcagtagtcgtctccttcacagtctttgtctttggcttcttctcttcatcatcttctgtctcttcttcctctgttgtctctgtggttgattcctcttcttcacttgattcctcatcagctggcacttcgacatcgacctccttggttgcccacaagtaaatggggaagttgatgaactcagagtacttcttcaccaagtcctgcagcttgccttcttccaagtactccttagcctcatcacggagatgcagtttgatctcagttccacggcccaggggttcattccatgtatcctcagaaatagcgaatgatccatcagttttggactcccacacatactgtttgtcatcattgtgcttgctgaccacctcaacatagtcagcaaccaagtatactgagtagaaaccaacaccaaactgcccaatgagattgaggtcacctccagtctgcatcttttccacgaaagctgaagttccagacttggcaatggttccaaggttcttaatcagatcttccttggtcataccaacacccctatcccgaatagagagaatcttgttctccttatccaacttaatctggatttcaagcttagcagtgtcaccctcgcccaaagcctccttatcggtgagggtaaggaacctaatcttatccaaagcatcagatgcattggaaatgagctccctcaggaagatgtccttgttgccgtagagtgagttgatgatgatgtccatgagcctggacacctcggcctggaactcaaacttctcggccgagttcctgagggtcttcctcgagatcgactcggactccctctggacaacctcggagtcggtggacaagccatgggggacggccccaagcttctcctctaccttgggaaagtcgcccacctcgtcgctgctctcctcggcattgacttggagcttcttagctggatcggggagggtggtgaggaggaggacgaggaggagcgcgcaggagagcgcccacttgcgcatcgtcgccggccgccgcttcactctgccaaccaaaactgggtgagctcgtcgcggacg

SEQ ID NO: 33406 - DNA, 681 bp, Triticum aestivum
  Clone ID: PAT_TA_33406
aggggaactatcgagtccttataaaaaaagaaggtgttgaagatcatggtccaaggccttgttaagtactccaattggaggaatgaaaagtattggtgccccttttgcagcaagcccaagcttaggtttgggtttttggagcatttaatggaacattgccgggttacatcgttttccagtcatgactacaagatctttggtcagcattttgccctcctaaaggtcttgagaaaccctgccctctagttgtacagcataatgatcttcggaagttggaccccgtacgacgggtcaataaatttgatgatgttttacttttggaaagctgtatttgggtcagaactgcttggaaactagctatattaatgtaatgtaatgtaatgtattgtgtgtctgaactgcatctgttgtgaactgcctgctacctgtggtggtaacctagaatgctatctatatatgtgtggccttaactttattggtggtgaatgcttccttcatgtttagttgttgtttcatggtgcaatgaacacaaatggcgcttcggtgttgcttcagacatgctgcaacacttgtctatgatgtgggcaagtggaacatgctgtgcccatgtgccaattacaccaaatattgaatgtggcaatgttccaaaatggctgtcatgaattatagtacatggggttt

SEQ ID NO: 33407 - DNA, 584 bp, Triticum aestivum
  unsure (1)..(584): unsure at all n locations
  Clone ID: PAT_TA_33407
ggctgagcaagnatgagatcgagaagaggtgcaggaggctgagaagtacaagtcagaggacgaggagcacaagaagaaggtggagtcaaagaatgcccttgagaactatgggcagaaatcacagatttgacctgaggcataaatcaaatcacaaactgacctgttcaggaaaaaatttcactctgctaaccctttggtgtggcgcccgacatttgggcgccgcaccctactatgcagcgccttccccttaggcgacgcacatcctgccagcgtggcagcccttgtccagttgcggcctcacacgcacctgtgcagcgcctaagagctatgcgccacactttgacgtgcagcgcctaggccttgggcgctgcacagtgacttaagcgcggctgccccagcccgaccaggcagttcttcatctctctgcatccctctcagatctgaagatttgatccgtggattcgatccccaatccatcctactaggtaaactcttcccttctctttcttttgctccgtaaatttgttgccattctagagatttgtccatgatttgatggaacccttgatttgtttggtttaaaa

SEQ ID NO: 33408 - DNA, 1121 bp, Triticum aestivum
  Clone ID: PAT_TA_33408
ctccacggcgacgatctcagggagatggttcaagaatgctatgaggtggctgctgaatatgaaactaagcatgacctggaaaagcttgatgaactcggggagtcggtcgcgggcttggatcctggcgattctattgtgatcgccaaagctttttcacacatgcttaacttggccaatttggctgaggaagtgcagatcgcatacaggaggagggtcaagctcaagaagggagactttgctgatgaaaattcagcaatcacagaatctgacatcgaggaaactcttaagaggcttgtttttgacatgaagaagtcccctgctgaggtctttgatgccctcaagaatcagactgttgatctggttttgactgcacatccaacacaatctgtaaggaggtcactgcttcagaagcattcgaggatccggaactgtttggttcagttatactcgaaggatatcactccagatgacaagcaggaacttgacgaggctctccagagagagatccaagctgcctttagaactgatgagatccgaaggactcagcccactccccaagatgagatgcgtgctggtatgagctactttcatgagacaatatggaagggtgttccaaagtttttgcgccgtgttgatacggcattgaagaacattgggatcaatgagcgcgttccttataatgctcctcttatccaattctcttcttggatgggtggagatcgtgatggaaatccaagagtgacaccagaagttacaagggacgtctgtttgcttgccagaatgatggcagctaatttgtattgtgcacagattgaggatctcatgtttgagttgtctatgtggcgatgcaatgatgagctacgctcgcgagctgatgagctgcaccgctcttctaagaaggatgctaagcattacatagagttctggaagaaggttcctccgaatgagccatatcgggtaatactgggtgatgttagggataatctttacaacacgcgtgagcgatcacgtgagttgttatccagtggacattccgacatacctgaggaagctactctgacaaatcttgagcagctgttggagcccttggagctctgttacaggtcactgtgtgcttgtgg

SEQ ID NO: 33409 - DNA, 899 bp, Triticum aestivum
  unsure (1)..(899): unsure at all n locations
  Clone ID: PAT_TA_33409
aggggaattcaaattgtccgcaatcccttaaacccaacacggnaaaaacgcccccgcgtcgcctctctctggcggcacgggcggctcccatccctaccgtagctactagccccgccagatctgccggccacctcgccgccgccggaggaggtcgccaggcgaagcctgcgtggcggacggcggctgcggggcactgcctgctcgtgccgcggtggttggaggcgaacccgtgctgcggtggtgttggtccttggggcggcgaggtggcgttgctcggcggtggttccggctaggcacggcgacggctgggcgtgcccccggtgcgggcatcgcggatctgggcctcgcgctccagatcaagccctgggggagcggatcggaccggcgacgccaaggctgctccagccgccgactggtggtgtccggtttctcctttcgcctcctcccctcgcgtctatgattgctgacctccgtctgccgtcaatgacgacggggctgcctggcagttgtcgtcccttctcccaccagatccaaaagtgatgctcgtcggacggctgcggtaggcaggtctgcagcgtgctattgcggtggtctgtatgctggaggtcggtggtgttggtgatgctagtggaagcttggacgcaggtggaggtcatgtgtggcattccgggcgaaagccatgttccatctctggagccgacgatggtgacgccttagggcgccgctcacctccacggcttactcaggtgatctaattaatgggcaagccccactcaaagcaatgcagtcccggcatcgttcgatggggctgcgatactcctcatggtctgcgagtctccgggggaaacctcagatccatccggattcgtcgatggcggcgcttcatgcgtcgcttccct

SEQ ID NO: 33410 - DNA, 832 bp, Triticum aestivum
  Clone ID: PAT_TA_33410
ggccaggcggcgctacccgggctacgacgaccccatgcagctcgccgcccagaccgcattcagcgtcagcgaggtggaggcgctcttcgagctcttcaagaccatcagcggctccgtcatcgacgacggcttcatcaacaaggaagagttccagcttgcattgttcaagagcaagatggacaatatttttgctaaccggatatttgacctcttcgatgtcaagaaaaggggggtcattgactttgctgacttcgttcaagctctaaacgtatttcaccctagcattccaatggaagagaaaattgatttttccttcaagctatatgatatggacaacacagggtttatcgaacgaaaagaggtaaagcagatgcttattgcccttctgagtgaatcaggaatgaggttatcagatgaaaccattgagtcaatcattgacaagacattttcagatgctgatgtgaatcaggacgggaaaatagatagagcggagtgggagaactttgtctcacgaaatccctccttgatgaagataatgactctgccatacctaaaggacataacgaccacattccctagctttgttttcaactcgaaggtcgatgacatcgtgacatgagtggcatggtttctgtgacatttcacaaggcctgcgcgcaagaggggaaggacatgtacatctaatagtatatcaaggagagtcattttttctgttagagcaaaagcagtaatgcaaggaggttaagagatgaggggagggttgtagtctgagaaattggcaagttaccgcgatatgaactgcatccatatgctgctgctgttgtttgttgtg

SEQ ID NO: 33411 - DNA, 1034 bp, Triticum aestivum
  Clone ID: PAT_TA_33411
cgagtcacttcgatcccaaatccacagcagagaccggcggaggaccccagcgccggctggccggccgcatcaccggcggagagaagatctcccgctgcgctcgtcctggaggaggagccaccgcggaggtgggtgccgggcgcaacgccgctgtaggcgccatccgcgagcgcgagcgctgctgctgcggggccggaacggctgctcgacggcggactctccagcgggaccgcgagggccccgaggcggcggcccgcgcctgtgcgccgcaaagccggaggagtggtgggtgtctgggacggcgcggcagcttcggcatcgactgccgcggcgcaacaggagccgctcacgccggagccatagatgaagacggaggccccggtcggcacggactcgaaggcgagcgcgtgacaggcggcgacctcgacgaccgcagaggtcggagatggcagcggcgcggcctcgtgctcgtcgtgtcgtcgtcaaggacgacgatgtcgttccccggcgccgcgctcaaccgtcgcgtgctccgcgttgggagccgccaccggcccggacttcagcaggccactgagccatggtcgcgcgcagaagggcgccgctgagccgcgtgctagatggagcgctcgcactgcttgcaggctgtaagtcgtccgtgccgtggatgcgaacagaggctgctgcctccggtcttggacatgagaccgcatcatcgacaacatcattcaccgtttgagtacctgtgaagaaatccacaggaagaggtgtcgagagagtcgccgcgccggggctgtggtcgcctcgggctggtgcaggaggtcgaggctgcggggtcactcggcggctgaagacatgcgccgccgcgccgctctgcagggtgagccccccccccatcatacggcggagggcttgtcctgccgccagttgccgaggacgacgctccgtcggagagcgtgctgataacgtgtgaaggatcgattgtaaacgaacaaaagagtcgaacaaatgaatcgataagattcttttcaaaa

SEQ ID NO: 33412 - DNA, 478 bp, Triticum aestivum
  unsure (1)..(478): unsure at all n locations
  Clone ID: PAT_TA_33412
ggcagcggcggaacgggcgatggccctggcttttgatggtggtgtggcggcaacggcggccggcaacagctaccgatgggcaccggcggcggagcgtgtggtgggtgttccgcgcacacccaatggggacgccacacgcactacactacgcctgggactgcgccgccgccgcggtgtagccacccagctggagttgtcttctgatgatggcggagtggctgagcgacaacgacggaccagtgccattggcgattgtgggagaagcagacgagataaggtacagggagggatgggaaaatgcgacacaggactcgccggtcgtgagggtttttatagcaggtcggtaagcattgggattttgggggatttcactgagtcagggagaagcttgcgcgggaacctgcgaggttgcgcgggaatgagctcancgacgattcatttggcacaccgtttggcaaaatgaacgcccccgcgcgct

SEQ ID NO: 33413 - DNA, 1126 bp, Triticum aestivum
  Clone ID: PAT_TA_33413
aagaaaacggtggtttaggaatcaaaaacatcgagtgttttagccgggcgttgaggctgagataggagtgtttaaatggcaagatgaggagagaccatggaaaggatctgccacaccatgtgacgacacggataggcagctcttttcaagctgcacaacgatctgtttgggtgacggaagcattgctagcttctggatgaacaaatggctcaacgggaattcgccaagtgtgctggcacctgatgtgtttaaacttgctggtttcaaaagagttacggttaaagaggggctacgcaacggcaaatggatgcaagggctgcagcgattggacacggagaaacagctgaaccagtttgtgcacctttggcatgaggtgcaaatgataaacctatcagtcaagagggacactgccatttggaacctcacaacgtcggctgcctacagcgcatgttcagcctatgatgcacaattttgcgcaagaattgaaaagcctggactagcacgagtgtggaagagcaagatggaggggaaggtcaaattctacatctggttgttgttacagaacagaaattggacggccgactgccttcaggctagaggctggccaaacaatgaccaatgcaagctctgcgaccaagaagctgaaactgccagccacatagcactgaaatgctcatatgcaagagaggtttacttccattttcggcagcaaaacaatgcggtgtggactactactgatatggcacaatcagtctcagaatggtgggatcagtgttgagcattgtcagggaaacgagagaaaaaaccaaggaggagatcactctgggagcatacatcgtatggaacctatggaaagagaggaaccggagagtttttgaacacaaggaactgacgacgttggcgctgacaaggcttatcagagatgacatccggtgtttcaatgaggccacgagaggaactgccgttcctggcgagtagtcagcgggctcccgtagctctttttttgtgtttttcggctatgcgcctgtgtagatgacctgtttctaagtcctggggcttcggcccagcgttctatggcttgtacctctttttctcctataatgcaaaggcgtcaaaaacatcaaaa

SEQ ID NO: 33414 - DNA, 544 bp, Triticum aestivum
  Clone ID: PAT_TA_33414
cccgccaactcttaaactcgccccgcggttccttccgttcctcgcttcctcgctaatggcagcagcgtcaggaaccgccgcgacgttctccatcaggacgccggcgccggggctccggcggccctgcgcccgcgccgccgcggccggcgggggcgccaagtggtgggcgccgctgctggggtggtcgggccagcccgactacatcgactcccagccggccgctgaaccggcgccgaaggaggagcgggggaaaaggcggttcggggtgctgacggaggagaaggcgcggcagctgcggctgaggatgatggagacggagagcttccacgacgtcatgtaccactccgccatcgcctcccgcctcgcctccgccccgcccgacaccgctcgccgcaccaagccgtagcctagccacgcgcgcgcgctcccttgccgtacgtggccgccgttcgaggagcagctcagctcatcggccggcgggaagccatgcatgcgcagctgtgtatttgtatataaatagcagaagcttttgttcgttcgttct

SEQ ID NO: 33415 - DNA, 622 bp, Triticum aestivum
  unsure (1)..(622): unsure at all n locations
  Clone ID: PAT_TA_33415
tagagagccagcaaagtgcacagcaaagggttatgggatagagctgcatttgcacctgcacctagagaggaagaaaggtcgagggcttggaacttggccatgcatgcgattgcgatgcatgcaacgttctccttgaccctctcgctcttcctgtaggtgcagtggcatatgcaactctatcacaggcatcctaggtacacatcactcgtcacacattctccccatcttcttgcttttggctacatcagaagctcaaggtgtctttatgcaagtagctcgtccagcttcagcttggatcgataataggtgaagaagaatggcgtgatatggctgcatttgcacctgcacctgcgacgaagaacaaaggaaacgctttttgtcctcctcaagttgctaggtgcagtggcacatgcagccgtatcacatgaattttctgaacacaagttgaagttacttcagttgttttgccttcttttttacccgtcctgctggactcgtaactatgtaaatgatgtattcttggcaactgccgattttcttgaatatcagagcctcataggcaactaaaaagcntcatgacncangttttccaannaaanttaaggtccattgatgnattttc

SEQ ID NO: 33416 - DNA, 1981 bp, Triticum aestivum
  Clone ID: PAT_TA_33416
cgccggaagactcgttcacaatgggatgctccaccaatgcccttacatgctgtgagcctacttatggaggccatatatctcaaagcaagagcacttcatgtccgcggaacgttcaaagatgctgcacaagagtgcagaatgatattggatatcgtggaagcagcagtacctgaaggcttaccagcaggctttggaaaaggttgtaaattgaacgaaataatatgcaaggccgtagagtttctccctgagttatggaaattagcagggttttcgcttgaagccatttctgaatataggaggtctcttctcaataactggaatcttgatggagagaccatagctaaaatacaaaaggaatttgctgtttttcttctgtacagtggctgtgaagcccgccctccaaatctccattctcagttggatggttcatttgtaccacgcaacaatatggaagaggctacactccttttaatgattctattgagaaagtttaatctgaggagggttgagcgggatcccactgtgatgcatcaccttacttttgcgctgtccatatcagggcagctaaaaccactggctgtacaatttgaagaactgttacctggtctgctagacaaaagagaatggtcatacaatgttgcattgtgttacctagcagaaaaagatgattctactgccctgaatctactcaaaaggatgctgaagtttggacaggattctgacaacctcaaagaacttctcctagcttcaaaagtttgcgttgagaagggtgctcatgctgaaggcgctgcctatgcacggagggctataactaatatacaaggaggatgcaaacaattggcgggtgttgcagatcttttgcttggtgtttccctttctaatcagctagatatgctatatctgataccgagcgagcttcttggcagtgtgaagcactcgaagtacttggcagtgccgaaaaaaacatgcatgggcaagattgtaggataatgtacaatctgagccttgaaaatgctgagcaaaggaagttagacgcagcagtattttatgcaaaaaaactggtgaagttagaggctggatcagagttgaggagttggcttcttttagctcgaatactgagtgcacaaaaactgtttactgatgctgaaaccgttgttgatgctgctcttgatcagactgggaaatggaatcaaggagatttgttgcgaaccaaagccagaattcaggctgcacaggggcaattgagggatgcggttgggacatatacccaacttcttgctttaattcaacttagaacaaaaagttttggagctgggatctcactggcaaagggtggcgaagatgataaaagcctggaaacagagacctggtatgatctagctctcttgtacctaggcatgtcacagtggagggatgcagaagtttgtgtatcaaagataagagcaactaattgttattctgccttcgcttggcatgctacaggaaaactatgcgaagcgaaagatcttccaaaagaagctttgggggcttattttcgagcattagactttgatagtaaacatgttccaagtttgatatcgtctgctactattctacgacaacttggggacaggccattgccttctgtacggtgcttcctgactgatgcactgcagcttgatagaacaaatcatatggcatggtttaatcttggtctactctacaaagaggaaggtggcaggtcagcagctgaggctgctgaatgtttccaagctgctgcacttcttgaggaaacagcacctgtagaacctttcagatgacatatttgtacaggggctatagaaattgtaagctagtatattctttcaaatttgtttcacttacaccggtgaagtagattacaaagttccagaaatgacctacatgattgagaagtaatagcatcgggcaatgtttctttttctttaacagttcaatatatagttgaaatttgttttcaaaa

SEQ ID NO: 33417 - DNA, 2147 bp, Triticum aestivum
  unsure (1)..(2147): unsure at all n locations
  Clone ID: PAT_TA_33417
gnaggagaaggagtaagnaggggagtggaagtgttaccaatgtggtacctactgctgggaatgggacccctgtcaggcctcagtcttctaattcagccaagaagaaggctacaaaatcacagcttgaatctgatgcttctgttggccccaatggcaaggcatcccccgaggaagccgagagtgaggtcagcaagcccggaagccgtgttggccgtcgccggaaagctagtgccaaatcacagaatggaacaagaagatgctgggctcgataacccagaccttggtccattccttcttaagcatgcaaagagacttgattgcctctgataatccgcggcgagcgctgaaatatgctctccgtgccaccaaatcatttgagaaatgtgcaggtggaaagccaagcttgaacttggtcatgagtttgcatgttgtggctgcaattcactgcaacatgggaaagtatgaagaagctgtacctgtcctacaacgatccctcgagattcctgtgaccgaggaaggtcaggagcacgctcttgccaagttttctggctgcatgcaattgggggacacctatgggatgctaggtcagattgccctctcactgcaatggtatgccaaagggcttgaaatccagaagcagacattgggggagcaggatccaagggttggagagacttgccggtacttggctgaggctcatgtgcaggcactacaattagatgaagcacaaaaattgtgccagatggctcttgacattcacagggataatggccagccagcatcacttgaagaaacggctgataggaggctaatgggtcttatttgtgacacaaagggtgaccatgaagctgcgttaaaacatctagtgatggcaagcatggccatggtcgccaatggccaggagactgaggtggcctcagtggattgcagcattggtgacatttatctctcattgggtcgatatgacgaggctgtatgtgcttaccagaaagctcttacagtattcaagactagcaaaggggagaatcatgccaccgtggcttctgtttttctgcggcttgctgatctatacaacaaaacagggaagctaagggaatcaaaatcatactgtgagaatgctctcaaaatttatcagaaacctattccaggcacgtctcttgaagaaattgccactggtttaactgatgtttcagccatatatgagaccatgaatgagcatgaccaagcactgaagttactccagaaggccttgaagatgtacaataattctgctggccaacagagcacgattgctggaattgaagctcagattggtgtcttgcactacatctctgggaattatggcgatgcatatgactccttcaagagtgcgattacaaagctccgcacatgtggtgagaagaagtccgccttcttcggtattgccctgaaccagatggggctggcgtgtgttcaaagatactccataaatgaagctgcagaactcttcgaggaagctagaaccgttctggagcaagaatacgggccatatcatgcagatactctaggagtatacagcaatcttgctggaacttatgatgcaatgggaagactggatgaggccattgagatcttggaatacgttgttgaaatgcgcgaagagaagctaggtacggcgaacccagacgtcgacgacgagaagcggaggcttgccgagttgctgaaggaggctggccgggggagaagcaggaaggcaaaatccctggaaaatcttctagagaccaacccatacaccatcgggaagaggactacagttgcagcgtgagtgaactacagcttttgaaagagaaaaaggaacactatgacgctaagaatttgtgtatcaattggtttattcaaatttggtgagaggggtacatgggaatagtagtagcgttttgagtatcgagatacaaaaatggtctgattgattgttgtaaagttgcaaaggctattttcacttgttattacttgctcggtgtctagagcaattaactgtgctcgttgaacaggtgtgttttgcctagtcctactagttacatacactacaacaaataatgaacagttataacccttctgtttagatgacaaaaaaaaccaaaaaaaactcgagacctcgtgccgaattc

SEQ ID NO: 33418 - DNA, 447 bp, Triticum aestivum
  unsure (1)..(447): unsure at all n locations
  Clone ID: PAT_TA_33418
ggaagaaaaccgagcgatcacaccatgccgaaagggcagcaaagtcttgttacttgggccactccaaggttgagcgaagataaagtaaagcaatgtgttgatccaaagctcaacagtgactaccctccaaaagccgtcgccaagctagcagcagtggcagcgctgtgcgtgcagtacgaatccgacttcagaccgaacatgacgatcgttgtgaaggcgattcagccccttctcaaccaaaaaccggctggaccagccgccgaagcaccgaaaccctgatcgatcagcgctaggcggcacaaagaagcttgaatgaactcttgcatggttccatgtgttatatctatagatcatctacttgatttgtttaggtcatgggctgaccacctgtggcggtgctaggttcaaaaccttgtcatgtcaaaattttctgaacgaanatcgtgt

SEQ ID NO: 33419 - DNA, 757 bp, Triticum aestivum
  Clone ID: PAT_TA_33419
catccaaccactaattggttcttattaatatggctatcgaatttggccacgcacacacagtgtggatgcggcttatccctgtctctgttccgtacagcagggtggaagggaaccactcattttcatctttatcctcctaagcagcatggatcacacaatcctaaaaactctcatactcacacaccgacacacatggtacatggatcacgcaagcagaaaaccgagaagacgacttacagtttctttttacgggtaactggatctcacagtaatggctgcaactatcacgaatctgctctgggcgtctgcacttggttggtcggcctagagcccatgaggaagtcacggtaccacttcgccgacatctttggagtcctcttctgcgtttcataatccacatgatacagcccgaactttaccgtgaaaccgtaagtccactcgaagttgtcgatgatactccatacggaagtagccacgcacgtttgctcctttcctgaccgctgaagagagacatgtgagataaccctgtaggtagttcactctttcaacgtcattgatcaattcgtccatagtgttattactgtattgcgagtaaccattttcagtaacatagataggtgtgttctcgtatctctgattaacatacttgacgatccgctccatgccctctggaacatcatagtaaccatcgaatgcagtgggtttcccaattgcaacgccatctctttcacctgtagctaggactagtgcattcgcc

SEQ ID NO: 33420 - DNA, 1047 bp, Triticum aestivum
  unsure (1)..(1047): unsure at all n locations
  Clone ID: PAT_TA_33420
cgacggcaaaatacagtacaggatacagttccagaggccaaaccccgtcggcaccaacaatgcgcctccatcaccaaccaccgcggcagcagcggcgccgcggccaacaacgccgtcgtgcctgtccctgccgtcgcggagcatcagaacctgaaccggcacgagatcgagatcgaggggaagaagatcaacgacaccgacaagaggaacaacggaggagtcggagccgcgcaggtaccgacaagcaacgggcagacaacgccgccgacggccacgttcgacctgggtgtaaaaaaagccagaagacgctgtgagggagctgaacgagcagccgcaccgggagttcacgacggacgagaccgacagcgacgacatgggcgatgactacactgacgacggcgaaggacggccaggacgacggcaaaatgcagtacaggatacagttccagaggccaaaccccgtcggcaccaacaatgcgcctccaccgccaaccaccgcggcgacagcagcgccgacatcgacccccgcgagctccttcctcgccatggttcaataggcgctcagcaccatggatcatcagtatacttccagttccagacagacaataacctcgaagcatcatcaccatcaccatcaccgagtcaccgttccatgcgtcacctcctcgagtcgatcatcgccatcacatcacaccatcaccgacgacgactgttccttttcaccttgtaattcctctcgtgccattccattatttattgattcgttctgtgtaataagagcctctcttctgtcccctaaaccggccaaggaggcagagggggtggccggtagagcaagcaagtccctgcgtaacataggtgttcatcgtcgtgttaaggccaagaattgtacatcgatgtaagagtcctgatgtctgtttcttcttcttcttcttcttctttcggcggtatacaggtttgtatacaggtatacatgaattacatacatttcaagcaaaaaaaaaaaagtcgacgcggccgcggcggnngttccngtctancgccctc

SEQ ID NO: 33421 - DNA, 268 bp, Triticum aestivum
  Clone ID: PAT_TA_33421
cgcaaggagctggacgagttcgtggccggcgcattcgacgggcccttcagggaggccgtggcgatgctcagcaagcgccgcacctacctgctagagatgaacggcttctaatcctgtgacctgaccttgtgcgcgcgagatggcgatggccaccagattgctctgctctgttggcttcagctctgctcagtggcaggcaggcacactagcgaggtgttccttgttgtaacagcagcgatcatgtctagtcatacctcatttcgtcgct

SEQ ID NO: 33422 - DNA, 418 bp, Triticum aestivum
  Clone ID: PAT_TA_33422
gggtccacggaaagtcgtcgcagtgacgccggatcacagcgtcggcgtgctacatcacaacagcaagagcaccaagtcgtcgaagttgcatcgtagcaccaggtggctccctgcagcgatgtcggctcgtagcatccggcgtgatgcatcacaacagcaggagcaccaagtcatcgaagttgcatcgtaacaccaggtggctccctgcagcatcgcgcctcgacctccctattctgccgtgttgcagcaccgacgatgagcggcggcggccaccggcaaccacgccttcgtgctgtgttgcagcactgatgggttgtggctccacctatggcctccctcttcttgctccgttgcagtgttgacgttgagccgcggtcttctcgggcctcctcttcttgctgcgttgccgtgctgacgt
